United States Patent 8,067,671 (METHODS FOR GENETIC CONTROL OF PLANT PEST INFESTATION AND COMPOSITIONS THEREOF) - sequence listing, part 53

SEQ ID NO: 147835 - protein, 101 aa, Heterodera glycines
  Coding regions on vcDNA: vcDNA=SeqID_74258; Strand=+; Position=1-306
MLIVNIRPLKKLETIVHFQFKKCYQKYVKSCAGSNHRVGDEMSRETAANCQRHQQNGTDQRRPPLPQQKGSVIGLTDMRGNAMALSQNQAAYFDQLRKYWN

SEQ ID NO: 147836 - protein, 80 aa, Heterodera glycines
  Coding regions on vcDNA: vcDNA=SeqID_74259; Strand=-; Position=1-244
QNALSFPLLAISFLMLLLVAPIQIHGMFGSNGRGRQMSGGRGQMGSNGMGPGMGGGGGSIRRMQQGQGMGGNGGGGGGMF

SEQ ID NO: 147837 - protein, 691 aa, Heterodera glycines
  Coding regions on vcDNA: vcDNA=SeqID_74260; Strand=-; Position=1-2076
  Homolog annotation: Hit_ID=CAE56862.1; Match level="QueryCoverage =35%, HitCoverage=44%, E-value=9e-09, Identity=24%"; Hit description =Hypothetical protein CBG24692 [Caenorhabditis briggsae]
MDIPDNPKGVRRTTSACGHNTVYELRNEEDMSEMTISVINRKFWSGKTAVKVSDLEAAHNELVKLEDGMNRSIRALNRCMDKKTKWVSEVVSNANSNFEIVKAQIETLVDQIDDLERANDGTDANSTVREQDDSSQFEMPLKDNKGTNRGLLSTGGGTTTQTQKGVGTSSNNPAGPTRSFFGINMLSNSLSINSNLELFGEESVYAFDDWAERFKDYLSVSGKNLTEGEKVTRLKLALKDTPRTLFKELEADQIVTLTSALDALRAKLDSPQRRELAKRTLALCRQREDETVGQFLRRMTPLVESSNPSLSGDQRKEKVCEEFLDRLKPNMSFLIRLVDLTQAKNLELVKAQAEELEALFLASKGDDVTRLSHLINALKDKSENEQSNSNPNAENDRNFGRQQRNNTWGFRPFTADDVQRQRASNRGGRGNSNRGWARGRQEHMSQRNWSNNPVCYFCNRVGHLANNCNARKAQFQNRRGGNSNWNQRGNNSWNQRGTNVGWNQRQHQSRQNWREQAHEVNVMQPSTSSSSQGFMEELVKSLITMNIRGSSNHPPMDNGRGNPGSMNLIAHVDSNNEQTAVKTEIENADERPEIGLACGQNTDKVKPKTSNWESRGVGKINSLFFTTAIMTIFFSIFISPVFGTLPDHPILCQTKEEGKVWQLPGVSGCSKMAIDPSKPIVTRILEIFSRK

SEQ ID NO: 147838 - protein, 125 aa, Heterodera glycines
  Coding regions on vcDNA: vcDNA=SeqID_74261; Strand=-; Position=1 -134,459-702
MPDRIGIERVLALSNGRICSGTNASEEVYEMKETLLMKNAQHPSGSQSAMSILMSMAPTSSSSTQQYNHNQQQLQMMSYTRGEETGAGERGPLLPNDGDDEAGIGMAGAGDEEIIKLAKNLINLI

SEQ ID NO: 147839 - protein, 200 aa, Heterodera glycines
  Coding regions on vcDNA: vcDNA=SeqID_74262; Strand=+; Position=1-601
MVALHVHVVHRRRVRLLLQHHHLNIVLLSMLRLPLFSYYCFVFSAFPTANAFVVIVIVVVAMIMIMMPPIVVRMAITKLLLLFLLVLVRQLLMMILVRPPLFLFMLQLLRRRLAIVPLVVIVALFNAQPISGGVVVGIGNTKAMPLCHCAVIADDGTVGALERAHRHCNTTSSIATAAANVVILLLANTHVLLMAKYGRC

SEQ ID NO: 147840 - protein, 251 aa, Heterodera glycines
  Coding regions on vcDNA: vcDNA=SeqID_74263; Strand=+; Position=1 -320,2079-2458,3090-3145
  Homolog annotation: Hit_ID=NP_510671.1; Match level="QueryCoverage =56%, HitCoverage=14%, E-value=9e-23, Identity=40%"; Hit description =predicted CDS, endonuclease/exonuclease/phosphatase family and RNA -directed DNA polymerase (XR69) [Caenor
MEHLTDAPQWASAMLELVNQMVGMCRELVTMVREQDGERNPNMVFDEERRLHSVVIAQLPESNSQMPTQRATDDLANVKALMDHCDVECLPTQVYRMGKKQSNGRPRLSLDTGKLPTIWKQSIIIPLHKQGDKSNPMNYRPIALTCSLCKIMEKFIVWAISDFLLKNNLFSEHQFGFIKGRSTTTQLISTLENWYDGIYNNKNIDCVYIDFRKAFDVIPHNLLLYKVHRIGIREIFYSNCFQKMLSAKYSL

SEQ ID NO: 147841 - protein, 115 aa, Heterodera glycines
  Coding regions on vcDNA: vcDNA=SeqID_74264; Strand=+; Position=1 -27,83-403
MKEFVNSGQTHNKQRTNETILPANWYCDRINRTEYEAQSKDSDRHLLDLLDQILSNHHPNSLQRYDQLKKVHPGTFRRLILPIHFQFRLAYPSIYEKRFPTHSSHLVVGTNLNHS

SEQ ID NO: 147842 - protein, 99 aa, Heterodera glycines
  Coding regions on vcDNA: vcDNA=SeqID_74265; Strand=-; Position=1-650
IASRFALLSASAWAMGRDGPIARDISPLQWSSFVSLFDCPFPSLSLDAFAHFVLVKKHLTSMAPIIPREQAQCLQNVFKHFAHFEINSATKDWTQEGGH

SEQ ID NO: 147843 - protein, 159 aa, Heterodera glycines
  Coding regions on vcDNA: vcDNA=SeqID_74266; Strand=-; Position=1 -32,88-151,205-322,532-624,675-797
  Homolog annotation: Hit_ID=CAE62609.1; Match level="QueryCoverage =100%, HitCoverage=30%, E-value=3e-50, Identity=55%"; Hit description= Hypothetical protein CBG06727 [Caenorhabditis briggsae]
FSRCGSCWPDYCFALCFALQNYTRYYVKDYGKLSGRLQMMSLQMMSEIHNRGPIACAIGATEQFDLNYTGGIFQQTSDAPTNHIVSVSGWGWDESNTEFWIVRNSWGDAWGETGWFRIVGETGWFRIVTSIYRGGRGDQYNLGIERECYFADPDISNLN

SEQ ID NO: 147844 - protein, 190 aa, Heterodera glycines
  Coding regions on vcDNA: vcDNA=SeqID_74267; Strand=-; Position=1 -68,120-537,581-667
MGQAGGETNQNGKGDKSPMGQQKRSTAEPQCRNATAGLSRAVNICCIRRRSDGAATTNSSTSANGGDGRVNVGIWRFAAVDISDANRRFGAVPVDTHCTNGHLGFNLEGAKFSGDEALHSVWRRLEQLWKTMPDAEQMRQQLEHHFVSNWLLDTGRLDELKLREEEMREQAAEEKTNEESDQEANIDVVD

SEQ ID NO: 147845 - protein, 126 aa, Heterodera glycines
  Coding regions on vcDNA: vcDNA=SeqID_74268; Strand=-; Position=1-380
MNPPMVRWVLFGNGIGWSLGLTNSAPSRSECFICVLLWSALASSLAVQSFSQKVPSVSKRIAFPSTAFPNPNPNNAIPPPNVVRRRAHNIPRDKPPCLRPMDRPFREHRTYPRSWEMPGFEATIPR

SEQ ID NO: 147846 - protein, 24 aa, Heterodera glycines
  Coding regions on vcDNA: vcDNA=SeqID_74269; Strand=-; Position=1-73
MAQCLKLFVQFAIFMAAASHATLN

SEQ ID NO: 147847 - protein, 31 aa, Heterodera glycines
  Coding regions on vcDNA: vcDNA=SeqID_74270; Strand=-; Position=1 -12,306-389
MNLKIFMYEHPISKTKQPDEIVLIKPFNFII

SEQ ID NO: 147848 - protein, 222 aa, Heterodera glycines
  Coding regions on vcDNA: vcDNA=SeqID_74271; Strand=-; Position=1 -97,143-714
  Homolog annotation: Hit_ID=EAK81377.1; Match level="QueryCoverage =95%, HitCoverage=73%, E-value=2e-14, Identity=33%"; Hit description =hypothetical protein UM00466.1 [Ustilago maydis 521] ref|XP _398081.1| hypothetical protein UM00466.1 [Usti
MDERHTFLGWDQLEDEEGKEEDYWDRGRPDSKKLAELVEHVEQYRKSAILSKSERGGQRDNKPMDKREGTKGRQTNGQKGRDKGTTNQWTKGKGQGRQTNGQKGRDKGTTNQWTKGKGHKGTTNQWTKGKGQRDDKPMDKREGTKGRQTNGQKGRDKGTTNQWTKGKGHKGTTNQWTKGKGQRDDKPMDKREGTKGRQTNGQKGRDKGTTNQWTKGKGQRDE

SEQ ID NO: 147849 - protein, 108 aa, Heterodera glycines
  Coding regions on vcDNA: vcDNA=SeqID_74272; Strand=-; Position=1 -73,196-446
MRRNSSLSMDTFGDLSTKIASTQSAEKVHFACGEQDQRLENEGEAISRGEEEEDEEEVEGGQSSDSSYVKVIAFADGVSSDELGTDLSEFVKEVKLAPDDLCSFSSEP

SEQ ID NO: 147850 - protein, 68 aa, Heterodera glycines
  Coding regions on vcDNA: vcDNA=SeqID_74273; Strand=+; Position=1-207
MSMCGSDLVMTVLRHFATSAKRALRDSAKIGHFAKNAKIGHFATVQKWCKNGAFRDSAKMGTSRNVQI

SEQ ID NO: 147851 - protein, 76 aa, Heterodera glycines
  Coding regions on vcDNA: vcDNA=SeqID_74274; Strand=-; Position=1 -124,797-903
MQKLGTSRQCKNGVKMGRFATVQKWALRETCKFNRKRPGLIRCKRKAERNPQSPRKPSPYLAILFSQWKTFRLVFV

SEQ ID NO: 147852 - protein, 54 aa, Heterodera glycines
  Coding regions on vcDNA: vcDNA=SeqID_74275; Strand=-; Position=1 -45,138-257
MVPRFLKRSQSGSSGWRGVAVGKASAYASMKLMSSIPLTFCPMDQDRAASPMFF

SEQ ID NO: 147853 - protein, 611 aa, Heterodera glycines
  Coding regions on vcDNA: vcDNA=SeqID_74276; Strand=+; Position=1-1833
MQKPTPSNRPNSSVSKTLACGLEKIVNLSGNEPLSVPVLADRSDPLGLKSVQPDPVPMESAEAGTKELEVMEVDEMSGEKGKKGEMGKEKVKSGGIEEEEESECSEGELLGDGGFGNLQLNPSLRAGNKAVEKEDKGKPYLVAQVRSDGVIAARMKLFWDFPELVFVPFSLFDNAQPIEIGDLFRLHKCEWTNNETGWEERGDWLYEATGRLNYQATATDVSQLRQRIPTQAVGILVDVQRARDRHVKVAMVSAPELSCVMRAYRRHFPADFTDNDIRYRSVVRLQLRQINSPPWVLYSQQFAYVLPSDFGKKRGDELLVHHANVIAGVEPEPMGYEFPFSAELSWAKVQLGEKVMAAAVAAQAFDVKADLRKHTLFVEPVVINEISTRSVIIQFVMPVPSIEELTELCKIWEVDLAVGCKVNPATKAKPCAHGYVLSIEKRALCRGYEIDVKVILSYQEAKDQDAQEEFDQMRCGELDGCVELIPQTSVRALQERMFTLRSNDCSKVAMDEGKGKVGRIMSILLGRPVKPESPKGNNPLMTFGALSKLKEGQVDTALCMLDEVPRLVFQQAGPGTGKTFSAASIVATILATDPTARVLALAPPNVAVVKL

SEQ ID NO: 147854 - protein, 46 aa, Heterodera glycines
  Coding regions on vcDNA: vcDNA=SeqID_74277; Strand=+; Position=1 -63,1220-1297
MPKICIHFEMILDENEDRCKNTLTTFFADYCRMIANFLHENPSGIK

SEQ ID NO: 147855 - protein, 94 aa, Heterodera glycines
  Coding regions on vcDNA: vcDNA=SeqID_74278; Strand=+; Position=1 -150,1343-1474
MCSLGPVFVSFASSGGLQVRVGLLLPVFHGMDENRFQNSGLSIVNKLTLQVLDETRMHPINLLSLNSQLASLLLFPFWLFTDALKMWSNIHSTN

SEQ ID NO: 147856 - protein, 44 aa, Heterodera glycines
  Coding regions on vcDNA: vcDNA=SeqID_74279; Strand=-; Position=1 -59,943-1018
MFFLTGKWIILGIKMFFFDCCGMMGAQNTTRQQTTKEQRMEIEN

SEQ ID NO: 147857 - protein, 236 aa, Heterodera glycines
  Coding regions on vcDNA: vcDNA=SeqID_74280; Strand=-; Position=1 -507,1527-1727
  Homolog annotation: Hit_ID=NP_498041.1; Match level="QueryCoverage =29%, HitCoverage=9%, E-value=5e-22, Identity=74%"; Hit description =SET (trithorax/polycomb) domain containing (83.9 kD) (set-2) [Caenorhabditis elegans] gb|AAA21163.1| Set (
MMDDNHDDDGDGRGGEEKEMVTAPKKRKKNPVAGMEEEEEEEEEEETNGVPLSSSSSSSSLPFMLPAICGGVAGGYGFGGGGGGVMLKTRCPMLLPSHKKPFVVTAAASALAANASVTINHAVGADCRGGNFVSPPPSSQCRDGTVQPAGGTSSSLLSTTSARSTAQSKYRSKMIKFARSRIHGWGLFALEPIAQDEMIVEYVGDKIRPEVANVRELAYERQGIGSSYLFRIDDHN

SEQ ID NO: 147858 - protein, 167 aa, Heterodera glycines
  Coding regions on vcDNA: vcDNA=SeqID_74281; Strand=-; Position=1 -132,559-759,1136-1306
CHRCVGSGLYLLLARLREAELRSVKQWAKRSPAEEDAMLSEYMRDGLELEEIEYLKMAFKDLDLADLCADINESAFQNVRRMPCADAADVQAQQPFVWVEPEGICETPNVFPKPYTDARRPGSIYYYVDAELEGVMPNRTGSARTEGHYTRKRDLEKEQLLAQVGGQ

SEQ ID NO: 147859 - protein, 108 aa, Heterodera glycines
  Coding regions on vcDNA: vcDNA=SeqID_74282; Strand=-; Position=1-325
MKGGDGHGAEVTSKWTPTTTVGEAVTIVMPPPSPVAAVSAEQSCAKHPWQVHHDEAVTAPAAAAGRHQLPQQLQAVHHHHLPVIGTGPEDGGGTVSPQPPAAAVAAVT

SEQ ID NO: 147860 - protein, 332 aa, Heterodera glycines
  Coding regions on vcDNA: vcDNA=SeqID_74283; Strand=-; Position=1 -28,1865-2835
  Homolog annotation: Hit_ID=EAL50634.1; Match level="QueryCoverage =66%, HitCoverage=69%, E-value=3e-26, Identity=35%"; Hit description =hypothetical protein 19.t00007 [Entamoeba histolytica HM-1:IMSS]
MAQWGPKKGETEARKELEEEARKEAEKKAQKEAEEAKEKSQKEAEEAKEKTQKEAEEAKAQKEREEKVKREEEEKRKKEKEAKTKPKKKAEREENDTIIARGIKKRRLTEAEKEERSQKDAEEKARREITDIVKEVEEEAKQRQIRNKIEELTAKLAGKPREEMGEEEAKELGKEKERFENPPEPPRERRPFYSSAVARFECQSELDSASKPRGREERGDRERNLGMSGKRLFTNMLKSAVGTVNDRPCIPPEGLNREMLKRRPTPAPVPQFTTRSAERSPVRKTYAPFRKGMPLERAEEAIYKIRKSLLQAADAFRARRRTVPARRSARER

SEQ ID NO: 147861 - protein, 207 aa, Heterodera glycines
  Coding regions on vcDNA: vcDNA=SeqID_74284; Strand=+; Position=1 -300,449-772
MPTATPATFGGAAGGDQNKQSCANGSSNTSPARHGHQTQMTTTSRSSTTPPSTAPSLCPLNGVGCDGEAAQQKQDTIQPANCVAGASSSSSSSSFSVPNEHFAQKASKFCKSLSKFVINGLKMETFGLFCVPFYGCTPFFGQKSLRTTESQCQPMEEAIADMPMDDDEKEDEDDDDIDVESVLVNQKLQQQPNCITTTYMPLIDTDS

SEQ ID NO: 147862 - protein, 121 aa, Heterodera glycines
  Coding regions on vcDNA: vcDNA=SeqID_74285; Strand=+; Position=1 -72,780-930,1691-1833
MLYRTPALPLKTRSTPLYSLVLDLHFIASPEARRSVGRIERHNLRVGAIVGAATAHPTKIGGFCREKILKKLIVNAVSFVLATTAQELFSPDVATMISFAMVQFAFLRFLVMFSLPSLLVH

SEQ ID NO: 147863 - protein, 464 aa, Heterodera glycines
  Coding regions on vcDNA: vcDNA=SeqID_74286; Strand=+; Position=1-1393
MPSKQHAKRKKEQERYQRQMEQSVSPGRSPVPDGSADENGVASHPGITTPNISALQLSTPASSFGSKRKGRPPKAGAVSIMTSQHSVSSSDTQITSAPQNIDSSPRKKREKVDEVDHHISANESIASTPVSRQKSRGGRPTKKRGGPGRGQTNYSMSNGSSMNHGSEAATSVVDLPTVPEKINFSTVQINFATSRNMACKIRRWADIGLYECDERRSGPRFIETCWNDLTQFLNDGFVVEYLAYLASISQRKVVVVDPMVWQMGIDRVMPYKNMTFGYDPNVPAEVILLPVHFPGHWTLIVHDVQCGTHFADSLPTPYGRLDWQLTDKIGKIISDILPSAVLTGIVNAVNLTVQHDGNSCGYFVCLYAESWLMNNRTFVLPDLSINYEKRRLLWHINELYGTDNVPYHPREGVPTPCPIVCRQVQSTSKTAEPMEIDEHDDITIIEPQTSGQAVNAVSTQAQVA

SEQ ID NO: 147864 - protein, 220 aa, Heterodera glycines
  Coding regions on vcDNA: vcDNA=SeqID_74287; Strand=+; Position=1 -428,620-854
MHWDEHNNAAEEDQCFGPMVEFGGCEAKETPEKVELNESSETLVDDLNQQLKELKEKLTSANEKLVTVANQMDKTLDESFVGMEQQNEWANKESANGTREKTTTNKGLKGKSTQTMGSWSMGFGAPFGKDNSAVPRMSSDLECKMRMECRELMRKHIETLREHMKVRVFLLHAKRKGMAAAEKKKCQTKFKALMDEFDEAKRKIKADFKRGNADKVGNRS

SEQ ID NO: 147865 - protein, 220 aa, Heterodera glycines
  Coding regions on vcDNA: vcDNA=SeqID_74288; Strand=+; Position=1 -428,615-849
MHWDEHNNAAEEDQCFGPMVEFGGCEAKETPEKVELNESSETLVDDLNQQLKELKEKLTSANEKLVTVANQMDKTLDESFVGMEQQNEWANKESANGTREKTTTNKGLKGKSTQTMGSWSMGFGAPFGKDNSAVPKMSSDLECKMRMECRELMRKHIETLREHMKVRVFLLHAKRKGMAAAEKKKCQTKFKALMDEFDEAKRKIKADFKRGNADKVGNRS

SEQ ID NO: 147866 - protein, 573 aa, Heterodera glycines
  Coding regions on vcDNA: vcDNA=SeqID_74289; Strand=+; Position=1 -222,376-481,538-1253,1388-1743,1791-1932,1982-2161
  Homolog annotation: Hit_ID=AAM19760.1; Match level="QueryCoverage =65%, HitCoverage=69%, E-value=1e-09, Identity=21%"; Hit description =glutamic acid-rich protein cNBL1700 [Trichinella spiralis]
MPQPFQATISPQIPPLNFDQLSVNDIEYDDNDGGGEGLLNKTFTLPEEQNDNVHEEEAENENGSNADEGIWQEQIVVSNLSTSHSEVGNVTQNSDKISNEVQMVECHADGVEHSKEGCGDNVSFSELTSIAGGNTSDDITSIPYPSEADKRANKDEDNVANDDKANGEEQQGLVSSQNSGSTPTSSRRVKYKICAEERGTKVEVSAHGRQMDVERTHCVVQQQQPIEAIERSKTGQNEIQPMDDGSADDDEPSERTAAEDSTQSREVADSVFEETTQNSNSSPTNKIGESGGPTNTGECTPNAQSVHGKRQRGEEEEEEVEVISAKSLVRSSALTQRTLAEVESIPEELSMASHSAKSLPNSSVSTMSSGKGMVVAVEPVAEHQQQQQTDDSIAEEVFSEDIVSTFKPSEKSLHSILSLRSNSMSTSARDSMGKLRRDSASEALLKLRTMNCVPELRSPRESKSPPKPLRSPRGIDRFMAKFPHNSSREASFSEELSVKGEMLEELPNASQIGMLFDVSGASVEGTLSKLDSTADSKRGQSDIFLGTDKRTDSVESNKMERGNSLGGFGVPEG

SEQ ID NO: 147867 - protein, 149 aa, Heterodera glycines
  Coding regions on vcDNA: vcDNA=SeqID_74290; Strand=+; Position=1 -64,137-222,309-374,446-545,734-865
MSISNNSMNCGDDFTPAAENGEVNGDSISLDNDGQFDGNSESIADQQQLKEFREKFAKMEMELKMAKLELENKALEQKLKHQEMMGEQKALKEKVTKIEQEKEKNAIIPNLSTSEEMSVLIARIAELYRAKTIEASVASSSDLFGQVGN

SEQ ID NO: 147868 - protein, 241 aa, Heterodera glycines
  Coding regions on vcDNA: vcDNA=SeqID_74291; Strand=+; Position=1 -58,152-255,474-554,657-771,848-928,1126-1227,1859-1923,1970-2089
MSSNFIGSPNCFFRPTADQAAAEEVDKYEVFSWHGDLSDQLAAQFLVSDQQLLKECREKLASAELRETKLLCKNGELNAENKALKAELEKQKLMSENSELKAKVDKMDQEKQQQLDKKYVSVDVFNSLVERIKQLENRQNKEEGRKAEEKQQKESVGQQNKNTEQKLDGKYAVVDKNNVLVALVTSSGDHSPPAVVSAKVAKEVPNSQQQNGWDAKVCHKDIEIIGEKQLTINCKGSRFGI

SEQ ID NO: 147869 - protein, 166 aa, Heterodera glycines
  Coding regions on vcDNA: vcDNA=SeqID_74292; Strand=+; Position=1 -141,525-617,723-853,1345-1480
MTPNLLPTLYLTALPLRHQDGPGAEHQQQHQQVTRVFYPDSLADEKEVTVDGLHEKCWYYLCIEWENFNRHNETTGTDCRLFRTLDRLGKGADSTVSELEPTDFSSQMMQFRLRSVSDFPMRFLRQLMDYGQLCTVEEPMVIRYTALGRLVSGISIRKCHFRRTKY

SEQ ID NO: 147870 - protein, 94 aa, Heterodera glycines
  Coding regions on vcDNA: vcDNA=SeqID_74293; Strand=+; Position=1-283
MKASFGRWADRMKECFGDGTFSLAPPMFYQINCFHFFILLIIIFNEKFAWRQNVGAKTTLAPKRRRQIVGAKTSAPKRPGPFKIVSDAQQIMCQ

SEQ ID NO: 147871 - protein, 416 aa, Heterodera glycines
  misc_feature (339)..(339): Xaa can be any naturally occurring amino acid
  misc_feature (343)..(344): Xaa can be any naturally occurring amino acid
  misc_feature (355)..(355): Xaa can be any naturally occurring amino acid
  Coding regions on vcDNA: vcDNA=SeqID_74294; Strand=+; Position=1 -142,194-341,436-470,518-605,652-770,819-854,909-1085,1250-1307,1426 -1686
  Homolog annotation: Hit_ID=NP_055529.2; Match level="QueryCoverage =98%, HitCoverage=23%, E-value=3e-73, Identity=38%"; Hit description =KIAA0590 gene product [Homo sapiens] gb|AAK61285.1| KIAA0590 [Homo sapiens] gb|AAH35577.1| KIAA0590 gene
KCKEHNMADRLVNLALIAGGAELVDAADFYRELPGHADKVVMLYHKAGLIGRALDFAFRTEQFGAGLIGRALDFAFRTEQFGALDLITQELNEHSDPSVLARAAEFFSANQQDGQAVRLLVYAKKYSQAVALCADYSQAVALCADKNVQITEELENVLTPNKLGKSLPSGSLPSGERSLLLEQIARCALQQGNYHIAAKKFTQSGNKIEAMRALLKSGDAMRALLKSGDTQRVLLFAQTARVGAIYRMAGNRVLLFAQTARVGAIYRMAGNYLQTLNWKEDAQLMRQIEAFYVKAGAMDLLSNFYESCAQVEIDEYHDYEKAAAAYGEAWKNLAKRWTXSPLXXDKRVHLGWGNXLIMGRNLELFSLYETDPGEAISQLSELAQRKGIDEHVRLGDIYALMVAHYYKRENYRKVGQ

SEQ ID NO: 147872 - protein, 378 aa, Heterodera glycines
  Coding regions on vcDNA: vcDNA=SeqID_74295; Strand=-; Position=1 -63,120-195,264-368,492-533,590-674,740-840,890-976,1076-1136,1176 -1276,1317-1444
  Homolog annotation: Hit_ID=NP_493344.1; Match level="QueryCoverage =98%, HitCoverage=36%, E-value=8e-84, Identity=48%"; Hit description =guanylyl cyclase (85.3 kD) (gcy-35) [Caenorhabditis elegans] pir||T24458 hypothetical protein T04D3.4 - C
HDSTRDLIMLNQSRMQVELNRRLEETTRNLKCLRRLEETTRNLKCLANALKAEKQRTEGLLCEGLLCELMPPSVAESLRRGATVDAAEFSEATVLFTDIVTFTNICSFCTPYDVIKLLNDLYQRFDRIDVIKLLNDLYQRFDRIVGLHDVYKVETIGDAYMIVDAYMIVGGVPKESQNHAEKILNVAIGFLMESRFVTNPTNELAISIRIGVVTNPTNELAISIRIGVHSGPVVAGVVGVKVVRYCLFGDTIHLANRMESLGMPSKIHVSKTAKALAIRNNPNRMESLGMPSKIHVSKTAKALAIRNNPSFLFTERGAIKIKGKEKLRTYFLERNDGKEKLRTYFLERNDRQSVWEICGRVREMDQSIDGYQVDEAGG

SEQ ID NO: 147873 - protein, 304 aa, Heterodera glycines
  misc_feature (265)..(265): Xaa can be any naturally occurring amino acid
  Coding regions on vcDNA: vcDNA=SeqID_74296; Strand=-; Position=1 -77,132-232,285-391,433-465,515-641,689-969
  Homolog annotation: Hit_ID=CAE73023.1; Match level="QueryCoverage =96%, HitCoverage=56%, E-value=5e-76, Identity=52%"; Hit description =Hypothetical protein CBG20390 [Caenorhabditis briggsae]
QFGWIHESFRQLMTRKYGREIWTKILEIAKFEEGTENEIGKYYKDEEIAKFEEGTENEIGKYYKDEESFRIVSAMGSVIGIPVEEVWEIPVEEVWEAYGGFLIQFTMETGWDELLRALSPDLEGFLDALDALHYGFLDALDALHYFIDHVVYRTKLKFIDHVVYRTKLKGPAFRCEPQSDGSLILHYYSRRCGLYPIVKGVIREVARRIYDTEVVIREVARRIYDTEVIMKVQERKQEHMDTMMTEHVIFVINQVGRSHKANNMXSDAPIDRSRTAHKPTDRAVLPREVSFHPPDQSMFFLLFL

SEQ ID NO: 147874 - protein, 122 aa, Heterodera glycines
  Coding regions on vcDNA: vcDNA=SeqID_74297; Strand=-; Position=1 -111,347-539,660-746
  Homolog annotation: Hit_ID=CAE70211.1; Match level="QueryCoverage =88%, HitCoverage=42%, E-value=4e-30, Identity=56%"; Hit description =Hypothetical protein CBG16689 [Caenorhabditis briggsae]
PLILLPLSVPSLFIFPSPPPPPPSFVNSFIHQRAKGHLPKGQRQMAGKVANKLKNIVLLKRIHTGEKPFRCEHCGRAFRQPGNLTRHAYTHTTVKPFVCAECGKAFNRASNLQAHLRVHSTG

SEQ ID NO: 147875 - protein, 131 aa, Heterodera glycines
  Coding regions on vcDNA: vcDNA=SeqID_74298; Strand=+; Position=1 -96,633-932
MPMNEKCHLRPKRAERQLWSLIGWPPFETSTKKFSPLSDEAPNSEESEGTAEGQRPIEKPNDENGDAFEDGSEEKDMAIPLLGEGSVGSAKSSPRKAKAAEGGGTLWRKHSPAMVKQLNALTAPSLRKSKF

SEQ ID NO: 147876 - protein, 77 aa, Heterodera glycines
  Coding regions on vcDNA: vcDNA=SeqID_74299; Strand=-; Position=1-521
MPVRLDQLPKTFNLDCAEKPFFPYAFNRRFFPKAVTFVKKIMLLRENYDVRLPHLPPIEDYCAGSMKQEKYDKFVSW

SEQ ID NO: 147877 - protein, 111 aa, Heterodera glycines
  Coding regions on vcDNA: vcDNA=SeqID_74300; Strand=+; Position=1 -95,144-263,462-582
MDNGKKEELKDRKNVKRRYPFPLVSARAQDSWRIKLEQMEEKYAKMEEEMSSEDSDDAIDFFQDTIEDIVENSGVDNGEIDDMDDQQDDDDAPTSTVYLNLGKDERTAKNS

SEQ ID NO: 147878 - protein, 422 aa, Heterodera glycines
  Coding regions on vcDNA: vcDNA=SeqID_74301; Strand=+; Position=1 -320,372-420,476-636,681-771,826-1017,1061-1181,1223-1557
  Homolog annotation: Hit_ID=NP_001004509.1; Match level="QueryCoverage= 95%, HitCoverage=27%, E-value=2e-51, Identity=30%"; Hit description =si:busm1-180o5.3 [Danio rerio] emb|CAD60788.1| novel protein similar to DNA polymerases [Danio rerio]
MADEMCVNWTRPEQLPYRGILRVRVVPPRGLRVPVLPVKIDERLLFCCCHHCATMFRKKSTRRPHKCPHTDAQRSFTGSYTHIELERALEHGYKIDRLWRAWHYDEWSDQIFKDYVRLLIKLKIESSGFPEGVSSVDQKQRYADEYRRIYEVNIELENVKKNPGLRFIAKLMLNSLWGKFSMRNELGANKVITRPQEFFSLLFDHKIEVSAIVPFSDQALRVLYKPKKNFVSEHTTSNIVISLWTTSCARLKLHDYMVQVDQREDSDLLYTDTDSVIVLHKRDTTPLETGEFLGQMSEEYLDCDIKTFICGGAKQYAFRMRHRRTNELEFVQKIRGITFDVNNSKALQFEKFVEKVLNYGRVDDNDDDDDNSAVSPAVFSYQKIMPTRDSKVITRKQLKKYLPVCQKGIINNSYEVFPFGYE

SEQ ID NO: 147879 - protein, 189 aa, Heterodera glycines
  Coding regions on vcDNA: vcDNA=SeqID_74302; Strand=-; Position=1 -36,83-616
MLSQAEDRGCSVERTSVRGTEGSDDLSGRLAGMSLTLRTSEQQQQLLPASGGRVGPAQRKQQRRRQRERRDLVRVLCRFNRCSPTWLHKMLQKRKEENLKFLNKQSLATHHLKRNVAVSADALSRHGANMMFAYRGFMGITVQQHLYARHRIVLKYPQLPCVVQFGGSSHQDNFPLELLHVVSEEHETD

SEQ ID NO: 147880 - protein, 127 aa, Heterodera glycines
  Coding regions on vcDNA: vcDNA=SeqID_74303; Strand=-; Position=1 -114,392-482,790-968
MQQVQQQRAAMGIDDGTTQRKNAGITARVPLASSNIRQAEETSGIAGPKPPKSKKARKNANFYGQNLLAPKNASDQFMSFAFQFVINFLVIVGVAVSWALSVQFRKSTLVIDPSHFYAPFSLVSLIY

SEQ ID NO: 147881 - protein, 82 aa, Heterodera glycines
  Coding regions on vcDNA: vcDNA=SeqID_74304; Strand=+; Position=1-249
MKGCLLTSLFVFLITILISNNYVGSVKKKLEQKSFEEIFGEKWEEKRNEEQKRREIIGKFYKIKEKIKQKGRKYSTKGGHHR

SEQ ID NO: 147882 - protein, 143 aa, Heterodera glycines
  Coding regions on vcDNA: vcDNA=SeqID_74305; Strand=+; Position=1 -141,482-772
  Homolog annotation: Hit_ID=NP_490685.1; Match level="QueryCoverage =63%, HitCoverage=91%, E-value=3e-11, Identity=37%"; Hit description =transposase (1A616) [Caenorhabditis elegans] gb|AAB54166.1| Hypothetical protein F53G12.11 [Caenorhabditi
MCVPKRMRCESANRSVQPHKSLKWNKVEKMSFIQKIKHFVFADIRAKTRQKAEVEVNEYLRDPKIKSRADPSLYWEVNSQKWPMIGAVVRKFLSPPATSSESERLFSTAGLISDDLRKSLLPENLAKLLFLHHNLLLTGFSIE

SEQ ID NO: 147883 - protein, 113 aa, Heterodera glycines
  Coding regions on vcDNA: vcDNA=SeqID_74306; Strand=+; Position=1 -73,214-371,453-560
  Homolog annotation: Hit_ID=AAG21331.2; Match level="QueryCoverage =100%, HitCoverage=91%, E-value=9e-47, Identity=83%"; Hit description= hypothetical esophageal gland cell secretory protein 1 [Heterodera glycines]
MPNIFKILLIVLLAVVSFRLSASTETANDGSGNNSSAGIGTKIKRIVTAGLLFTSLATGGAEAIGRSNAQGGKAAGLAPPPPPAQFEKRATRVEKMRAHLLELSEKMTDKEPK

SEQ ID NO: 147884 - protein, 88 aa, Heterodera glycines
  Coding regions on vcDNA: vcDNA=SeqID_74307; Strand=+; Position=1 -53,162-262,1574-1685
MVTFEQFIKGAQLALRERMNTAGRLKRVQSEGKLFGSDLENGKSGESNRAKKRIVFKKISLIFTLPIKMVLLRPTKMEMMSKLFIDQK

SEQ ID NO: 147885 - protein, 92 aa, Heterodera glycines
  Coding regions on vcDNA: vcDNA=SeqID_74308; Strand=+; Position=1 -120,184-271,579-649
MQSSPLSAVNGQNGIHKRQNSAIQSNGTTNNYADELQPQVAKHERLLDEEFNIVKMGTKKAQELMDWYADRAESLEKRKRMLNKGMVALVAN

SEQ ID NO: 147886 - protein, 65 aa, Heterodera glycines
  Coding regions on vcDNA: vcDNA=SeqID_74309; Strand=+; Position=1 -92,327-432
MLFICAKLLLKLLILLKLIGGIFSTRQQQLFYFARTWQKELLRIFEHENYTDMLELRNHVKVNWF

SEQ ID NO: 147887 - protein, 46 aa, Heterodera glycines
  Coding regions on vcDNA: vcDNA=SeqID_74310; Strand=-; Position=1 -3,493-630
MLLINKLTNFLILRLFALVAGVLGIARQRVTETLILEKKLTSINNY

SEQ ID NO: 147888 - protein, 45 aa, Heterodera glycines
  Coding regions on vcDNA: vcDNA=SeqID_74311; Strand=-; Position=1-137
RVQRDREIWTRPGLFCLKNRDFLAGKTGKKAGNFPVPVKTGQNRD

SEQ ID NO: 147889 - protein, 97 aa, Heterodera glycines
  Coding regions on vcDNA: vcDNA=SeqID_74312; Strand=+; Position=1 -105,651-839
MTFENSSTKTDRDGKSGLDAVPVVLQCRDPNQLQTSAAGPGNLDETGTFLFEKPGLFGWENREKSREFPGPGQNWSKPGPWYSVVRVQSSYPPRFWG

SEQ ID NO: 147890 - protein, 171 aa, Heterodera glycines
  Coding regions on vcDNA: vcDNA=SeqID_74313; Strand=+; Position=1 -97,141-208,257-322,514-654,850-948,1002-1046
  Homolog annotation: Hit_ID=XP_418964.1; Match level="QueryCoverage =36%, HitCoverage=12%, E-value=2e-09, Identity=45%"; Hit description =PREDICTED: similar to chromodomain protein, Y chromosome-like isoform b; CDY-like, autosomal; testis-spec
MEFEEFDPFLNMFVGPEKDLEYDPLFDLFLSNGKKINFDQGFLDYLLNNDDAEPVYMDLDNVPTAPPQFTIPQSPKHLADLGNLLANPAPQLTSQVSPIFPPHNEYEVEQIIDQRKKKGKEEFLVLWKGFLPEESTWEPVEHLESGHALLEEFKKMKKKPKKPAKATKLVK

SEQ ID NO: 147891 - protein, 191 aa, Heterodera glycines
  Coding regions on vcDNA: vcDNA=SeqID_74314; Strand=+; Position=1 -426,525-674
  Homolog annotation: Hit_ID=NP_584829.1; Match level="QueryCoverage =69%, HitCoverage=66%, E-value=2e-22, Identity=40%"; Hit description =TRANSCRIPTION INITIATION FACTOR TFIID (TFIID-1 [Encephalitozoon cuniculi] emb|CAD25333.1| TRANSCRIPTION I
MKVYNPNATAIIFSTGKFVCTGAANEKECTQAVEHVTERIRQCGYQEALIHKFDVKNLIATADVGFHIRLGELSDFLGVKCCSFTPELFPGLAYRNINPKMSIIVFSSGKLNFTGNNSIDDIKIAFNQFYPILYKFIHSPQRLDHFQSFAQAQADRIDRAHSYSSLLHTDCLHNGDKFYAVHKSAGQRSHS

SEQ ID NO: 147892 - protein, 83 aa, Heterodera glycines
  Coding regions on vcDNA: vcDNA=SeqID_74315; Strand=-; Position=1 -199,353-405
MDSGKRTPGKGQWESDTGERDSGKGTTGKGQLERDTRERDNGKGTVGEGHWGKRQLKRDSGKGHDKVIYFLILFLQFKSDHEF

SEQ ID NO: 147893 - protein, 199 aa, Heterodera glycines
  Coding regions on vcDNA: vcDNA=SeqID_74316; Strand=-; Position=1 -271,652-980
MDTATINRILTMNEKTKEHYLGCFPCNKIPLNINKFPSVLVANNDPSNKEGTHWVSIFIKDYKTVYYFDSFGRTPNKCIEKFLSQFKTVEEHKEFIYGGITKDNARKQMAYKGFKNVTVDQHFYVRHRICLRYANNPCVIEKNKNGHDRFYPLELVRMIENDQADIYFGQNFTKVVPSAQESSNNAHFIKNYYDSYPLW

SEQ ID NO: 147894 - protein, 513 aa, Heterodera glycines
  Coding regions on vcDNA: vcDNA=SeqID_74317; Strand=-; Position=1 -249,343-1159,1262-1737
  Homolog annotation: Hit_ID=XP_320889.1; Match level="QueryCoverage =54%, HitCoverage=35%, E-value=1e-17, Identity=26%"; Hit description =ENSANGP00000012033 [Anopheles gambiae] ref|XP_313651.1| ENSANGP00000013044 [Anopheles gambiae] ref|XP_314
MATKEELKIILEAQQKQFLDLISKILPKNTAPSASSSDLFSQINSQLPQFHYDPEADETFSLWWDRFGQFVEKDGKDLTGDMKLTISTLKALFGDTKSIFVRRFECFQLSCGLLQNVMEFGAMVNARCERADMTLSKEEVKCLIFITGLSDAHKELRQECLRQMEKARKSTPPRSMTLEALLEECRSIQSLQNSAAALSGPGQVHSVQVRPQRVSDGSKKSNRGKMVNQKGNISVPNSKEYNFPFNSNRTDEDQQQKCKRCGQFHVNDCPYAEDVNCYRCGKRGHIRPVCPERTQSNAVTVASTFCVTQKCHDWIWTHPLINGHPVKLAADTCSHLTIIQESLWISLGSPKLRSQVANTGAPNIMGLDWIVPIEKATQSPIATTLDLSSAPTKVNTIDERPCHFKIGDTVRVLNYGKTGKSNWFEGKIVAGKGLIWKVKIPLLNITVKRHVNQMRSFVPYQSETTFPNDTIEQVPQQQSPCHRSVATTPPTNLPVQPTQRPQRQRRPPIRYSP

SEQ ID NO: 147895 - protein, 285 aa, Heterodera glycines
  Coding regions on vcDNA: vcDNA=SeqID_74318; Strand=+; Position=1-855
MERHDDDQFNENANQGDPPPSDQQDERRAIGAQPAKPKTVLEAHGLGTSQPGVTPAVTKNLRSGLIAVRSARDQIERAAGTLAARIVEARELMDDDYTRGEALEHAARMMAMERGLGEVKRIFEGHFEKGIAEAGAAPDERQDFFYDSIAAPLPAATKYLRLREHPTPAELLQIAAEHLGDLRAMRQTFEDEERESISRSSRSVETENNQAEEELPRAMPRRSMQEWETSFREAYVRQHDELFGQQQPLVNQAERVATPVMSNLAALIQRRSNAPSVASVRVNNP

SEQ ID NO: 147896 - protein, 348 aa, Heterodera glycines
  Coding regions on vcDNA: vcDNA=SeqID_74319; Strand=+; Position=1-1044
  Homolog annotation: Hit_ID=NP_504187.1; Match level="QueryCoverage =90%, HitCoverage=24%, E-value=2e-50, Identity=39%"; Hit description =predicted CDS, integrase, catalytic domain containing protein family member (5E782) [Caenorhabditis elega
MPSVKAIEQFWSVEAIGIRDDPTQDADTEAIIQFERSVRQHDDGRYSIRLPWREEHPELPSNYAVAYRRLIGLLQRLQRTPGVLEQYQGVIEEQLRAGVIEEATVGTGSTEYFIPHQAVITPKKLRVVYDASAHAKGVPSLNDCLLRGPVWLPDLAGMLIRFRACQVPVLADVEKAFLMVGIEEADREVCKFLWVRDPLGPLTTANLVPYRFRRLAFGLTPSPFCLAAVVRHHLRKYNSEFAEQLIRDTYVDNVLIPADTIEEATTKAQEAKRMFTDAKMNLREFLTNDQGLNDSFSEADALGKTTAKVLGLEWDSVDDSIQISFPGVTPEGECRQTRRTVLKTIARL

SEQ ID NO: 147897 - protein, 117 aa, Heterodera glycines
  Coding regions on vcDNA: vcDNA=SeqID_74320; Strand=-; Position=1-352
DTVQPQLLIGIRRFWDFVQGFRKTAEGTYLIDTVFGTVICGEQFQTTTGVTPDSSVFAIPPCGEDERDQMPSVKAIEQFWSVEAIGIRDDPTQDADTEAIIQFERSVRQHDDGRYSI

SEQ ID NO: 147898 - protein, 354 aa, Heterodera glycines
  Coding regions on vcDNA: vcDNA=SeqID_74321; Strand=+; Position=1 -318,1788-2012,2295-2558,2976-3233
MICSPPARQPAAATDSVMGVKFFMCRVNGGAADQRQYVFLADAMRNDDANANLNDAALAKCFVHFYTVKTDRKGRFLLRSDGKLADRSSIFNQQYNVHLIALNDNSQPIVDDVSYAASTKVVAQRVYVNDMRNSVDTICQHIDERCVINFYPTGYDREKQMKEMTKRWLTDQQHYQEMSEMVNFFLIAVFRELITSAKEKSALNVGTLTSNEAQLIGHFWNKFASTKKNGLLHKRLRLIDHQMVRLIDDFCKIDDSFLRSHHELKSALSLSNQPEKFCENWPKVKETSNKYTNLDIVMEAFGHWLHTSEQLNNDEENIIFFWIEVFSKRLQSRCYNWPFLDQNLFKEIGNFLDD

SEQ ID NO: 147899 - protein, 81 aa, Heterodera glycines
  Coding regions on vcDNA: vcDNA=SeqID_74322; Strand=+; Position=1 -177,281-349
MMFVTVKDEHKLTLDKIVRIKNINNMLDNICRKIFQISANEQFNPVPWKEQLCTGSYFQKKISYLFLIMPLNSFGNPCLFN

SEQ ID NO: 147900 - protein, 107 aa, Heterodera glycines
  Coding regions on vcDNA: vcDNA=SeqID_74323; Strand=+; Position=1-324
MSRISIASYEALLAEFNKQVMSQCHLSASTAKSEHISALIAMRNAASAGHNPTKAHQTMAAKNAQQSSTTATAAEQPSQQQQPQQLYSSKRPMTLLKIQPPAPAVKA

SEQ ID NO: 147901 - protein, 321 aa, Heterodera glycines
  Coding regions on vcDNA: vcDNA=SeqID_74324; Strand=+; Position=1 -144,951-1122,1193-1322,1376-1533,1580-1717,1776-1996
MAEETQSHREKTTRGKSQENSERGRSANVRQVRSNSSSSNTSTDTYSQKGYTPKPPPTATAAVNCSLRRLCLRFELIKHTTNTKGVVPLPHPPIPTRPAHVPPVQAIRHPTLGPNSLSENSDSELSSSENEAEQEQSSTRRSHRSRKDGFTDEPSQVDTRQPSIKRETPNAQAVHIKSEQVPLVTPIESTTIVTKNIVQNAERGNEKIMQNETKEENTEKSKDTKGDEQSKQKNQTASEKDETAPKKTTAVAPSLPVQPPQTVGKVQVPRPSQRTVVCIPLDVQSTSSPPTDPRQMRPKQQRPSAVTESIMCLDLPRFVHK

SEQ ID NO: 147902 - protein, 37 aa, Heterodera glycines
  Coding regions on vcDNA: vcDNA=SeqID_74325; Strand=+; Position=1 -57,725-781
MMAQNHQAHRDSEALTMSKNFWNNFFHIYVRKAKYNP

SEQ ID NO: 147903 - protein, 60 aa, Heterodera glycines
  Coding regions on vcDNA: vcDNA=SeqID_74326; Strand=-; Position=1 -76,123-229
MSWPENRVMKYHKKRNVVHKKHINRVEILIFSNLIGLSKDFFHQCIPFLLNLKIPLALGN

SEQ ID NO: 147904 - protein, 119 aa, Heterodera glycines
  Coding regions on vcDNA: vcDNA=SeqID_74327; Strand=-; Position=1 -111,255-503
MGTKSRKSLNTENEGKNELEKGKARENVQWESEEQTKKTHEKRSVSRGPEKGEVAFGSVKPIPKESGKEGTEKDVADDSDHLQKTEFDKGGRKGRSTYPGGQFIVRNEGIQEMIHEEIK

SEQ ID NO: 147905 - protein, 43 aa, Heterodera glycines
  Coding regions on vcDNA: vcDNA=SeqID_74328; Strand=+; Position=1 -12,79-198
MGVWHLFICISGQVAKPSDFIICRLGSIPHSDRIFFIFSLPLF

SEQ ID NO: 147906 - protein, 149 aa, Heterodera glycines
  Coding regions on vcDNA: vcDNA=SeqID_74329; Strand=-; Position=1 -40,115-158,214-280,370-456,525-609,1002-1079,1140-1188
  Homolog annotation: Hit_ID=AAC06296.1; Match level="QueryCoverage =100%, HitCoverage=69%, E-value=7e-70, Identity=86%"; Hit description= GTP-cyclohydrolase [Ostertagia ostertagi] sp|O61573|GCH1_OSTOS GTP cyclohydrolase I (GTP-CH-I)
MLYFTKGYDENFDDVLNEAVFDEDTDEMVIVRDIEMFSLCEHHLVPFLGKVHIGYLPNKKVLGLSKLARIVEMFSRRLQVQERLTKQIASAILQAVHPTGVGVVIEASHMCMVMRGVQKINATTTTSCMMGVFRDDPKTREEFLTLIKK

SEQ ID NO: 147907 - protein, 65 aa, Heterodera glycines
  Coding regions on vcDNA: vcDNA=SeqID_74330; Strand=+; Position=1 -72,307-432
MCVRRRSFLCSPQKIWFFSLDVVKGLFDALSTNMTSISTNFEPGPEYEQKVEYSIFQFRTYSTID

SEQ ID NO: 147908 - protein, 143 aa, Heterodera glycines
  Coding regions on vcDNA: vcDNA=SeqID_74331; Strand=+; Position=1 -195,429-547,595-712
  Homolog annotation: Hit_ID=NP_508272.1; Match level="QueryCoverage =95%, HitCoverage=97%, E-value=1e-47, Identity=64%"; Hit description =spondyloepiphyseal dysplasia late (XC58) [Caenorhabditis elegans] gb|AAB52862.1| Hypothetical protein W05
MSSTTSREYYFVIVGRQDQPLFEMDFPPKKREQQQETHHLLQFIAHAALDIVDEQTLRETQMYFKIVDKFNEWFVSAFVTASRIRFLMLHTQKNEDGIKQFFQEIYEMYIKFSMNPFYRQDTPIRSPSFEQKAAMYGRKFLGV

SEQ ID NO: 147909 - protein, 257 aa, Heterodera glycines
  Coding regions on vcDNA: vcDNA=SeqID_74332; Strand=-; Position=1 -194,700-1104,1345-1510,1551-1559
MFTPNVPYQTHLLQSVPYSSTAAHQQNQFSSPAAAAAWTTTSASSAGISRWSQQQQQQNNESLIRKHRSLEGVHQLLADNPSCSSAPSMFPPPAPSTVVQQFSESLPSSHCHHNHLQQHNIMPQNLNGPTMPNLNGPLPPSLLQPLLPAAGGPSPYFGASGYAHVPQPTTAATTAPIATTTTTKTAAFINDSSSTASRQFFSQPTTQHHHSLWMPSSSGTVPQQQGIHPWGNEGMVPIGDVEDGQSALRIDEDDDGR

SEQ ID NO: 147910 - protein, 108 aa, Heterodera glycines
  Coding regions on vcDNA: vcDNA=SeqID_74333; Strand=+; Position=1 -133,180-373
  Homolog annotation: Hit_ID=NP_497406.1; Match level="QueryCoverage =96%, HitCoverage=91%, E-value=5e-36, Identity=76%"; Hit description =ATP synthase (12.1 kD) (3C509) [Caenorhabditis elegans] gb|AAK26152.1| Hypothetical protein Y82E9BR.3 [Ca
MSLLVFSRLRTLPRLAPLLTNSPCALSTSAVRKDIDSAAKYVGAGAATVGVAGSGAGIGNVFGSLVIGYARNPSLKQQLFQYAILGFALSEAMGLFCLTMGFLILFAF

SEQ ID NO: 147911 - protein, 168 aa, Heterodera glycines
  Coding regions on vcDNA: vcDNA=SeqID_74334; Strand=-; Position=1 -34,77-128,433-457,515-576,650-755,1179-1294
  Homolog annotation: Hit_ID=AAH44038.1; Match level="QueryCoverage =100%, HitCoverage=71%, E-value=2e-55, Identity=64%"; Hit description= Ube2h-prov protein [Xenopus laevis] gb|AAH75340.1| MGC89025 protein [Xenopus tropicalis] ref|NP_001004909
KRRMDTDVLKLIESNHEVVITGGLNEFLIESNHEVVITGGLNEFLVKFYGPKGTAYEGGVWRVRVDAYEGGVWRVRVDLPEKYPFKSPSIGFMNSPSIGFMNRIYHPNIDEASGTVCLDVINQSWTALYDLSNIFESFLPQLLTYPNPADPLNGETASLYMHKPDEFK

SEQ ID NO: 147912 - protein, 127 aa, Heterodera glycines
  Coding regions on vcDNA: vcDNA=SeqID_74335; Strand=-; Position=1-384
MNFTDYERKFMPAKIHFISLIGTVRFKVNGAHSSSNKIPFICECNSRFYTHCESELFCWRNARRSQFVIALTLALLATTEQPTALVGWFFGGPVNWTPKENWTLSEFWTPKENWTLENWTLNSSFKI

SEQ ID NO: 147913 - protein, 350 aa, Heterodera glycines
  Coding regions on vcDNA: vcDNA=SeqID_74336; Strand=-; Position=1 -26,123-603,647-740,894-1093,1169-1420
  Homolog annotation: Hit_ID=NP_727425.2; Match level="QueryCoverage =90%, HitCoverage=12%, E-value=4e-11, Identity=28%"; Hit description =CG17255-PB, isoform B [Drosophila melanogaster] ref|NP_572631.2| CG17255-PA, isoform A [Drosophila melano
MGNCEFELGFSDTASVNFPPSSGQPGGGGPVVVHGGNAVNFAAAAAHQQQQQQAAGDPSQHVAAVHHHHQQQQQLPPQQNKTLFTPAANPAMVSATPAMQQHLQQQAQTIFHQTSATAVPQFPSYNMPYMYSPVATAQTLQGPNAEIDRFLIQQYGTPYSQLDLQMGAMSIGPPTTLAPNHHRATLESYMENKFGQQQQNVNQAANNGHYQQTQQSQQQQRGLAQSEQATLLGGPPSHVGPPPGFGMPTAPTQPSYVQPANIHSLFQMPTYPHPYQHPQYMMSNANRFQAAQRPAQTSPPEANVQNQRRGGGDAQGYAGGAVPDSTSEQHSAAVSQQYGNNFNHKYRSYM

SEQ ID NO: 147914 - protein, 251 aa, Heterodera glycines
  Coding regions on vcDNA: vcDNA=SeqID_74337; Strand=-; Position=1 -217,273-810
SAGPRVRTERQGQGFKGQNRTFTAGGAYRRDNVAANKQTTNKVVGTGTNTGDFSSTVEQSYGETAGHENDEWKNGPRVFMPSSAATVVMAETSTNGGVKWPALDNFTPSVEPAEPAAVHKPKTFAAVAAAKKASPQPSPPQHQQQQQQQQTITYESREPDWTKENWTTEPTNWSSENWASTGKLESTEILDNPEKLDTTEKLENTDMLGTAGNIEAANNLDTSVMLDTSCKLDTAGIMDNHCDTAGMADTN

SEQ ID NO: 147915 - protein, 95 aa, Heterodera glycines
  Coding regions on vcDNA: vcDNA=SeqID_74338; Strand=-; Position=1 -208,417-496
MELQKQPVMATKEQLRLAELTQIGHDATIAHDDIAEQKPVKVSFSVKLDLAFSWTHVQSVFFFVIWVFLGVFLDAEYEPGLLFGQFRIPNPNSNI

SEQ ID NO: 147916 - protein, 156 aa, Heterodera glycines
  Coding regions on vcDNA: vcDNA=SeqID_74339; Strand=+; Position=1 -77,122-155,206-234,396-426,476-592,660-726
  Homolog annotation: Hit_ID=NP_500130.1; Match level="QueryCoverage =100%, HitCoverage=21%, E-value=2e-32, Identity=49%"; Hit description= transmembrane protein TM9SF3 (66.6 kD) (4C515) [Caenorhabditis elegans] gb|AAK68454.1| Hypothetical prot
MRNFLLLLCFAIILQVLCDEHDHIYNPNAEVVLWMNTIYNPNAEVVLWMNTVGPYNNRQETVGPYNNRQETYSYFSLPFCQGYKKGYKKTIEHYHETLGEALLGVELEFSGLDIRFTVDQPKTVYCNYCNTKLTPTDIDALIFAVEHNYCFAFFID

SEQ ID NO: 147917 - protein, 34 aa, Heterodera glycines
  Coding regions on vcDNA: vcDNA=SeqID_74340; Strand=+; Position=1-106
DEAESSSNSESLESGLPCVAIYAGKGAPKPHGEC

SEQ ID NO: 147918 - protein, 24 aa, Heterodera glycines
  Coding regions on vcDNA: vcDNA=SeqID_74341; Strand=-; Position=1-75
TPSEKTRCVPINRECQRKTLSFFS

SEQ ID NO: 147919 - protein, 21 aa, Heterodera glycines
  Coding regions on vcDNA: vcDNA=SeqID_74342; Strand=-; Position=1-65
TKEGPQVSVGFPNEISWVDRA

SEQ ID NO: 147920 - protein, 31 aa, Heterodera glycines
  Coding regions on vcDNA: vcDNA=SeqID_74343; Strand=+; Position=1-176
LLINDFLIFFSFSFRFLKLLSLMFNCLCLMC

SEQ ID NO: 147921 - protein, 37 aa, Heterodera glycines
  Coding regions on vcDNA: vcDNA=SeqID_74344; Strand=-; Position=1-111
LIADVQKSPGRNGQIRQTMAVEGKSFRRMPCRERVKI

SEQ ID NO: 147922 - protein, 187 aa, Heterodera glycines
  Coding regions on vcDNA: vcDNA=SeqID_74345; Strand=-; Position=1 -121,520-700,1198-1459
MSSNNALTQMMRREKRKLLGNVDVQNPLAFVIPATLREKGVLCDFEKAEIAAVRTAFPTAQIKCCMFHYGQSLYRNFKRLGLVHLYGEKTERGEEVRNTFRFLRPVPVPVFQKWPVPVFSVQKYRKIQVQEKYRLPNNGLYLYLDPGKIQVAEQWPVPVPGSRKNTGLDPDTGRSLVPTIISTCQKC

SEQ ID NO: 147923 - protein, 171 aa, Heterodera glycines
  Coding regions on vcDNA: vcDNA=SeqID_74346; Strand=+; Position=1 -120,213-320,531-599,837-1055
  Homolog annotation: Hit_ID=CAE75251.1; Match level="QueryCoverage =97%, HitCoverage=50%, E-value=2e-24, Identity=29%"; Hit description =Hypothetical protein CBG23209 [Caenorhabditis briggsae]
MPFALFSGMTCTAIIYTAINFAFFVVLSVCDIQNSTAVAMTFADQTMGYFTKLMPFIISLVLLNALNASVFMGSRHTVFIMIGLFLGNVNELISYVSFAAIRMPIVLPFLFLAICFSLSIITIIKDFSTAYIGLTLIGSALIIYGIFIWEKALNRISAYREQSSNWNGQWK

SEQ ID NO: 147924 - protein, 54 aa, Heterodera glycines
  Coding regions on vcDNA: vcDNA=SeqID_74347; Strand=+; Position=1 -96,154-222
MRFFFLLTIALLSVVLLLSPSALAKKRARRSMPVNAAMPEWKILSAEVENDGTA

SEQ ID NO: 147925 - protein, 129 aa, Heterodera glycines
  Coding regions on vcDNA: vcDNA=SeqID_74348; Strand=+; Position=1 -165,340-452,495-604
MEEYEASSVRQRAKIEERDGKRAKANAQKAPKNGEKSLQIGWIVCFVLFTFAIGILMYQSRETPTNYQKEVNRECDEGTGQCIAIADYTRDSGKTWHRGIFYVNETTFDFEKMLEKKIGAEAILKCPAN

SEQ ID NO: 147926 - protein, 15 aa, Heterodera glycines
  Coding regions on vcDNA: vcDNA=SeqID_74349; Strand=-; Position=1 -36,181-192
MISKHFRLIHEKVTF

SEQ ID NO: 147927 - protein, 128 aa, Heterodera glycines
  Coding regions on vcDNA: vcDNA=SeqID_74350; Strand=+; Position=1 -106,864-979,1041-1094,2038-2148
  Homolog annotation: Hit_ID=CAE64449.1; Match level="QueryCoverage =96%, HitCoverage=87%, E-value=2e-32, Identity=52%"; Hit description =Hypothetical protein CBG09156 [Caenorhabditis briggsae]
MANLFGQKQSVAVVGMLKCKGKPSAGTKVKLYDNDHFTTDDLMAQSKTDNYGRFKLSGTAKEITKIDPKLNLYHDCNGDFPFTPCKWKITIKIPKSYITTGPHAPKVFDIGVLNLEGKFSGQKRDCIN

SEQ ID NO: 147928 - protein, 17 aa, Heterodera glycines
  Coding regions on vcDNA: vcDNA=SeqID_74351; Strand=-; Position=1 -51,325-327
MPKELRLAYVRSHEESK

SEQ ID NO: 147929 - protein, 88 aa, Heterodera glycines
  Coding regions on vcDNA: vcDNA=SeqID_74352; Strand=-; Position=1 -163,508-611
MTLQRRKNDCSYYPNKILLKNSNICSVRKIYYNQNNGGEREDDNPSTGFIYTDIALKEMLEEKAKEKKQAYDENGEPKSKRSIMKDTD

SEQ ID NO: 147930 - protein, 137 aa, Heterodera glycines
  misc_feature (90)..(90): Xaa can be any naturally occurring amino acid
  Coding regions on vcDNA: vcDNA=SeqID_74353; Strand=+; Position=1 -99,256-408,880-1041
  Homolog annotation: Hit_ID=1EGC; Match level="QueryCoverage=98%, HitCoverage=33%, E-value=8e-32, Identity=53%"; Hit description=Chain D, Structure Of T255e, E376g Mutant Of Human Medium Chain Acyl-Coa Dehydrogenase Complexed With Octanoyl-C
SMACGLQQRALDEAVKYTTKRRTFGQPMIEYHGVSFKLAEMAMHLEASKGLVKRAGKKVDAQAEDAVYFASMAKCFACDAAFQLLCSFEXIFGGNGFNEQFPVEKLLRDSKTLQIYGGTSEIQRVVIARELRKKYGN

SEQ ID NO: 147931 - protein, 326 aa, Heterodera glycines
  Coding regions on vcDNA: vcDNA=SeqID_74354; Strand=-; Position=1 -158,523-1198,1532-1678
  Homolog annotation: Hit_ID=NP_702139.1; Match level="QueryCoverage =84%, HitCoverage=30%, E-value=5e-17, Identity=22%"; Hit description =hypothetical protein PF14_0250 [Plasmodium falciparum 3D7] gb|AAN36863.1| hypothetical protein [Plasmodiu
MAFHGKLCHFLLTHMVFDHRLAKCPSFRCVFDPPHPTRAVAVRRPLRLKKSTRKKTNFNKDVHNGEVSQIGNINVHKREEKKTGNINVAQQNDDVGPNTESQNTNTQPNDDVGQNTGRQNTNVHNVEQTKNENTNLAQPNDDVGPNTESQNTNTQPNDDVGQNTRRQNTNVHNVEQTKNDTGRQNTYVHNVEQTKNENTNLAQPNDDVDQNTERQNTNEEETQTENTNVAQLNDDVGQNIKSQNTNDHNVEKTLKGNTKNVKQQKFDVGQTTEGQQIKAENETAKESVNSNSIQKTIGRKSVGTQTDETYVGTLVHYKVTQNIKGH

SEQ ID NO: 147932 - protein, 90 aa, Heterodera glycines
  Coding regions on vcDNA: vcDNA=SeqID_74355; Strand=-; Position=1 -102,1055-1225
MLSFRMTPKCWVWMTKKKAIVEKHAGPNRVGRTEKKYFPNKKALGMPHRMQSIWPLTQNKRRPPPARPPFCPPASQGLWTPPNAWPFQRV

SEQ ID NO: 147933 - protein, 268 aa, Heterodera glycines
  Coding regions on vcDNA: vcDNA=SeqID_74356; Strand=+; Position=1 -264,314-857
  Homolog annotation: Hit_ID=AAL78214.1; Match level="QueryCoverage =67%, HitCoverage=92%, E-value=4e-10, Identity=28%"; Hit description =putative esophageal gland cell protein Hgg-20 [Heterodera glycines]
DVLMDSLPFFNHAQLGLKLALVSPRFDALVDKHFDGKSALTIWRQIRIDKIGTMPRLSVFINYVKSVPFPLPDRPLPNKIHFKDLQIAYIDHFVIAFLRANKQIFDGNGTALKFSIWSAKNDVVPIWDVFANQIWPIFAPNIRHMGLTNADHLDNLRRLISPTILSDLKWLNSINSYRLLPDAIGGDFDQSNATGGQILSKWLHTPTTNGQPKRFNCVYYQEPAINIDEWINTFKEVCGHIFLKQLINDCLLILFPIGYVGIWWMAEV

SEQ ID NO: 147934 - protein, 45 aa, Heterodera glycines
  Coding regions on vcDNA: vcDNA=SeqID_74357; Strand=-; Position=1 -58,298-377
MKNDKRPKIVTKSELPCTKGLRDPNPTSISAPRTRTLKKMSKNRI

SEQ ID NO: 147935 - protein, 183 aa, Heterodera glycines
  Coding regions on vcDNA: vcDNA=SeqID_74358; Strand=+; Position=1 -135,273-689
MEEGGLPPETAPGSATAEQQQQQQQATQPSGNEAPLDDGLAMLQELYQRRHAELLAQFQQSQSIAQQDYLLNLQLLQSALPAAAAMVVLQQQQIAVMPSAASQHRPLLGSLAHTSSEQSTEEFDVSAQQTAQQPQHHQQTCSSVPLAKEHAAGGIAATARNRRTFSGSGQTISQHTRDRLKSM

SEQ ID NO: 147936 - protein, 48 aa, Heterodera glycines
  Coding regions on vcDNA: vcDNA=SeqID_74359; Strand=-; Position=1 -71,196-271
MDRNSHRPCGIMDKAFDFESKDCSTALPMIIYPKGSFSNFMPFQIFYD

SEQ ID NO: 147937 - protein, 276 aa, Heterodera glycines
  Coding regions on vcDNA: vcDNA=SeqID_74360; Strand=-; Position=1 -40,320-468,656-829,1056-1253,1629-1748,1808-1957
  Homolog annotation: Hit_ID=CAE62158.1; Match level="QueryCoverage =69%, HitCoverage=2%, E-value=1e-23, Identity=35%"; Hit description =Hypothetical protein CBG06205 [Caenorhabditis briggsae]
MVWKEWVDGGGDGDTLIQLCYPKCEQSDTGTYSIRIVNEFGSASVDLRLKVVDRPAPPEGTLKERTASSSRRRRVGSTAADRSAQAAAAACAAGEEAKDEVYNNEEERQNMAVVTKRMAILDLETSGTPARIVEIPENVTVVEGELAIIKCVVEGNPAPTIVWKKGGRKMPLTDDRVRCQTDGDTGHVSLIISKCRPQDGGEYTLMVKNAHGKHKVGAKLLVTPAAESNLDIRAKQKKRGTGISNSEQEKQRQRSDAEPKSKQKSGAQAGDLLVRR

SEQ ID NO: 147938 - protein, 153 aa, Heterodera glycines
  Coding regions on vcDNA: vcDNA=SeqID_74361; Strand=+; Position=1 -150,1390-1701
LFLAHFSFFCFLALFYFEREKKEERNGTDRNKKERKKKEKRLEEVRDRERVFRVLPGPGPGFFFHIGPGPGFPGQKSRKIQCHEKSKMPKNDLDLDLDPTKIQAWIQDQAEIKSKAYCITDSFSIVPLRYVTEMIGDLFTSIFMIIFSFILKS

SEQ ID NO: 147939 - protein, 174 aa, Heterodera glycines
  Coding regions on vcDNA: vcDNA=SeqID_74362; Strand=-; Position=1 -60,1396-1497,2595-2726,2772-3002
MKLLNKIEQLRNCKNETIDTEAVAIERNKFDWKIGNALVKLAAIEETLKSRAAKKRKEEAFTIPDKLRLKDGEDIVLYDSRTVRIGEKDVVLVFGSERTLDILSKNSATWHLDGTFKAAPNMWEQCFVVGASVNHRMCIGVWGLLPGKHRRYYEEVLNFLRNRISPVAPRKGEN

SEQ ID NO: 147940 - protein, 333 aa, Heterodera glycines
  Coding regions on vcDNA: vcDNA=SeqID_74363; Strand=-; Position=1 -90,1619-1699,1753-1915,2112-2244,2310-2477,3025-3226,3672-3836
MTHRTQHELMCDNNDLFLDNKSEKNAEMGEPFVVRRWHLEIVQWQKWDNFGGKWLHKAPHLLPKRNGQKQKNRKTFWGGQRNNWQIEICGMCRRDCRRPMARSDHFQAPRRNAEPLGNELQEALSSAAFLDDFMPFVLAFEFGTKFCAENGGTNKFALQRHRLLAQPNPMAKQQQQLQSRQPPKNKHFRFNHFPNLCPILALIVRKLFSPWRHAELNACYKSMNPVVPSNNAIAKLCQDHLNESNAAGFAVQICIHRDEMEQKLVFETFLNLSTTDKLYAIGIGTVLNDIKAENFAKMIHLVPPVADRMKAFFQIPTPNFNKLISAQKPYEND

SEQ ID NO: 147941 - protein, 108 aa, Heterodera glycines
  Coding regions on vcDNA: vcDNA=SeqID_74364; Strand=+; Position=1 -97,673-902
MQRRINECQQTRKKKVTFRETVEEINGTTTEIVHMETSSHGNRRQSSDISTSIRELQQLHEIVLSIQNLAAPNSRRRHYSSADDGEHGEASVAIHQLQQATQQLQQVG

SEQ ID NO: 147942 - protein, 198 aa, Heterodera glycines
  Coding regions on vcDNA: vcDNA=SeqID_74365; Strand=+; Position=1 -99,274-379,649-739,1212-1512
  Homolog annotation: Hit_ID=CAC21848.1; Match level="QueryCoverage =79%, HitCoverage=63%, E-value=2e-12, Identity=36%"; Hit description =hypothetical protein [Globodera rostochiensis]
MRKNGNYQNVCRNAFHFTPSPITCDQRVQQKDGLFAIHLKNCWDKYACHIGLKILGTQFLKVQKTDQSVGWSSVFATCCVPAESAGIFYFEVRIFHVLSCFTIGLATKQMPLAPQFALPAHNASSAAASAPGGTTHLFGGNDHFLLMISMSSIKPTQQGSTTTNTTTTGFACGDIVGFGIELANRRIFVTKNGRRLGE

SEQ ID NO: 147943 - protein, 46 aa, Heterodera glycines
  Coding regions on vcDNA: vcDNA=SeqID_74366; Strand=+; Position=1-139
MVVETQEQLNIDHHPSAFHRVGSATVAPQPPAAVVETNVVAGTMPT

SEQ ID NO: 147944 - protein, 248 aa, Heterodera glycines
  Coding regions on vcDNA: vcDNA=SeqID_74367; Strand=-; Position=1 -51,280-432,508-646,777-1109,1900-1970
  Homolog annotation: Hit_ID=BAB55143.1; Match level="QueryCoverage =44%, HitCoverage=36%, E-value=5e-14, Identity=38%"; Hit description =unnamed protein product [Homo sapiens]
MYNKLRILRPINCCCLINFANCCLAYIGKNADTLLKSDAFLQIDQKLLCEILECDELQIRGEISIWNAALRWADEKCRENGIDCSAENRRQMLGPALFKIRFPLLSNEEFTKKIVPFGVLSKDEVIAVYQFKSLPNCHGISDGIFPMPFSTNGRISDRKKGTLLLDIEKVSEFAREEVESSRYSEKVYINGLPWKIVAEISQLTESTDNIEKCLDFSLWCDASEEVKLLTNFVQKMNYNWLIYGLMAI

SEQ ID NO: 147945 - protein, 78 aa, Heterodera glycines
  Coding regions on vcDNA: vcDNA=SeqID_74368; Strand=-; Position=1 -66,1427-1597
MNVMKTGEEQDITNFKLGKTQKAQCNRLKEANETLQEANEKQKEEIGELQKQLDAIFQTMLSRAEAEQRGGEKEDPPE

SEQ ID NO: 147946 - protein, 70 aa, Heterodera glycines
  Coding regions on vcDNA: vcDNA=SeqID_74369; Strand=+; Position=1 -84,259-387
PNSVTVRWKYCTNVRRVAKKRTEIMSASKRMTMNNFELVEHKYDVMSNVWMGNYYKTSDEWTNDLIRRLL

SEQ ID NO: 147947 - protein, 700 aa, Heterodera glycines
  Coding regions on vcDNA: vcDNA=SeqID_74370; Strand=-; Position=1-2100
  Homolog annotation: Hit_ID=XP_550305.1; Match level="QueryCoverage =69%, HitCoverage=27%, E-value=6e-20, Identity=22%"; Hit description =helicase-like protein [Oryza sativa (japonica cultivar-group)] dbj|BAD68127.1| helicase-like protein [Ory
MNNRTFVLPDLSINYEKKRILWHINELYGSDNVPYHPREGVPTPCPIVYRHTDETQSTSKAAELMEVDEHDDIMIIEPQTRGQAVDAILTQAQVAGENQADTLGLVSESCIPQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSSICCRKGRVVLPMLNPHPDELKQLIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQNQEELRFFRMTLLDSRRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDSEAESDNESCETQSIASSDVGSVADSDAESVASVSSPHRRIDKSKQFISLRDYCKYYLAIRDENVELQYHHILSCGGGLGQRWILDQAAKIDWQIATFLRRPDMDLRISTPKNLLQYLVNQYNGQQARQNPNAQQKTVDDIGSVVRLSEHNVNSLQYWKKMYEDCNTVFARCHDAKKARLFITFTNNREWPEFKENLHKNDK

SEQ ID NO: 147948 - protein, 124 aa, Heterodera glycines
  Coding regions on vcDNA: vcDNA=SeqID_74371; Strand=+; Position=1-375
MGGGKGKTVKKVSETEQHEKEKVKCAEDVISLDSGEFYDDQAILYSPKAQFDRFGFWDSCVNTEAKRDLKELKEKEKIVKSELDTPSIEKWGIRVQKLREHEKKTKEARSTPMPFKNSRKGTHG

SEQ ID NO: 147949 - protein, 27 aa, Heterodera glycines
  Coding regions on vcDNA: vcDNA=SeqID_74372; Strand=-; Position=1 -37,393-439
MTFQIKNLISNRASDKQEFVAFYRQKD

SEQ ID NO: 147950 - protein, 290 aa, Heterodera glycines
  Coding regions on vcDNA: vcDNA=SeqID_74373; Strand=+; Position=1-871
MDNSRQNSLNHMYPNLFGSGGNSSSGNLGQGQNLYSTQSSSVGQYGTAPLQQYQPMPSSLGQGAATSGDMLHNVQMMATNNQQIGTSGSGSYNYFKDQKDLFDEVNPFASPNASFAHTHQEVVQQQQQPQTQTPSLNAMVQQQSQQKQKLKKKTTIKQQSTLATGQMGNLSINESNTASSHTAVPVPLSSQANQPSIQTSPLQHTGGRTSFQNLPPGGNQQSHPQMLAHSPLGNMAGSTSMGHASAGPIQGGQHPLGNMAGKASIGQASALPAQTGHIGLSPLGQAAGNN

SEQ ID NO: 147951 - protein, 174 aa, Heterodera glycines
  Coding regions on vcDNA: vcDNA=SeqID_74374; Strand=+; Position=1 -225,269-568
MTGSGPIQFGLHSPQPSTPTIPLSEESSLQLIPRWEQDIVCPPRFPISFWNVYTRAQMAIERTNNGMEAAHGQFARELNHHPSLSDFIAAFTKDINKQLDIGRAEQLQKSTKRRQRYVIKEQNVVRILDEADFESEEGLTNASHLIGLVMQVFAEGLHVRGNSESGEETEADEN

SEQ ID NO: 147952 - protein, 27 aa, Heterodera glycines
  Coding regions on vcDNA: vcDNA=SeqID_74375; Strand=-; Position=1-81
MAAQNKGNMAEIGIRFGLLMNLLLDTL

SEQ ID NO: 147953 - protein, 35 aa, Heterodera glycines
  Coding regions on vcDNA: vcDNA=SeqID_74376; Strand=+; Position=1-106
LANHGSFALFHFTRMGFRVAKCAQNVGTVKRRGQK

SEQ ID NO: 147954 - protein, 36 aa, Heterodera glycines
  Coding regions on vcDNA: vcDNA=SeqID_74377; Strand=-; Position=1-225
INFLVCFTLNVYQYSTLLVWKWPKCLSRELAVGNWR

SEQ ID NO: 147955 - protein, 73 aa, Heterodera glycines
  Coding regions on vcDNA: vcDNA=SeqID_74378; Strand=+; Position=1-222
MERIENWHQILEGKMKEERDDDEEERIDWKKKGTNKRRWKKRRRMINEEEDERELEERMEEKRKSSTADRCIK

SEQ ID NO: 147956 - protein, 88 aa, Heterodera glycines
  Coding regions on vcDNA: vcDNA=SeqID_74379; Strand=+; Position=1-264
MLSMEMVATEEDGEGQQLQQMEEEDNDNADILTHYIKPERNLWLLKRRPTVGGGKWQKQWAQWEAEAIGWNWTNAWNVIEVANEEDVD

SEQ ID NO: 147957 - protein, 227 aa, Heterodera glycines
  misc_feature (211)..(211): Xaa can be any naturally occurring amino acid
  Coding regions on vcDNA: vcDNA=SeqID_74380; Strand=+; Position=1 -236,716-923,1077-1321
  Homolog annotation: Hit_ID=NP_497751.1; Match level="QueryCoverage =85%, HitCoverage=32%, E-value=5e-57, Identity=55%"; Hit description =2OG-Fe oxygenase superfamily (67.4 kD) (3E801) [Caenorhabditis elegans] emb|CAB63431.2| Hypothetical prot
QFFFQKIRLVNVYEPGHGIPLHLDAHSAFEEPIYSLSLLSDVVMEFRDCANSARRASAHLPRRSILSLRGDVRYRHKHGILTRQYDVHPSSNRLLKRQRRISITFRTVRRVPCQCPYVEFCDWDRAGRLRIPSEECDGRQMEQRYVTKVYDAIAPHFDLTRHSNWHCVVAFLASLPSGASLLDVGCGNKYLHSDALDKVGHDILFFIPLPXLRHFCKWILLRIGYFF

SEQ ID NO: 147958 - protein, 253 aa, Heterodera glycines
  Coding regions on vcDNA: vcDNA=SeqID_74381; Strand=+; Position=1 -102,160-255,426-535,804-964,1171-1327,1376-1511
  Homolog annotation: Hit_ID=NP_496822.2; Match level="QueryCoverage =94%, HitCoverage=27%, E-value=2e-70, Identity=55%"; Hit description =TOPRIM and DNA topoisomerase I (2N691) [Caenorhabditis elegans] emb|CAB60424.2| Hypothetical protein Y48C
TDYVMYVLIVAEKPTIAEEIAKILSNGNYKKLRGWNSHTFVFECLGKFYQQIVTFRITSTFGHIMNTSFPQKFTSWHREEPKALFKCPIEPRVANPMHNLNEFLAAEAANCEFILLWLDCDREGENICFEVIDAVRKEMCRAKGLTEEEFMDRVFRARFSSITAKEIKRAMADLGKPNFSVSQSVLVRQELDLRIGCAFTRFLTTHFRRGYCDFDDNYVSLGPCQTPTLAFCVRRHDAIGQFKPHAVLGGASR

SEQ ID NO: 147959 - protein, 81 aa, Heterodera glycines
  Coding regions on vcDNA: vcDNA=SeqID_74382; Strand=+; Position=1-243
MCCILLNIHHDGDSDDNQLDELYADHQLVQIHANGNNDHPENDNLYDNNNTDKSKIIDHDKELRDQSPELTKVPELNGGEL

SEQ ID NO: 147960 - protein, 143 aa, Heterodera glycines
  Coding regions on vcDNA: vcDNA=SeqID_74383; Strand=+; Position=1 -118,158-473
PELGAYGRVDAWIRNRIQNNGLQGRSASFPQEMWNMSERVEQNLMRTNNSIEGWHRSFNSQFRFLHPPLSYFVKKMKEEDRHWNLIKQDYNNNPQNGMRGRGMARKNIYVQQDQAIRAIFLDRHNRPFLAYLRAIAYRMPEPN

SEQ ID NO: 147961 - protein, 119 aa, Heterodera glycines
  Coding regions on vcDNA: vcDNA=SeqID_74384; Strand=-; Position=1-360
  Homolog annotation: Hit_ID=EAA17085.1; Match level="QueryCoverage =69%, HitCoverage=33%, E-value=4e-10, Identity=40%"; Hit description =STARP antigen [Plasmodium yoelii yoelii]
MGGKERKREEKKEQKLKRKKKIAAEHHQKRLPDNPTVDNSTVDNPTVDNPTVDNSTVDNPTVGQSDSEDNPTEVDNPTVGQSDSEDNPTEVDNPTVGQSDSEDNPTEVDNPTVDNPILQ

SEQ ID NO: 147962 - protein, 84 aa, Heterodera glycines
  Coding regions on vcDNA: vcDNA=SeqID_74385; Strand=+; Position=1 -37,430-647
MNGSDLCFSEAETVQQQQQILMGNEMKMDNSKNGETREEEGNSIGEGGETEEKERKRKNSAEGRGERGKNEAEKRKEQQQIDTF

SEQ ID NO: 147963 - protein, 166 aa, Heterodera glycines
  Coding regions on vcDNA: vcDNA=SeqID_74386; Strand=-; Position=1 -64,123-214,318-383,437-539,630-671,754-885
MSFLTNSINYGDAFTQAAANGEVNGDAINLDNDGQLFDGKNSESITDQQQLKEFREKFARMEMELEMAKLELETKTLEQKLKQQQELIGEQKALKEKLAKIEQEKEKNDAKYLTVHHREKEKAIIPNLSTSEEMSVLIARIAELNRANTAEPSIASSADLFGQDGN

SEQ ID NO: 147964 - protein, 143 aa, Heterodera glycines
  Coding regions on vcDNA: vcDNA=SeqID_74387; Strand=-; Position=1-432
MNYTGRLKHDGSRTRPRFDPNIWSVYTRTLQGDDRTNNHSEAANRRLQCAFACSHPSIWHFIDLLRMDQKLSDDDFAKCSTGQDPPQKAKKYREADRRILTMVQNYLPLNNGDPNVFPLEQRFNHLFIITFLIGISRNYEMRP

SEQ ID NO: 147965 - protein, 532 aa, Heterodera glycines
  Coding regions on vcDNA: vcDNA=SeqID_74388; Strand=+; Position=1 -110,176-483,557-760,828-1003,1339-2139
MASKQPEFATVVPPIAESGFSNIHWLLLEWTADMVMNRIVGLVVLAGPFTTQSDINGFDVRLIFDQQNMDHELAMHGWQECVARMNNISPGQIVEFTRLKVREQGRNGNVKGSFPFTLLYNGESRHRVLGQAPTAVTNAVCSPNFNTPIIVEANDQHQHSSSNGTIIGGGDRDGNDLNNPSNNDSADNDALPAQLTNRPDQVNISDIGDEQRLRIQSNNEDAEDDDFDRAGHSGGGSSTMSNGALFSAMAAPGTVVVRNEDSGSSSAWLSAARPPPRSRPVASTSPSPSPRPNSPSLPGRSSPPPVRACSLTAQRTMTAIVQRMNVIEAEVARDERLSRERDRRRRRRRQLLQDCPRSTPRSSRGQHSGQQQHQQQRHENVITIESDGEEAALLGVQQQQPLASDDEVYYNDELLTIEDQVAQGLVEGAANEVVMMGNHPLAAADRAWLISTAFNLRALPSSVKGVVELDEEGRRNLACCICREWLVGGSQRVVRPSCDHFLHVGCFEAEAKLRRVCPLCAGHFISGKRMSP

SEQ ID NO: 147966 - protein, 379 aa, Heterodera glycines
  misc_feature (228)..(228): Xaa can be any naturally occurring amino acid
  Coding regions on vcDNA: vcDNA=SeqID_74389; Strand=+; Position=1 -43,442-567,655-972,1026-1186,1267-1511,1654-1822
  Homolog annotation: Hit_ID=NP_493130.1; Match level="QueryCoverage =98%, HitCoverage=46%, E-value=6e-48, Identity=33%"; Hit description =glycosyl transferase, family 14 (1M951) [Caenorhabditis elegans] emb|CAB03539.1| Hypothetical protein T09
PAQKRQLTDQSPATPRMKCERVFSGDKALVRRMVRRRRKMSDPAELEMNCEAIKARIYTIYTVSDQSTGPLSQPLTFPKDYLFLEAELLVNYASNNWYCYVLDSKSSTVFQLRMRQLASCFDNVIVVDQMFDIEGLGANMNKAVMECVRTLSDERNWKYLVTLQNHDVQAKTNAEMAQINHDVQAKTNAEMAQIFTWLGGANDVEVELQLTDEEAFGTLPKKVQLDFXRTNADKEGKPLALALSKDKEGKPLALALSKGYMAVSLSRQFVDFVVNKLNVTPLLEQLNKGLFGVDEHFWQSLSSSESLDAPGGFPHECFVKGIDEKDTDRFALWADPSSKCRSGNWRHAVCVFGLEDFNEIRRLPHLFVNKLMQEFDFDA

SEQ ID NO: 147967 - protein, 36 aa, Heterodera glycines
  Coding regions on vcDNA: vcDNA=SeqID_74390; Strand=-; Position=1-108
MAFDQMDCDDEKLLDFEEETPVNESVKSLTKEEEEK

SEQ ID NO: 147968 - protein, 721 aa, Heterodera glycines
  Coding regions on vcDNA: vcDNA=SeqID_74391; Strand=-; Position=1 -1433,1568-2300
  Homolog annotation: Hit_ID=NP_704325.1; Match level="QueryCoverage =35%, HitCoverage=21%, E-value=8e-10, Identity=23%"; Hit description =hypothetical protein [Plasmodium falciparum 3D7] emb|CAD51144.1| hypothetical protein [Plasmodium falcipa
MESTGFQQRYNFRVRRPINYMEQEESSHSRHSRRNGTEQNNGLNLAPQNILDNVQNPNPFPRNFENSIPQQVGMQQNVEEQMQLAMFRPPNQNAVQSFGNPRAHSTPQNGSPHISYNGGQQNFEQNQNRNPDANRFGNEIHGQNMQFHRRQNPRIFVNSQMTNNHQFSAINFEQNRELRAQPVRHAHNFGYEEMFGEQNQNFPNPNYGREIGVNHPIQNTRDFGNGPNFQNFHPVRNINQPNYQQRPNPNFENLAPQPNHFPNVQNFEFVPQQNFQQNQIPDIVMELHKVTLSNQYANTLREIPNLYGTEGRDKIKDFFLNVQMCAGEWRPEKQKELLQTKLKGKALKAYHIALNKFGNEATFGILKTEIMSILRETDYKEANAFSELTQNGKRKPNEDIIKFGERIQRLVNCSYIGLDENQLDEVSKKHFISNINDVNLARFLECQTKANQTFDELLMMANRLSLIEDEKTGKETNQPNRQSGFRNEAFRQENQNFPSNRNFDFQNRNYIPTSQNTQNFEATGANRTPLFQSNKRAQNKESNMIMVKEVIPENSDSKTVSLNHVGHGEIPTYEKFFNSLILHSNEFPSQNPANAECSESPTTEVNIVGMKAIGLIDSAAEINAANPKFLHKIANEKGVDLLKWGFCPNKGNSKLSFEVASFTGGKIPIIGVLNVPMRRGNFECEINCVVTNNSFPYDFVFGPKALNSLGYYIGNTLHTYK

SEQ ID NO: 147969 - protein, 112 aa, Heterodera glycines
  Coding regions on vcDNA: vcDNA=SeqID_74392; Strand=+; Position=1 -135,1373-1576
  Homolog annotation: Hit_ID=H89052; Match level="QueryCoverage=39%, HitCoverage=8%, E-value=2e-16, Identity=90%"; Hit description =protein C18C4.10 [imported] - Caenorhabditis elegans
MYDEVEKYYRRALEIYESKLGPDDSNVAKTKNNLSSAFLKQGKYKPGPHPSVQQSGAAGDDDAQLLAGGDQMSQSLITSVSMTPSQSSNKLKNRLLNVLGFSGEGAGGAPQQ

SEQ ID NO: 147970 - protein, 149 aa, Heterodera glycines
  misc_feature (40)..(40): Xaa can be any naturally occurring amino acid
  misc_feature (43)..(43): Xaa can be any naturally occurring amino acid
  Coding regions on vcDNA: vcDNA=SeqID_74393; Strand=+; Position=1 -114,171-360,415-561
  Homolog annotation: Hit_ID=NP_506424.2; Match level="QueryCoverage =86%, HitCoverage=23%, E-value=4e-28, Identity=41%"; Hit description =putative protein (60.9 kD) (5O309) [Caenorhabditis elegans] emb|CAB02126.2| Hypothetical protein F55B12.5
SRACRWNASFAWRRCECVSGARQVHKLCPARGQLRVAIKXHFXHSRLYSDVLLTGVDFKVYKGGMDGIMAGAIRKMVSFLIPRAIWPKIQQRLRLVVNYKGVQIPRLCSVEFNHLHLDYIAHAAIISGDFDVDLPLFIRSFKEFMDEKQ

SEQ ID NO: 147971 - protein, 87 aa, Heterodera glycines
  Coding regions on vcDNA: vcDNA=SeqID_74394; Strand=+; Position=1 -128,271-406
MLDDQAHLMQVLWREKEQLKKEVALMDEYLYMDPERDERNDMILTRPKRRYYDRVEDLPQNVVARWRKEREQFQPPTDPYAGKEDEE

SEQ ID NO: 147972 - protein, 83 aa, Heterodera glycines
  Coding regions on vcDNA: vcDNA=SeqID_74395; Strand=+; Position=1-249
MSSTIAPVSSADGTAGSAAAVASAGPSSVEPMPPVEQLMEGIEEKCPPSLDQRLNAMDEVDMRIDDLLTVVAEVMAGLDKDKP

SEQ ID NO: 147973 - protein, 104 aa, Heterodera glycines
  Coding regions on vcDNA: vcDNA=SeqID_74396; Strand=+; Position=1 -250,587-651
MTVIIIKLINLILISPFVLAICCRATVPPVFASICDDEQYPQVNGHCAAIKLTHFGSVQRWAFVGQSDGRPGTFKSRHPEFTLENLAKLLFLHHNLLLTGFSIE

SEQ ID NO: 147974 - protein, 425 aa, Heterodera glycines
  Coding regions on vcDNA: vcDNA=SeqID_74397; Strand=-; Position=1 -124,171-449,498-597,641-778,886-997,1046-1569
  Homolog annotation: Hit_ID=NP_492519.2; Match level="QueryCoverage =78%, HitCoverage=93%, E-value=9e-32, Identity=30%"; Hit description =inositol polyphosphate kinase (37.2 kD) (1K70) [Caenorhabditis elegans] emb|CAB03023.2| Hypothetical prot
MLPPKGLLSILGHVCKPFNHREFEFYSRMDAKLAPFTAKLCSKIKVQCLNQNVEDGTLMMSTEQIVNCHRHPPENVADLPTSIGCSFQKSIATASINANGKRKHSMTFRVKSGRVEAEKSVTANNWAWQCQSKVYCTEIAERTRQKLHTPRGFGQQIQPALCDRPENGHSSARRRRKRTKTTNANAKMPTVDKFRNWRPIGRMQLFDREVGEYIFMNKYEGRRMDRMQFIMRSFTFSKLLQEQGQCVLLRQELLKLRKTLLNAEGFRFFSSSLLIAFDGSGHKSKANEGVTVKMIDFAHSTFNGFLDDQPYSSTDDGYLLGMDSLLRILNVFQQNRLIVPIGGIKQSIELLAIGEKKKSGTKRKYSEEDEESRSSITSSMYTSDSCTGEEETEDCGGGCSTPEAPKTTENALNCGINDIPLVKLN

SEQ ID NO: 147975 - protein, 110 aa, Heterodera glycines
  Coding regions on vcDNA: vcDNA=SeqID_74398; Strand=-; Position=1 -99,1100-1152,1595-1658,1722-1838
MDICAAQQKWTFAPLSKVDTCVAPFAPRHLLRLSEATNYQQDQSSSNSNGGGGTPNNVVALPRTGGSYPATAIRQKREHTPMASAPFVGPLLPNVAAAADELSRHYSMWI

SEQ ID NO: 147976 - protein, 50 aa, Heterodera glycines; identical to SEQ ID NO: 128481
  Coding regions on vcDNA: vcDNA=SeqID_74399; Strand=-; Position=1-155

SEQ ID NO: 147977 - protein, 135 aa, Heterodera glycines
  Coding regions on vcDNA: vcDNA=SeqID_74400; Strand=+; Position=1-408
MELPSGGHRRTFGHCYSFLLICQCHYRRAVAHTVVVMLLSSSAFAAVAVNFGKMFLTIMMPRDDRGRPVIVVSFGAIAIPAAGDGPTCEATPVDDGHVIEKGKASQGQCQRDEHGTGGDQKLNDERNFLVKKCAT

SEQ ID NO: 147978 - protein, 35 aa, Heterodera glycines
  Coding regions on vcDNA: vcDNA=SeqID_74401; Strand=-; Position=1-105
MACPNICFTSGAIDLDTTKNESVCSMELAVYCFDV

SEQ ID NO: 147979 - protein, 206 aa, Heterodera glycines
  Coding regions on vcDNA: vcDNA=SeqID_74402; Strand=-; Position=1 -308,500-812
MAKIFLMGPQMICRFILAATIFTGVLLNFVAFASARHHHRHQVRAVPVEQQSAEKQQQRHQQQYFFDIDGPMLEGQQRHQRWRHNLRLLMTMQQQQHEQQRHGLPKYRREIDDTLLDDVEGSAENAYEGLIGENDGSIDELIGGQDNGNSDQRGGLGIAADADHDDGGDDDLPQWWRRSEHFATTAQQHRQQQTMSQSFLVSASDC

SEQ ID NO: 147980 - protein, 1159 aa, Heterodera glycines
  Coding regions on vcDNA: vcDNA=SeqID_74403; Strand=+; Position=1 -582,1201-2144,2189-2287,2349-2619,2700-3681,4283-4884
  Homolog annotation: Hit_ID=AAA93301.1; Match level="QueryCoverage =23%, HitCoverage=72%, E-value=2e-38, Identity=33%"; Hit description =HASI
MLISGPSGSGKSSFLVKSMLESSELIGPKPASILYAFGEMSSIVPTLQKCGISVYSGVPPEELIKRLPKPLLLILDDLLLSIDEAYLSALFTKKSHHQNFAVVFVTQNLFERRIKVARQNAQYLVLMRAPNSALAVRNIGVQLFPGKLDYFLSAYRIATNKPYGYLLIDMHAASNPLLRLRSGIFKEDEEDGEKITRGLKALIKRGDESDEEQVFDFGADGVQRPASQSRRRLRRHRHYNDDEEMPLMPPSPPLQVENRGQKRKANEFYFSWEEGAKRQSRHEDAPVPSSSKIANRQGRRKLPPVSWRREEEQIPADIQQEEPFQPAPQPSIPIHPQLNRKRKAQHALNDVRESKKSLIGLEELRPPSLQQEASLRFKQKRTSKSRVTLPQHSNSLALAKLRNPPRDLLAEAASAPLPDDDTHDFDLSQNPGVAAQVEPLPPGPPLPSKAKKRKSNKAEKENERKRIKIGSRKRDLLAEAASAPLPDDFELSQQPGTSDQVEPLPPGPPRIYRKKKKQNWFLKEIIFTKCYQKSAKKAKELGIPNSQLTNEQKRRRLQFVFNRKPAKYGVQGDTILNSAGNPITDSSVAQALDYIIERREGRIPQFRQPPGTKLIRDRINQDLILRTWTAPPRNETGESQGARRIDASVSNEGSQAEVDGPANSRNGNPNQKPASQATKMEKSIENVLERLYNDPKSPAAFAGVDRLWLEAKKELGNKIRKNDVKHYLEGHRTYTLMRPRRVNFLRARTTAAGFMTDCQVDLADFQALSRHNFGNRYLMVVIDVLSKRIYVTPLRTKKSDDMVEGFKRVFSTMPMKPHRIFSDKGTEFRNQQLKKLFDEEVEKYESAHSEKKAALAERAIRQIKNRVYRYFAQTKTLNWVDVIDQIVDGINKSPSRVHGMRPIDVNFKNSQQIWEKMFGEDQHRALFGKHRKRAKFVPGQTVRMSIAKGQFEKGYIPNYATLKNHAESLESIIKDNTPIRRKRGAVEPTTPPSARIVPKSPPNVTKKVIVPTSPPRVGQEHQENTEEISDSLTNVTKPPEKQPKIEKQPEVVKPKNEQINQTENISHQNAPSPKPPPPASIPTTKKHEELKSTIDPTPSVSKPPPPLPVSNPVNQNKNVSINQSVSQKITIPNENGILVVDDGICLLFSVRVSTYSLLC

SEQ ID NO: 147981 - protein, 123 aa, Heterodera glycines
  Coding regions on vcDNA: vcDNA=SeqID_74404; Strand=+; Position=1 -84,130-417
MVLVFRELFMEGLNPSMIRKGNRLFEMKVKSRKNLNPNVTFRDSWNLIPGPLASMGPMFGLDVQDKPFFPHMANKPDNYGCQIFPSKADYLADGMNPEKRKQFDQWYQQNKNIPFLLDESLAR

SEQ ID NO: 147982 - protein, 102 aa, Heterodera glycines
  Coding regions on vcDNA: vcDNA=SeqID_74405; Strand=-; Position=1 -103,625-830
MGAHAEQKWTTETIVLRRFGGRRKKRQLGQQFQGVHTSIEPFEAVNERTKEKLTLGKVPSPAFYWLLKRCPISEKAAAVTLEYDEFWDDNLNSVTIDHTIGI

SEQ ID NO: 147983 - protein, 163 aa, Heterodera glycines
  Coding regions on vcDNA: vcDNA=SeqID_74406; Strand=-; Position=1 -178,769-897,968-1152
MNTYATTGEFEGPFAGRSFAFAVRKRSPKKLCGAKKPNKHLRKGDCGKIGVIGGSPDYTEFVRLYTQMFPNQQKGEETDKLKIQCEMAEQLAKHLEVTVMRKGEIDIISNGSAAQTRIVQAETSMRRCGGQGDILSGATALRILGKESLRCRHLFLRAFAGRG

SEQ ID NO: 147984 - protein, 210 aa, Heterodera glycines
  Coding regions on vcDNA: vcDNA=SeqID_74407; Strand=+; Position=1 -57,617-793,1075-1206,1266-1332,1570-1769
  Homolog annotation: Hit_ID=NP_497802.2; Match level="QueryCoverage =64%, HitCoverage=51%, E-value=1e-17, Identity=37%"; Hit description =putative N-myristoylated protein (28.3 kD) (3F80) [Caenorhabditis elegans] emb|CAA84649.2| Hypothetical p
MPQKQRRCSLIVKYRQLIQLQSLANEFGARFVDLRLLGFKADFFAVLADSTTMECVLLDAAVHPANVTLNAFSQFITMLFSAVRDGFYTEMRRLRRTSNSFTINPNAPNTMMKKLSVDDNMKVSRALQGARSISPSPELETCQKSAHSSPIGHGSQESITDRQSQQNNNNGTNSRKISPESLQAKEEIRLLTAEFMGRAMVVGGKECQRD

SEQ ID NO: 147985 - protein, 73 aa, Heterodera glycines
  Coding regions on vcDNA: vcDNA=SeqID_74408; Strand=-; Position=1 -139,252-334
MNIYLYSIIISIGIHSAVVAAQFEEQWVNACKEILVKIKSSAEKAEKCDGELKGNLTELEQKVKEMHFFVPSK

SEQ ID NO: 147986 - protein, 52 aa, Heterodera glycines
  Coding regions on vcDNA: vcDNA=SeqID_74409; Strand=+; Position=1 -54,243-347
MIFHACFLFKKKLTMLYKAYDVNDVESLPFPLKYNICVNMYASIFLLHRLMT

SEQ ID NO: 147987 - protein, 140 aa, Heterodera glycines
  Coding regions on vcDNA: vcDNA=SeqID_74410; Strand=+; Position=1-423
MAQQFDRNHGTKAIEFLPTDPVLLLNYRLGKSHWLPGTIVERLNNSPTYRVHVPTLGRIVHRHANQLRRRLDFEDNSNWEPPIQEQMAIEPNQRTPPRQHAAIDQRTPPVVDQARQKAKSPIGVRRSQRVPKPVKRFTPG

SEQ ID NO: 147988 - protein, 421 aa, Heterodera glycines
  Coding regions on vcDNA: vcDNA=SeqID_74411; Strand=+; Position=1-1266
MGEAPDQRVEAVQEEELGAVAGTEAEGQPGEDNNAPRGLSGSEGEKTVEAEEVAQDEAEEGPIPPSFVQNEVGSTSPASQTNEQIRETVNQKTEAEKADSPEGSNSMREVEPRRSRRVRRTREVWSPDRCATKRRGIGGPLVSLAMMIMLVYPTLTSGCQPTIRPEIVGQQSQELPTTMLPCHMRCTERGVKVLSGQRLEKMEICCPDGCWAIVPISTEISYELPTELLVHDYHCSGQCWRGSGPPYNITQRCPARAECDLINCSFCWEQLANPTCNPRWASSLFGFGAAILLAIISCFCSIFGRFLSGAKLLSKAVAWGVRYPIGLINWATGRDFRKPTTEQIERKVRKGARKARTEIRELQQQLQLGRRARAMARAWQNPDGTRKAFPAKAVAALIPLLLIIDPAFLQFSPYNPSTSRI

SEQ ID NO: 147989 - protein, 67 aa, Heterodera glycines
  Coding regions on vcDNA: vcDNA=SeqID_74412; Strand=-; Position=1 -65,167-305
MIFALNCGLMAIFVLLLIAFLLHSSIFIKYKFSYLLGLLFICVMYGALIQYFVVDYAFENAGKYDAI

SEQ ID NO: 147990 - protein, 62 aa, Heterodera glycines
  Coding regions on vcDNA: vcDNA=SeqID_74413; Strand=-; Position=1 -33,149-304
MPSINTSSDNAPYLAYRFVGPSADLIVPAVALYLVAFVGIVMHGTVLVVTVKSRQMPLAFLF

SEQ ID NO: 147991 - protein, 53 aa, Heterodera glycines
  Coding regions on vcDNA: vcDNA=SeqID_74414; Strand=+; Position=1 -76,497-583
TFENFSQVLIGYLASGSTIYYPWRTNSESMVCNVTLSEQMFMLFIKILNYFKG

SEQ ID NO: 147992 - protein, 19 aa, Heterodera glycines
  Coding regions on vcDNA: vcDNA=SeqID_74415; Strand=+; Position=1 -20,303-342
MFQAIFCLCDSLFIGIISY

SEQ ID NO: 147993 - protein, 69 aa, Heterodera glycines
  Coding regions on vcDNA: vcDNA=SeqID_74416; Strand=+; Position=1 -101,961-1069
MAISAHFSEETAQSSLHALQRLEDAVAQSLRGALALKWHLTRTRVTINPIIKYPVKELFCHYSEKCFRA

SEQ ID NO: 147994 - protein, 58 aa, Heterodera glycines; identical to SEQ ID NO: 128482
  Coding regions on vcDNA: vcDNA=SeqID_74417; Strand=-; Position=1-320

SEQ ID NO: 147995 - protein, 85 aa, Heterodera glycines
  Coding regions on vcDNA: vcDNA=SeqID_74418; Strand=+; Position=1 -96,137-298
  Homolog annotation: Hit_ID=NP_476760.1; Match level="QueryCoverage =98%, HitCoverage=5%, E-value=2e-29, Identity=72%"; Hit description =CG10223-PA [Drosophila melanogaster] gb|AAF53802.2| CG10223-PA [Drosophila melanogaster] emb|CAA43523.1| D
MSIEATYKKVSQLEHVLLRPDTYIGSVEYTKMASWVYDSEDDKLVFREISFVPGLYKIFDEILVNAADNKQRDPKMNLIKVDIDK

SEQ ID NO: 147996 - protein, 122 aa, Heterodera glycines
  Coding regions on vcDNA: vcDNA=SeqID_74419; Strand=+; Position=1 -155,202-416
PTSDDFIIRRTVAEQCGGVHVVHIVDCAVSAIKVDELQLEFVLLEIGPQLAQQFLCSADRRSERPRNANAHHGQIGIGSAGSEDQIEGFVWVLQVGVGTAQFVQLDSLKMDKARQRFIPLEK

SEQ ID NO: 147997 - protein, 280 aa, Heterodera glycines
  Coding regions on vcDNA: vcDNA=SeqID_74420; Strand=-; Position=1 -332,383-465,573-760,825-1127
  Homolog annotation: Hit_ID=CAE59012.1; Match level="QueryCoverage =60%, HitCoverage=65%, E-value=2e-17, Identity=34%"; Hit description =Hypothetical protein CBG02288 [Caenorhabditis briggsae]
MLFPFRFVLSIRIGAALPHSFCSFSDAFPSSGDRILIRRENFNRNKPRLLKRNEKSLLAENRQGIPTATDCATLVLFCQLGSPSAEERCVLFTQRAKRMKHHANEISFPGGRIEQGESVETAAIREAEEEIGLDRNDVELWGTLRPLFFGEAGVVTPVVATIGQNVEQRLASLRCADAEVQNIFMASVSDLLARIHYTTFRFSGKPSDDKMPFFFRMPIFHSTKPRLLCNSSLVNCPEKFRIWGLTARTLLEALNAFLPEDAKEREASELLRKGKTDNSC

SEQ ID NO: 147998 - protein, 222 aa, Heterodera glycines
  Coding regions on vcDNA: vcDNA=SeqID_74421; Strand=+; Position=1 -102,635-1051,1124-1273
MRSPINEFKILFINILVLYFFHSLTWFVYFLRYRWLASLLYLACIVGLALADPQISGHPQGVVYLTSDYNANLIFWAMLFTMLLVVATALCDWRIYLLNKRLNRVGNGPSTEYNLSLKYQINENTLSLMLIFPLDLLYALIYPIYNVIVLVLRAYRQMLSTANYVSYYHMANTLLFLHSLVTLVVYIRFIKYVSRVRKPSIVKSQPNEEANIHFKQLQAQWK

SEQ ID NO: 147999 - protein, 94 aa, Heterodera glycines
  Coding regions on vcDNA: vcDNA=SeqID_74422; Strand=+; Position=1 -30,261-515
MNGQKEAFGISSPENDKKKLEEKQTKSTKCYHQLVNYHQSAQTMKEEEEEEVVQLYFEAKQSKKRKIQWPKNTVKRQHNLRKDQTNTTTHSLSN

SEQ ID NO: 148000 - protein, 102 aa, Heterodera glycines
  Coding regions on vcDNA: vcDNA=SeqID_74423; Strand=-; Position=1 -159,213-299,1887-1949
  Homolog annotation: Hit_ID=AAB94996.2; Match level="QueryCoverage =81%, HitCoverage=15%, E-value=1e-12, Identity=40%"; Hit description =Amino acid transporter protein 7 [Caenorhabditis elegans]
MAIQTLTFGEYFFDGLRPFWPSLEQSETMAFVLKRLIGYLAIWLICFINLFSLQKIAARFQVILTVLKLLVIALIILTGLYQLFALIVLSFICDLENLIGYM

SEQ ID NO: 148001 - protein, 22 aa, Heterodera glycines
  Coding regions on vcDNA: vcDNA=SeqID_74424; Strand=+; Position=1 -45,274-297
MKELIVLYFYGHPKNRICRATF

SEQ ID NO: 148002 - protein, 130 aa, Heterodera glycines
  Coding regions on vcDNA: vcDNA=SeqID_74425; Strand=+; Position=1 -215,513-622,922-989
  Homolog annotation: Hit_ID=AAG23825.1; Match level="QueryCoverage =83%, HitCoverage=9%, E-value=3e-58, Identity=100%"; Hit description =guanylyl cyclase [Heterodera glycines]
MPGNSVQQFTTPSAPVANNQTVIKVAMLVAQNDTDFGLPRKNSMLRNAGGAIPMALEQLWADEVLPKSVNFSFEWVYEKCNEATAMGLTYQFIHDFGADAIIPTTCMEVVLSRPDANPDPDFFKNQGFIN

SEQ ID NO: 148003 - protein, 272 aa, Heterodera glycines
  Coding regions on vcDNA: vcDNA=SeqID_74426; Strand=+; Position=1 -104,159-195,250-316,478-606,664-808,878-1008,1147-1191
  Homolog annotation: Hit_ID=AAG23825.1; Match level="QueryCoverage =97%, HitCoverage=18%, E-value=1e-102, Identity=74%"; Hit description= guanylyl cyclase [Heterodera glycines]
AFICFSICLLLFSKSFQFKNFVYIIPDNDMTLSFNLSLDPFWNLSLDPFWVQTSVNSNGLDGRDADAEVIGRVNSNGLDGRDADAEVIGRLAFWWHYDITLSALSNRNYYGFYGRVVNRTYGWPFYCPESECNTVANGSLNSVLLYDAIYNYGMALNGSLNSVLLYDAIYNYGMALNESFKQFGIRRETYRNGSLLAANNRRPFMGLTGYATVELTGYATVETDRNTRVFVLSNRKSDSKQSPLRILMQLAWTNGELNVAMRDGRSMMWFSL

SEQ ID NO: 148004 - protein, 243 aa, Heterodera glycines
  Coding regions on vcDNA: vcDNA=SeqID_74427; Strand=+; Position=1 -92,327-482,545-683,779-829,1329-1496,1556-1681
MVANAGIDASEAVMPLDQTDLLFAETLYEAWKQFGDKKAVILFVHNQPSHIKLDSRKVQYQLEKIATERIMCRFITLSEGLKRLKIDPNNFNLILDDKFVVGVVFDRLGGPITRAEAALNFSFERTTAIKTPPYVFAVAHTKKMQQKVYENPQDYVLKTNECGSPNQRMFFNDDIPKKLARMTPAEHNYFYIMEKLRPMVVKYSNRKICQPGFFMGWVFLGFCPGNQGPTWNTGPGFFTNTDL

SEQ ID NO: 148005 - protein, 256 aa, Heterodera glycines
  Coding regions on vcDNA: vcDNA=SeqID_74428; Strand=+; Position=1 -157,194-485,806-1064,1285-1347
  Homolog annotation: Hit_ID=EAL50144.1; Match level="QueryCoverage =89%, HitCoverage=26%, E-value=1e-09, Identity=24%"; Hit description =actin, putative [Entamoeba histolytica HM-1:IMSS]
MRRIIDAKRNLGEDLQKCRELKGKRKTEGEESSADEGDDDSDFVDVEEKEGPRYEPDFSHNDCNKSSDKKAKCAIILDERPGPSGLKVQKEKPKEDEEKGRKSDEINGKKRIPKLAMGLDLKYWGEEHIKPAERVRVQAEGHHFWRPMDEDEDENLQNSTDEADEQREESEAEFLQDLQEATGVKLTENSKKVKKKTTKRRKKKTTTKKKKGKRKKKKTARERPKPKSEKSRERLVLKIFVRIIFSFNREYNQSTK

SEQ ID NO: 148006 - protein, 79 aa, Heterodera glycines
  Coding regions on vcDNA: vcDNA=SeqID_74429; Strand=+; Position=1-617
TLIKHQHSFIISDQIEENQKLQFFPQFPASPHKKIFEGHSFVLSSFVHSTPKIHLICAHFTEETFVPKNCLLISQISNK

SEQ ID NO: 148007 - protein, 54 aa, Heterodera glycines
  Coding regions on vcDNA: vcDNA=SeqID_74430; Strand=-; Position=1 -83,132-213
MDQELTELAKIGQDGTGMDFALCIICILVIRATKLCQENLNLVVSKKGYDQSME

SEQ ID NO: 148008 - protein, 28 aa, Heterodera glycines
  Coding regions on vcDNA: vcDNA=SeqID_74431; Strand=+; Position=1 -39,364-411
MDFFFQSPPKPLQAHSMPKGVAISLVHQ

SEQ ID NO: 148009 - protein, 93 aa, Heterodera glycines
  Coding regions on vcDNA: vcDNA=SeqID_74432; Strand=+; Position=1-283
  Homolog annotation: Hit_ID=CAE65014.1; Match level="QueryCoverage =96%, HitCoverage=30%, E-value=7e-22, Identity=50%"; Hit description =Hypothetical protein CBG09852 [Caenorhabditis briggsae]
LWPTPKVDLSAVEPSFRAQLESLSWYSCVSDWATDKPSPFGAARSTRVCRCCCFPFRPNPKTLKCEHIPGAPEAPGEEQLEEDETERRSREWK

SEQ ID NO: 148010 - protein, 119 aa, Heterodera glycines
  Coding regions on vcDNA: vcDNA=SeqID_74433; Strand=-; Position=1 -24,999-1331
MVERKMALKEYQKALREVTDPTERDQIIAQMFAREPWYMRQLAPLCVSETQKAKLENLVGLREMRHILVNLKTQCYEKVTKSENTRGTQTEQSEEEEEEDEAEEQTKLTHTEQKEDGQK

SEQ ID NO: 148011 - protein, 316 aa, Heterodera glycines
  Coding regions on vcDNA: vcDNA=SeqID_74434; Strand=-; Position=1 -171,228-385,430-575,624-652,700-790,1166-1203,1434-1591
  Homolog annotation: Hit_ID=XP_218952.2; Match level="QueryCoverage =99%, HitCoverage=77%, E-value=1e-47, Identity=33%"; Hit description =similar to acyl CoA:monoacylglycerol acyltransferase 2 [Rattus norvegicus]
LLLYFCWFVWDFATPSRGSHFWPFFYNSPVWRHLATYFPISVIKTADLSADRNYLFSAHPHGIVGSSSFIFFAHPHGIVGSSSFIFFATNGANFASLFPGLRMHSVTLDLNFWFPLRREMIMASGMIPSDSKMIPSDSKSIEWVLSRPGGGFAVGIVPGGAAEALESFPGTNRLITSRRKGFVKLAIKHGKGFVKLAIKHGVAIVPVFHFGETDVYEQVAIVPVFHFGETDVYEQKESREGSTLKKTQAALFGIFPYRRKIVTIVGEPMEIEENANCEDEQTVDRIHAEYCQRLRKLFDENKVKLGGPEDSEIEFV

SEQ ID NO: 148012 - protein, 70 aa, Heterodera glycines
  Coding regions on vcDNA: vcDNA=SeqID_74435; Strand=+; Position=1 -60,164-316
MAISTHLTRQVPMERLNFGDRFNTEPIFAESAKMLISIAFIPIADLTEAVNVLDVAFRNFRTCNRCWILC

SEQ ID NO: 148013 - protein, 518 aa, Heterodera glycines
  misc_feature (5)..(5): Xaa can be any naturally occurring amino acid
  misc_feature (511)..(511): Xaa can be any naturally occurring amino acid
  Coding regions on vcDNA: vcDNA=SeqID_74436; Strand=-; Position=1 -31,198-257,318-485,530-590,1006-1106,1159-1275,1317-1453,1498 -1601,1783-1873,1928-2042,2104-2158,2243-2354,2782-2854
  Homolog annotation: Hit_ID=CAE62553.1; Match level="QueryCoverage =98%, HitCoverage=89%, E-value=3e-83, Identity=39%"; Hit description =Hypothetical protein CBG06663 [Caenorhabditis briggsae]
EYGYXKSKKKKQIFKVVLTGGPCAGKTTGQARLSSFFESIGWKVYTVPARLSSFFESIGWKVYTVPETASILLSPGRIRFPDLSRDQAAQFQIDLLKTLIQIENVFFNQAEVFFNQAELSEAEKIMIILDRGAMDGSAYIDMESWSDVLSACKVTNEQLRERYHQICHLVTAADGAQSFYQLICHLVTAADGAQSFYQLANNQARTESMDEAIQLDKKTKEAWVGHEYLSIVDNSSGSFDEKISKEAWVGHEYLSIVDNSSGSFDEKISKLIADVCERFGISISDRLAPNSKKRKWLVSSIDDSAFLKMKKEVFNSKKRKWLVSSIDDSAFLKMKKEVFVIEDAYLHMEGSTLQVRLRSRSQNGKYTYTHTTRTIEDADGKKVETRKQLDWHEYQIYLKLLVETRKQLDWHEYQIYLKLLDKDYQAIRKKRVCFLFGNVFNLDIYIAPLPPALMYNARLTFQTYTTRPIGDPEPRLPDFLEIDREITMESAYSIRSTKFKSMTNTKLSFDXARLYNSK

SEQ ID NO: 148014 - protein, 38 aa, Heterodera glycines
  Coding regions on vcDNA: vcDNA=SeqID_74437; Strand=-; Position=1 -57,339-398
MQMNKYLLMPKLNPNLNGCLNDFIFLPKFNFLLNITTI

SEQ ID NO: 148015 - protein, 24 aa, Heterodera glycines
  Coding regions on vcDNA: vcDNA=SeqID_74438; Strand=+; Position=1 -9,436-501
MTLLFIIFLKLLTPQINFLIELLI

SEQ ID NO: 148016 - protein, 1236 aa, Heterodera glycines
  Coding regions on vcDNA: vcDNA=SeqID_74439; Strand=-; Position=1-3710
  Homolog annotation: Hit_ID=CAA82797.1; Match level="QueryCoverage =46%, HitCoverage=75%, E-value=3e-14, Identity=21%"; Hit description =gag protein [Ascaris lumbricoides]
MQRLEFEDGSESNMDPANEGHRNGAQHDENVQDGDGPVASTNEEQQKVARVNEATRGSNMATGLATNQQGMLPFPSRNLRSVSIPVRTARDRIERASGTLVARIAEAREVIDQDLTEGEAGYQAARLLAMERGLKEATQIFQGHFEIGMAAAGAEPAGHQDFFYDILTAPLPAATKELQLRNHPTPAELLQIADEHIGDLRTMRLALEDEEEAIARSRLSGSFGTNNSHPVGDDPPPLENRNMEEWERSFQVAAKRWQNDGQGVLQHNRRPMGRVATPVMSNLDGIFQRRAKVPSVASMRVTNPAREWINRNRDEMGAFPPATAHRPALMQPKIEKQQAHVNDDYRERQTYPIRRHARDEGEHDRKHGRDEITGMTTFETVRLQPPTFSGKPEDWTTFWAYFKRAVDDKPIPGFEKQLHLLRCLKEGSPARRAVEVYPPSDGNYPVVVQLLKERFGDTDDLQRAIRARLLHLAPAKDNVNSLTTMIDEFERCVCQLEQLGANVDDDSFGPLLEAKLPVRVLTELRIRESMMGSKWSVREFRRAVAAQVRCMRSAESALAAMKDPEVRTDHKTERDQTGLDVQAGREPFQRAFMVRDSQPTRAQSNGTRSEERYGTNARFARRSITHANENESSGGNWPRVASNGPIATTEIWNCSLCLRSGHRPSKCQAYPTAQARRKRLIEQKRCLRCMSSDHLFKQCQRVNRCNAFRKDDHHWLLCWKSISGGQSRSFTEHERRAKNHATLISGMDRPTHFTEVRDEQNVRDGIETNAGEQRAFTTFGSRLPAQQMICRVIAAAEEGEDECQTTLLLDPGSHVDGADTELIQQLGPQPIDKRPLTVQVFGGKKQRIRSATYRLRLKRTDGKWESIEVSEVPQICTPIRTELIESGATPDSDPRTITQTTQPQIMIGIRKFWDYVIGFRKIESGAHVIDTVFGQVLCGEGTQASSGATPAASILTTMPCGNIHQTRTNKRQQIGEVRRNWKRKRKSRKNNSRGIVSRDRHNSPAELGPDRSGANEVITSREEPIGEMDPKQRKWPIGRIVETKGASEHNRNAMIRMANGRTRRRPIKKIWPLKEARPKTGETDDRADEAVHERLEEQRATETQSKMRDRNAPSAATENEKKEAKRKNIEKRGREVKAVQPDEKANRQIRNDNSRGNGPHDSDEKYGSATTTEKSAVFEKAAEVPSATQEEAGNSANPHSVQRHEKKYLGDSSMAPSLLNDRAKLQTNSTESQGGD

SEQ ID NO: 148017 - protein, 195 aa, Heterodera glycines
  Coding regions on vcDNA: vcDNA=SeqID_74440; Strand=+; Position=1-594
NARRGQQNLNLKGGLAFIPKQQQFGFSQRDSASGHIEPGSTFTLTMPNWGFDPFPLLRLLSTGQWLLIAVASGIIALAALFVFIKFNPHFRLYRSLAALAFVALIGKGEAVGTGFNSRLITNSDISSIHPTISSLRPTFSPKFSHFFTSLIYSKIVGPKTTGQQQKTAFPFINNSDLDKNLCPSNKRRATGDVYP

SEQ ID NO: 148018 - protein, 3078 aa, Heterodera glycines
  Coding regions on vcDNA: vcDNA=SeqID_74441; Strand=-; Position=1-9237
  Homolog annotation: Hit_ID=CAD32253.1; Match level="QueryCoverage =40%, HitCoverage=63%, E-value=1e-119, Identity=28%"; Hit description= gag-pol polyprotein precursor; hypothetical protein [Drosophila melanogaster]
MQRLEFEDGSESNMDPANEGHRNGAQHDENVQDGDGPVASTNEEQQKIARVNEATRGSNMATGVATNQQGMLPFPSRNLRSVSIPVRTARDRIERASGTLAARIAEAREVIDQDLTEGEAGYQAARLLAMERGLKEATQIFQGHFEIGMAAAGAEPAGHQDFFYDLLTAPLPAATKELQLRNHPTPAELLQIADEHIGDLRTMRQALEDEEEAIARSRLSGSFGTNNSHPVGDDPPPLENRNMEEWERSFQVAAKRWQNDGQGVPQHNRRPMGRVATPVMSNLDGIFQRRAKVPSVASMRVTNPAREWINRNRDEMGAFPPATAHRPALMQPKIEKHQAHVNDDYRERQTYPIRRHARDEGEHDRKHGRDEITGMTTFETVRLQPPTFSGKPEDWTTFWAYFKRAVDDKPIPGFEKQLHLLRCLKEGSPARRAVEVYPPSDGNYPVVVQLLKERFGDTDDLQRAIRARLLHLAPAKDNVNSLTTMIDEFERCVCQLEQLGANVDDDSFGPLLEAKLPVRVLTELRIRESMMGSKWSVREFRRAVAAQVRCMRSAESALAAMKDPEVRTDHRTERDQTGRGGKAGREPFQRAFMVRDNQQTRAQPNGTRKEEQYGMNARITGRTVARGNENGHKGGNGPRFTPNGPPPSCGRGNCSLCLKSGHRPSECRAYSTPQARRKRLIEQKRCLRCLGSDHSFEQCQRPVRCDTCRSDDHHWLMCWKNQPGNQSRPVGEPERKENNHAMLISGINQPTRFTAAREEQVNREVAEMNAGEQRAFTAFGSRVPAQQMIRKVTAAAEEGDDECLTTLLFDPGSHLDCAETELIQHLGPKPTERRPLTVQVFGGKKQRIRSATYRLRLKRIDGGWESIEVAEVPLICTPIRTELIESGAVPESDLRTVTQTTQPQLLIGIRKFWDFVTGFRKTESGTYIVDTVFGPILCGERFQVSSGATPASSVFMTLPCGEDERDQMPPIRAVEQFWSLEAIGIRDDPTDDADAQAVIQFERSVRQLNDGRYSLRLPWRECHPALPNNFSMAYRRLTTMLQRLQRTPEVLKQYTTVITDQLNAAIIEETTIGAGKREHFIPHQAVITPKKLRVVYDASAHTRGAPSLNDCLLRGPVWLPDLAGMLIRFRACRVPVIADVEKAFLMVGIEEDDRDVCKFLWVRDPFRPVTTDNLVTYRFRRLAFGLTPSPFCLAAVVRHHLRKYDSNFAEELIRDTYVDNVLIPADTAEEAAIKGREAKRMFADARMNLREFLSNDETLNSSFSDAEFLGKTTAKVLGLEWNAETDKIRMKYPGSEPGTPISTTRRTVLSSVASLFDPLGLVCPATLKAKLFFQKLWDDNHEWDTPLSREEAREWEHILASWEGESNVIPRGVTAGRGHPLQLHVFTDASEIAYAAAAYIRTGGESGCNSRLIMAKSRLKPKKAATTFTIPRMELMGILLGVRLAAFIEKQLHHPIAGQHIWSDSMIALHWVRTASAQPQFVANRLFEIRKATATTFHYIRTNENPADLATRGEVPTLLQHNDQWWNGPQWLRGPRTEWPSELEFQPDQEGLPSPAGQEEGQSAFIVRNEASTGLESEQFPSSLLTRCSKWSRVQRATAWMQRFIGIVKKRIKKRRGSEIGGPPIIETEKAVTRGSKGNLEIESRRIVGQGLHNVPAKFEPDRSGTNEVITPEAERIGEMDPNQRMIKIEGKHLASLRACELREATWALIRAVQGQGSMTGSVKTEPDHRGIQRLISRIGQCDEPGLSSPIILPRKSRAGALIIDGIHERLHHSGVDGTLAEFLRGWWSPSARQQVRKVIGQCRTCRRMQMGAYSLPPMPPLPADRVQRRLPFESVGLDYLGPTAISDENGQRRKSWVLLITCLTTRAIYIEATRDLTAQSFIMVLRRFIARRGAPSRIISDNAPTFTIVGKTLADFGITNADPISFADSKGIQWRFTPQHTPWAGGVFERAVQLVKRALQKTLSGTVLNYDALSTILAEIEATINSRPLTYVNSTAGDPLPLRPIDLIQENTRLAIEPPPEPQIQAVQREPPHLQLARQWRDSQQRLEHFWKRWHREYLLVLRDKAGWAHPARRVNAHGTPQIGDVVLIEDKFHPRNLWPIGRIVEIKGSNEHIRSVMIKMANGRIWGRPINKICPLEEAPPKMAEMDDQADQAVQERHRDDARAAETRREMRDRDAPSAATKDEGDESEESDEKRGQEVGAVQPDGRANREIREDSSREEGPNDSDGKNGGEMAPQKSAVFEKAAEVPSAAQGKAGTLAHLHSAQRHEKKYLGDSSMAPSLLKVPTKFQPNSTRSEGGDRFGADGPQAVRAGEIGGEFPEAPAVEQHQNELEQTPNKPVEEVHDGKDVREVQAVPGAEQRKSARTRRNREIWSPERHVPRKRGVIKPKTGMALLIMLISIVGTFGCQPSIRSSGMDPNLPFQEGPKMPCTMECAKRGVIIMSGRELNKLEICCADGCWATMPKSTDVNYELPAEELIHGYHCHGKCWWGNNAPFNTTRRCPAKSECDLIQCAICWEQFANPRCFPRWTMTMVGIGMAFLLAIMGCICPILGRFWSGAAALGKAIAWGAKYPIRLFNWATGRQISPPTAAQVEIKLKRGARKARTRVRELQQQLQLSRRARAAAHAWRQPERNQLTVRGTVAAGLLPLLLLIGTTFASKPLSVTVRSEDCARTAKGLQCAGTAATIITLLPADQVNSFVIRTQQDELLGTVRLRLASITMVCVPKTESWLRSYTISTVAVKRCPSAGSCRDNNCSTMNSRVMVPELNELNHRPGHSMCMSSTSFWHNSCGLPSASCLFYRWAAVPTSTTVFEEFSCIEWDLQLSAWIEIETNNGKIETQRLILHPGVPEKWGNMTIAVIPTSLPPMPILSAYFISDGRAMAMGKPISSDLHCSDEEAARGFDKCQLAIGSCQKCAPNHENGTVHCHCRNLEIERVLNNPEHRLPLDVGRLHVHNKGPTVQAEFQYTPVQVQIQLNELELVSEYSNTKCWVGSPQLSGCYRCISGATFEAMCRTDYGTALAKIKCADGTMFGLHCGGNGTTTTESIPFDRSEIFTECQVKCPAGTTKFKLKRGACFHP

SEQ ID NO: 148019 - protein, 219 aa, Heterodera glycines
  Coding regions on vcDNA: vcDNA=SeqID_74442; Strand=+; Position=1-657
  Homolog annotation: Hit_ID=NP_508324.1; Match level="QueryCoverage =94%, HitCoverage=7%, E-value=4e-18, Identity=27%"; Hit description =predicted CDS, peptidase family A16 and RNA-directed DNA polymerase and Integrase, catalytic domain and Zn
EDCARTAKGLQCAGTAATIITLLPADQVNSFVIRTQQDELLGTVRLRLASITMVCVPKTESWLRSYTISTVAVKRCPSAGSCRDNNCSTMNSRVMVPELNELNHRPGHSMCMSSTSFWHNSCGLPSASCLFYRWAAVPTSTTVFEEFSCIEWDLQLSAWIEIETNNGKIETQRLILHPGVPEKWGNMTIAVIPTSLPPMPILSAYFISDGRAMAMGKPI

SEQ ID NO: 148020 - protein, 212 aa, Heterodera glycines
  Coding regions on vcDNA: vcDNA=SeqID_74443; Strand=+; Position=1 -154,743-923,1133-1235,1650-1850
MLRFRKSALNFTKAFAIVDQFIRAQMALPRGAGVSFVRLDRDDFHPLYQVYYHLPIEYQPTDSAEFFDIRPKCSIQLGILHWKTVFKAIGFIVLVGIVLGLMTYSYYRHSPSFRLFVHDLLSREHHAIQVSWRRTHEHVEVIREEIEEQKVDGNGGGGGASFLAEFANRAFSWKMERKDNDDDNDDEAKEEAADVNSQKEALAADEKGQQEK

SEQ ID NO: 148021 - protein, 45 aa, Heterodera glycines
  Coding regions on vcDNA: vcDNA=SeqID_74444; Strand=-; Position=1 -120,793-810
MNNHTGVRVICKWVIEWGRLNGTLPVAPKTRNSATLWNSFLLSKR

SEQ ID NO: 148022 - protein, 109 aa, Heterodera glycines
  Coding regions on vcDNA: vcDNA=SeqID_74445; Strand=+; Position=1 -120,420-575,963-1016
MFKIFILLNAFLLIKFAITDEEQEVHGPPDVHYADSEKIEELASRAVDQINQETNNTFLFFPVKVLCAKSSRVAGINFELRVLVGQSNCAKNVYERECVAAIFEEFGVD

SEQ ID NO: 148023 - protein, 193 aa, Heterodera glycines
  Coding regions on vcDNA: vcDNA=SeqID_74446; Strand=+; Position=1 -87,166-259,304-432,898-1007,1064-1225
  Homolog annotation: Hit_ID=NP_502244.1; Match level="QueryCoverage =94%, HitCoverage=31%, E-value=9e-21, Identity=32%"; Hit description =BTB domain containing (67.7 kD) (4M616C) [Caenorhabditis elegans] emb|CAB01179.1| Hypothetical protein F3
MSSSSKQENPIERMKHLLSSGEDADIHFLILSAHKLILKHASDVFEAMFRFDSQKEKTENASAVSPVEVPDVEPAAFKIMLSFIYSEDLSELNGDNAMAVLYTAKKYVIDRLVSPAVEIPIAQLRSVFEAFALTRLYDLEHFSHQCLRYICQNAAKLFKSEGFLQIDQNLLCELFDRDQLMISSEFEIWKAVI

SEQ ID NO: 148024 - protein, 51 aa, Heterodera glycines
  Coding regions on vcDNA: vcDNA=SeqID_74447; Strand=-; Position=1 -59,194-290
MPLAMPLVKFLNLCPPLHERKFLNFHRQCASAAVSFGCVPIRNPSLGNFNG

SEQ ID NO: 148025 - protein, 74 aa, Heterodera glycines
  Coding regions on vcDNA: vcDNA=SeqID_74448; Strand=-; Position=1 -42,341-523
MNPEVQAGLAHFSLLTHGFGGPSVQTVLETMVSVINECNGVLTRNCQSPINAAAATVGQQNAVPSVGIWSPFNS

SEQ ID NO: 148026 - protein, 125 aa, Heterodera glycines
  Coding regions on vcDNA: vcDNA=SeqID_74449; Strand=-; Position=1 -181,839-1033
  Homolog annotation: Hit_ID=AAN32892.1; Match level="QueryCoverage =99%, HitCoverage=60%, E-value=1e-10, Identity=33%"; Hit description =secretory protein 4D06 [Heterodera glycines]
MHGYIVGFTSSVETDQKELMCQNVISDVKYIKQQLATMNKCVAGGGAKIVREIDVQLTLMDPCAYALSFVRALFELAAKATGHLKSAKWETLSNNFTNQIDVVDGVGHSFNVNINKNVHFTSPAN

SEQ ID NO: 148027 - protein, 17 aa, Heterodera glycines
  Coding regions on vcDNA: vcDNA=SeqID_74450; Strand=+; Position=1-53
MVSLAWHRSSDQNGNSR

SEQ ID NO: 148028 - protein, 67 aa, Heterodera glycines
  Coding regions on vcDNA: vcDNA=SeqID_74451; Strand=-; Position=1 -73,1236-1366
MPYTQLFNVLGFPALVCPVGLNGDEAIWTRNVCRRSQKNLAFGSLKSEHKNVSKRKSAFQYIADLDS

SEQ ID NO: 148029 - protein, 115 aa, Heterodera glycines
  Coding regions on vcDNA: vcDNA=SeqID_74452; Strand=+; Position=1-515
  Homolog annotation: Hit_ID=CAG06679.1; Match level="QueryCoverage =99%, HitCoverage=21%, E-value=3e-21, Identity=51%"; Hit description =unnamed protein product [Tetraodon nigroviridis]
DNQRVSEHVIEKVRQERKEREGRRRDRERERGKRERERGEGERREKERKREREGRERERREKEREGRRREREREREEGEIGGNEREERERERREKEREGRRREREREREEGEIGG

SEQ ID NO: 148030 - protein, 36 aa, Heterodera glycines
  Coding regions on vcDNA: vcDNA=SeqID_74453; Strand=-; Position=1 -107,1488-1491
MGSCFSGDKTDQSDSKHYVKKRGTDQQHQQKQALSA

SEQ ID NO: 148031 - protein, 80 aa, Heterodera glycines
  Coding regions on vcDNA: vcDNA=SeqID_74454; Strand=-; Position=1-387
LISSQKSCQLKTAKKAEFSKFFISIFFYSSKFSVIFSRLIEPVKSFRMISRLFDSVNNFKSYIDSKLAQTELARRSWPVP

SEQ ID NO: 148032 - protein, 292 aa, Heterodera glycines
  Coding regions on vcDNA: vcDNA=SeqID_74455; Strand=-; Position=1 -168,230-600,931-1270
  Homolog annotation: Hit_ID=NP_508395.1; Match level="QueryCoverage =34%, HitCoverage=57%, E-value=5e-24, Identity=47%"; Hit description =DumPY : shorter than wild-type DPY-3, collagen family member (29.6 kD) (dpy-3) [Caenorhabditis elegans] g
MIAKLNIPRIKPGQPGKVGPAGDRGRLLNGAAPGRAGQMGPYGPRGTPGPPGKDGQPGGDGARGMRGPTGDRGDDGSQGPQGPAGMPGLLGEPGGCGHCQRGSTTAGGAIQAGQQRNNVAPVPVPQSSATNNEGRPVNAAVQMTNQQQQPQQVQQQQKQELQEPQPFRQHAEQSSSAALGQQGSDVQATQVYKAQAHAAPISSNMPKAAAQIGRPAIPLPMAPPGQLPPSTVMPTVTVSGKFVGTGYSNNNNNGGGYGAAVMAANQNEEMMEYLEEVQQASLTLNDIILYTN

SEQ ID NO: 148033 - protein, 69 aa, Heterodera glycines
  Coding regions on vcDNA: vcDNA=SeqID_74456; Strand=-; Position=1 -36,136-309
MSMMLSNVQQCQHQSAKLWHQLITPDDAQLLSGTTERQKRRNGMPFEEESRSTGGFRGSCCACTQCVIL

SEQ ID NO: 148034 - protein, 41 aa, Heterodera glycines
  Coding regions on vcDNA: vcDNA=SeqID_74457; Strand=+; Position=1 -53,300-372
MPFTFKDGSFYIKKASAWITENFYGFLYSIIVYTTFLVNQN

SEQ ID NO: 148035 - protein, 200 aa, Heterodera glycines
  Coding regions on vcDNA: vcDNA=SeqID_74458; Strand=-; Position=1 -42,2165-2352,2405-2510,2628-2682,3187-3281,3347-3463
  Homolog annotation: Hit_ID=AAM74954.1; Match level="QueryCoverage =99%, HitCoverage=89%, E-value=4e-67, Identity=53%"; Hit description =pectate lyase 2 [Heterodera glycines]
MKTSTGVELLTRNTNTDYQNTLFVSGSGLLNGACDVKNAKLKNLMILTDGVTIENAIFDTPGYGIYCKGSCTLKNIYYKKLCYHAVGLAYTDTSKSYTYKVIGGAGQGTADKYFTQSGKGTTIIQNFCGEAVNLNYGDTVLFSGLTLYGQSSSSTATKYACQNVNALTYVAQLFAASSFKPTESGTGSCTYKASSIKIAN

SEQ ID NO: 148036 - protein, 26 aa, Heterodera glycines
  Coding regions on vcDNA: vcDNA=SeqID_74459; Strand=+; Position=1-80
MAPRIRNFVQEFVIEGENFSKFEWTA

SEQ ID NO: 148037 - protein, 78 aa, Heterodera glycines
  Coding regions on vcDNA: vcDNA=SeqID_74460; Strand=-; Position=1 -70,486-578,712-783
MATTVASIGLQLLILGTVVQLSYEFGCMHSLRAVGHTKGQPLPAEYKPLLEFVSADIVNERLRGCFDGNSCVTASCVR

SEQ ID NO: 148038 - protein, 99 aa, Heterodera glycines
  Coding regions on vcDNA: vcDNA=SeqID_74461; Strand=-; Position=1-8,69- 261,304-402
MVVIENIRKHIEIAVAPATGAHETEKWMNNLDIASASKLFRINIIVCERLQERIFRWQLYSPDLETSLSNLSQKESTASIFLYFNDGHFELIKQPMKIN

SEQ ID NO: 148039 - protein, 459 aa, Heterodera glycines
  Coding regions on vcDNA: vcDNA=SeqID_74462; Strand=-; Position=1 -327,392-488,556-734,856-936,1165-1375,1547-1723,1838-2142
  Homolog annotation: Hit_ID=NP_490733.1; Match level="QueryCoverage =51%, HitCoverage=16%, E-value=9e-17, Identity=28%"; Hit description =TOLl related (136.1 kD) (tol-1) [Caenorhabditis elegans] gb|AAF39752.2| Toll (drosophila) family protein
LEWAQFPAEAELLEIEANGNEMRSIGTEDEARRGRKLRKLEAFDILLTKRGGPSPNFKFKLRRNHLANLAMDSLPPSLEELDVRENRLTEVTFGTAYELADTAMAQLKKVDLRSNKLSTIPRELYERFVVANAPFGELWVGDNPLECSCEMNWLLNASASAVGTAISRKQINAAKGGVMDIESAKCVVPLDGQRKRIIETTAFDFLCTYSLFCAIGCQCCQFNGCDCKGFANACFSCFPLGTESSRAEQQRIFRPEKAARVAPQPIGHSEDRAKRIRIAGQFNGKRTKRRLIGTQPLFIPPFVEQPTDAFQWQRMHRNRKHSFVGPQRKRIDRNGHRIGRSAAQFGDTSFSGQRNGGKSLLCQFASRFACGQSVPLRLRQRRTVGGGAAEAPADGRGPLAGGQQRARDRRAGDAMRGKCDAGEGTQRKHSVGQSVRVAQPRGRPPLLNANARVSARGEQ

SEQ ID NO: 148040 - protein, 74 aa, Heterodera glycines
  Coding regions on vcDNA: vcDNA=SeqID_74463; Strand=+; Position=1-225
MRQCRAGQSEPFQRVKTVKEMGTQTEERRHLGEMKQPKTGRGKEKPTRRGEKPTEENGRRGAILNKHTVTRAIT

SEQ ID NO: 148041 - protein, 579 aa, Heterodera glycines
  misc_feature (572)..(572): Xaa can be any naturally occurring amino acid
  misc_feature (575)..(575): Xaa can be any naturally occurring amino acid
  Coding regions on vcDNA: vcDNA=SeqID_74464; Strand=-; Position=1 -1635,1699-1791
  Homolog annotation: Hit_ID=NP_499726.1; Match level="QueryCoverage =94%, HitCoverage=24%, E-value=7e-75, Identity=32%"; Hit description =predicted CDS, RNase H integrase-like protein family member (3O318) [Caenorhabditis elegans] pir||T26836
MEGGGRLLAENFRLAFSRLSALIRRLKESPQLFSGCNDIIQEYLEKGIIEKAHRAKTTTFLAHHTVMGKKLRIVFDASSHEKGAQSLNEMLFSGPNLYPDLAGKLIQFRATKCPIWADIEKAFLMVSLKESDREFSKFLWVKNIFAPLSGENLLVFRFRRITFGIVSCPFLLAAKLQHHLEAFPSELAEEIRDLLYVDNLLLLADSPEEARRKSRSTEIFAAAKMRLCEFIVADPSSLDEIPENDRLQNEAPTVLGVKWTICEDNLSLTFPTVLSPDGLTRRTVLKTVASFFDPLGLCSPCLVGAKLFFQKLWDGSKSWDDPIPVEETKEWDEIKALWAAKMMRIARFTPRINTGEIQLHVFTDASPNAFACTIYLRAEMPQGILSSLAYARSRLRPKKTDGLTIPRLELLGILIGSRAVKFVHKHLNYEIGQINLWSDSRIALSWLASTDKMPIFIANRVREIRANRHIFRYVRSADNPADLATRPVTPDVLKLSELWWRGPNWLGKPENWPDELTVSLPPEESAISEPIVCAPTAMYALKFLSETGKKTAMYALKFLSETGKKRKGSPIXRDXKFSP

SEQ ID NO: 148042 - protein, 38 aa, Heterodera glycines
  Coding regions on vcDNA: vcDNA=SeqID_74465; Strand=-; Position=1 -49,141-208
MATSMATAIADQIRLLWLWLRPFDAVQQKQRDDVVIAF

SEQ ID NO: 148043 - protein, 130 aa, Heterodera glycines
  Coding regions on vcDNA: vcDNA=SeqID_74466; Strand=+; Position=1 -113,573-714,862-942,1010-1066
  Homolog annotation: Hit_ID=NP_740995.1; Match level="QueryCoverage =61%, HitCoverage=17%, E-value=1e-18, Identity=57%"; Hit description =DeHydrogenase, Short chain (dhs-6C) [Caenorhabditis elegans] gb|AAK68188.1| Hypothetical protein C17G10.9
MPRLPKYSSSVCRTFSEPKVCSNKCNRSKGTKRANTTCYTTLPVQKLASFMDIPDSELDSFIGKLLTYKMIVTELGKETIDKTEGDMILIADTKVARRVSEYFIKQIGKLREISRKIKSSVTPVGQIHKN

SEQ ID NO: 148044 - protein, 69 aa, Heterodera glycines
  Coding regions on vcDNA: vcDNA=SeqID_74467; Strand=+; Position=1 -142,340-407
MSSQNGTDSSLLDDGQWLDGHFPLHHAVFDNDVPRLGQLLKEAAAAAGPCTSAVCLATEVPLTIIWLIS

SEQ ID NO: 148045 - protein, 93 aa, Heterodera glycines
  Coding regions on vcDNA: vcDNA=SeqID_74468; Strand=+; Position=1 -60,120-187,232-385
MSTKPIHFVQAKNFLNFPKWDKIDNYKAFLYHIKGMQLITMKRREHLSREDLERNKKMQLFFSSGKMPKGDDNTLEDINTEIPEHDPVKFSEI

SEQ ID NO: 148046 - protein, 80 aa, Heterodera glycines
  Coding regions on vcDNA: vcDNA=SeqID_74469; Strand=+; Position=1 -115,177-256,314-361
  Homolog annotation: Hit_ID=NP_494753.2; Match level="QueryCoverage =100%, HitCoverage=16%, E-value=3e-11, Identity=46%"; Hit description= ankyrin (2E574) [Caenorhabditis elegans] gb|AAB00714.3| Hypothetical protein C01F1.6 [Caenorhabditis ele
LLSRILPSDTFKIYKKGHRLRFDFSLVDFNNNGPLPKWERGDVSLLLDILSTDGRKAVLMDNRKKVYQVLREKNQNLSDE

SEQ ID NO: 148047 - protein, 207 aa, Heterodera glycines
  Coding regions on vcDNA: vcDNA=SeqID_74470; Strand=-; Position=1 -340,443-724
  Homolog annotation: Hit_ID=EAK89192.1; Match level="QueryCoverage =72%, HitCoverage=9%, E-value=3e-32, Identity=68%"; Hit description =very large probable mucin, 11700 aa long protein with signal peptide and pronounced Thr repeat (308 aa long
VVYFIAVQQQFVNGCMRTATTTISRTTTIASISTTTIPIQTTATTTPSTVTLTPTTTSTTTTIPTTTTTTPTTTTTTPTTTTTTPTTTTTTPTTTSTTTTTTTTTTTTTTTTTLCTACTATLVFDRQQGGIAAPTQPACPVTACPGGTNAEPLPRGTTPFDVQQNAQCANPCVCDAANVCYQPSGERNGDILVRLTTQCPDSCATTD

SEQ ID NO: 148048 - protein, 257 aa, Heterodera glycines
  Coding regions on vcDNA: vcDNA=SeqID_74471; Strand=-; Position=1 -317,570-851,944-1119
  Homolog annotation: Hit_ID=NP_733106.2; Match level="QueryCoverage =97%, HitCoverage=85%, E-value=4e-32, Identity=51%"; Hit description =CG31439-PA [Drosophila melanogaster] gb|AAN14054.2| CG31439-PA [Drosophila melanogaster]
TAILAPTTTSTTTTTATPTTTTPTTITTTPTTTTTTPTITTTTPTTTTTTPTTTTTTPTTTTTPTTTSTTTTTTTTTTTTTTTTTTCTLKIIINIVPGLEFGEFALCTACTATLVFDRHQGGIAAPTQPACPVTACPGGTNAEPLPRGAAAFDVQQNAQCASPCVCDTANVCYQPSGVLNGNILVRLTTQCPDDCATTDGCTIQALVRGTSPNTRGCLARQGTTVCAYQIGSTFNVKSVSCNGCPNLDTLTCGGLIP

SEQ ID NO: 148049 - protein, 191 aa, Heterodera glycines
  Coding regions on vcDNA: vcDNA=SeqID_74472; Strand=-; Position=1 -45,641-1171
  Homolog annotation: Hit_ID=CAE72204.1; Match level="QueryCoverage =59%, HitCoverage=15%, E-value=3e-11, Identity=38%"; Hit description =Hypothetical protein CBG19313 [Caenorhabditis briggsae]
MRKMGDTVKCQQFVNEQAEQSGDVARVRDLQQQVNELEEKAKKIVIGRNSRVNTQMVIFEEHQRTKNLSAISAINQRNRDHMKQTFLGAGMVREEQEKDDDPFTRKSARMKVVSGSVKSKTAGEGSGGSVGISLFLLYNTFGSSQCRVIRYGHDGFFVGFVVVFVGVLSKQKSATSLNSRFIQRTWNRHKY

SEQ ID NO: 148050 - protein, 179 aa, Heterodera glycines
  Coding regions on vcDNA: vcDNA=SeqID_74473; Strand=+; Position=1 -99,143-322,457-525,568-756
  Homolog annotation: Hit_ID=NP_505475.1; Match level="QueryCoverage =84%, HitCoverage=80%, E-value=9e-43, Identity=54%"; Hit description =putative protein, with at least 3 transmembrane domains (5K69) [Caenorhabditis elegans] emb|CAB03197.1| H
MNAKVKFIPESRKGQLNTQYLATLPGLLKIVELILGFVAFILAICARRSTNSAWVEHITFETTIVVSVLIILYVVFPHLTFADERTREGLIVVIWLMVHLSASFTAEGRGAAILGSILCLALCVIYAGEAYIKFKVWTNPAGKVQQSKSQAQGHNQVPPAPTHYEEKTIRRNEMEERAV

SEQ ID NO: 148051 - protein, 130 aa, Heterodera glycines
  Coding regions on vcDNA: vcDNA=SeqID_74474; Strand=-; Position=1 -63,111-232,312-466,559-611
  Homolog annotation: Hit_ID=NP_611665.1; Match level="QueryCoverage =63%, HitCoverage=11%, E-value=1e-12, Identity=46%"; Hit description =CG10955-PA [Drosophila melanogaster] gb|AAF46837.1| CG10955-PA [Drosophila melanogaster]
MKTNKRQKVSSSEEEFDPNQKDEDYDLLMDDEEREKFDKMTEKEREIEIYKRLEQREIMKTREKIKKKLEMAAGKKADGEVAARQKKRKRKMSDESNGDDESDEKDSASEAEEGLFYCAEHESDLIFDRF

SEQ ID NO: 148052 - protein, 98 aa, Heterodera glycines
  Coding regions on vcDNA: vcDNA=SeqID_74475; Strand=-; Position=1 -235,277-338
MKKFLFLTIIILLLPNTHSSNKQRHRKQRAVSALARLTVALSRIGTYIKAHPYITASTILMEMGSVSLNIYLLIQEIKACEEKQILKDFFPFVLTLNF

SEQ ID NO: 148053 - protein, 52 aa, Heterodera glycines
  Coding regions on vcDNA: vcDNA=SeqID_74476; Strand=-; Position=1 -60,120-218
MNQIKVDQEESTKLWDWPLQSHDELVSIYDGRDRWEVGLDTGFFTPNEIEAC

SEQ ID NO: 148054 - protein, 75 aa, Heterodera glycines
  Coding regions on vcDNA: vcDNA=SeqID_74477; Strand=-; Position=1 -60,345-512
MQFGTGADPVLEECAFCGEKVLFGPCRKLCNDSGGTKRCKTEGERAQRQEVQEGQKMIGWNLQKLCDHSLIGKSM

SEQ ID NO: 148055 - protein, 49 aa, Heterodera glycines
  Coding regions on vcDNA: vcDNA=SeqID_74478; Strand=-; Position=1 -38,345-456
MELSFYNRYGPRWYCSGSAGGCALTPVSEKDAKLKEKGMNTKKFKKAKK

SEQ ID NO: 148056 - protein, 57 aa, Heterodera glycines
  Coding regions on vcDNA: vcDNA=SeqID_74479; Strand=-; Position=1-173
MASVNGQTALFADHGRHFLHRFGGEHRWTSARITIGHRRWYGIITNAKILGPYEFEI

SEQ ID NO: 148057 - protein, 223 aa, Heterodera glycines
  Coding regions on vcDNA: vcDNA=SeqID_74480; Strand=-; Position=1 -154,444-594,698-843,1434-1652
  Homolog annotation: Hit_ID=NP_388504.1; Match level="QueryCoverage =98%, HitCoverage=46%, E-value=3e-64, Identity=55%"; Hit description =hypothetical protein BSU06230 [Bacillus subtilis subsp. subtilis str. 168] emb|CAB12442.1| ydjK [Bacillus
PWLRRCLFIGIGVAMCNQLAGVNSIMYYGTNILIEQGLMTNVALTANIANGAISVLATGLGIMLIGKIGRRPMLLSGQIGTVLAHLAIGTCSLLMAKGMARPFVVLSLTVTFLLFQQCGISPITWLMQSEMFPLRIRGLAMGLSTSILWLVNCLLTFGFPILISWVGMTATFYAFAVIGCCAMLFVFHFMPETRRKTLEELERQFQTKDIKALKKHGPVEGAD

SEQ ID NO: 148058 - protein, 99 aa, Heterodera glycines
  Coding regions on vcDNA: vcDNA=SeqID_74481; Strand=-; Position=1 -156,272-415
MDNSTIATDPQTVLNSPVLQLPDYLPYLELCLNWIALISHGITALTMGFLVLIKINKQDKLCLFREFVTNIMYYFSLKHYKSDQIIERQRYDSKKSDEL

SEQ ID NO: 148059 - protein, 47 aa, Heterodera glycines
  Coding regions on vcDNA: vcDNA=SeqID_74482; Strand=+; Position=1 -37,746-852
MSFNFKSAEVHERLIPKTKSDIANMKFYTDPYIFKRVLIFISCLSWE

SEQ ID NO: 148060 - protein, 59 aa, Heterodera glycines
  Coding regions on vcDNA: vcDNA=SeqID_74483; Strand=+; Position=1 -114,543-608
MEVDKPMASPRMRNGNISDCISQVIGEMPHCWNRRKVTKKLQSCFKNMVYNFAKYNEID

SEQ ID NO: 148061 - protein, 750 aa, Heterodera glycines
  Coding regions on vcDNA: vcDNA=SeqID_74484; Strand=+; Position=1-2253
  Homolog annotation: Hit_ID=CAA82797.1; Match level="QueryCoverage =80%, HitCoverage=88%, E-value=1e-50, Identity=28%"; Hit description =gag protein [Ascaris lumbricoides]
MNKEEWNNEWKVQKIFREKHDYLKTIKEIDEILDTLKDVNLEVKRRLKLLKAKSSSDSDLEDESNDYEHENEDEVEEQEEEKEYESDNEDESPELSLNDQIHHDRTPFVNYRSRIKLPPQTLTHFNGKFSQWPSFWDDFKSSVDNDPNLENIQKLKYLRGLLHDEPYRIVSPYPLTNKNYTIVIKLLKSRYGNPQLIRENLHSELRNLKRPTESTIELRRFILLIDRIILQMKSQGEDINHPQIKQSIETKLPYNIRLKLKEKFKIYSTKEIMEFLNDHTQAREDIERMEESNRQIRNFPSNRPPQNGVQRQFYPNFPHNQMKPNPRNQQNTSSSPFPYTSAFTTKSNPVRLAQFKSNPTQTRTQNKIFCRFCERENHASKECKIYSTPEKRNERVRELKLCLNCLNKGHMVNDCKSTYLCFNCKYKHNTLLCTRKQTQYKPKEQKTRVNMAKNYENHEETQTFMTMDYDKNLSNYEEEELLMTAEVNCINPDKHKVKKEIILFDNGSQKSYITEECAQSLQLTTIEEKLLVISTFNQNKPKIIKSRLVKVGIKTLKGEVEYIILQTVEKITDVTKMVNKENVDVLGVKIPISHASPQILIGIDHYWHFMLPNSQIQLLPSGFYSINTKLGKILSGKGTIEDTNCNSVTEKRKKDETNQILQKFWELENIGIIDSPHMTDEDAAMIHFDKNVTFKNNRYHVRWPYKRENPNLLTNFGLCMGRLRNVVKQLIKNKQLDKKDRICKNKWILM

SEQ ID NO: 148062 - protein, 181 aa, Heterodera glycines
  Coding regions on vcDNA: vcDNA=SeqID_74485; Strand=-; Position=1 -262,318-601
MDTLDGWAKDAAKLGLGQAELGAFNALREVLSSSDSKQILGMAANERGIDGADEAARRRLSTIKGGVDSPRVRTLTELPKITLRAKKKLWSEGYDKETSSAEEDQDNAKRRVKTVLAKLEEGEESELFEKITPTDYKRLARLDDTFTTERFEDILTDLNGKSVVELPGGLSLALKDAAGCE

SEQ ID NO: 148063 - protein, 87 aa, Heterodera glycines
  Coding regions on vcDNA: vcDNA=SeqID_74486; Strand=+; Position=1-264
MRFLECAAHVQPYEQGEGAIIRRRRDRRRRRGNGQRRFKYAFWILITIKSEYVANSVILLCQRHGLFSDVTLPTINQRRDVESATSP

SEQ ID NO: 148064 - protein, 56 aa, Heterodera glycines
  Coding regions on vcDNA: vcDNA=SeqID_74487; Strand=-; Position=1 -156,205-219
MSPQLQKASIVRHIERDHPGRSSEEFDYNYPAFSRKIHHKLAECFPMRNAEVSQQF

SEQ ID NO: 148065 - protein, 58 aa, Heterodera glycines
  Coding regions on vcDNA: vcDNA=SeqID_74488; Strand=+; Position=1 -20,302-407,1330-1380
MNKRLKFADELAQNRMARAAYDTLCSFYKLAESKINQAYVEERIGPVWMNLPLCCVRK

SEQ ID NO: 148066 - protein, 143 aa, Heterodera glycines
  Coding regions on vcDNA: vcDNA=SeqID_74489; Strand=-; Position=1 -57,141-231,281-533
  Homolog annotation: Hit_ID=NP_500569.1; Match level="QueryCoverage =98%, HitCoverage=98%, E-value=2e-44, Identity=66%"; Hit description =histone H2A.F Z (14.7 kD) (4F211) [Caenorhabditis elegans] gb|AAC48074.1| Hypothetical protein R08C7.3 [C
MAGGKGKAGKDSGKAKSKVISRSARAGLQFPVGRIHRFLKKRTTSTGRVGATAAVYSAAIATAAVYSAAILEYLTAEVLELAGNASKDLKVKRVTPRHLHLAIRGDEEVSERVRHPGIGAKKFLNRLGTFAVGGPRKNAKGGT

SEQ ID NO: 148067 - protein, 177 aa, Heterodera glycines
  Coding regions on vcDNA: vcDNA=SeqID_74490; Strand=-; Position=1 -150,195-430,483-630
  Homolog annotation: Hit_ID=AAL93203.1; Match level="QueryCoverage =81%, HitCoverage=21%, E-value=2e-12, Identity=35%"; Hit description =transposase [Bactrocera dorsalis]
MSRVLAITEFSESHTGKNIALKIEDLLLKWGIPKERVHAIISDSAANMKRAFVERDENENRILPMPNGPCAAHLLNLAVQEALKKDESISSLLAKSRHIVGRFKHSNTAFSELKKIQKLLDAPSHTFCRWYVSGGIVCLQLIKFLKRRGHISPSEAETMIEEMKNIQRQPPIFFQSK

SEQ ID NO: 148068 - protein, 179 aa, Heterodera glycines
  Coding regions on vcDNA: vcDNA=SeqID_74491; Strand=-; Position=1 -121,1077-1295,1340-1472,1525-1591
MNNTTKEGIEVLRSSDETNDTLFHLLLLSHYAFAFPVFLLSICLECQSNEKPKYEFKLTKGTVKSLHTHLHCFHENSEFSEKLNALESKAEKEKQKQKPISDFQSSCGPTFSDSQLSSFDKKILHFLVTKNISFGAVDHQTFHSLFPHQKVKSESFYRKTALPIVYQRVRHKIKDELKE

SEQ ID NO: 148069 - protein, 176 aa, Heterodera glycines
  Coding regions on vcDNA: vcDNA=SeqID_74492; Strand=+; Position=1-533
  Homolog annotation: Hit_ID=CAH81944.1; Match level="QueryCoverage =100%, HitCoverage=97%, E-value=1e-30, Identity=35%"; Hit description= conserved hypothetical protein [Plasmodium chabaudi]
KAEREGKAKEKPKEKKRKRKAKKSQSKRKGKAKREGKAKEKPKEKKRKRKAKKSQSKRKGKAKGEGKAEGKAKGKEKRRKAKVKEKEKPKGKEKRRKSGRKSRKGRKSEGKGKGKEKEKPKGKEKRKEKPKEKKRKRKAKKSQSKRKGKAKREGKAKREGKAKEKPKEKKSEEKPK

SEQ ID NO: 148070 - protein, 85 aa, Heterodera glycines
  Coding regions on vcDNA: vcDNA=SeqID_74493; Strand=-; Position=1 -103,532-686
  Homolog annotation: Hit_ID=NP_497206.1; Match level="QueryCoverage =96%, HitCoverage=8%, E-value=1e-26, Identity=47%"; Hit description =nematode-specific EB region and pancreatic trypsin inhibitor precursor family member (171.6 kD) (3B124) [C
MHLEVRYCAIGQIFMNGRCKHPQSRYKRQGVAGSEQCAAVWPESRCEKSRCECPEDVNGIPYVQSKTRDGVVCILHSGEDGDPVR

SEQ ID NO: 148071 - protein, 298 aa, Heterodera glycines
  misc_feature (10)..(10): Xaa can be any naturally occurring amino acid
  misc_feature (24)..(24): Xaa can be any naturally occurring amino acid
  misc_feature (38)..(38): Xaa can be any naturally occurring amino acid
  misc_feature (113)..(113): Xaa can be any naturally occurring amino acid
  misc_feature (127)..(127): Xaa can be any naturally occurring amino acid
  misc_feature (172)..(172): Xaa can be any naturally occurring amino acid
  misc_feature (202)..(202): Xaa can be any naturally occurring amino acid
  misc_feature (261)..(261): Xaa can be any naturally occurring amino acid
  Coding regions on vcDNA: vcDNA=SeqID_74494; Strand=-; Position=1 -884,1832-1856
  Homolog annotation: Hit_ID=EAA16792.1; Match level="QueryCoverage =100%, HitCoverage=18%, E-value=2e-48, Identity=40%"; Hit description= ookinete protein-related [Plasmodium yoelii yoelii]
GNGTGAEEGXMGDKGNGTGAEEGXMGDKGNGTGAEEGXMGTTNGEWHGSRGGLNGGQPMGNGGSRGGLNGGQGEWHGSRGGLNGGQPMGNGTGAGGLNGGQPMGNGTGTEEGXMGDKGNGTGAEEGXMGTTNGEWHGNRGGLNGGQGEWHGSRGGLNGGQPMGNGTGTEEGXGGQPMGNGTGTGGLNGGQPMGNGTGAEEGXMGDKGNGTGAEEGKWGTTNGEWHGNRGGLNGGQGEWHGSRGGLNGGQPMGNGTGTEEGXMGTTNGEWHGNRGGLNGGQPMGNGTGAEEGLTFPLNP

SEQ ID NO: 148072 - protein, 218 aa, Heterodera glycines
  Coding regions on vcDNA: vcDNA=SeqID_74495; Strand=+; Position=1 -129,231-757
MTHFQHLQQQVHLLTQKLEDEEKRANILAKTYGDTQKKLARSEDNFELNNELERWRNMKQSSVTLDDGLEVWDNDEENKTEDEEEMRELEEQGKGKTEQEDEHMELLQREIDNLLVAIGNASLFSQIQMNHFLKTDSGTFSSRSCDTNGVNYCDQNNGTTVEESGSAIGPFDIFGGFSPFIKASLSRSQSESKPTNSFGSLAIKPPTLANTHCQFNYN

SEQ ID NO: 148073 - protein, 170 aa, Heterodera glycines
  Coding regions on vcDNA: vcDNA=SeqID_74496; Strand=+; Position=1 -70,128-364,410-556,643-702
  Homolog annotation: Hit_ID=NP_701217.1; Match level="QueryCoverage =46%, HitCoverage=4%, E-value=1e-10, Identity=44%"; Hit description =hypothetical protein PF11_0357 [Plasmodium falciparum 3D7] gb|AAN35941.1| hypothetical protein [Plasmodium
QLRMIMPQPSVVSKKNSPTSQNDKRMDKLENGETNTSSLCGDEEEKPAKNYLHKTQICLFWKAYVSGKSRTKCRNGVNCNFAHGEKELKKLDPFYFKTELCEFWNLDEPCPYGDGCNFAHGPDELRQMGVKGPFPLRFSKFDLFDPSNFQKPLASYGKPVEQKVTIINGH

SEQ ID NO: 148074 - protein, 39 aa, Heterodera glycines
  Coding regions on vcDNA: vcDNA=SeqID_74497; Strand=+; Position=1-121
LLTLLQAHNAQILEEQKQRRSAEWRGEQRGGQGKVIGWQ

SEQ ID NO: 148075 - protein, 131 aa, Heterodera glycines
  Coding regions on vcDNA: vcDNA=SeqID_74498; Strand=+; Position=1-396
MSIDANFVLNIHSPTTTTNKREKAGGSNSSRSASDGTNSLNSAAFTVIRTPTPAEQQRHQQKDEKQHQQQRDSRDSAKNGDDDGGTFMERSESDNSTASVVVEHFPHQQQNAKSRQQPPNIGEGSKVKKHF

SEQ ID NO: 148076 - protein, 19 aa, Heterodera glycines
  Coding regions on vcDNA: vcDNA=SeqID_74499; Strand=-; Position=1 -14,362-407
MFVVIFVFVVLLFIVLAKV

SEQ ID NO: 148077 - protein, 69 aa, Heterodera glycines
  Coding regions on vcDNA: vcDNA=SeqID_74500; Strand=+; Position=1 -16,1180-1373
MGSLKGGGAAKADGTNWAMTGKHQQWHDRPDIVCRLFIGKRDELLNALNKKMILGYITAWFFSLEFQLR

SEQ ID NO: 148078 - protein, 131 aa, Heterodera glycines
  Coding regions on vcDNA: vcDNA=SeqID_74501; Strand=-; Position=1-396
MLLTPLFLLVMAFMALLVVQCSSAAAGDVSPALDNQEEKRVLSADESGPLQNFRTVLEGRHKRSLMGRYRNSTGRKRNSNGRNRNSTGRRRNSTGRKRNSYGRNRNSNGRNRNSFGRGKRSPMAFPPAADK

SEQ ID NO: 148079 - protein, 91 aa, Heterodera glycines
  Coding regions on vcDNA: vcDNA=SeqID_74502; Strand=-; Position=1 -229,659-705
MAYLKWKVKKSLMIIKKEIKWLSFGQYAKHRAVIDSQPITLSYASMEDIFRGMGGLDTYNLCKFNCQDWSREFMANAQFSNATITLKFIVL

SEQ ID NO: 148080 - protein, 170 aa, Heterodera glycines
  Coding regions on vcDNA: vcDNA=SeqID_74503; Strand=+; Position=1-513
CGRSTKSSVWAFHKKLSVGVPQKAQCGRSTKSSVWAFHKKSSVWAFHKKFSVGVPQKAQCGRSTKSSVWAFHKKSSVWAFHKKLSVGVPQKAQCGRSTKSSVWAFHKKLSVGVPQKKLSVGVPQKAQCGRSTKSSVWAFHKKLSVGVPQKKLSVGVPQKAQCGRSTKNAQ

SEQ ID NO: 148081 - protein, 207 aa, Heterodera glycines
  Coding regions on vcDNA: vcDNA=SeqID_74504; Strand=-; Position=1 -616,706-713
MNKTFIFIFLLFRFEYSTSTNSGFEEFIKNHKAIELVKSYQNKEIKTLKKLHEQMQLKGIDLSFCTLRRYVSRLTIVSAHTNKNDASNSNASSHEMPKHELRFEKCFSKTLRKNVFIIGNESAWRKYVQTNENNEDIYISCSKCRYFREQEKNVNVKSIVASAVLRQGTQLVMLQSNHNANCKPEKLEKLEAEQVDREQRRENYKFL

SEQ ID NO: 148082 - protein, 90 aa, Heterodera glycines
  Coding regions on vcDNA: vcDNA=SeqID_74505; Strand=-; Position=1 -89,244-313,536-575,685-758
MPKVEFLIGHLILNCSAGSFNLLKNLSEKRTYYYIFGGQGRFRVAIFAWGRFRNKLRSHFIVSGNTKHIYPKSLISNVNMFMYNHNIKHF

SEQ ID NO: 148083 - protein, 30 aa, Heterodera glycines
  Coding regions on vcDNA: vcDNA=SeqID_74506; Strand=+; Position=1-91
MKIFPKDSFPKFLFLISCNCKGEMNNEWDL

SEQ ID NO: 148084 - protein, 326 aa, Heterodera glycines
  Coding regions on vcDNA: vcDNA=SeqID_74507; Strand=-; Position=1 -284,528-648,915-1017,2230-2372,2662-2816,2903-3031,3101-3143
MVLAEPARVGPGDGRAVLLRVAERHIGGHGEHFGGWGCHWFQGGGWRCRWHTATAEPKRRRCGHCIRRMPVPHYNWNFAAAVPTSTTGTRHWAAITQPAEVAPSVVGIPKLTRTPDDVGHAHTGEQNEQRVIWGTPNKFNPYSNSNCHSDGLGSSGGGGGLNACAPTSFLNIVGAGRLFKRQMCKALGQAPGIVTREGIAKGVRGSLTTADSPKRQLCIFRRPAAATASTSAAVLPLAGALVAAAGDHRHNNLCVILEKTRKTADTTVEAYLIILPIFLQFRLYEPVHRHLPCPARNDQLVAKAELLDRIRSADELAQNQMAAAAG

SEQ ID NO: 148085 - protein, 120 aa, Heterodera glycines
  Coding regions on vcDNA: vcDNA=SeqID_74508; Strand=-; Position=1 -158,770-976
LGQQQLALTDGSAVAMDHLQWETIREWVIKADTVPRLVDSLIDADGQMDSKQQQYLDLECIWNNVWSKNESVRALYPPAVYVSLKSFMVGLLCREDNRIMLDGQSPAQPRNVWINQNFLN

SEQ ID NO: 148086 - protein, 32 aa, Heterodera glycines
  Coding regions on vcDNA: vcDNA=SeqID_74509; Strand=-; Position=1-9,70- 159
MYVVNIRVRHFAKSLDNMDSMLDLDFEYGLDP

SEQ ID NO: 148087 - protein, 202 aa, Heterodera glycines
  Coding regions on vcDNA: vcDNA=SeqID_74510; Strand=-; Position=1 -231,286-663
MRQFAPSMLIDCPPLRCVSFEGDILPEFPPDDSANATDGQAVAKWLFSPRPDGVPNLLHCHDFSVPQWSSRMEQIKTAFSDASSHVCFIIYFEFSTFPSLDFVVPFELTNALTGEQLTLSQYYDFDQCFVLIRCPIGQKEMALEQFKKAGTSRGSRIFIGIGADGLKMGEQFQKIFGFNFLSFFQTSQRFPWAEWSASERSE

SEQ ID NO: 148088 - protein, 45 aa, Heterodera glycines
  Coding regions on vcDNA: vcDNA=SeqID_74511; Strand=-; Position=1 -129,355-363
MAEWQKALGIVEKLRAQLSQRQYVTVRVLLLEERFKELIERGERF

SEQ ID NO: 148089 - protein, 168 aa, Heterodera glycines
  Coding regions on vcDNA: vcDNA=SeqID_74512; Strand=+; Position=1 -142,838-926,973-1050,1401-1598
MYFLVVFLATDAELQHFALHFQDLLLLLERQRHPRVERLDRLKELRKKKSQYYRMSDLTTPSPEVTTDDGTTPQSSKAAEKTGQDGCNSAAASVDDDLACAQMVLSPAFENISEDSSSPTTDSAHIVDAHAQKVVFCDSEKYSGVSRALITNLTPPCHKNNLIYDFSS

SEQ ID NO: 148090 - protein, 123 aa, Heterodera glycines
  Coding regions on vcDNA: vcDNA=SeqID_74513; Strand=-; Position=1 -122,174-267,315-467
MKKHVTFTPSIGDDVHSTNVSSVAESEFSVKECAEVPEIFKKLADDAFQILPLPDIDPTVTSTPAVVNNLIEAVESLDSRMPLAFQEQQQILKMQSEMLQLGVSCKEHYKKIHEQSVMRYNLE

SEQ ID NO: 148091 - protein, 72 aa, Heterodera glycines
  Coding regions on vcDNA: vcDNA=SeqID_74514; Strand=-; Position=1-219
MNDRQFFGRKHGTVHVDGQTVVRRVERAQKGGAELVVVGLDEGGAGARAESAQVGGEAGAKSGLKRAWGRTR

SEQ ID NO: 148092 - protein, 280 aa, Heterodera glycines
  Coding regions on vcDNA: vcDNA=SeqID_74515; Strand=+; Position=1 -44,245-424,474-544,801-831,1067-1198,1242-1415,1995-2207
FHSVRKAIDRMAAKTTLGSGFPSDLGGLGTGTGTTFVQPHNYQFGTALLGSFHSSDDSLSVNMNCAMFAPEELTVSVVGNQIVVVGNHGEKQDSLGSIVARYRYRYWPKSVFLQSLESLSNSAKLLPEEIFEQNEELFNYRIQCMLTFILTIISIRYVKRSTEWQQRLANLRYSGFSPMAPLVVSFVAFFNFPVFRSQGPSTSVETAPEEVRHQRDRNQHLLKAVCDGTVVITREHCEVNPKNEWMYAQYAYRDFENIYKLTFNVIPRRMSNTFKLISEE

SEQ ID NO: 148093 - protein, 138 aa, Heterodera glycines
  Coding regions on vcDNA: vcDNA=SeqID_74516; Strand=+; Position=1 -262,502-655
MEAPNSPMASAQNRGHGVDPSTVSADLNDICGDTDGMANEEEADDSIVKEIVTALLSGGPFPAAEENDEQSQAMEQQQTNGTAMDGQSPNLVEKSWSAVAICIDGVGTGATAFIGAVTKTGATAVPVRRGQWAKRREP

SEQ ID NO: 148094 - protein, 248 aa, Heterodera glycines
  Coding regions on vcDNA: vcDNA=SeqID_74517; Strand=+; Position=1 -183,238-402,546-713,761-925
  Homolog annotation: Hit_ID=CAE65838.1; Match level="QueryCoverage =91%, HitCoverage=92%, E-value=2e-73, Identity=59%"; Hit description =Hypothetical protein CBG10963 [Caenorhabditis briggsae]
RRELPSFVGCFSLLISFRNQLEWAPPMRIIAVITLLASTLDLMADFLLCSRLAEYLHNFQTEFARYCALTEFARYCALGYFFFTGVSILVYVFEMVDVCLTLKYDEENVFFARMAKSMVLVLEEVPLPALLYLLFTSEPRLSLANPMHIASWIKLITLSWAIVKFAKLRFFWPLLPFNPKHDKRENIRRCFHLNHDKRENIRRCFHLNLYRMTMIVVNAFHLLAIFIVINNLVVSRRGGRSIQAQSSL

SEQ ID NO: 148095 - protein, 98 aa, Heterodera glycines
  Coding regions on vcDNA: vcDNA=SeqID_74518; Strand=+; Position=1 -182,341-455
MSRGTSRSRSEFGISTTLGCPMMQKKSSHRQATRRHQRFTWHLTGSTDRGRKFRDHQIIRGANETMKDGRNDQEDAGLSVDDDVELYAVGDDDEFFVC

SEQ ID NO: 148096 - protein, 27 aa, Heterodera glycines
  Coding regions on vcDNA: vcDNA=SeqID_74519; Strand=+; Position=1-139
IWQHGKSYSELIAFSKPLNSFALLICT

SEQ ID NO: 148097 - protein, 30 aa, Heterodera glycines
  Coding regions on vcDNA: vcDNA=SeqID_74520; Strand=+; Position=1 -4,345-433
MRCSDHHEGVIGSSILRFEARLFPLIFGHL

SEQ ID NO: 148098 - protein, 31 aa, Heterodera glycines
  Coding regions on vcDNA: vcDNA=SeqID_74521; Strand=+; Position=1-250
WRPHKVSKPRNVQKSKNPGNVQNFSIFINTK

SEQ ID NO: 148099 - protein, 96 aa, Heterodera glycines
  Coding regions on vcDNA: vcDNA=SeqID_74522; Strand=-; Position=1 -50,87-327
MIMIDYNRHIVSDSKLGKMNNTTKEGIEVLRSSDETNDTLLLLSHYAFAFPVFLLCWFIIIKFLKRRGHISPSEAETMIEEMKNIQRQPPIFFQSK

SEQ ID NO: 148100 - protein, 338 aa, Heterodera glycines
  Coding regions on vcDNA: vcDNA=SeqID_74523; Strand=+; Position=1-1017
  Homolog annotation: Hit_ID=NP_913627.1; Match level="QueryCoverage =97%, HitCoverage=23%, E-value=1e-39, Identity=34%"; Hit description =putative helicase [Oryza sativa (japonica cultivar-group)]
MAIRQHKDLLFGGKTVIFSGDFKQSLPVVPHEGLTAQVTACFQTSPLFGQFTTMKLTINQRLGKGQQAYLQMCRQIGLGETGEHFWIPRQFLVKSKEELIDYVYPNFQQLLGNDKELLNRLILAPHIDTCDEVNDIMMANVPGHMREYLSTDKPLDDRPLDIDEIESEVAALNRRTDSGMPPHSLRLKVGCVVVLLINKSDKEGLINGTRIVLEELGDDRLIGRVINSNAIGGQVKFFLERTRNVYEDKSPGGIKYERLQFPIKPAFAMTIQKGQGQTIHTVGIDLEREVFSHGQLYTAFSRATDGNNVRVHAPNRDVDAQGQAKVLNIVATNMLKLQ

SEQ ID NO: 148101 - protein, 159 aa, Heterodera glycines
  Coding regions on vcDNA: vcDNA=SeqID_74524; Strand=-; Position=1 -189,494-679,948-1052
  Homolog annotation: Hit_ID=NP_509115.1; Match level="QueryCoverage =92%, HitCoverage=30%, E-value=8e-22, Identity=40%"; Hit description =rhodopsin-like GPCR superfamily (XH248) [Caenorhabditis elegans] pir||T34117 hypothetical protein C25B8.5
MFVLLSCVLPISSSLLVSCYLLRLMCYKRGQQLRTDSIQSNSSSQRTVKNANFVPLAPAFSHKLRSLVFIFTTTVWTAISLLPFRILIIIRLNFIDAISLLSNCELLRFMVIAAWILHYILMLSPVINPFITAIIYHPYRVTFVKQLSFSGSSIRSTQL

SEQ ID NO: 148102 - protein, 45 aa, Heterodera glycines
  Coding regions on vcDNA: vcDNA=SeqID_74525; Strand=+; Position=1 -43,468-562
MLNGTYHLWSRPFAILDDDEGIWPISGPNDCTIEKLKVRKMRMHF

SEQ ID NO: 148103 - protein, 333 aa, Heterodera glycines
  Coding regions on vcDNA: vcDNA=SeqID_74526; Strand=+; Position=1 -155,237-392,499-646,897-947,1000-1134,1331-1492,1572-1640,2233-2357
  Homolog annotation: Hit_ID=NP_496011.1; Match level="QueryCoverage =99%, HitCoverage=66%, E-value=6e-48, Identity=36%"; Hit description =glutathione synthetase (55.4 kD) (2J706) [Caenorhabditis elegans] emb|CAB01655.1| Hypothetical protein M1
VEVNIGPIGGNVSAQAVRQVHGRVFSKLGLSEDNLPENRASTAIGEALVKAWELFEDPSAVVVIMSIKNNHGHFALRHIQYEIEQASAYKIKVIRLTLAECDEKLILDPNDSSLRFNGRKVAVVYQRTYLSEKDWPTEKHWDIRRKIERSTAIVTFNVNIHLAGSKKVQQTLALPGMLEQFLPDVDEGMISSIRKTFADLLALDKEDEATEAVIRKAIENPENYVLKTNRDGGGNNFFGEEIAKKLSGLPLDERSSMILMEKLKPMEVKNFPIRRLRDHTVRNMVSCQQLSMSSELGIVGYFLGNGQTMATIANVQQGHLLRTKFAESNEGGV

SEQ ID NO: 148104 - protein, 72 aa, Heterodera glycines
  Coding regions on vcDNA: vcDNA=SeqID_74527; Strand=+; Position=1 -173,324-369
MPPGENIGGIHPPAKYQLPKDYGRDEWVALAWHFTFFLAIPKGILSLNILVNQPVKLRTKRRSDQTGRNLSK

SEQ ID NO: 148105 - protein, 102 aa, Heterodera glycines
  Coding regions on vcDNA: vcDNA=SeqID_74528; Strand=-; Position=1 -256,382-434
  Homolog annotation: Hit_ID=CAE59445.1; Match level="QueryCoverage =46%, HitCoverage=49%, E-value=7e-12, Identity=76%"; Hit description =Hypothetical protein CBG02820 [Caenorhabditis briggsae]
MPLVSTGHGNHRFRWCQTLPPAYFVIPANVPLERPIYDQNDSAIEDELAEEAKAKRAQTFVRFGKRAQTFVRFGKRAQTFVRFGRDAQRQQEMANEQAQKKE

SEQ ID NO: 148106 - protein, 317 aa, Heterodera glycines
  Coding regions on vcDNA: vcDNA=SeqID_74529; Strand=+; Position=1 -205,321-415,471-749,1013-1389
  Homolog annotation: Hit_ID=NP_112344.1; Match level="QueryCoverage =58%, HitCoverage=50%, E-value=2e-46, Identity=48%"; Hit description =protein geranylgeranyltransferase type I, beta subunit [Rattus norvegicus] pdb|1S64|L Chain L, Rat Protei
LSPSRRCGGFRGCVLSVPSAGLCPYESAHLAQTYTSLCILLILGDDFSRLDRRAILRAVADSQGADGSFFDGDRSNENDMRFLYCACAICYLLDDFSPINIPSLLDFVRRSVSYDGGIAQGPSLESHGGSTFCAVSALLLTGHLWDGSVLDSAKMERLKKWALMKQEEGFHGRTNKLDDSCYAFWVGATLSVHAQRPPLGGLARFAFFSAPCSGRDHRRLSPGRRLGPLRPFAHVFLIGCARNFRRTAHSSAVRSAEHFRTDLRTLATDSTPMARRNGDGGGKAGKKKMNGGKAAPKTDRLTALFSPECLKIESNFY

SEQ ID NO: 148107 - protein, 102 aa, Heterodera glycines
  Coding regions on vcDNA: vcDNA=SeqID_74530; Strand=-; Position=1 -256,405-457
  Homolog annotation: Hit_ID=CAE59445.1; Match level="QueryCoverage =46%, HitCoverage=49%, E-value=7e-12, Identity=76%"; Hit description =Hypothetical protein CBG02820 [Caenorhabditis briggsae]
MPLVFDRPWQPPISLVPNPPPAYFVIPANVPLERPIYDQNDSAIEDELAEEAKAKRAQTFVRFGKRAQTFVRFGKRAQTFVRFGRDAQRQQEMANEQAQKKE

SEQ ID NO: 148108 - protein, 19 aa, Heterodera glycines
  Coding regions on vcDNA: vcDNA=SeqID_74531; Strand=-; Position=1-57
GPGSRSRVLKSSGPGPGRA

SEQ ID NO: 148109 - protein, 106 aa, Heterodera glycines
  Coding regions on vcDNA: vcDNA=SeqID_74532; Strand=+; Position=1 -81,405-644
MNKSYNYSSYLQKSFIFFLLNFSIFLYDLVKKKETTKYQKNVNADLFRPLVDIRDKILYLAIKYFGIDKTENEGNCSMVQKSNSLNLKKRINDEFKKLIRTTSDKV

SEQ ID NO: 148110 - protein, 216 aa, Heterodera glycines
  Coding regions on vcDNA: vcDNA=SeqID_74533; Strand=+; Position=1 -357,1065-1358
MKKLVQKAMCVYASIEGAMQKSEKEKLNKMLNKEKEANKNKENIQRIGEEVDQEVEARRKALIKQENVREYHIDQLLLDQQHAVADHQPQQQPLAVMEQGESSAIKEIVAVGEDGAGKKANQALITEQQQTENVQAQAEQNSNGKKKLHRRNTLKDIFEETKSDEHIVDQNLSSKRSDSIKSEAISQELTKETNKPENERSNSLRMKLVETVDTKC

SEQ ID NO: 148111 - protein, 57 aa, Heterodera glycines
  misc_feature (11)..(11): Xaa can be any naturally occurring amino acid
  misc_feature (16)..(16): Xaa can be any naturally occurring amino acid
  misc_feature (19)..(22): Xaa can be any naturally occurring amino acid
  misc_feature (30)..(30): Xaa can be any naturally occurring amino acid
  Coding regions on vcDNA: vcDNA=SeqID_74534; Strand=-; Position=1 -99,148-353
  Homolog annotation: Hit_ID=AAP30773.1; Match level="QueryCoverage =100%, HitCoverage=39%, E-value=1e-18, Identity=82%"; Hit description= putative gland protein G24A12 [Heterodera glycines]
LSGQFGQKVTXSESKXAEXXXXIGHVPINXPKGVHVQNVPNSESVISMPGLAGSHTQ

SEQ ID NO: 148112 - protein, 81 aa, Heterodera glycines
  Coding regions on vcDNA: vcDNA=SeqID_74535; Strand=+; Position=1 -75,114-284
MNKILFLFIALFVVQIIAAYEPSCKCPENEEPGQKSCNGYEPSCDNPKPEICTARFCDCSCDCVKELFRDKTKKCVPKCPY

SEQ ID NO: 148113 - protein, 104 aa, Heterodera glycines
  Coding regions on vcDNA: vcDNA=SeqID_74536; Strand=-; Position=1 -179,341-476
MRQRKPESTPRPNKLPNAPDKYRPVNAAPDNHDQIKLSAGQLGPTKWIPKQTKKKTLGKPQNNNNGNAREGHVDLALAEANEGQAEEEVNEVEEEEEEEQQIGY

SEQ ID NO: 148114 - protein, 79 aa, Heterodera glycines
  Coding regions on vcDNA: vcDNA=SeqID_74537; Strand=-; Position=1 -132,915-1022
MRLVILMGQMQRLAKFCPNGCTFRGKMGCRSNCVAKILTNKRTLALVMTALGLQVEGYAGKLMKTWKIQPQISIRIYLL

SEQ ID NO: 148115 - protein, 116 aa, Heterodera glycines
  Coding regions on vcDNA: vcDNA=SeqID_74538; Strand=+; Position=1 -80,164-492
TKLLQEWTLSHFTDNSTDLNQLSSIDSFGLLPYAFGDFDGPNATAGQVLSKWLHIPRKDGVPKQLRCKDFNEQADFGWVNILKEVATRDGPCHHFFRHLPIHFTVHAPSMPIMPFE

SEQ ID NO: 148116 - protein, 138 aa, Heterodera glycines
  Coding regions on vcDNA: vcDNA=SeqID_74539; Strand=+; Position=1 -147,363-437,481-673
  Homolog annotation: Hit_ID=CAE63310.1; Match level="QueryCoverage =94%, HitCoverage=6%, E-value=5e-25, Identity=43%"; Hit description =Hypothetical protein CBG07699 [Caenorhabditis briggsae]
MILHEEEGELEVLRDEEQMYKRMARGRNDRGMVAWEMHLCTPDAPLGRKIVLIANDITFQMGSFSMREHRLYQKASEYSRKHQMPRIYVAANSGARIGFASDVTNRLKIVWNDEERPEDGFNTSRWIVGEGGSDILSP

SEQ ID NO: 148117 - protein, 419 aa, Heterodera glycines
  Coding regions on vcDNA: vcDNA=SeqID_74540; Strand=+; Position=1 -327,384-471,524-966,1016-1417
  Homolog annotation: Hit_ID=XP_314071.1; Match level="QueryCoverage =69%, HitCoverage=12%, E-value=8e-88, Identity=55%"; Hit description =ENSANGP00000015662 [Anopheles gambiae]
MINLSPLTKDDYARLVNTHPTKSAYDPRTILDSDDEGLFDRGTFDEIMSGWAKTIIAGRARLRGISVGVIAVETRTVECELPADPATQDSQARLVQQAGQVWYPDSAFKTSEAINDFNREGLPLIILANIRGFSGGQKDMFEMVLKFGANIVDALQTYTQPIVVYLPPFGELRGGAWAVLDTKINPTCITMLADPNCRGGVLEASGIVEIKFREKDLLILLRKCDPKINQLEESLATASDPTAKGQLQDEYKRRIEKLLPICRAAAVKFADLHDTTARMLQKGAIHDEVPWQNARNYMHGLISVHSTKLQMARRYLDAIGRGTTNVSVDELAIGLQWVDEHLQKTDVQVRREVKPEERGTNNSSKRTRFIYFDEQISKYADGDGFRKALAAIRQKSLLERLTALSKEERDQLILVLSEK

SEQ ID NO: 148118 - protein, 38 aa, Heterodera glycines
  Coding regions on vcDNA: vcDNA=SeqID_74541; Strand=+; Position=1-114
MRGIASKFLSKFSGAIPRLDEFADCRLADIIPITDQHF

SEQ ID NO: 148119 - protein, 95 aa, Heterodera glycines
  Coding regions on vcDNA: vcDNA=SeqID_74542; Strand=-; Position=1 -152,194-329
  Homolog annotation: Hit_ID=NP_490770.1; Match level="QueryCoverage =93%, HitCoverage=40%, E-value=6e-21, Identity=53%"; Hit description =phosphoglycerate/bisphosphoglycerate mutase (24.9 kD) (1B166) [Caenorhabditis elegans] gb|AAK21514.2| Hyp
MVKTLWIVRHAEREDNINSNWQKNANPQKLKSDNSPLSSRGIKQATELAERFSNVQIDHIFASPFERTVQTATFLISQRKIPIKVEPGLAEVNPL

SEQ ID NO: 148120 - protein, 420 aa, Heterodera glycines
  Coding regions on vcDNA: vcDNA=SeqID_74543; Strand=-; Position=1 -987,1080-1353
MGLRAPTQFDDFSRNFDVYTAEWPEKKRISALESKVYGRAERAFEAAKATQPFQYALIRRDMLNQLEETDATQLNAFDELMIGVKRGANETIDALANRISGLVRRAYVGLGQHLCDEYAIKFLIRAMASPELALNLELARTQGMNLNHFVSLAARAESTQKAAKRFTNPNPRNVDRMDSYDSHGVPNQQTRNFSSRPANTFQRQYPNSLKCYNCDQPGHISRNCPRNRQPFSPPQNFERQIVSNFSATGANRVPLNHPFGNNQNQDVKHHNPSRNFLRQNCVIVQEEVPHLNVRLGKVDLDPEVTDFFDKLGTECSKKEAVAYTIGKVMLVIEKHLNLWEAGFCNSCPKISDVNGKLLECLGTVSIPVHRKGLTEPKLCTFNITKAPIGFNLLLGTVPFETVKPERKDFSKHIESVFHRI

SEQ ID NO: 148121 - protein, 113 aa, Heterodera glycines
  Coding regions on vcDNA: vcDNA=SeqID_74544; Strand=+; Position=1 -252,1018-1107
MPNIPSHKISFSILIVDNEFANGTKYFFHFQCASRLTNNFYLEKKMGEKNGQIEFMDEICEDNLYRIGVMVTQNTSLPLQFQIKPRRNFVEALNLLGNFASGHHQQHTEEVLN

SEQ ID NO: 148122 - protein, 38 aa, Heterodera glycines
  Coding regions on vcDNA: vcDNA=SeqID_74545; Strand=-; Position=1 -90,154-180
MKANGQNGRMKRTIGEFVISGIKLAFIFMMASNNSRPK

SEQ ID NO: 148123 - protein, 108 aa, Heterodera glycines
  Coding regions on vcDNA: vcDNA=SeqID_74546; Strand=-; Position=1 -47,110-389
MSDRRKEAEEKMEKAIFISADCWLCVFDLLPTSQLGLGIALISHRFDLYIDEHFKTRKWTLKSIQIDRKFGKNGTKQMEIINHYWKPLPIPQNPLPKKIVGFKDISIE

SEQ ID NO: 148124 - protein, 40 aa, Heterodera glycines
  Coding regions on vcDNA: vcDNA=SeqID_74547; Strand=-; Position=1 -47,95-170
MSDNGKEAEKEMEKAIFISADCWLCVFDLLPAYHLASELH

SEQ ID NO: 148125 - protein, 148 aa, Heterodera glycines
  Coding regions on vcDNA: vcDNA=SeqID_74548; Strand=+; Position=1 -123,165-264,642-863
MIHNQHCNGVPLEQLTAEQIDRSQRRDLAQCSTDPKSIWREGSDRSREHDIAEDIGVEDTTGIPFNYPNWQTVRSDAPIEYPVPFDFVSSEYGPGEVISILGDGNCGWRAVSVAMTGTESNHAEIRRDVIEYLQETINQNSYTENSWW

SEQ ID NO: 148126 - protein, 42 aa, Heterodera glycines
  Coding regions on vcDNA: vcDNA=SeqID_74549; Strand=-; Position=1 -86,545-587
MLKNYVNKYMQFDFVLYAYFYEVRVNRRNLTAVFFRRVGPLK

SEQ ID NO: 148127 - protein, 119 aa, Heterodera glycines
  Coding regions on vcDNA: vcDNA=SeqID_74550; Strand=+; Position=1-360
MSANCPWFPPQLVSISPPLSLPLLADSHQIIGAKFGAILRHGNFHDKFALFVEQPNRKFLCFFANSELHSQHFANFRCSFNGKLRIVSCNPTMLGNSWQNVGETRFGRFIRIFSGMEEL

SEQ ID NO: 148128 - protein, 122 aa, Heterodera glycines
  Coding regions on vcDNA: vcDNA=SeqID_74551; Strand=-; Position=1 -77,125-268,332-479
MNHKSLIIFVFLTAFCSFSYQIEPEKVVYLSDATKNYFNTEYNAMDQCFKKESKQKKINSFLLKFKIIGKCNKGMLICYPGALDAEQSKFSFGMVPEKQFRIQNIAGVIRTNCTQKFDHLTN

SEQ ID NO: 148129 - protein, 289 aa, Heterodera glycines
  Coding regions on vcDNA: vcDNA=SeqID_74552; Strand=-; Position=1 -240,391-648,698-828,886-1020,1364-1471
  Homolog annotation: Hit_ID=NP_741381.1; Match level="QueryCoverage =85%, HitCoverage=65%, E-value=2e-30, Identity=35%"; Hit description =SH3 domain containing protein (4F376) [Caenorhabditis elegans] gb|AAM98033.1| Hypothetical protein F19C7.
VSIPCHLPASRRDTSLGISEPLNGTFSPAEVSNRVGLCKSARTPKLSSQMKSFSLDCADFMPASPPVQPKNGGIRHNHYMHKPPIRSARAAFVSSGGAQMATIVPGQFERREKRTESACGAGANGSAVVVGTVRRQRRLPPVPTQKKENAQTAPSEQPPIQHTAKLLISRPQLLHIVTHEYASSECALRPGDRLVVVYNGDPDWKHGFKLNDRLEQLITFPSSCVASYKAEEQPMRLLQSCNLSDQKLRLYRDQVVFAQPDSLSKDGKVMVRNEHDKFAKCPLQFLSLA

SEQ ID NO: 148130 - protein, 57 aa, Heterodera glycines
  Coding regions on vcDNA: vcDNA=SeqID_74553; Strand=-; Position=1 -84,316-405
MTMFKELTNRQLVAIVMLAISNLCSTVVMHVIGSKWMCIAGLQIASLAAIAFGYVVS

SEQ ID NO: 148131 - protein, 57 aa, Heterodera glycines
  Coding regions on vcDNA: vcDNA=SeqID_74554; Strand=+; Position=1 -50,93-216
MCAPHVYFFLDGYCARRCYFRFAWRHFVGSHLNAFCNGGRKKNNELRDCLLKKDALM

SEQ ID NO: 148132 - protein, 108 aa, Heterodera glycines
  Coding regions on vcDNA: vcDNA=SeqID_74555; Strand=+; Position=1-327
  Homolog annotation: Hit_ID=EAL36064.1; Match level="QueryCoverage =70%, HitCoverage=9%, E-value=4e-09, Identity=44%"; Hit description =hypothetical protein Chro.60622 [Cryptosporidium hominis]
NKYFKTEWGCAVSQDRVSINQQIGEAVKAEVDCEAMFGQKDVDFSNENFTIDMLEVETTTTTTTTTTSRQLEVITTAQPTTTTSSSTTTTTTTTTKPTIEESTNSTNG

SEQ ID NO: 148133 - protein, 147 aa, Heterodera glycines
  Coding regions on vcDNA: vcDNA=SeqID_74556; Strand=+; Position=1 -31,1154-1240,1461-1782,2012-2015
MPKQKTVYEGGTEENPLYLTFTYITFILVSEQTASISSKRRTHCSDQSRKTACYLQILSAYRYEKTEIEQDILSSYSNSGVDERNKYWNNWLNAFKCHWMEGKPESGCCAENYNLIRHTKVLAVMISNFKIDSRIKKCLPKRQPDTF

SEQ ID NO: 148134 - protein, 57 aa, Heterodera glycines
  Coding regions on vcDNA: vcDNA=SeqID_74557; Strand=-; Position=1 -24,389-538
MVNYLKYKGDRKHLELVKLYQELRLLKSPILRSYRILFFPSHAPILQLAQLLTECFI

SEQ ID NO: 148135 - protein, 1123 aa, Heterodera glycines
  Coding regions on vcDNA: vcDNA=SeqID_74558; Strand=+; Position=1 -633,681-1352,1401-1841,1949-2256,2307-2707,2759-3101,3151-3722
  Homolog annotation: Hit_ID=NP_001004509.1; Match level="QueryCoverage= 71%, HitCoverage=53%, E-value=6e-69, Identity=28%"; Hit description =si:busm1-180o5.3 [Danio rerio] emb|CAD60788.1| novel protein similar to DNA polymerases [Danio rerio]
MQNQPPKHPSLFSIDQILSAPSKKPRRGFLINELLGEVLQEGGGSSSSSSSKSTKEYVKKLDSTIEHVPRFQYSKIKSRFSIEDVPAANPEGLLAGIFQYCLDAAMEESRGRGIEPTHLGCMISSPLLTGGDIPIPVRQITDNTVNTILNQFTKVAQSKQQQNVTLWGEPFTVVVTTVDRTGLPGRRVLKGGARRSLAPVHHRVTETCLIKICNPDGHCLFYALQATMVAKTSGWPRWKFHRYVHSLHGQQGCLRRDALQLMQQIGVRTGRNTYDAEICVPRVVDHWNNTQQQHRFAVFIFGSSGQYKPLYKYINDHYDTPIVLYLNNQHFDGVQKLHGLFGQPYCLDCEKPYERPSRHLNSCKARCLLCSRVGPAFPCVPLGGFFHQCAGCNKKFRNNGCLQHHLASNFCAQSKQCKDCGVIWDTRVHNRDGRKGHKCHESYCQLCNTFHNPERGCFIQPIEPKEQDPYHIVAFDLETMQHQPVDPQQPEKREHQPNFIAARVACPECIESGNWRRATAGCRFCGPHRTVAFCQRPFEDTRVDKRVVADNPLQAFVDWLIFQLPAKYDTYAYSHFGGRFDMGNKMYEMKVRKQKRRNPNIVFRDSFNLMPCALAALIPSYGLDVEDKPFFPHLANRPENYGREIHPTPEDYLANGMMPSKRQKFDEWYAAHRHEPFKLDEALASYCTNDVEILMAALVAFRREFFEISRRQDYVDGIDDKENHDGIDVLRECMTIAGACMRHFRTNHLPDEHLAIVPERGYDNAQNQSLLALRFFHWYAKEHGVQVQTAHAAEGEKRIGPYSLDEWIEAERRAIEVNGCTWHGCKKCYPNDNMLLPSGKTAGQVRERDSKRMEFLREKVNRVDVYLECEIHRMLERSKEMRKAFEDYVDDGPLVIRDAFMGGRTGPLKLLRKAGPGEKISYYDFTSLYPYINFTTRYPIGTPKVHVLNQEVDWRSAADNPYPLALLKVWVVPPRRVDVPVLPVKVGKRLCFPLCITCAKEHPTGGVDNDYHCEHNDRQRGWVITCTSIELNETLDEGYTVTRVFRVLEYEQSDDKLFRPYIAEFMAQKIQASGFDNSIRGDAEKEQQFVRECAEQFDITIDPTKMAVNKGKRSLAKLCLNNL

SEQ ID NO: 148136 - protein, 68 aa, Heterodera glycines
  Coding regions on vcDNA: vcDNA=SeqID_74559; Strand=-; Position=1 -63,530-673
MENELKESRHLNKISKLEQQNKELREKIKHCGLVAELNVLQEKVAKIGEEKQREKELTKYGRNYQTLL

SEQ ID NO: 148137 - protein, 92 aa, Heterodera glycines
  misc_feature (45)..(45): Xaa can be any naturally occurring amino acid
  Coding regions on vcDNA: vcDNA=SeqID_74560; Strand=+; Position=1-278
  Homolog annotation: Hit_ID=AAP51089.1; Match level="QueryCoverage =98%, HitCoverage=26%, E-value=5e-26, Identity=53%"; Hit description =transposase [Forficula auricularia]
VAFLTQQKIEQLRWAVLPHPPYSPDISPCDHYLFRSMEHFLRGKXFADQNEVENALDDFFVSKNDQFYKKGIEMLPERWERIIDQNGEYIID

SEQ ID NO: 148138 - protein, 146 aa, Heterodera glycines
  Coding regions on vcDNA: vcDNA=SeqID_74561; Strand=-; Position=1 -74,161-387,1319-1458
  Homolog annotation: Hit_ID=AAV34698.1; Match level="QueryCoverage =90%, HitCoverage=49%, E-value=5e-13, Identity=34%"; Hit description =IC5 [Globodera pallida]
MYSILLNNNSSRIFYYEISLKHLKGWAFFGFALRQQQTSKDETIRYSTGTYAYEKNGELWINGKRKEGSDGYSYGVGDTVGIGVNLSSRRIIFTKNGRQLDNSELMATSSCADCFFFPFVTLSLNGAGDKIEANFGPNFRFDLVTL

SEQ ID NO: 148139 - protein, 332 aa, Heterodera glycines
  Coding regions on vcDNA: vcDNA=SeqID_74562; Strand=-; Position=1 -63,920-1037,1300-1392,1478-1843,2333-2437,2495-2748
MENELKESRHLNKISKLEQQNKELREKIKHCGLVAELNVLHEKVAKIGEEKQREKELTKYAPIDAFEAIFGRIGEVEKKPATKGKYGKRIYTQDTWMFESTSAFFQILSDWVGREKAASSDTTAQVEIELTEQTFADCREAIKGFVHHLMCTISIIICLIKALGIFSNTDPKVLLRRWRSGYRKRHPEATAQVQCGVFVIDGEQMDEQEKRTCVGQRKDQKTLLDRIDELEGQLKSLQRQQEDETSKYVSVELFNEMQKDHNELLEKFNALEKQMNELQQNKTNECCWESVGTSGGCARTQGHFTRKGDLVKGKEHLQPQVERGDNLISDRI

SEQ ID NO: 148140 - protein, 242 aa, Heterodera glycines
  Coding regions on vcDNA: vcDNA=SeqID_74563; Strand=+; Position=1 -209,260-689,792-881
MALLSDRFDVLVDKHFDGKSELTIWRAIAIRKDKGPKAKLSVLIDDKCVAFPFPDHPLPNKIRFKDLQIYYVDHSVLAFLRSNKQIWDRSGIKLDLFLPLYMTDVKLIWDVFTREIWPLFAKSIRHLSFHADNLENLRRRISPTLLTDLDQLYSIDSGALFPDGIADDGPNATAGQALSKWLHTPSKNGQPKQLHRNNYFGPPKLEWVNNFKETFRRATTSVSYTIQLYIIVEPMPIDHLNW

SEQ ID NO: 148141 - protein, 67 aa, Heterodera glycines
  Coding regions on vcDNA: vcDNA=SeqID_74564; Strand=-; Position=1 -101,164-266
MSNCYKWEDCENSGANANLNHIRFDLWSFDKSIGPLSPPAEEEKEEEADQSNNEMFSTTPGPSGSAE

SEQ ID NO: 148142 - protein, 133 aa, Heterodera glycines
  Coding regions on vcDNA: vcDNA=SeqID_74565; Strand=+; Position=1 -100,659-960
MVAHAEQRWTTKAIAFPCLCGPTKSRMAQQFPRDISPCHLFGSYTVRIIFRVKPMPIAPFELMNEVTNEKLTLIKGGAFRWLLKRCPIVGETAAVVQKQQKKDEKLDRLNGVYFCLYDAIFSTPGHIDQRKKK

SEQ ID NO: 148143 - protein, 127 aa, Heterodera glycines
  Coding regions on vcDNA: vcDNA=SeqID_74566; Strand=-; Position=1 -109,607-880
MSQQKSFSSTDVCLKRTATQNKETENNDEEDEKESSGPNTPPLPPGLSAFSLSGFYGQHRLGWSNTSSLASVWSPPATTEQQAVPTFSFFEANSPIGGGTPSIERGQQLLRAGKRSPDFEGILMGRR

SEQ ID NO: 148144 - protein, 125 aa, Heterodera glycines
  Coding regions on vcDNA: vcDNA=SeqID_74567; Strand=-; Position=1 -77,144-189,231-343,405-546
MQRKIDNNSIQNYEQSKEAAATAALIKKYNESFPEANFPEMFPLSTPQAQPFSMAKRSLLAKNASTNDLTQYINPVLANRRRSSLFCTAVDPAMKRLRQREAYKTAMCQVGAFTALGKKHWLRLF

SEQ ID NO: 148145 - protein, 223 aa, Heterodera glycines
  Coding regions on vcDNA: vcDNA=SeqID_74568; Strand=-; Position=1 -226,983-1176,1226-1476
MLRFSEPKLALDSFCHWIVPIEAEDKGSADGISKSDEMSEEMRQIVKFWMAILSAKMFSHCSNWTENELIMLRDIGEMIQIVVIRAGNRSKEKIDVLMKTVQSESEFENIYAKFSNFLVACQPEHQLMLSPWDKIVQKFPGNQNEFGNLFDVQPFERKASFEIPKSSEASASNCAPKNSKRKVSPKRKERKGTEGHWSGICSFCHKAEVLIAGFYCSNRVAMT

SEQ ID NO: 148146 - protein, 115 aa, Heterodera glycines
  Coding regions on vcDNA: vcDNA=SeqID_74569; Strand=-; Position=1 -126,188-409
MKNVLPFLILLLAQFSSSVCQIIRKYDQNVETINEATHHLAQISPPGNYRIIIWANFKQQKFECEENSIFFNVRRLEKHGNDENNKSLYFRWTTLIWQLEQLPKWFWGFLHCYNG

SEQ ID NO: 148147 - protein, 101 aa, Heterodera glycines
  Coding regions on vcDNA: vcDNA=SeqID_74570; Strand=+; Position=1 -149,579-734
MNIGSVGSSAMGSRTAEMHRRMLQRMRMDASNVPENRAFNTLARGLFQAWLRFGNPNAVVVFAVLQGSMRRFDERAVEYELQRISDWQVKVVRLSSKEAYS

SEQ ID NO: 148148 - protein, 121 aa, Heterodera glycines
  Coding regions on vcDNA: vcDNA=SeqID_74571; Strand=+; Position=1-366
MDKVLLKIYYGLKSPASYAGVQKILAEAKKVNPKITPEDVNKFLEKQRTYTIHKPIRKRLPRLKTIPSSNSDHVHQCQLFLGPFIHQFIWHNWRCRSQWKLNNVSGGQSGGTEKCPNKKPS

SEQ ID NO: 148149 - protein, 75 aa, Heterodera glycines
  Coding regions on vcDNA: vcDNA=SeqID_74572; Strand=-; Position=1 -67,110-270
MVDLISIFLYGIILLSKMGERFAQNFRKCRINIGGVAQLVKGWLLSLGPYEFNSPCLLLAETRPSCAAQFLFYLF

SEQ ID NO: 148150 - protein, 47 aa, Heterodera glycines
  Coding regions on vcDNA: vcDNA=SeqID_74573; Strand=-; Position=1 -69,246-320
MAIDLEKFLLLSPYSDVLWFSKMRSLIRNENSQQGQVAFNRPHENSF

SEQ ID NO: 148151 - protein, 30 aa, Heterodera glycines
  Coding regions on vcDNA: vcDNA=SeqID_74574; Strand=+; Position=1-91
MDAGFVISEDHSWRRSARIAPIELRKCQKT

SEQ ID NO: 148152 - protein, 181 aa, Heterodera glycines
  Coding regions on vcDNA: vcDNA=SeqID_74575; Strand=-; Position=1 -47,181-297,343-531,608-718,762-843
MALRKAHLPSASARTQTKTAASPASASKGSNNKPKQQKNSASASASMTSVMTLTQTKTAASPASASKGSNNKPKQQKNSASASMTSVMKRTQLASKYFGNYLVVFQDHNRSISSAGIWTKTAASPASASKGSNNKPKQQKNSASASMTSVMKRTQTTTAASPAPVSGTMASAMTFTELAIK

SEQ ID NO: 148153 - protein, 269 aa, Heterodera glycines
  misc_feature (2)..(2): Xaa can be any naturally occurring amino acid
  Coding regions on vcDNA: vcDNA=SeqID_74576; Strand=-; Position=1 -132,188-363,454-620,819-910,959-1058,1158-1223
  Homolog annotation: Hit_ID=CAE67546.1; Match level="QueryCoverage =93%, HitCoverage=47%, E-value=7e-64, Identity=41%"; Hit description =Hypothetical protein CBG13071 [Caenorhabditis briggsae]
KXQKKILLINVILAEGMCRTKNLMEKERCNVHSCRRLLSAHSEEICEEEKETGQCQGQFPRYWFNEICEEEKETGQCQGQFPRYWFNTKQQKCERFVYSGCKGNRNQFESEEECKQFCIPNYRPTLAATNGGKTTEEGEEGTDGDGGTATDCEMSEWSPWSECSVSCGRGKRSRHRSVKSLPQNGGNKCPPREHRVQERHCEMRPCGKWITCRVTCRVSRWSIWSPCSVSCGIGYQTRRRRVHRYGLIDPDDPNCHAQELEQRQCRMPC

SEQ ID NO: 148154 - protein, 302 aa, Heterodera glycines
  Coding regions on vcDNA: vcDNA=SeqID_74577; Strand=-; Position=1 -77,143-258,398-603,778-1006,1066-1144,1268-1423
  Homolog annotation: Hit_ID=CAE67546.1; Match level="QueryCoverage =100%, HitCoverage=35%, E-value=1e-118, Identity=64%"; Hit description=Hypothetical protein CBG13071 [Caenorhabditis briggsae]
LTHFTDVLGASHSKHYRLWRFGDIASDGLKEIAEWGNDGLKEIAEWGNTYKGEAEMKANASEVRTIVKMKGLWYPEVQGRTNGHFRVNKYHHLASLAAMFGPSPDWCVGISEVNLCLPDCSWVQERAFDLRPFDAGTDNGYTYMSPNEPAEPRVPIAAITTRDDPRSPFFDEHSEEIAPLARLVLRRKNVLTAQCQSEEAYRREAFNSTNTSEDEEYRDRRECAECAVSQWGSWSLCSATCGKGIRMRSRVFVFPVKAQMFHCHRQTTERQFCNAKQSECGADSDAFNSRCLVSGWDDWTEC

SEQ ID NO: 148155 - protein, 18 aa, Heterodera glycines
  Coding regions on vcDNA: vcDNA=SeqID_74578; Strand=-; Position=1 -52,152-156
MNGGCWDYGDYDDSGGDY

SEQ ID NO: 148156 - protein, 140 aa, Heterodera glycines
  Coding regions on vcDNA: vcDNA=SeqID_74579; Strand=+; Position=1 -152,1376-1485,1714-1874
MTSPSTFSAARLFAKLSGNSNQQQQSIEHKMAELRAAYAIQPAQTPTVAKSGANSTQNKSSAPPPRRPGRTSLPTPSLGDMLELPQLSSRSCVPSRRASTVTACFSPAPSLMDLASSAGLLSLSPSGTIFNFGIRHFNKF

SEQ ID NO: 148157 - protein, 158 aa, Heterodera glycines
  Coding regions on vcDNA: vcDNA=SeqID_74580; Strand=+; Position=1 -30,534-698,946-1226
  Homolog annotation: Hit_ID=CAE68448.1; Match level="QueryCoverage =72%, HitCoverage=49%, E-value=2e-15, Identity=42%"; Hit description =Hypothetical protein CBG14238 [Caenorhabditis briggsae]
MRRLMRRASEASLVENIAQLAEICEAVTDTRLDGSDHSLAVYRLLLAKLDQKTNVEWFESVLVPAALLERNGIPVSELSLLTMGILVWRCTLNNARLLCLVNSMPQQQMHEDGNATAASFEALKRAANKYKCMHHVLTIGQRRPSAGSTHSSCSSSSR

SEQ ID NO: 148158 - protein, 86 aa, Heterodera glycines
  Coding regions on vcDNA: vcDNA=SeqID_74581; Strand=+; Position=1 -160,297-394
MSGIPGGMRNRRSRYKKLLWSHFGPYLILEINDSSAFLVPIDNRNTEPRAERKMMEVDEEDDDKTFDWDVLCAEDLDDHEFCAVFR

SEQ ID NO: 148159 - protein, 20 aa, Heterodera glycines
  Coding regions on vcDNA: vcDNA=SeqID_74582; Strand=-; Position=1 -52,100-110
MSKYFMFKQTFQLIKYKESF

SEQ ID NO: 148160 - protein, 43 aa, Heterodera glycines
  Coding regions on vcDNA: vcDNA=SeqID_74583; Strand=-; Position=1 -61,715-785
MNNKIASSSYPANSAAPQNDSFYKFPLCCEFGAPLRDPRGKAK

SEQ ID NO: 148161 - protein, 293 aa, Heterodera glycines
  Coding regions on vcDNA: vcDNA=SeqID_74584; Strand=+; Position=1 -39,336-660,714-1069,1129-1290
  Homolog annotation: Hit_ID=CAE59919.1; Match level="QueryCoverage =88%, HitCoverage=34%, E-value=4e-72, Identity=54%"; Hit description =Hypothetical protein CBG03405 [Caenorhabditis briggsae]
MDKCFKEMLAISPFKLGVPAYALDGDNIRHGLCKNLGFSAEERAENIRRVAEVAKLFSDLGMVVLASFISPFRAGREEARRIHSKVGICKRLKTEIVQENIPFFEIFVDTPIEVCEARDPKKLYKKARAGKIRGFTGVDSDYEVPLQADLVLSSGVDSETKCLQQMLQFLFERNVLPENVNPLSNSNHRQFPFPQAMFQFCGQSVRQLFVPDDISRRRLLNGIGLCPAVHLSLVDLQWLQVLAEGWASPLPGFMRERQYLQCLHFGQLMDLQSFCGAAEFAGYEEEAILLFMR

SEQ ID NO: 148162 - protein, 116 aa, Heterodera glycines
  Coding regions on vcDNA: vcDNA=SeqID_74585; Strand=+; Position=1-349
DCLNHPDEIQKVEKYLKGKTLQTTYKNQLDEYKDFEYGGITRESARKQMAYNGFKNVTVDQHFYVRHRICLRYSSNPCVIEKHKNGNERFYPLELVKVKDNDIIYLGQNFPKSIPL

SEQ ID NO: 148163 - protein, 222 aa, Heterodera glycines
  misc_feature (22)..(22): Xaa can be any naturally occurring amino acid
  Coding regions on vcDNA: vcDNA=SeqID_74586; Strand=+; Position=1 -101,1183-1754
  Homolog annotation: Hit_ID=CAB40395.1; Match level="QueryCoverage =95%, HitCoverage=84%, E-value=4e-40, Identity=39%"; Hit description =TATA binding protein of transcription factor IID [Guillardia theta] gb|AAK39780.1| TATA binding protein of
HFSNAFLTQQNKNIYIFQMHFXRKTNTKRHTSIKIFSHYSFKMFFPTIKNCVAVVDLKIPLDIEKIYLIAPSTKYNPRKIHAVIMKVYNPNATAIIFSTGKFVCTGAANEKECRQAAEQVTERIRQCGYYEARIHEFAVKNLIATADVGFHIRLGPLSDFLGEYCSFTPELFPGLVYRNQNPKISIIVFSSGKLNLTGSRSKEEIDFVFNQFYQIICNFKYS

SEQ ID NO: 148164 - protein, 296 aa, Heterodera glycines
  Coding regions on vcDNA: vcDNA=SeqID_74587; Strand=-; Position=1 -373,448-965
MDTTTINRILAGNTKTREHYLGCFPCDKLPNKINKYPSALVANNDPSNKEGTHWIAMFIVDDKTVYYFDSFGRKPNRCISQFLRNYESVISNKPAIQSVFSENCGYYCIYFVHCMCSLGGRNYEKTDKKYLKEFIINSFIKMDRLDTVIASLLNCPARNLCDCLNHPDEIQKVEKYLKGKTLQTTYKNQLDEYKDFEYGGITRESARKQMAYNGFKNVTVDQHFYVRHRICLRYSSNPCVIEKHKNGNERFYPLELVKVKDNDIIYLGQNFPKSIPLLDENNSKYNDNYYDSYRLW

SEQ ID NO: 148165 - protein, 91 aa, Heterodera glycines
  Coding regions on vcDNA: vcDNA=SeqID_74588; Strand=-; Position=1 -165,219-329
MSPNECSDRPFQQPDNVQTVQLPHQQPDEDAELRAQIEDAEEDLLLNWWREDPTIIRFLFGHRRAPTIEAALLQRAEREAEILRQYAENHQ

SEQ ID NO: 148166 - protein, 39 aa, Heterodera glycines
  Coding regions on vcDNA: vcDNA=SeqID_74589; Strand=+; Position=1-119
ISFYLVTPILRPMKRAIGRPLVRTNRKEFSETAKCGQKE

SEQ ID NO: 148167 - protein, 21 aa, Heterodera glycines
  Coding regions on vcDNA: vcDNA=SeqID_74590; Strand=-; Position=1-63
KVGTGTKFFDRDREKTRDQPG

SEQ ID NO: 148168 - protein, 48 aa, Heterodera glycines
  Coding regions on vcDNA: vcDNA=SeqID_74591; Strand=-; Position=1 -49,278-375
MAEKRIAKRREGQAQVAVLFLCCFSFLLIDRLGQSERWPKRWTMVVRK

SEQ ID NO: 148169 - protein, 66 aa, Heterodera glycines
  Coding regions on vcDNA: vcDNA=SeqID_74592; Strand=+; Position=1-201
MISLAHPHHEVRNLTSWSNTREIKKKEKKKKERKEAKRKEENGVSGGWDELSLQLTPPKLTNQPIN

SEQ ID NO: 148170 - protein, 88 aa, Heterodera glycines
  Coding regions on vcDNA: vcDNA=SeqID_74593; Strand=+; Position=1-267
MRGELVARNSVAERAEKASSVYENVATGERREAAEPAAPREANYDANDGANDHNYEQQQQQHGPPQNGQGGERREGPKGEIWYEFGCV

SEQ ID NO: 148171 - protein, 33 aa, Heterodera glycines
  Coding regions on vcDNA: vcDNA=SeqID_74594; Strand=+; Position=1-101
MAKLPPFFADPQNVQPTKCPSLEFEFFIIQMGL

SEQ ID NO: 148172 - protein, 22 aa, Heterodera glycines
  Coding regions on vcDNA: vcDNA=SeqID_74595; Strand=-; Position=1 -36,489-521
MNNFLSTIIHLMLPNYPVEIGQ

SEQ ID NO: 148173 - protein, 83 aa, Heterodera glycines
  Coding regions on vcDNA: vcDNA=SeqID_74596; Strand=-; Position=93 -308,364-399
MSDMSAYMGSGPAEPAPSSGAAEASPSSGVASAYMGSGPAEPAPSSGAAEASPSSGVASAYMGASPAYEPPAQEKSPDQSAYM

SEQ ID NO: 148174 - protein, 153 aa, Heterodera glycines
  Coding regions on vcDNA: vcDNA=SeqID_74597; Strand=+; Position=1 -70,153-544
MSAFITGDLFYSGYHFCELVTNFKNALPTGRNNGTDCSVWHSEFEADDANIALPLSSLDGGAKQKTQPNHLARRRRTKKATAPSSTKGLLALGRERMAAISPVAEEDEEEEEETDREDEDEDTDQREEDDRREKGRRKETKRRRESSRGVTEL

SEQ ID NO: 148175 - protein, 25 aa, Heterodera glycines
  Coding regions on vcDNA: vcDNA=SeqID_74598; Strand=-; Position=1-75
TCTCGVVVKLSTFHNFSPGFNSPLG

SEQ ID NO: 148176 - protein, 110 aa, Heterodera glycines
  Coding regions on vcDNA: vcDNA=SeqID_74599; Strand=-; Position=1 -255,961-1038
MVTKKGRIVIKVGQMATKLGRIVIKVGQMVTKKGRMVIKMGLMVTKLGRIVIKVGQMVTKKGRMVIKMGLMVTKLGRIVIKMGLMVTKQLQLSILTRGKSLFVFEELNKT

SEQ ID NO: 148177 - protein, 90 aa, Heterodera glycines
  Coding regions on vcDNA: vcDNA=SeqID_74600; Strand=-; Position=1 -93,140-319
MALRQMFFIPGNQQEVAMENRNYDEFRVGIEATEENVSRFYEEKEKFSNLPTLTLELHAETRVKAENLNTEVKTKWQALIGLVDLRKKLL

SEQ ID NO: 148178 - protein, 139 aa, Heterodera glycines
  Coding regions on vcDNA: vcDNA=SeqID_74601; Strand=-; Position=1 -29,72-286,545-685,762-796
MNWYFRMENRIDFIQKVPESVELCEQNKEKFQSENDGTVQAYERVMVESQQLLQSLKQQRELLEVDNSEAACHVHRLTRDIELAAGPRRIATLRGQGCRSVQAVSHRQHCQGATDRVRCNEKTKRTVTVHSRKEFATCL

SEQ ID NO: 148179 - protein, 25 aa, Heterodera glycines
  Coding regions on vcDNA: vcDNA=SeqID_74602; Strand=-; Position=1-78
KCHGTRKVLLGRVKCHGTRKMSWDA

SEQ ID NO: 148180 - protein, 182 aa, Heterodera glycines
  Coding regions on vcDNA: vcDNA=SeqID_74603; Strand=+; Position=1 -94,149-603
MMLHKLSFPFLPIIMMDFAIGRIALNDECQKDFFGTADQLEEMALEIFAAADKQTENGKFFEKGFDIFCCIAFEIEKDALNKDELALIDEFEANQRNFCHQLKKGQNIWEAVESPAGNAIVTAARNAKVNSLIHEEGLRKLEKMQNSSPENQAEIGMFAKHCIAALKLFQQFITGISLMQNN

SEQ ID NO: 148181 - protein, 305 aa, Heterodera glycines
  Coding regions on vcDNA: vcDNA=SeqID_74604; Strand=+; Position=1 -94,142-573,1056-1447
MMLHKLSFPFLPIIMMDFAIGRIALNDECQKGFFGTADQLQEMASEIFAVADKQTENGKFMEKAFVGILCCITIKAENDSMKKEELAMIEDFEANQRNFCHQMKKGQNIWEAVESPAGNAIVTAARNAKVNLQTYEEGLRKLEKMQNLSPENQTEIETFAKHCFAALKLFQQFITDERLAQTLLAGGGQTVSDQSSALSAQPAPTRSDQLQKEKSSRRRKRSSKWPKCLGAFALAGFSGYVCSIFARLLKINHVNIFTSHHPVVQPHPRISLVMEVLVSMYMFFVLSLVSIFLGIYHCFVKRDYY

SEQ ID NO: 148182 - protein, 155 aa, Heterodera glycines
  Coding regions on vcDNA: vcDNA=SeqID_74605; Strand=+; Position=1-468
MIVIVIPFLVIPQQLSAFDGSNRSFFPPLSIGIQTPNQCQKGEEGPLAKPTANCQNGEESEWSTKSAPTPNEMSGNKRAKKRKREKVAKNGQNGEGEGEQRNAKKCNTNAKDNNNPIVQMVMSAVAEGTAATTAINLNTCGQFRGEGGRDTVLWG

SEQ ID NO: 148183 - protein, 498 aa, Heterodera glycines
  Coding regions on vcDNA: vcDNA=SeqID_74606; Strand=-; Position=1 -49,474-585,661-715,775-847,993-1161,1209-1327,1384-1520,1568 -1613,1718-1802,1869-1951,2220-2376,2439-2534,2635-2693,2824-2881
  Homolog annotation: Hit_ID=NP_500274.2; Match level="QueryCoverage =99%, HitCoverage=99%, E-value=1e-135, Identity=51%"; Hit description= transporter (48.1 kD) (4D701) [Caenorhabditis elegans] gb|AAF59574.3| Hypothetical protein Y54G2A.4 [Cae
FFVFALFALCVCCAIIYLISRSLTPSVLDGHFLSFQRIYLAVYCLAVAGDWLQGPHVYALYESYWGPHVYALYESYWMTKHQIELLFIAGFGSSLFFGLLFIAGFGSSLFFGTFIGSIADKFGRKANCLLYALLYGVSCVTKHFADFNILLIGRLMGGIATSILFSAFESWLVFEHRKRGFSDQSLKQRGFSDQSLKQIFANATLANSLIAILAGITAQAAANAFGFVAPFDCAFVVLIAPFDCAFVVLIVMALLMAFTWTENYGDERANLAQTFGEAFNTIRNDQRILCLGLAQRILCLGLAQSLFEGSMYVFVLEWTPALSRASETGTIPHGFIFASFMLSVMMGASFMLSVMMGSAVFNLLSQYNRPESFMRFVFLVASLLMCAPVLFPSSSTIIFISFALFEVCVGIFWPAMGFLRSQYIPEKTRSTTMNFFRVPLNLLVIGILWNNFHLDTIFKFCFCFLLSAAFIQHAIARRLEKIDKEQREDSTEETAERR

SEQ ID NO: 148184 - protein, 917 aa, Heterodera glycines
  Coding regions on vcDNA: vcDNA=SeqID_74607; Strand=+; Position=1 -1269,1455-2939
  Homolog annotation: Hit_ID=DAA04499.1; Match level="QueryCoverage =43%, HitCoverage=27%, E-value=3e-42, Identity=31%"; Hit description =TPA: pol polyprotein [Schistosoma mansoni]
MLTSAPVLQSPRFGRLFIIECDASKKAIGAVLLQEKGPVAFISRALNRHETNYPSIERETLALVYAVKEFSPYIVGSGITKVITDCSALTSMIKANELKGRLEKYQISLQSFDLEIIYRPGNKNKAADFLSRYNIPKIDIIEESDNNPKESKEEKVKILSAQSLENSSEKSGKEIFCEKGQITLEEIIKAQRQVKEGAQIFYILKTGKIPEKTSKWSQINHDYCLINGAIYYKKGKSNAERPKLLIPYLYRKEIFHLIHDEGHFGFDKTWPEIKNRFYWVGMKDDVNMLIDSCVGCQKRKVQPGQAKASPGVPIIPTDYPFQRVHCDIMGPLKKTEKGNVYVFLAIDSFSKWVMAVGIPDQKAETVSESFVEMVIHQHGVPETVVTDQGRQFMSQIFENLSKCTDLYIIHQRPITNSQTEQQRLPKTDELTSDISVYTRKHGEKAAKAWEFVRDEILKAQQRTKEENDLCRKAKEREFEVGDLVLLKKEVLKHKFDKKWSGPFRCVGIEKDKMNVLLQSLEGKGKLRKVHQEKVKIFYGPAVLPLRPCDEPLCWEKYVNDPNLEQEEAEDESETSEIEYDELKVEEKNKEEKEGGNPTKTGKQMSKYGFESSDEETHSKIIAFIRENQNFEEDEENEGPGILMGDRNPEIEAIPTFTELEILLEGSFTRVYTGWINPVTIALISSIPENLVRENWEIYINEHGSRFVLGWIFGESFEIYIINEFDEIMLGIDAQMLLGERWRLKNEELTESYWEIYVDESGEEVEIPRIPEILISEKDHVENEENGIIRISINLVKNEIERDLYDFTLNTNPKEFIEMEKKKIQDNSTMDSLTGMESTSNLFDSLTTDEEESLKRLKRSLMAQLERVNKTLTNSEQMSEKPEEMADKGMPDEGIKGHAVEDKMGEKAKRSGRSYKAI

SEQ ID NO: 148185 - protein, 346 aa, Heterodera glycines
  Coding regions on vcDNA: vcDNA=SeqID_74608; Strand=+; Position=1 -235,304-1109
MEKEKIQDNSTMDSLTGMESTSNLFDSLTTDEEESLKRLKRSLMAQLERVNKTLTNSEQMSEKPEEMADKGMPDEGIKETEAKNESSLPVKKAEGKVIPEDCISLDLEEEERILEFPKTFETGALGFYESCVNKSKSKSEYEATLKKVEKKPTNPWKIAYHEIKAAETNILSKKDEAIPPEGKKKNPFAESTLDKKECENNSRKRFAVGDPWLAPPNSIWREMKTNEPKEVQNVMAMLLSIRNKALDVHDEAQNAWNELMKMKGKGEKKEEEGMDSGLPGFSTADWQSDHDRWRGQNRWRGERGARRWGQPWRGREWNQPNQGAGPSTSAASQEGQWNFSKMAGYG

SEQ ID NO: 148186 - protein, 180 aa, Heterodera glycines
  Coding regions on vcDNA: vcDNA=SeqID_74609; Strand=-; Position=1 -54,173-331,657-725,1270-1460,1947-2016
  Homolog annotation: Hit_ID=NP_510810.2; Match level="QueryCoverage =52%, HitCoverage=9%, E-value=4e-25, Identity=54%"; Hit description =PaTched Related (ptr-5) [Caenorhabditis elegans]
MSIGMSVDFTAHTAYSFQLSHRRETRDGRVVLVPLRTPRDKLQHALRSIAWPMSQAGLSTVICVLPLVFLQNYIPLVFVKTISLVAIWGLFHGLQMSDQQQQQNCVGGGDDPNNDWDCVVISGGGCSKMLLSSAADNCHQKQKIGENQNDEAKRRGQSRLEPFRLSHLLRSTERHTKAEA

SEQ ID NO: 148187 - protein, 430 aa, Heterodera glycines
  Coding regions on vcDNA: vcDNA=SeqID_74610; Strand=-; Position=1 -93,163-240,1956-2097,2154-3131
  Homolog annotation: Hit_ID=AAD41992.1; Match level="QueryCoverage =82%, HitCoverage=89%, E-value=5e-46, Identity=33%"; Hit description =hypothetical protein [Arabidopsis thaliana] gb|AAM15181.1| hypothetical protein [Arabidopsis thaliana] pir
MPDADQILQQLEHHFVNNWLLDTGKIDEMKQRQSDRREEHDEFDQSEEETDEISLINRRLTVSPSVRSDVESNDHHIVGASTRHTPSQTHRPPASTRRRATSANVKHRAQRRTWSQSRRPSDYPSFLRVPTSTEPPRCTSTEPPQSPRNVHVPQLPSNGPPQNPWNVHVPQFPSNGPPQSPWNVHVPQFPSNGPPQSPWNVHVPQLPSNGPPQSPWNVHVPQFPSTGPPQSPRNVHVPQLPSNGPPQNPWNVHVPQFPSTGPPQSPRNVHVPQLPSNGPPQNPWNVHVPQFPSTGPPQSPRNVHVPQLPSNGPPQSPWNVHVPQFPSNGPPQSPRNVHVPQLPSNGPPQSPWNVHVPQLPSNGPPQSPWNVHVPQFPSNGPPQSPRNVHVPRRSSTGPPQSPWTVSRPDHLIEHAHQLNVVPSASLPSDQ

SEQ ID NO: 148188 - protein, 25 aa, Heterodera glycines
  Coding regions on vcDNA: vcDNA=SeqID_74611; Strand=+; Position=1 -31,373-419
MHVLVLCDFDTIFNVFCGVPITMKE

SEQ ID NO: 148189 - protein, 43 aa, Heterodera glycines
  Coding regions on vcDNA: vcDNA=SeqID_74612; Strand=+; Position=1 -18,71-181
MNLCDIYWKTSRAGDNEAVNEVRTALDAGMECHAVVGHPYLNA

SEQ ID NO: 148190 - protein, 148 aa, Heterodera glycines
  Coding regions on vcDNA: vcDNA=SeqID_74613; Strand=-; Position=1 -55,433-524,568-865
MVPNKGKRSLAKLAVNNLYTDSLFLVHPEDSNLLQTGVHLGQLTDEFPKHDILEFVSGGAKQYGLKLRKKGAADDFEYVLKLRGITLNYDVTENQGLRYDTFKQRVLEFARSGKTDPIKVLYPNFLRPTVIQGNVTSAPLQKIYKPYV

SEQ ID NO: 148191 - protein, 31 aa, Heterodera glycines
  Coding regions on vcDNA: vcDNA=SeqID_74614; Strand=-; Position=1 -31,73-136
QGCAEPDKIRFRLNRRFRLWPKIRLIAIPIT

SEQ ID NO: 148192 - protein, 38 aa, Heterodera glycines; identical to SEQ ID NO: 130624
  Coding regions on vcDNA: vcDNA=SeqID_74615; Strand=+; Position=1-364

SEQ ID NO: 148193 - protein, 42 aa, Heterodera glycines; identical to SEQ ID NO: 132699
  Coding regions on vcDNA: vcDNA=SeqID_74616; Strand=-; Position=1-151

SEQ ID NO: 148194 - protein, 49 aa, Heterodera glycines; identical to SEQ ID NO: 130195
  Coding regions on vcDNA: vcDNA=SeqID_74617; Strand=-; Position=1 -110,199-238

SEQ ID NO: 148195 - protein, 41 aa, Heterodera glycines; identical to SEQ ID NO: 133620
  Coding regions on vcDNA: vcDNA=SeqID_74618; Strand=+; Position=1-347

SEQ ID NO: 148196 - protein, 38 aa, Heterodera glycines; identical to SEQ ID NO: 129423
  Coding regions on vcDNA: vcDNA=SeqID_74619; Strand=+; Position=1-364

SEQ ID NO: 148197 - protein, 156 aa, Heterodera glycines
  Coding regions on vcDNA: vcDNA=SeqID_74620; Strand=-; Position=1 -16,1109-1239,1284-1607
MCFTQDTDSLILVHPDGRCHLKTGPHLGQFTDEYPDHKIIEFCSGGAKQYGLCLQRKGAEPGAQMEHVLKVRGMTLNHDVLNNQGLRYETFKNEVINYATTGDYEPINVIYPNFLRQNIREGGRLTSMPMQKCYRPFVGKGIVGQGFQLMNFGHTL

SEQ ID NO: 148198 - protein, 29 aa, Heterodera glycines
  Coding regions on vcDNA: vcDNA=SeqID_74621; Strand=+; Position=1 -26,819-882
MTLCEVFVEDFSYEIYLIKVKKVLKRCRW

SEQ ID NO: 148199 - protein, 37 aa, Heterodera glycines
  Coding regions on vcDNA: vcDNA=SeqID_74622; Strand=+; Position=1 -49,264-328
MWMDVEVKRWHSVGVLAMRDHQRALLSLSTDIKMLIY

SEQ ID NO: 148200 - protein, 422 aa, Heterodera glycines
  Coding regions on vcDNA: vcDNA=SeqID_74623; Strand=+; Position=1 -424,1183-2027
  Homolog annotation: Hit_ID=NP_502721.1; Match level="QueryCoverage =67%, HitCoverage=21%, E-value=8e-12, Identity=25%"; Hit description =endonuclease/exonuclease/phosphatase family and RNA-directed DNA polymerase (4O953) [Caenorhabditis elega
MERRRSVVITGLPENQSETPSVRAISDNNAVTGFLDQLGVETHSIVSYRMGWYNKDRARNGACRPIKVVLPASSFQRTCLHQWNKKSLEIRRQLDNKRLNIRESLTQEQLKARRELQAQCAEKRKETSADWIIYNGMLVLRSPTRGNSVLDLCLCTNPNLIHFVEIKDSLIHSDHSALFFQINLSLQKSPPPRITIRNFNPNNIKTLNSYLLSNVTSNLTNVFTLENKYKVFSETISSALEHFVPQTSFLKKPPPKYPLHIRESIRHKALLWQKMKIDPIKYKKFYDSITLHIRIQTKKFYENRQKKFLSVNPMNLYKLIRKSFVTNNSIPPLETENGFIFDDKDKAQYFAKYFSETFSNNLDSTPCLSQTDSLGYSISDLNFDVSDVFDKLNRLTNRNNTSPDFINNKILKNCLIPLETCN

SEQ ID NO: 148201 - protein, 326 aa, Heterodera glycines
  Coding regions on vcDNA: vcDNA=SeqID_74624; Strand=+; Position=1 -268,607-1201,1486-1603
MPKNDAKGNCQTDKVSPYEKNDDNDDKALTKNLEGKEKVDKTQNKEKENKINEEEKTKHKDSGNNDEGIVTEKEAAVTNAKTKKAYRIADIKEDVFLLGHFQNILSNSKEFSIEMPRNLLELGIYSNEIWHRILAERHFDKIGIKFWHSKINFEEKWAEIENNKINKENEQLLKMELYQMLSNFSPDFDENFEKNYVNKNWQKIGEKLHRNWLARTLLSNGEMSNDGPGRFRTAVFVPPFSYRRFRTAVFVPETFSYRRFRTGDVFVPPFSYRCFRTGDVFVPPFSYETLAHGFKYVVQKLVGVHSCDMNAAHVECQRLVTGDVLL

SEQ ID NO: 148202 - protein, 102 aa, Heterodera glycines
  Coding regions on vcDNA: vcDNA=SeqID_74625; Strand=+; Position=1 -90,876-1008,1472-1554
MSEQKPAEWRAQIEYLQQINCDNNVDLTYRHPEVHSLQRIQSNWVPLIRLKLINFDHEIDIVFASIPGPVPKERAFKLFYSSKSANEKLPMLFEQQIKFHEK

SEQ ID NO: 148203 - protein, 75 aa, Heterodera glycines
  Coding regions on vcDNA: vcDNA=SeqID_74626; Strand=+; Position=1 -49,105-283
MTFWKWKKEVMPNCHKSPNKYSNEEKLRKIKQYFETKEKNPKICDETKAKKLRIASDTLRIWKKETYFSSGKVIF

SEQ ID NO: 148204 - protein, 36 aa, Heterodera glycines
  Coding regions on vcDNA: vcDNA=SeqID_74627; Strand=-; Position=1 -21,701-790
MYKTPKYSLFRQLIQLLTDYCGRKPTNTVNLHRKIT

SEQ ID NO: 148205 - protein, 106 aa, Heterodera glycines
  Coding regions on vcDNA: vcDNA=SeqID_74628; Strand=-; Position=1 -161,401-560
  Homolog annotation: Hit_ID=CAE69100.1; Match level="QueryCoverage =88%, HitCoverage=75%, E-value=3e-12, Identity=43%"; Hit description =Hypothetical protein CBG15126 [Caenorhabditis briggsae]
MSSSHAKVTVLLLLFVIAFVALAVSAPVAEEANAIVEANNGKLAASIGTDEATSLIRHKRYGYGYGRRYGGYGGWGGYGYGGWGGGYGYRSCYCGYGGYGYGYYGK

SEQ ID NO: 148206 - protein, 104 aa, Heterodera glycines
  Coding regions on vcDNA: vcDNA=SeqID_74629; Strand=+; Position=1 -130,643-827
MVCGNAFKDWHRDAHPIDGRGGEGTATAPGKTGRNWGTRGRDQPHFAKTLNVQMEHRFGQLDTAEKEISEMGDAEAETVRERVAETREKCRGLTEWTEVEKADK

SEQ ID NO: 148207 - protein, 166 aa, Heterodera glycines
  Coding regions on vcDNA: vcDNA=SeqID_74630; Strand=+; Position=1 -308,528-675,760-804
MPFLLEAEYFTCGHSDAELAIDLDIFQTLISIALAMELRDKLVRYLADELPNFQNDMQKPNFAPSPNDIIQQYHAKLCALATPFFGNKFGQKEEQLVWPSLTRFLPPLSAQNRPKWCSLLLMDASSDHAIIGASLNWVGHLEVFVDEEQKFKYSQHINTVYSACKH

SEQ ID NO: 148208 - protein, 514 aa, Heterodera glycines
  Coding regions on vcDNA: vcDNA=SeqID_74631; Strand=+; Position=1 -870,1227-1712,2342-2530
MDTIGQRLEWIRQQFEQRTVVGQIDEAEMSSSLEEEGKLSNENGKDAVIKIPQNEDRKPKFGDELEKIRELGTITEKTCQENSKVEKPASVNAKVEKPAFENGEVVEKLPFENAEQQKPHRQNAETIKTTLETARMAIPALKNGEEKPYLDSAKEVNTKTTSEQAEFEEKIIAEIESPQQNAEIGLRLLDHESDRSFVRQSPPSSAGYHSSRPSTSQNNSHEEEANVNAKLNANRRNQNAKTGNVPTPPIVEPMDFRGLRSSDEGEEMEQQQQLNVQQKRPKVRSWKEIEVFPRNSPSNVEKPSIFVNKCAKSIPKSKNNANYPSKNIKEEAVQQMPKRSPWRRPQWLRLLPPFDGTIRTERQTTTAQIKHGHPLLELKLDGSPMFFNFLFLFLEHFSTPRSTDKVANAGGDVGTFLTNPGRCRRTFLELAAKKERRHRSQNSSLNRPKTTMDHQQQQTHNNGIYDSGIGLEQQQQQQQQSNNGTSRNGIVLYTVELEEADVAAMRRRAEGRQN

SEQ ID NO: 148209 - protein, 132 aa, Heterodera glycines
  Coding regions on vcDNA: vcDNA=SeqID_74632; Strand=-; Position=1 -178,404-482,705-846
MLPLQSGLSSAKSFAMFCARGIAKRVSVFAKIPFVGSMIDAVRKIIADMKNRFLPLLAEVNVVQNWRKNVVYLITYPRIGAFDENSNVPVISPAALKLEVWLQFRGVDFYVSKLITNHPLLPQLISYFLAHC

SEQ ID NO: 148210 - protein, 86 aa, Heterodera glycines
  Coding regions on vcDNA: vcDNA=SeqID_74633; Strand=+; Position=1 -96,173-337
MGTTDNEEKKTEPMKKFCKMFSWVQQMFSWVQKENVETKIDDDETLLKRLDNVFMVKHPPELLNFWRHAVKLNPKKPLGKYFFTKI

SEQ ID NO: 148211 - protein, 173 aa, Heterodera glycines
  Coding regions on vcDNA: vcDNA=SeqID_74634; Strand=+; Position=1 -157,249-349,732-995
MSNNGPDYLKMLKKRRDRESLEMLFHGIVNKFPLDDKGIGYQQLLLDDAKENAQLKRNIKTMGTTDNEEKKAEPSKKFFQMSPWVQISSNNSFAVTKPPFWLPTDPFWRPVFDAMIYAAIAISAITVIFGVPFMIFIACIASSAARDSERWAEMIERREQQRREAERRDELLF

SEQ ID NO: 148212 - protein, 154 aa, Heterodera glycines
  Coding regions on vcDNA: vcDNA=SeqID_74635; Strand=+; Position=1 -101,360-467,762-1017
QLKRNIKTMGTTDSEEKKAEPSKKFCKMFSLPQLSFCFVFLLLSFFVIWYTSDQTQINTVRLLGNPGEWKMPLNDSTSVTPNKPPFWPYTDPFWRSVAHGVFYACLAISAFSLIFGFASFIFIFVLLSRTLTNMEHITMTCYEIDEIFAWMRLK

SEQ ID NO: 148213 - protein, 525 aa, Heterodera glycines
  Coding regions on vcDNA: vcDNA=SeqID_74636; Strand=+; Position=1-1575
  Homolog annotation: Hit_ID=NP_740973.1; Match level="QueryCoverage =99%, HitCoverage=82%, E-value=4e-15, Identity=21%"; Hit description =M protein repeat containing protein (72.5 kD) (2C572) [Caenorhabditis elegans] gb|AAM97999.1| Hypothetica
MDEFYVVLPSNSPGPGNTTSKFTVRLPHTLELDANWMVALSSIIYPYSFPSVGIDDDDFISIKLVNPNFKFADDKRFVDIELKIPSMQFSSVGHLRQTLNDIINDAYKQRFGLSSQKAAKVKRQIDVTELFFHDHPVDYWEKIEELEKRLVELREEIDTKEREHGAEGTEQKRKNELEGELKILRLRLKRKDDELEELKRAAKRRDDDTPENQQKKIREFFHHHPDDHEKKLNESRLIFTKYLSGLQEKMSEYIGERDGAKIVQLNEQTGKLREKIKYLLRNLNLFESAVLQRANSDDPSRKTREEYEKSSHEQNSVYVQEFFQRHPTNYWQIIHNNYDGLREQFDKIEELQQKTAQKQLKDDEHSSFQQQIDRAKQLLEYRRKRFAALEFEAKKRDGQQQQSSPFSSPISSALTAGEALKERLGAVQVKQTEKSDQDNNNSMEKPKTHAEVLKEKIQQQQQQQDIATSTPNELQNDGKAVAEPKTHAEVLKEKLEQKKGTSASAERDGDHDSDAVDLLSRGHKL

SEQ ID NO: 148214 - protein, 159 aa, Heterodera glycines
  Coding regions on vcDNA: vcDNA=SeqID_74637; Strand=-; Position=1 -61,522-584,765-818,952-1005,1179-1426
  Homolog annotation: Hit_ID=AAP30775.1; Match level="QueryCoverage =100%, HitCoverage=96%, E-value=1e-22, Identity=43%"; Hit description= putative gland protein G32E03 [Heterodera glycines]
MRALLFLTMVSLVLAVLLETGAVAAHGKGKDAHKGGASPAKGNKKAAKSPGKKDAKGKKDKKSKTAKSSKSKDKKTPTKPSKAVKAASPKAEPALNNEPSSAPATEVEQEEQDVMEADEELGEANSAESYDLAEGELLEDDANGDGEVDAIDADEEPME

SEQ ID NO: 148215 - protein, 181 aa, Heterodera glycines
  Coding regions on vcDNA: vcDNA=SeqID_74638; Strand=+; Position=1 -61,112-147,190-264,319-372,422-478,521-553,611-840
  Homolog annotation: Hit_ID=AAP30775.1; Match level="QueryCoverage =97%, HitCoverage=96%, E-value=3e-36, Identity=54%"; Hit description =putative gland protein G32E03 [Heterodera glycines]
MRAVLFLAMVCLVMAVILETANSKAVKNDGKKGAVASPAKGKASPKGASPAKGKTAKGGKKDAKKAGKKDGKVKKEKKEKPAKKAGKGKDAAKKDKTKDKKAPAAAKPKAEPVETEEPSSAQVVAEQDGGEESANNQEMDAGEEMTEEEQTDLAQDEQLEDDAIDGEEGDGMAEEEQPEMN

SEQ ID NO: 148216 - protein, 385 aa, Heterodera glycines
  Coding regions on vcDNA: vcDNA=SeqID_74639; Strand=+; Position=1-1158
MLKPSMDQKHFASGVVKETNVESMRSLGRPKFILWIAVKVTQVQERKNRDVHEELERAEEGGSFVAHPMIPQGLELRRACFASNLPSRVAKLDTNQGKLMRAVMGRPREQLVGEQGEILGHASAVQEFHPLMRKLNERQKVSAKLLLGNECCLIYQNAPPGVGKTYVASIVAAILLSINENVKIAIVTSANLPLAKLAQELDEVLGSDEMEESGSIAFFSGYAKEKYREMVEKLKRHILVSKLKSEEIQSKFEERSEENQDKRDVREYCQNYEFRPRLTKERKMASLYAEVANLRIVFATATMAENVLWTALTGTSVLIFDEATQGSWVILAHLVARLPKLEKVFVTGDRYQLGVHLQELPKILRKGFGLDSMVDQLVDSPNVVQ

SEQ ID NO: 148217 - protein, 104 aa, Heterodera glycines
  Coding regions on vcDNA: vcDNA=SeqID_74640; Strand=+; Position=1-437
NGLSKNRNYAQKASQTILALPIPSIIAFIHPIMSAKIIRVPKIACDLSLEKNGLSKNRNYAQKASQTILALPIPSTIAFIHPIMSAKIIRVPKIACDLSLEKMV

SEQ ID NO: 148218 - protein, 132 aa, Heterodera glycines
  Coding regions on vcDNA: vcDNA=SeqID_74641; Strand=-; Position=1 -64,127-207,263-516
MVLFTAINIALVFLCCNKTYFECKHTALEVLFNCDSCGHEVHRTYECFIYFVYVNYVDNRRRHRWYRYCRNKTYSPWGRYTAENVTRTVEQKPRPTTTIEAVEREFKEMSGEEKDDYTTSWAWTTDLISRLD

SEQ ID NO: 148219 - protein, 98 aa, Heterodera glycines
  Coding regions on vcDNA: vcDNA=SeqID_74642; Strand=+; Position=1 -243,338-391
MTFRQLDIKCLKSFFIGLSFFATFFVSMNIIKPLQSLVCITSPNNCKEFVNPSSDPNLTSSKIAPIFYLMIYRWGLNALLEDILKNLCYHFRVFNENF

SEQ ID NO: 148220 - protein, 60 aa, Heterodera glycines
  Coding regions on vcDNA: vcDNA=SeqID_74643; Strand=+; Position=1 -46,169-305
MNFFLFITIIFTFVKSNAVLNYVEEAFSSRDEVQKLANYAIDWAFNNGMILRYDIRQYNK

SEQ ID NO: 148221 - protein, 585 aa, Heterodera glycines
  Coding regions on vcDNA: vcDNA=SeqID_74644; Strand=-; Position=1 -70,113-414,714-915,958-1511,1555-1835,2005-2353
  Homolog annotation: Hit_ID=NP_001004509.1; Match level="QueryCoverage= 78%, HitCoverage=33%, E-value=1e-52, Identity=29%"; Hit description =si:busm1-180o5.3 [Danio rerio] emb|CAD60788.1| novel protein similar to DNA polymerases [Danio rerio]
MKEEEAVKLEKWYNENYQTEFELGEQLKIYCENDVEILLQSVLKFRQLFLEITGDFDVMKDSVTIAGVVMKIFRAKFLKERHIPIMPEGGYERAENQSKIAVKYFEWLAQRKGVKVRHACNGGEECDVREELKKNKEMKKFFESVPDKGPINPRDAYAGGRTMPFCLYAKATEEIEISMFDIISLYPFVNYDTPYPVGVPKIVVSRNFNVNWTAPDDVPYDGLLKVKVIPPKNLLYPLLHVHIDEMLLFPNCWSCARRAKNEFVMTKDVKKCNHRPTQRAFLGTFTSIELRKALELGYRIMGFYRAYHFEQFDSQLFKGYVRMFLKIKVEASGWPAEVKSEDEKRAFIEMYKAKYDIGLDYDKIGFNPGLRMIAKLGLNSLWGKFSMRNTLSSTEIVGSMERWMELGRDNTIEFGRPVKISEEISRVVYRKKEEFIREHKVSNIVLSLWTTSAARLKLYEYMEQVYKKEGEMTREYADSEILEFVSAGPKQYALKLRRKKGGVIWHKTKIRGMTLDRRNEFKYELFKEMVLDYKKGVKKVFHYPEKIGPTNDFRVLSKDVQKEYTPVQKKGIIDDHFNVLPFGYY

SEQ ID NO: 148222 - protein, 874 aa, Heterodera glycines
  Coding regions on vcDNA: vcDNA=SeqID_74645; Strand=-; Position=1-2622
  Homolog annotation: Hit_ID=NP_920205.1; Match level="QueryCoverage =97%, HitCoverage=56%, E-value=2e-78, Identity=28%"; Hit description =putative DNA helicase homolog [Oryza sativa (japonica cultivar -group)] gb|AAP52492.1| putative DNA helica
MIGQECREFQKKYGGPHAHRVYHTDLLAIPENVDGLIWAHIPPEPNQNEKSDWAIFIRKVRELLPKYQFHDCGRHCFNHKGKCKKGFPKPFSKFTILHDDRPAIYFRPCQEDGGQTLTVKRGKTQITYDNSRVSAYNPYILVHFETHHNLEYAYGQSTNLKYLYKYPFKGPSFSYIKTIEENGKTSIDEPAYYARMLYRSSPEAYCRIMSLKYAKLSHTVIALSLHLPGQQKIYYKSSEKESVAQQVQAGILPETPLTAYWKMCETDPDVRKILFEHMPDQYSFNKSGKFWKKRIFSTRPHNIHNRKPIIGRIFPVSPRNPELFALYLLTKHFPGNPQQLKMVNPTHICETFLETARLRGLIDDNDVWVRTMEEGAASLTPAQMRQLLANILIFGSTENCLIDGALLWKKFIKHMFDTRCTEAERPARIDHALALLEKLLVAQNKQCKDYGLPTPAISIMNDQQRGINEFFFPQLVKDDDADDTVDTTAFEHGNLNAEQQKFFDMVKTAFLNTTNSRLFYLCGDGGTGKTFLLNYILYQLRKIGAKIIPTASTGMASTRYYVGGTTVHSAFKFGINVEPGKLPAIPFDSFFGRRIIESDIIIIDEMTMLERTVFENIDLLCRQLCSQKAHLPFGGKCVIISGDWKQSLPVVINSYGSAAQVAACIQSSPLYPIFSKYKLTQSMRVNPNEIEFLKWFDDIGRGVNGDTVAIPKDMLVDSREDLIAWVFDQGLNMPSSEMLKRLLLSTTNRIVDINNSQISHSMLGNFIEYFSVDKATDENPFSVNAADFDVAQLNQLNPMGMPTHLLRLKIGSIVVLLVNLNTSKGLCNGTRLLIKKLTDNLIECETIGSGSSGNGIIIGIPRNRHTYKDKRPDG

SEQ ID NO: 148223 - protein, 63 aa, Heterodera glycines
  Coding regions on vcDNA: vcDNA=SeqID_74646; Strand=-; Position=1 -36,542-640,707-763
METNKQFTTSVTSICKVKGRKCENEIGVCCLLPFFFYDPLKKRPAAPSKMIEECLCTYHEIFG

SEQ ID NO: 148224 - protein, 61 aa, Heterodera glycines
  Coding regions on vcDNA: vcDNA=SeqID_74647; Strand=-; Position=1 -91,172-266
MTRKEHFVSAPHSLCCKLGNGQTVLCPPARDFTDRIMPIDVEEKGPLIGINWANESQMGDN

SEQ ID NO: 148225 - protein, 288 aa, Heterodera glycines
  Coding regions on vcDNA: vcDNA=SeqID_74648; Strand=-; Position=1 -112,220-303,356-429,585-648,703-773,817-894,945-992,1100-1153,1389 -1535
  Homolog annotation: Hit_ID=NP_508174.1; Match level="QueryCoverage =87%, HitCoverage=73%, E-value=6e-80, Identity=58%"; Hit description =male ABnormal MAB-7, EGF-like domain and metridin-like ShK toxin family member (mab-7) [Caenorhabditis el
FELFNKKILLFPIFFHTVTAGVGQVVIKRFSKEQCKFNPCLNGGKCIPGKTSCDCPSGWMGKYCHRRCRNIYQSCDRWAMEEKCERCRNIYQSCDRWAMEEKCELVRTQTNFFDINCAVSCKLCSPDPSIKLTPLTPIPLAPALEPLQFMMGKWYSQASKGLRASKGLRYPTDMVAGEYEEMLDISPAQVPMFGPPSLNLTFVSLVPMFGPPSLNLTFVSLIPSDMRVTHGFITLKPNSNPPEVAILSTGNEGLNMIELGTLQNHAVTLNISYMYVECYDITQKAIKI

SEQ ID NO: 148226 - protein, 167 aa, Heterodera glycines
  Coding regions on vcDNA: vcDNA=SeqID_74649; Strand=-; Position=1 -270,560-793
MTNTSFSKICAKSQLLNIILSDIFYFEDNLDNLVAECLQGMPMSDGFDKARVTANRTETEQRHRIRANGGRKTPVHGVLCGHPLQMEKKSHFLCRSFVQSQRRKYQFGNDGTAKFVGKRRRTAGTKLQLRNSIRQIGKRRLLIRHSLGQGKDTNYEGPIEKGRDFEI

SEQ ID NO: 148227 - protein, 170 aa, Heterodera glycines
  Coding regions on vcDNA: vcDNA=SeqID_74650; Strand=+; Position=1 -242,287-347,403-612
MTEGRQAEEQSLPLADDGTHAVFPSKPCHVLVWDELRQILTDVLSKESANYSQFGLFSNQFTDNAKPSPLPPLEPFFVRLGFQNPFPFQLVLRNLCLSLDQLKLRPGCSPPFSDKFRCSIVSELVFSPLALDERPTEKVLKKHFVDLHVLPGPELEQFSVNGLLLAICCD

SEQ ID NO: 148228 - protein, 72 aa, Heterodera glycines
  Coding regions on vcDNA: vcDNA=SeqID_74651; Strand=+; Position=1-217
MDRRLSATVCSDSVPLLSFRPVGGDPGFIKAVTHWHPLEAFCDQIVQIVFEIENVGQNDVEQLRFCTNFAER

SEQ ID NO: 148229 - protein, 108 aa, Heterodera glycines
  Coding regions on vcDNA: vcDNA=SeqID_74652; Strand=-; Position=1 -51,98-228,493-637
MIIACVITLESRDRHAQVIQEESAELRRSRRYASQQKKGEITRTETGQMRENGLKVMCTRRELISVAHDEEIAAQQQEKPMETDEVQQIARKCHSTANCPTIGPSLRG

SEQ ID NO: 148230 - protein, 167 aa, Heterodera glycines
  Coding regions on vcDNA: vcDNA=SeqID_74653; Strand=+; Position=1 -168,222-295,350-610
GAETVGRWTQCPSKGMPTAFTDDASVAGEFGMEAANVGQFGKISRECPLSVGEKIGLRVAIRVQQKPQTFYFLFLYFDQNGRSRQFRFSARVRPLSRIFDADHCVLSGSIGLSMLTLRCLPFNSHESDATAKATTAVTLTKLDLLRLSVKVTDGNARTNVRRVENEP

SEQ ID NO: 148231 - protein, 154 aa, Heterodera glycines
  Coding regions on vcDNA: vcDNA=SeqID_74654; Strand=-; Position=1 -108,194-569
HSLFAPFSPSFRSFFSIIPLPFLPLFAPFLPSFRSFSYHFSLLFLPISLFFLHHLFHSFCFALIDPLLKLHSQILAHSFCEPGSVAQFLKHLSLVQLRRLIRLCSFIRPLTSEGKALATAIWEGCSNERSTERRSRTAKKSFVNISKLKITGRV

SEQ ID NO: 148232 - protein, 89 aa, Heterodera glycines
  Coding regions on vcDNA: vcDNA=SeqID_74655; Strand=-; Position=1 -67,121-254,312-499
FSVSNFLKMPSFSSVFVLFAIVVISLGKEQQKGDELRAKRQICQGFSAQYGACIAQKYSQCVWCNDADYRGPHRCDEKSSMKGCVQIVQ

SEQ ID NO: 148233 - protein, 190 aa, Heterodera glycines
  Coding regions on vcDNA: vcDNA=SeqID_74656; Strand=-; Position=1 -41,94-184,757-840,884-997,1050-1289
  Homolog annotation: Hit_ID=CAE67015.1; Match level="QueryCoverage =71%, HitCoverage=38%, E-value=6e-14, Identity=43%"; Hit description =Hypothetical protein CBG12416 [Caenorhabditis briggsae]
MKDMCCICGKNLRPEGGFSGERIEPTTANVSMIHHVPELVVSKEALFPCSEQLILMLDDRPDVWMHSDALIRVNPYRFFVEIGDINAPPQELLDSVQASEEMENTQADKWTLKQKVKSKTEEDKKEGEKSLLTTKNGEENAQKKGETEEKERGDGGGNGEERTENALAEPIAAIVDDDNALEHVERVLAE

SEQ ID NO: 148234 - protein, 229 aa, Heterodera glycines
  Coding regions on vcDNA: vcDNA=SeqID_74657; Strand=+; Position=1-692
NQRNKHHSASRQTFNGSYTGPGPKHCCTRRSRTPTHFGVHWPPGKQCARPSERVQEDREATTKILDHLEVEAEPTAVFRLGQYDPQRTTPRPLKVVLPTPTHQHVALGGWKRERARLRSQQNLTRLFVRPALSKEQLKEEYEARLRKRQQNPAPLAPPTQLSQTKNDQTPVVAKGPNQNEDSEDISKHPEVFDETILVCYEALKPLPPTDKIVHQIQSLEKQYPHLFNK

SEQ ID NO: 148235 - protein, 132 aa, Heterodera glycines
  Coding regions on vcDNA: vcDNA=SeqID_74658; Strand=+; Position=1 -290,1243-1351
RVKNSVEKLIAQIEAGNEAGAQLNQRGDGQGQLHVPADEQLGAVYRILPQAGSHHAGVVPRRGPGRGAGPLLGVHDAQLVGPNCEHKLIIKILFFYIQKVQEQAFLGIQIQLQVLPKCRSLVWTPNNKSLAL

SEQ ID NO: 148236 - protein, 97 aa, Heterodera glycines
  Coding regions on vcDNA: vcDNA=SeqID_74659; Strand=-; Position=1 -208,492-578
  Homolog annotation: Hit_ID=NP_491282.1; Match level="QueryCoverage =76%, HitCoverage=51%, E-value=4e-15, Identity=55%"; Hit description =CalPoNin (cpn-3) [Caenorhabditis elegans] gb|AAB52338.1| Calponin protein 3 [Caenorhabditis elegans] pir|
LALKLEPNSIKGVTDKASSTFQQMSNLELFIEFCRKQGVITQELFRAVDLVEARDLYSVCMTLNSLGRIMQKKGKSHPKHVSASEIVNIPSTDALRL

SEQ ID NO: 148237 - protein, 29 aa, Heterodera glycines
  Coding regions on vcDNA: vcDNA=SeqID_74660; Strand=-; Position=1 -14,155-230
MGSRSKPANTTRVRVSCCSTGSSRSPVPQ

SEQ ID NO: 148238 - protein, 33 aa, Heterodera glycines
  Coding regions on vcDNA: vcDNA=SeqID_74661; Strand=+; Position=1 -32,156-225
MGVQENDFEERKFIQRAKNCDNDQILLAFFITK

SEQ ID NO: 148239 - protein, 19 aa, Heterodera glycines
  Coding regions on vcDNA: vcDNA=SeqID_74662; Strand=+; Position=1-60
EGEGKYTIIRPNGSTLMVH

SEQ ID NO: 148240 - protein, 619 aa, Heterodera glycines
  Coding regions on vcDNA: vcDNA=SeqID_74663; Strand=+; Position=1-1860
  Homolog annotation: Hit_ID=XP_320889.1; Match level="QueryCoverage =98%, HitCoverage=73%, E-value=7e-89, Identity=33%"; Hit description =ENSANGP00000012033 [Anopheles gambiae] ref|XP_313651.1| ENSANGP00000013044 [Anopheles gambiae] ref|XP_314
MNAEQIQQLLTALLQGNAASSISQANLASSIDSRISKFVYDPENGQTFEQWHKRFGILIEEDGKDLTEQAKVRLLLGKLGDEEYTKYRDTISPELPDKPSWAESINRLKELFAETRSLFVRRYECFRIRQHPNQDISSLVAQINAACEHANLSLTKEQLKCMILVISLRDEHHDLRQKCLKMMEEAEKSGTTVTLKKLEEELKAIQIVKDSALSLLSTPASTNAIRTRPQQWRESKTKAKSANAVQQNHPAQQKPATGGKAIRGQPTQPCGSCGGTDHWRSDCRFREATCHKCQKQGHIANVCRKGAFTTKNQRRSFHTVQVKATCLQIGTTQGRWWTILVEINGTKIEMNVDTGAQATVLTIETWTKLGQPKLLPTDIETRNCNDVTFKTIGKFICLVSIVGQPAKKLTAYVTEELNYDLFGLPWIEATELIPKEIMFPETHTSVGIRASSAAPFQEIADVKSLTTALKENFPDVFGKELGQCTKIKAHLILKSDARPVFCKARPVPHGSLEAVNTELDRLLQIGAINPIEFSHWAAPILAVKKKNGKIRVCIDFSTGLNNALELNRHPLPRPDDIYAAISGAAFFTNLDLKDAYLQMELDDESKQLCVLNTHRGLFQ

SEQ ID NO: 148241 - protein, 38 aa, Heterodera glycines
  Coding regions on vcDNA: vcDNA=SeqID_74664; Strand=+; Position=1 -94,480-502
MPKHGLKTDQKMAFEVRQCQSRPGCSASYCTDFFLKNF

SEQ ID NO: 148242 - protein, 88 aa, Heterodera glycines
  Coding regions on vcDNA: vcDNA=SeqID_74665; Strand=+; Position=1-265
MLGLENARGNFRLRRRAGQNPGPRPGRTVLGRANGADGLLPALCLGLLQEQCPAAAQKVWLRQQHHVPALHTKHGFRLLFQCHGRRSD

SEQ ID NO: 148243 - protein, 91 aa, Heterodera glycines
  Coding regions on vcDNA: vcDNA=SeqID_74666; Strand=+; Position=1 -265,408-418
MLGLENARGNFRLRRRAGQNPGPRPGRTVLGHANGADGLLPALCLGLLQEQCPAAAQKVRLRQQHHVPALHAKHGFRLLFQCHGRRSDAIF

SEQ ID NO: 148244 - protein, 48 aa, Heterodera glycines
  Coding regions on vcDNA: vcDNA=SeqID_74667; Strand=-; Position=1 -61,116-308
YGLKFVLQLRNSIRSISSQQLIHSFTSAVDHLGREFRREAHRRCHPQK

SEQ ID NO: 148245 - protein, 188 aa, Heterodera glycines
  Coding regions on vcDNA: vcDNA=SeqID_74668; Strand=-; Position=1 -91,143-287,445-609,1039-1199,1338-1342
MGNSCLISDSTREQTISPPSNDFVAILRRPINTTILVKRQLINKRTLTKMLSKPRTETAIVLPERRMDTNFLSPKDRELIYLCWHNNIVTSRSDLFHKAMHYCIHASPKMNEIIACGHYCYRDLTKWPKLNRICQAIFKFFDKLINEYKMDEDKMYDACVHLGEMHANYAQYGLKQHFMDLFQQQLLE

SEQ ID NO: 148246 - protein, 26 aa, Heterodera glycines
  Coding regions on vcDNA: vcDNA=SeqID_74669; Strand=-; Position=1 -34,804-850
MEALIELAIIPYYLKHMRIEALIEMQ

SEQ ID NO: 148247 - protein, 65 aa, Heterodera glycines
  Coding regions on vcDNA: vcDNA=SeqID_74670; Strand=-; Position=1 -135,184-246
MGIENLSNLNQNSSFKRYLCLLIFRTLEVIVPTLCTRHLLLCLESHCCQSLALHFVAKCWLLRRG

SEQ ID NO: 148248 - protein, 30 aa, Heterodera glycines
  Coding regions on vcDNA: vcDNA=SeqID_74671; Strand=-; Position=1 -3,325-414
MVVLSVLGVLFVQGIIALLVFVCKSVKWQK

SEQ ID NO: 148249 - protein, 49 aa, Heterodera glycines
  Coding regions on vcDNA: vcDNA=SeqID_74672; Strand=-; Position=1 -100,216-265
MPNFILPFSSFFLCFIRYTQSICCTQIYWRNQTIKQCVRWVLRWAMTVL

SEQ ID NO: 148250 - protein, 73 aa, Heterodera glycines
  Coding regions on vcDNA: vcDNA=SeqID_74673; Strand=+; Position=1-222
MGKKTQSKRSKPMANIKVKMFTRKANRTDWKQKHVELEKKLRWSEEGHKSTERGRKSSKKPKMLDKRCKAIRM

SEQ ID NO: 148251 - protein, 80 aa, Heterodera glycines
  Coding regions on vcDNA: vcDNA=SeqID_74674; Strand=-; Position=1 -163,927-1006
  Homolog annotation: Hit_ID=NP_509820.1; Match level="QueryCoverage =65%, HitCoverage=7%, E-value=2e-13, Identity=69%"; Hit description =histidine ammonia lyase (74.6 kD) (XL512) [Caenorhabditis elegans] emb|CAA91982.1| Hypothetical protein F4
MIAFEQSLVFQVHGVVHDTIAFVKGILETEINSATDNPLVFSEIEEVISGGNFHVLAMELMAACQVSNNNENPTMNLNDI

SEQ ID NO: 148252 - protein, 40 aa, Heterodera glycines
  Coding regions on vcDNA: vcDNA=SeqID_74675; Strand=+; Position=1-477
ELPETLFYKLIIKYIPNLLYFTYVKGPRVLIYTKPVAYHG

SEQ ID NO: 148253 - protein, 59 aa, Heterodera glycines
  Coding regions on vcDNA: vcDNA=SeqID_74676; Strand=+; Position=1-280
GMGRGFAFRISHYSHFLAFRISLFAFRFFARNATFTPLRIGLNSHKIFQNFTYKLANFQ

SEQ ID NO: 148254 - protein, 92 aa, Heterodera glycines
  Coding regions on vcDNA: vcDNA=SeqID_74677; Strand=-; Position=1 -36,116-358
MNVQTVKLSTYHPKVCGPNIFTKNRKKLLFFSMLIYLVYPSWDFTPMPFRANESRTASSIKPWEFKAKKMKKKPMPSWSTFRVCSVQLEPSY

SEQ ID NO: 148255 - protein, 458 aa, Heterodera glycines
  Coding regions on vcDNA: vcDNA=SeqID_74678; Strand=+; Position=1 -161,386-503,1581-1650,1898-1994,2248-2452,3015-3231,3445-3616,4002 -4137,4482-4634,5307-5388
  Homolog annotation: Hit_ID=CAE69879.1; Match level="QueryCoverage =90%, HitCoverage=85%, E-value=1e-110, Identity=47%"; Hit description= Hypothetical protein CBG16219 [Caenorhabditis briggsae]
GSSCTEQTRNVLQLGIGFFFIFLALNSQGFIEEAVLDSFARKGSVKSHDGYTSLAIIYASFTIHNFVAAPIIAWLGVRWALVFAGLTYAIFQAGFLFVNRWYLFSSSTLLGLGAAVIWTAQGKYLAMNSTEETAGRHSGLFWALSQLCQSCGGIFLLVVFLLMPSQTSISVPTVRFIYGTFTALTVLGTAILALLPVPTATTPARQTNTFLSIGSTVKLMGTRRMVFFSLPFMYTGISQSFWSSIYPTTVANTEMLGVNPKLLLALTAIVQGVGQATSGFVFGILDSRTRRFGRTKIVSFGAALQLCSFLLAYLNLPAHAPLEKTFEHGILNSPSITLALVGGFLLSFGDACWNTQVFATLIAKYPIRASQAFAVFKFFQSLLCCAAFFYATSISLPWHVLILAIGLLIGLIGFLLAERMVRQNDDDFGDVSAVSSAMEKLMSNVDQRSQNSTIKNSK

SEQ ID NO: 148256 - protein, 840 aa, Heterodera glycines
  Coding regions on vcDNA: vcDNA=SeqID_74679; Strand=+; Position=1 -259,482-706,1086-1314,1403-1572,1786-2184,2510-2807,3084-3413,3797 -4003,4427-4830
  Homolog annotation: Hit_ID=CAE58521.1; Match level="QueryCoverage =32%, HitCoverage=5%, E-value=1e-32, Identity=29%"; Hit description =Hypothetical protein CBG01673 [Caenorhabditis briggsae]
ELPPYVAAQFGVDIQPLPNIGGLHVFDSSQLFAIVKKLVDTLTSLTPPQQLMDPPAFTQLQCNYWRERLKQVAVYVNALQMFLQLTNAKSYDTDQLVAVICCASFPLSPCSSTSILRQICAVHRDISNSLLQLEPEKTAASNDDDELPKSTVFRCWLPNLDQFQHNFVDRLREASAHLSQAIGNVAEDALCLLRWTNTTTTSRAYRLDVVQGNIHNILTTISTLKTLLITTNERENSSFDSTLSEVPFLFVYPDLVAPYLHVLNLLSIALSELGRQIASAQNIERVGLNYGFSHSEFYGLNQLLHCSSQSAGVNAANNDFAIDVQPFIRWLITDQQTPLTASDRLPICLWSIAAPFRRPFSQCRADVLGWILHLWERWHEQNAKIKAKEKLVVKRKRKRRKQNDEEEPGMMDEGGDECVHMESDDQKLRDAYLPDFSNSASDNNHPTSSHLDAAADVVVDQFSVSKDEVHDALCNLFKTLSSNEDDEAFANSSFHPPPFMPLLCVIGKLELFSSATNQTEHDEDLAYSQLLSLDKLREQLQLCAPSSTKFPSLSSSKSAPEVPKAALNVYRDSEPSAVVKCVECLAPLHQRVQLLLNEFPENGQLASLSSTIDAFVNKASAGVPLMKHAAQLESILVRAEEWESIADRAHSIREQMVPLQALLVEWRRREVHCWAELVNMVRADCTQLAVLAGWPLFKCALDTLQNEEQQQNGATVADENSNKNTLILAFVDWMHNATVGDFGARLWTGQLLTKCLPVLAPPNCAIVVGTLCRHMRSTCAHFAQFNRTLRAHFDDRFASVQRSLHDFCRAVRYTDLNVWSVQDSARRAHTHLVRILRSFK

SEQ ID NO: 148257 - protein, 482 aa, Heterodera glycines
  Coding regions on vcDNA: vcDNA=SeqID_74680; Strand=+; Position=1 -196,283-363,729-841,1330-1614,2282-3055
MPAQNEQTKQNAVPTMANLGEPVNVKQGGTLKQIKDSIQMAQQQYWALSGQHAHMGTVEWGGTKNQEKQQNTKKKQQQPYNNSEDISPKALSTKIERLTPMERDNLAKQLVNIEDRLQKTERKLQQKEQKLPTPTTLANSIATATVSTAPPSPFTTVVTKAQKTVEDITREWWKENKEKKHGAEQQRKPGRQPLHSDGGQKAVVEELTESAEFVASSAEEMPSNGEMSSRTSLSNSNGGFKTIASSEIGGTQSTVVGTPALNSAGAASPSDGTNSSSAKTASASALMMMTQNRKRPSPPTMAPQMDKISNATPTKVPPVVPMMPRYQQAVRNLTGRPLGRLDARQRTIVAVMEQKRKQFRKEGDMATATAAAEVPSPQQKMPKPQQKPPETMPQGKNRSGSGRPSADQLSVDTAQALEWMLANMTKSVEVVRHQSTKGGSSKKLLAMANGDDNGAETEEDRDRDQNQHGATAADEVNFKTNK

SEQ ID NO: 148258 - protein, 136 aa, Heterodera glycines
  Coding regions on vcDNA: vcDNA=SeqID_74681; Strand=+; Position=1 -342,841-909
ELARAQSVVGKQQTSGEKQQKEKHASPISMELEIGRLRAELSTMEQQMGQMRGRDRGGQRHQNVPGEQPQRQQNKQKKEEEEREEMGSKSTSGTMETSTKLRSTAAGIAHNQQQGTLTVLVYLFPFPKPFRAIKIS

SEQ ID NO: 148259 - protein, 146 aa, Heterodera glycines
  Coding regions on vcDNA: vcDNA=SeqID_74682; Strand=-; Position=1-439
  Homolog annotation: Hit_ID=AAT79414.1; Match level="QueryCoverage =95%, HitCoverage=65%, E-value=4e-37, Identity=47%"; Hit description =multiple banded antigen [Ureaplasma urealyticum]
MIVVGTKPGPGQMAKPGPGQMAKPGPDQMAKPGPGQMAKPGPGQMAKPGPGQMAKPGPDQMAKPGPDQMAKPGTGQMAKPGPDQMAKPGPGQMAKPGPGQMAKPGPDQMAKPGPDQMAKPGPGQMAKPGPGQMAKPGPGQMAKPGP

SEQ ID NO: 148260 - protein, 68 aa, Heterodera glycines
  Coding regions on vcDNA: vcDNA=SeqID_74683; Strand=-; Position=1 -111,510-605
MLSKWLHTPRKDGQLKRLFCYLKPPNIEWDNINTLKKAFVSTSKMVSDYVKVIYAFEKWSIILDYNDE

SEQ ID NO: 148261 - protein, 258 aa, Heterodera glycines
  Coding regions on vcDNA: vcDNA=SeqID_74684; Strand=+; Position=1 -160,621-759,843-964,1042-1216,1663-1766,2586-2664
  Homolog annotation: Hit_ID=AAB95119.1; Match level="QueryCoverage =44%, HitCoverage=20%, E-value=7e-43, Identity=73%"; Hit description =voltage-dependent potassium channel alpha subunit [Caenorhabditis elegans]
PRHTGDTGGVGQIGHGRTEGRGPADAGAAPDEEVRLGGRLLGGPAQLVDAHKANLSDFSSSPSVPQHSHIHQQQQFHSHFNQPINVQRVATEPHKIFAQIEFVCNIWFTFEILVRFVCCPNKLNFFKYPLNLIDLVATLSFYTDAVLVRLFRDQAPKDLVEFLSMIRILRLFKLTQHHRGLQILIHTFRASAKELMLLVGYGDMTPQVIKKEKHIIEKQRQSCIVIKIHQSLGNGNGPQKCLVDEEQCRTAAILRQRS

SEQ ID NO: 148262 - protein, 103 aa, Heterodera glycines
  Coding regions on vcDNA: vcDNA=SeqID_74685; Strand=-; Position=1 -156,199-408
LGLGTILLRFGLRYVFDRLSVRRFEHAQGNIRPSVVFSFVCNFCRFWPLRIRLLDTLETGQSVEEGAPAEPIRLYHLTNQTHTLHTFAIFPHFLNFCLENIFE

SEQ ID NO: 148263 - protein, 42 aa, Heterodera glycines
  Coding regions on vcDNA: vcDNA=SeqID_74686; Strand=-; Position=1-125
EFCQNVNLSSAVRSGRPSADSPMLAKSAFPLLFGPCRRLLSV

SEQ ID NO: 148264 - protein, 127 aa, Heterodera glycines
  Coding regions on vcDNA: vcDNA=SeqID_74687; Strand=+; Position=1-384
MPIKCPPTERRESCVEVRTKVAEINRKTRNILFPIKMPNTKKIPMEKQMVAMTMPALIPCVFVEDEASIQSQDNVTPMPNIVMGDQRAIAITNGENGTMINHAQNDGNNGEDKRTWVCDMLKMQNKS

SEQ ID NO: 148265 - protein, 280 aa, Heterodera glycines
  Coding regions on vcDNA: vcDNA=SeqID_74688; Strand=-; Position=1 -115,164-216,273-322,372-505,554-633,676-738,785-892,950-1048,1141 -1156,1437-1560
  Homolog annotation: Hit_ID=CAE64126.1; Match level="QueryCoverage =80%, HitCoverage=37%, E-value=4e-53, Identity=42%"; Hit description =Hypothetical protein CBG08742 [Caenorhabditis briggsae]
MFLALRLTAKSLIAFQITRSTFACSKAFFFGETNPKVTAYPNRSTVSVQMSHRNPLTFCGPLRSILMFEQSPTVILIALMSIVNGSGSAAKTRGLVCLLVGWVVLFIMDSDSPLTNHSESHRHQSGLNHVFYHFVGWFGLSDHSGGVLLLLFAVFLRMIYESNYRHLAVEIGGPKRLYALSSLVASLLLTPFAVLVLVFSPSFIHSFLEFPLLLLFAAAFVVVIDFYADNIAFQHVADPATFVLTSTQDSRRSVGGHFIGISEDGMPLFTHGEAFLEKTS

SEQ ID NO: 148266 - protein, 215 aa, Heterodera glycines
  Coding regions on vcDNA: vcDNA=SeqID_74689; Strand=-; Position=1 -156,212-472,636-728,774-911
MAVSERIRKCVIVTKLADGTFEECRRLAYIPLNKWHVTVAKRKNYPFYIYEERKSDGMICQTHQKFIMNAPKFNEQTYKLNITNYQVDERKDIQEFVDAFLRASEDEQTEANETLREKAFDHLFSTQYENLYERYRTFQIRFDELSATTLRRYKKFFNLPNRSGANSKAQLLEGINDHFESIPVDLAETAAHFLDTIYKKRNRLDYPNNIENSAG

SEQ ID NO: 148267 - protein, 76 aa, Heterodera glycines
  Coding regions on vcDNA: vcDNA=SeqID_74690; Strand=+; Position=1 -163,244-310
MVVLSKLGSPLRPFSNDYLLCRFQAFRNYAIKKERPPPAKIQVPPPANETGHWKYERDYSYDLRYSNPINKYSSFT

SEQ ID NO: 148268 - protein, 33 aa, Heterodera glycines
  Coding regions on vcDNA: vcDNA=SeqID_74691; Strand=-; Position=1-100
GKILALVHLMSPIEFYESNQLTIPGFYTITLFM

SEQ ID NO: 148269 - protein, 69 aa, Heterodera glycines
  Coding regions on vcDNA: vcDNA=SeqID_74692; Strand=-; Position=1 -61,518-666
MHKIVKYAQKSRNMQKNANKKFGHGADELEQFVGRTSHIVRTVHGPAVVLQGHGAGRVVDDQAGGKCQD

SEQ ID NO: 148270 - protein, 71 aa, Heterodera glycines
  Coding regions on vcDNA: vcDNA=SeqID_74693; Strand=-; Position=1-213
MARHGVLGGNIRTVDVRVVDGHGNCIYTPPPAAHVPQLLEQFIQDVNSAIGQASTGLMEARVVAAWAHYKS

SEQ ID NO: 148271 - protein, 29 aa, Heterodera glycines
  Coding regions on vcDNA: vcDNA=SeqID_74694; Strand=+; Position=1 -52,459-496
MAPGQSISGQSVSGQSVNSFLGNLRAFDH

SEQ ID NO: 148272 - protein, 22 aa, Heterodera glycines
  Coding regions on vcDNA: vcDNA=SeqID_74695; Strand=-; Position=1-3,71- 136
MVGIFGWDPGSRNSKSEAWPPM

SEQ ID NO: 148273 - protein, 613 aa, Heterodera glycines
  misc_feature (59)..(59): Xaa can be any naturally occurring amino acid
  misc_feature (259)..(259): Xaa can be any naturally occurring amino acid
  misc_feature (432)..(432): Xaa can be any naturally occurring amino acid
  Coding regions on vcDNA: vcDNA=SeqID_74696; Strand=-; Position=1 -188,250-1592,1623-1823
  Homolog annotation: Hit_ID=XP_318550.1; Match level="QueryCoverage =89%, HitCoverage=57%, E-value=1e-123, Identity=43%"; Hit description= ENSANGP00000020240 [Anopheles gambiae]
IQAISEMPVPTNVSEVRSFLGMITIYHFVKTMRFIRQPLDELLKGQSVAMVRRLSKCLXEVVSADASEHGIGAVIVSADASEHGIGAVISHRFSDGSLKAIAHASSSLSAAEKNYSQIEKEGLTIVFAVQKFHKYLFGRHFVLQTDHKLLLSIFGNKKGIKACTANRLQRWAITLLGYDLEIEYQNTADFGQADVLSRLIAKTPVPDNEVIIANIRESNETGVLNFVSKTLPLDHSDLANAAKNDQVMQKVKKFVCSYXPTKNKMAADIVPFHRRRDPLTIEDECLLYADRVVIPASLQKDVLQLLHRGHPGMKRMKALARQYVYWPGMDEQIENFVKMCNECTMEAKMPVNTELHSWPKADGPWKRVHLDYAGPFMGKMFLIIVDAYSKWPEVFEMRSSNSAATIDKLRSLCASYGLPEILFTDNGTQFAXKEFKEFVTENGINYVFSAPYNPMSNGQAERFVDTFKRTCRKIKGEGASEMLTTFLATYRTTPCEGKCPAEMFLRRKPRTTLDLLRSAMEKQFNRRHGAKPRSFALGDKVLARHRAMEKQFNRRHGAKPRSFALGDKVLARHRLSQPWRPGKVTKCKGVIYDVEFFDGKFGRFHTNQLLVRS

SEQ ID NO: 148274 - protein, 425 aa, Heterodera glycines
  Coding regions on vcDNA: vcDNA=SeqID_74697; Strand=+; Position=1 -229,669-1124,1205-1797
MMARASFALPLLLLLLPLFCVAMNENDGTVAGEGSANSETWIEKLANLLSEIGKICDVYTILPRSHYKILFIFGKFDNINDKKVQKIEIETDDKGDFRWNFDEMIVQNKTVAAGDGPEVTVLLCRTSKKHCHVFRVYESFAEMREEMTKNEGRFYGAFQVMYEHYGHCISMESGAYFGETEQCQKSEMSQSDENSGMAYSPASYSHICDTYTILPHTYYKILLLFGELKNAHGEKVEVPKIEISTDENGTFRWNFDEMIVKNKSVASKDGKVTVLLCNLVKKECRIFRVYDNFGKMKMEMAQNECRFYEHFQVMYEHCDHCTSMENIGKRNEEGNYLGEVSQCQEQKEKDGTGEQKHPKLPISTFPSFHTLASPENEAEKEEEDVEEDVPLLLERGGHEKHGRTHHRSLRHRRVGQSQAEKEEAN

SEQ ID NO: 148275 - protein, 121 aa, Heterodera glycines
  Coding regions on vcDNA: vcDNA=SeqID_74698; Strand=+; Position=1 -122,169-253,306-464
  Homolog annotation: Hit_ID=CAE68944.1; Match level="QueryCoverage =79%, HitCoverage=26%, E-value=3e-14, Identity=47%"; Hit description =Hypothetical protein CBG14924 [Caenorhabditis briggsae]
MAECCSSVSASDNGTAPSSSSSSWAELGLSDATLNALGTMNFPFPTPIQNAVIPIAVKLKKDIIGAAETGSGKTLAFAIPILEHWLTNAIATNVQHFPVKGSLFALIISTTRELDVQQGCA

SEQ ID NO: 148276 - protein, 178 aa, Heterodera glycines
  Coding regions on vcDNA: vcDNA=SeqID_74699; Strand=+; Position=1 -24,1945-2012,2079-2153,2207-2367,2474-2615
  Homolog annotation: Hit_ID=CAE67763.1; Match level="QueryCoverage =97%, HitCoverage=19%, E-value=1e-30, Identity=44%"; Hit description =Hypothetical protein CBG13338 [Caenorhabditis briggsae]
AHFNPFPLFRLSVKQNKYPVLFLCVGQTDRYVPFLDERSKVTYVPFLDERSKVTRVGSNFAACSNLLGINLHSEELLGINLHSEELLSDPSSLKRAVAMKLITFVWVEDLDKLEYVAYFRRQNVDAIIYDRIGELETRQNVFVVEREVKSALFKSPRTSPSLSRANSLFRNSQSPTMP

SEQ ID NO: 148277 - protein, 494 aa, Heterodera glycines
  Coding regions on vcDNA: vcDNA=SeqID_74700; Strand=-; Position=1-1485
  Homolog annotation: Hit_ID=NP_775082.1; Match level="QueryCoverage =52%, HitCoverage=9%, E-value=3e-09, Identity=26%"; Hit description =zonadhesin isoform 6 [Homo sapiens] gb|AAK01436.1| zonadhesin variant 6 [Homo sapiens]
MSNTFFVHLSSNSPDYAENTPNKFRVRLPKPIYFNGSWVCGLHSINYAYSWPSTIGTLDDQWINIHFTDGLDNERLRIVRVPAPKASNTTIENLRNFLISTLKNHAESLEKIIKDSSQRSIKRKRAASQPKSPPSAIVPKSQPNVSPNVTLNVKVPTSPPRVGQQPQTKSEDISDSILNVTKPSEKQPKIEKESEIVKHETEKINQKPTQNISLPTNQTKNVNSEGVSQNIIPPPPVTSPSIHANKQNQEPKKNDESPSQVGKTKHQLPVLNQAIVSQAQKKITATPTQRSKKSTIEIVPPPHRSTPTSPIRPNVTEKKTTSPPKTISIDTIGPPPKQRNEKSLNINQGQTQLVTEITPENSKKTTITTTTTTTITEPPKETIDDLVGQIEEPTERNRVEELISVLFGDEKWKQINLRMVRQIIEGVELQYHPNLDRFKAVFTHPRIEFISFSPQLGYVLGFENAQHVRNNEIAKYGSDLRGFCKLCRLRQRVD

SEQ ID NO: 148278 - protein, 419 aa, Heterodera glycines
  Coding regions on vcDNA: vcDNA=SeqID_74701; Strand=-; Position=1-1257
  Homolog annotation: Hit_ID=NP_775082.1; Match level="QueryCoverage =61%, HitCoverage=9%, E-value=3e-09, Identity=26%"; Hit description =zonadhesin isoform 6 [Homo sapiens] gb|AAK01436.1| zonadhesin variant 6 [Homo sapiens]
MSNTFFVHLSSNSPDYAENTPNKFRVRLPKPIYFNGSWVCGLHSINYAYSWPSTIGTLDDQWINIHFTDGLDNERLRIVRVPAPKASNTTIENLRNFLISTLKNHAESLEKIIKDSSQRSIKRKRAASQPKSPPSAIVPKSQPNVSPNVTLNVKVPTSPPRVGQQPQTKSEDISDSILNVTKPSEKQPKIEKESEIVKHETEKINQKPTQNISLPTNQTKNVNSEGVSQNIIPPPPVTSPSIHANKQNQEPKKNDESPSQVGKTKHQLPVLNQAIVSQAQKKITATPTQRSKKSTIEIVPPPHRSTPTSPIRPNVTEKKTTSPPKTISIDTIGPPPKQRNEKSLNINQGQTQLVTEITPENSKKTTITTTTTTTITEPPKETIDDLVGQIEEPTERNRVEELISVLFGDEKWKQINLRM

SEQ ID NO: 148279 - protein, 395 aa, Heterodera glycines
  Coding regions on vcDNA: vcDNA=SeqID_74702; Strand=+; Position=1 -60,118-449,863-977,1588-1939,5885-5986,6524-6748
VHAVQTVTILHSNPSHSAIAQHYGCEEVQQASPTAEDGTKNANGGADGGDDQLLLLSALLGSSSLLSSPASSARHGAQRWRRGTIGEQSIAEECSSGTTVSAGAVDGRENEGDDDENGTDCGEHGDDKEDKKSQPPLSALLSADKTPTKSQFANVNAKVQQEHQQQRTPLPQRFTAAASVAIGKLSGASPPPPALLATATTAQMLHLYNANIGNKSATQMITAAAGAVDDDDDNDEDEDATTDRPTDQSDANGSSTVPPSPALSHQLTMAAAKQQLLKHTAPKSGSADKIVDDKANVHVSMQQLLAMRDDGMELAFERCKAWSKYVSQLLQIVKLRLSTEEDYVNKLRRQSEQAKALLAVGTAQTVAANVGKMPLAGVFERMLDGTMQQTVHAEC

SEQ ID NO: 148280 - protein, 79 aa, Heterodera glycines
  Coding regions on vcDNA: vcDNA=SeqID_74703; Strand=-; Position=1 -102,779-916
MAAVDQHQQQLVERIKQLDTLSTTADEQFDNSLNSNFDQLKMALAKSTGTFASGGSAYPKVVGMDWSILSVIEVLRYFN

SEQ ID NO: 148281 - protein, 84 aa, Heterodera glycines
  Coding regions on vcDNA: vcDNA=SeqID_74704; Strand=-; Position=1 -72,292-298,444-616
  Homolog annotation: Hit_ID=AAR05911.1; Match level="QueryCoverage =100%, HitCoverage=61%, E-value=4e-18, Identity=62%"; Hit description= magmas-like protein [Globodera rostochiensis]
MVWKELAKVAAAGAVAVSRALARAMVASREAARRQASAATASDSAGGANNTASTSSATSSTASARRATEREALQTNTRLGITVQ

SEQ ID NO: 148282 - protein, 141 aa, Heterodera glycines
  Coding regions on vcDNA: vcDNA=SeqID_74705; Strand=-; Position=1 -123,843-934,1007-1193,2122-2145
MDIKWQKSQNMDINFSKLSAKFLQIYWLKLHMRYISKFFDSSIFLPSLVMIKVKLSKRLKWKIIHNSCYANSSVARQSDSALFPSFLPLSHWRKEEIVHCLTVCQRGAAAGGRVDSKQPCGVLAGSIVCGKREEKIFGILS

SEQ ID NO: 148283 - protein, 24 aa, Heterodera glycines
  Coding regions on vcDNA: vcDNA=SeqID_74706; Strand=+; Position=1-85
LTHRPLRRKNQLNCTWSPKLTRRV

SEQ ID NO: 148284 - protein, 246 aa, Heterodera glycines
  Coding regions on vcDNA: vcDNA=SeqID_74707; Strand=+; Position=1 -11,77-352,404-854
  Homolog annotation: Hit_ID=AAL78214.1; Match level="QueryCoverage =75%, HitCoverage=94%, E-value=2e-12, Identity=29%"; Hit description =putative esophageal gland cell protein Hgg-20 [Heterodera glycines]
MNRRWICNDVWMDIFPSFDRPQLGLKLALLSPRFDALVDKHFNGKSELTIWRTIEIHKGKGPEPKLSVWMDDKFVPFPLPDRPLPSKIRFKNLRIEYIDHSVIAFLRSNHQIFDKRGTNLHLWLPLSNTTDGQPIWDVFVREIWPIFSANIRHLRFPHGDDLDNLRRRTSPTIFTDLNQLNSIYSGDLLPAAIDADFDVPNATISAGQALSKWLHSPRNDGQPKRFRCGRNLNAQEDFDWVNSFKE

SEQ ID NO: 148285 - protein, 50 aa, Heterodera glycines
  Coding regions on vcDNA: vcDNA=SeqID_74708; Strand=+; Position=1-153
LQIYWLKLHMRYISKFFDSVRRFDKDGFRFAISQSTFGNWSRIFSAITCN

SEQ ID NO: 148286 - protein, 106 aa, Heterodera glycines
  Coding regions on vcDNA: vcDNA=SeqID_74709; Strand=-; Position=1 -127,250-443
MVQFSTKMLTTFSLFIIKILLLDSVEAAGHKVTIKAYFKDFENEKQLKGGIFWELTFENKEKLKPDEKCSNYEDEEDSELEALLSTLHAAKFPAEKANDKTPSRKK

SEQ ID NO: 148287 - protein, 104 aa, Heterodera glycines
  Coding regions on vcDNA: vcDNA=SeqID_74710; Strand=-; Position=1 -87,145-237,938-979,1041-1132
MSMVDFFRVKKDIRINGQLPAVRQQKDRETLFPLSCIVILPSQRLPLDKMADYVSRELLNIKFGDGGQLTFKDRINPGVRFLETSDRVKNWVVGYPRQINDQEV

SEQ ID NO: 148288 - protein, 62 aa, Heterodera glycines
  Coding regions on vcDNA: vcDNA=SeqID_74711; Strand=-; Position=1-283
AIFVTNSTQISKIFSRRRLSAPPDLHFPLFLQVFCLKTAKIGSFLVKKCSCYPAVEKKLLVK

SEQ ID NO: 148289 - protein, 36 aa, Heterodera glycines
  Coding regions on vcDNA: vcDNA=SeqID_74712; Strand=+; Position=1 -101,374-383
MPFVVIHFALHVNTANSIDVFVERGRRGNGLKLRKI

SEQ ID NO: 148290 - protein, 323 aa, Heterodera glycines
  Coding regions on vcDNA: vcDNA=SeqID_74713; Strand=-; Position=1 -142,200-297,897-919,1898-2607
  Homolog annotation: Hit_ID=NP_500972.1; Match level="QueryCoverage =73%, HitCoverage=88%, E-value=3e-12, Identity=31%"; Hit description =predicted CDS, putative protein family member, with a coiled coil-4 domain (4H108) [Caenorhabditis elegan
EFVKSWYPILKIKDIGNASSKLPNAALPLAQIVRWDWDQNGAQQINGTQILKKGSAISFNICANDSASFVIRILKKREKKNNTGPYTAKNLERLEKLLEGSGNPALNSIIQRLEKLENLVQQLVEGENRCGNRFADPQHASHSSSVPISNNGTVQWGQPPPFAGTGLVSRMITEAIINSEQLKEKANRAVIEKLPEAMDERALVEQIADECGVKDKLTPDIHRHPRTQLTDGGVKKDRILKVPFSDKYSRDKFIFNFRNALKKFPNLPQFIKVRRDMTQNELKILYSLRQQAYKANIAAGEYKYYVVDLEIRSLKNPHPLRTR

SEQ ID NO: 148291 - protein, 40 aa, Heterodera glycines
  Coding regions on vcDNA: vcDNA=SeqID_74714; Strand=-; Position=1 -30,175-267
MDYVIILLTKCLTSFCLFFISCFLITEKCPKNGSVVLVLF

SEQ ID NO: 148292 - protein, 70 aa, Heterodera glycines
  misc_feature (40)..(40): Xaa can be any naturally occurring amino acid
  Coding regions on vcDNA: vcDNA=SeqID_74715; Strand=+; Position=1 -98,244-547
KIKNILGLFLKYLYKHIRSFSIFSHFSKIHHKILQNQKSXHRRICRIFFLNTPSKNGKIQKFSTIFCFVF

SEQ ID NO: 148293 - protein, 138 aa, Heterodera glycines
  Coding regions on vcDNA: vcDNA=SeqID_74716; Strand=-; Position=1 -194,554-775
  Homolog annotation: Hit_ID=NP_509753.1; Match level="QueryCoverage =85%, HitCoverage=27%, E-value=7e-43, Identity=67%"; Hit description =neurotransmitter-gated ion-channel subunit family member (XL75) [Caenorhabditis elegans] pir||T19840 hypo
LPDLYFANARQANFHEVTVPNFNLFISTDGTVSYSSRVTLTVACNLKLQDYPMDEQQCHIRVLSYAYIAKIVNVTWFRRQPILYNPEIDLPEFDIDQIVAEYCDGTYRYAVTERAYKTGTNWLELVFVYLINNFLFSK

SEQ ID NO: 148294 - protein, 105 aa, Heterodera glycines
  Coding regions on vcDNA: vcDNA=SeqID_74717; Strand=-; Position=1 -44,946-1030,1487-1675
MHKNQIIGYKNSKHCGQNILGYTHSDEPFVAYHRATEHAPNRLKKLQRFRATKTKSATTFMASELHRKIRRPPSNSNGEPLSVQLGFYLESLGNFRETQMVYERH

SEQ ID NO: 148295 - protein, 110 aa, Heterodera glycines
  Coding regions on vcDNA: vcDNA=SeqID_74718; Strand=+; Position=1 -172,1136-1296
MPSSSPIVGFSLLLVLIAQNVFVQGFGLLNSKIDAASKASIKCCVKEAHLSMECAKSACCKRKGVKAPCLDLCNGKNPDYLPDPAYVPCTFPGKVDNAIQKCNHDAWKRG

SEQ ID NO: 148296 - protein, 18 aa, Heterodera glycines
  Coding regions on vcDNA: vcDNA=SeqID_74719; Strand=+; Position=1-56
YREAIPEGFGLPINLGAS

SEQ ID NO: 148297 - protein, 95 aa, Heterodera glycines; identical to SEQ ID NO: 138780
  Coding regions on vcDNA: vcDNA=SeqID_74720; Strand=+; Position=1-703

SEQ ID NO: 148298 - protein, 317 aa, Heterodera glycines
  Coding regions on vcDNA: vcDNA=SeqID_74721; Strand=-; Position=1 -222,270-534,586-1052
MILQLAIDTAYGCQTNESVDGIFRQNFNEILGEMFKKAEQRAKREDNNLLYVKYGIFDTNDIIVRSIFDDYCLWTNDAIFTEFVKGQETNFEKFYRMLKEYSNFEKSKEFYLQKYGAYFGLVYLMRKNWQCAKVGEDLKEKCQKYKKYLHILYEYFFRISAEAKNANMTNQLSAVKPIFKWGNKYWQFMQIISIIQNLNNFSKCFWKKGEKECENAYGNYEMELQNEKETNHAIEEEEKNGQNLERKSEKQSTEIGKLRTEFDQKMEEIYENTKEKVAEEKSKLVKKMAKLAINRERKMMEDEFEEKFGAFNSSPFA

SEQ ID NO: 148299 - protein, 612 aa, Heterodera glycines
  Coding regions on vcDNA: vcDNA=SeqID_74722; Strand=-; Position=1-1838
  Homolog annotation: Hit_ID=CAA82797.1; Match level="QueryCoverage =30%, HitCoverage=29%, E-value=1e-11, Identity=30%"; Hit description =gag protein [Ascaris lumbricoides]
MQQFEFENGSESNMDPANEGHHRNGAQHDENVQDGDGPVASTNEEQQKVARVNEATRGSNMATGVATNQQGMLPFPSRNLRSVSIPVRTARDRIERASGTLAARIAEAREVIDQDLTEGEAGYQAARLLAMERGLKEATQIFQGHFEIGMAAAGAEPAGHQDFFYDLLTAPLPAATKELQLRNHPTPAELLQIADEHIGDLRTMRRALEDEEEAIARSRLSGSFGTNNSHPVGDEPPPLENRNIEECERSFQVAAKRWQNGGQGVQQHNRRPMGRVATPVMSNLDGIFQRRAKVPSVASMRVTNTAREWINRNRDEMGAFPPATAHRPALMQPKIEKQQAHVNDDYRERQTYPIRRHARDEGEHDRKHGRDEITGMTTFETVRLQPPTFSGKPEDWTTFWAYFKRAVDDKPIPGFEKQLHLLRCLKEGSPARRAVEVYPPSDGNYPVVVHLLKERFGDTDDLQRAIRARLLHLPPTKDNVNSLTTMIDEFERCVCQLEQLGANVDDDSFGPLLEAKLPVRVLTELRIRESMMGSKWAVREFRRAVTAQVRCMRSAESALAAMKDPEVRTDHKTERDQTGREVQAGREPFQRAFMVRDSQPTCAQSNGTRSEE

SEQ ID NO: 148300 - protein, 1359 aa, Heterodera glycines
  Coding regions on vcDNA: vcDNA=SeqID_74723; Strand=-; Position=1 -3301,4024-4348,4396-4849
RAVDDKPIPGFEKQLHLLRCLKEGSPARRAVEVYPPSDGNYPVVVHLLKERFGDTDDLQRAIRARLLHLPPAKDNVNSLTTMIDEFERCVCQLEQLGANVDDDSFGPLLEAKLPVRVLTELRIRESMMGSKWSVREFRRAVAAQVRCMRSAESALAAMKDPEVRTDHKTERDQTGLEVQAGREPFQRAFMVRDSQPTRAQSNGTRSEERYGTNARFARRSITHANENESSGGNWPRVASNGPIATTEIWNCSLCLRSGHRPSKCQAYPTAQARRKRLIEQKRCLRCMSSDHLFKQCQRVNRCNACRKDDHHWLLCWKSISGGQSRSFTEHERRAKNHATLISGMDRPSHFTAVRDEQNNRDEFDMNAGEQRAFTTFGSRLPAQQMICRVIAAAEEGEDECQTTLLLDPGSHVDGADTELIQQLGPQPIDKRPLTVQVFGGKKQRIRSATYRLRLKRTDGKWESIEVSEVPQICTPIRTELIESGATPDSDPRTITQTTQPQIMIGIRKFWDYVVGFRKIESGAHVIDTVFGQVLCGEGTQASSGATPAVSILTTMPCGNIHQTRTNKRQQIGEVRRNWKRKRKSRKNNSRGIVSRDRHNSPAEFGPDRLGANEVITSRAEPIGEMDPNQRKWPIGWIVETKGASEHNRNAIIRMANGRTRRRPIKKIWPLKEARLKTGETDDRADEAVHERHEEETRAAKTQSETRDRNKPSATRREERNETKSNEESVENRRREIEAVPPDGKANREIRSDNSRGKGPNDSEEKYGSATTTKKSAVFGKAAEVPSAAQSKAGNSARPHSAQRHEKKYLGDSSMAPSLLNVPTKFQPNSTISEGGDRFGADEPQAVQADEIGGEFPEAPAVEQQQNELERTPNNPGEEVRGEQNIQGVQAVPEVEPRKSARTRRNRAIWSPERHVPRKRGAIQPRTGMALLIMLISIVGTFGCQPSIRASGMDPNLPFREGPRVPCTTECAERGVTNVSGREFNKIEIRCDDGCWATMPKSTDVNYGLPAKKLMHGYPCHGKCWWGSNAPFNTTRRNANRKTGSKTRCYNSWTHASELQLSRGAAGNVANFFIGDEKAGQSPPIAQMNGTGLNRSKKNEGFPFPLALENPGVGPERQRISSSSDSRSRSLADRCQSPASRSSRRDGANSRRRRNQAGQRRKEEPSGAKPSTEGQARSSPLIPPAGEARIAGVSLPPAGASTGGDGSRNPFPQPESRGSVSVSRQPEHPPQETGVKTRFIESRAKSNSRPFGAAQRVGQAPFTTNLVEQLPPVRSCSKGSDKPFTKILSVVPLSKQRFAAQFSQAPIQICHPSPLPFSSPFGADRIGQQHQTHQNERQKRVRFPLRQANGVSRRKKGRER

SEQ ID NO: 148301 - protein, 24 aa, Heterodera glycines
  Coding regions on vcDNA: vcDNA=SeqID_74724; Strand=-; Position=1 -31,545-588
MMRMYERMVFESLMIVLKKGERIE

SEQ ID NO: 148302 - protein, 50 aa, Heterodera glycines
  Coding regions on vcDNA: vcDNA=SeqID_74725; Strand=+; Position=1-152
MSNSFFVILPSNTPGFVGNKTNKFKVHLPKKLVFDGPGWMVDMSGIIYPN

SEQ ID NO: 148303 - protein, 247 aa, Heterodera glycines
  Coding regions on vcDNA: vcDNA=SeqID_74726; Strand=+; Position=1 -165,801-947,1587-1666,1994-2238,2270-2323
  Homolog annotation: Hit_ID=ZP_00051284.2; Match level="QueryCoverage =93%, HitCoverage=80%, E-value=5e-61, Identity=52%"; Hit description =COG0656: Aldo/keto reductases, related to diketogulonate reductase [Magnetospirillum magnetotacticum MS
QDKLVMPLTTLSGHPVRIIYGTAWKKERTAELVRSAIKAGFRAIDTACQPKHYDEALVGVTLEQLLREKFISREDIFVQTKFTSLDGQDPARVPYDRTASLPDQIKQSMERSLANLRLDFVDSLVLHGPMRTLDENRLVWRTFEQLHGEGKTKRIGLSNCYDLHLLRALYEAATVRPAVLQNRFYAQSDHDRAVRAFCKQNGIVYQSFWTLVSSPRIALPEFFKNLQSKFSPRIALPEFFKNLQSKF

SEQ ID NO: 148304 - protein, 88 aa, Heterodera glycines
  Coding regions on vcDNA: vcDNA=SeqID_74727; Strand=-; Position=1 -165,221-322
MEKIEFLENWRCKCSAILRIVTQKKGVFDFSREFEDHEFDSKCSWRGFTYFIAFSELMDPSKGFYNREEDKVTLAIDVTVKEAKTDNS

SEQ ID NO: 148305 - protein, 84 aa, Heterodera glycines
  Coding regions on vcDNA: vcDNA=SeqID_74728; Strand=-; Position=1 -98,718-874
MSLAWSVRLCKFQFQNCAMFFWLMFRLAFSILSSIRRFNNARNGQYFSFPSEFSWHFRWAFVPTSVSEPKANFISEKSDDLDGN

SEQ ID NO: 148306 - protein, 102 aa, Heterodera glycines
  Coding regions on vcDNA: vcDNA=SeqID_74729; Strand=+; Position=1 -113,200-395
MHIYVCVLYFGLLNQNLLGFGLLCTKLMLDRYWNMLLSLPPIPYQQRLDYLQLPTLESRRKLSDLFMAHKIIYGRTDRIPLKYSNLLNALTCPFIDLTRNIN

SEQ ID NO: 148307 - protein, 15 aa, Heterodera glycines
  Coding regions on vcDNA: vcDNA=SeqID_74730; Strand=-; Position=1 -34,701-714
METKIFGEKREFLWP

SEQ ID NO: 148308 - protein, 265 aa, Heterodera glycines
  Coding regions on vcDNA: vcDNA=SeqID_74731; Strand=+; Position=1 -92,262-410,591-736,1146-1414,1846-1987
MPKSGGNANIGGGAAPTPIPSPKNQKQKQQKQPSKAGQKNAPKADQKKVAPKNQQNGKPKSDQNGGPSPMSKKEKKKQQKQKKNHMKFARESAERLEEAVKMIQARKEGSEKATGEENVKKDKDAVYNMVASSLETLLPVRFVFGRLRSSARLVAKQHSSNIVQAATLLEPKKFKQFVQLLDSSNVAKKGGVAEATEDDEEKAERKEAGEEDEQRVLALALCVLSAAMCLLGNALPDDEDTAQRREEYLNESTELRKMAKANIHW

SEQ ID NO: 148309 - protein, 88 aa, Heterodera glycines
  Coding regions on vcDNA: vcDNA=SeqID_74732; Strand=+; Position=1 -15,61-312
MNYVLTFFAEKILNFPMENPSQIDLSPFLLFFNYSPFLPAGVVSQQWTNKCIFPIHILSIVILRPTSAVTVLGQTALRLTYPKIKCPQ

SEQ ID NO: 148310 - protein, 98 aa, Heterodera glycines
  Coding regions on vcDNA: vcDNA=SeqID_74733; Strand=+; Position=1 -179,622-713,829-854
  Homolog annotation: Hit_ID=CAE71617.1; Match level="QueryCoverage =67%, HitCoverage=2%, E-value=6e-14, Identity=57%"; Hit description =Hypothetical protein CBG18580 [Caenorhabditis briggsae]
MLRNIGILSLLAFFFLCGTINGQQPPLANGLEPTRQRIRNTLGGFYSGNVTLYFRNSPYRVERELIVESGATITIETGVQMYFDTGVGMKGPGLSWPG

SEQ ID NO: 148311 - protein, 259 aa, Heterodera glycines
  Coding regions on vcDNA: vcDNA=SeqID_74734; Strand=+; Position=1 -182,552-643,1117-1256,1745-1925,1986-2126
  Homolog annotation: Hit_ID=NP_506859.2; Match level="QueryCoverage =90%, HitCoverage=7%, E-value=5e-91, Identity=64%"; Hit description =speract/scavenger receptor (5P989) [Caenorhabditis elegans] emb|CAB03852.2| Hypothetical protein C06B8.7 [
KMLRNIGILSLLAFFFLCGTINGQQPPLANGLEPTRQRIRNTLGGFYSGNVTLYFRNSPYRVERELIVESGATITIETGVQMYFDTGVGMKVFGTLQAVGNEFAHIQMLPYQEQLVYDSKLPELRLIDGPTVRQGRLQIRFRDRWRSVCTQMTNWTSIDTGTACRTMGYDDGAFWRFFQRNNDTYPFVMPAPKCTQRQNSLWNCPGFEDKEQSLWNCPGFEDKEQIPLSENLCQGEDDIGIYCWGRPTFTGWARHWKGI

SEQ ID NO: 148312 - protein, 68 aa, Heterodera glycines
  Coding regions on vcDNA: vcDNA=SeqID_74735; Strand=-; Position=1 -160,210-256
MCANSLPTACRVPKTEIDGHANRAQIMPIRNLARDLETRTWVFLEFCPGNPCPVIMLYFKLSKNDKYF

SEQ ID NO: 148313 - protein, 128 aa, Heterodera glycines
  Coding regions on vcDNA: vcDNA=SeqID_74736; Strand=-; Position=1 -208,261-439
MVKKQKTDDEKREIVEKYFKIKIKFMKNGKHSQKEWKEFRAKIKQMFGVIFQAIEKWAKNLGIEQNNSKERKMLSIAEKIETIKQYYQIKKQNPKFKEYEIAAKLGIPMSSLDKYKTKYGNESKNKLL

SEQ ID NO: 148314 - protein, 74 aa, Heterodera glycines
  Coding regions on vcDNA: vcDNA=SeqID_74737; Strand=+; Position=1 -210,258-272
MTQKMRNFVMPMLRMNQIAVVDPFTKEQLLLPVNVLQFSHNFAIVLISLGTFLTIISIGLAAFFTVKRNGKYVK

SEQ ID NO: 148315 - protein, 77 aa, Heterodera glycines
  Coding regions on vcDNA: vcDNA=SeqID_74738; Strand=-; Position=1-316
RNAYLSSSFLHSPRRKESLLIYIITHCQFAFLFTIGSILHLLYYHYSGLLLRFTHSAFSADTLCSFNICLMLPFFMF

SEQ ID NO: 148316 - protein, 267 aa, Heterodera glycines
  Coding regions on vcDNA: vcDNA=SeqID_74739; Strand=+; Position=1 -231,278-397,767-870,950-1166,1232-1364
NLNSICYWLIGANSACIAIYSFTYFVQFGIVFFSPSGIPLWLCCLLVSVPLFFLCCQYVLFPLIALDRLIGAVFPLKQMGFLYKRRYMLFAFFASTSFGTVIVALAVNESIVNFSEKLVLCMTYDPVPAYFANFSWMLNLCSIVLYLALWFPMRSNETINRKVLFSLMAIFLVETFGWVFNLSVRLLLVQFGTTESTKWLVLSYAGYLTQFSLALNGPILYATSTEYRTAFRKVFGFGQVNLPAFTIQVVPMNRSGKTIGQSGKTIA

SEQ ID NO: 148317 - protein, 60 aa, Heterodera glycines
  Coding regions on vcDNA: vcDNA=SeqID_74740; Strand=+; Position=1-185
ILPKTIKKRIKNGYFEQISWVGPGLSFWPGNPFRTAEAEQTSAVPNLVSIVERSNFYAFR

SEQ ID NO: 148318 - protein, 43 aa, Heterodera glycines
  Coding regions on vcDNA: vcDNA=SeqID_74741; Strand=+; Position=1 -63,322-390
MSIQNNFLLFVVSALLFFIGMAMEGLNSNIYLSLDLAFYFKKD

SEQ ID NO: 148319 - protein, 49 aa, Heterodera glycines
  Coding regions on vcDNA: vcDNA=SeqID_74742; Strand=-; Position=1 -88,379-440
MTMLKTVLVILLPIFDHRTPKIIQWLRCFVQGPLAFGYFLSETSEHNFM

SEQ ID NO: 148320 - protein, 761 aa, Heterodera glycines
  Coding regions on vcDNA: vcDNA=SeqID_74743; Strand=-; Position=1-2288
  Homolog annotation: Hit_ID=AAA59875.1; Match level="QueryCoverage =38%, HitCoverage=68%, E-value=3e-34, Identity=39%"; Hit description =mucin
KIVDRINRSPSRAHGMRPIDVGFFNAQRVWKLLYDGHGPPQKRRPPRFRKDDFVRMSREKGQFEKGYLPNYGDEILEVDEVLKAVRPIRYKLRDEHGEKFKGSFYEQDLARVRKDAETSYRIEKVYRKRKRADGSTEMLVKFIGYPERECVDKSTHRPYCIPFIFLCEIKMSSNSFFVFLPSNVTDYPDNQPNKFRVRLPKPLHFNGSWVCGLHSITYPYSWSTIGTLDAQWIDIHFTQRSTMDEDRPRVIRVPVPKISHNRVEQLKDFITATLRNHIGAKMLPLPHEEEADRNRTKPLGSPPPRKRDRRDVNNTTPPQSPVLFDEHGKRLGSPPLYDPNAGEEQHMSDDDDDMRTQKGTLIIDPKSPSPIATPPVPAVKPLTTTTPTPPAVKPVTTTTTPAPQSSAKPSAQQQKPTPVPPKPSAPQTSEPKIATTTTPGPPKTAITKPTTLPPPPSPPTVPLQRKPTTTTPQTPTPTATPTPTQPITTVHTPKNTKTTTTTTTPIPQTTTKTTTQVSPTPKIPSPKPPAVKLPPPTSTTHPPQPEPTTTTTAPTKTFTSSPTTGAVIGLPSKEKQIPTVDEPVSAALTLEELDLPENSFIVEIDSLQFVPNSVSIQYRDDVERFKVVFKNDIISHLSFSPQLGYVLGFENPKHVMSNELSKYPVDLRGGISSFAVYSKGLTENMIIGNTLSSLLRVVSISGAIPGDYNEKIYDSPIFARVLPREINEIDIELRTMDKGRLVPFAYGTTMVVLIFKKVINF

SEQ ID NO: 148321 - protein, 81 aa, Heterodera glycines
  Coding regions on vcDNA: vcDNA=SeqID_74744; Strand=+; Position=1 -101,549-693
MYIPESSSRGEDLAFATIACNSMLITAPASTFSWWMAYLMPDNSPIYYSAHLEKTYRGKDNFLKEWIPLRLIDGKKIIRDG

SEQ ID NO: 148322 - protein, 126 aa, Heterodera glycines
  Coding regions on vcDNA: vcDNA=SeqID_74745; Strand=-; Position=1 -181,356-555
MKKNEKKVFYINNFMKKAYKRTELTYFNKLQNASILYFIFLDLFRHFLMKIKLIAVLVLLDIFGHFHKVSCESASNENKITAYEPSEHSITPLKDHINSITGQIDLSQFNATLENLLSFRQIVCQH

SEQ ID NO: 148323 - protein, 313 aa, Heterodera glycines
  Coding regions on vcDNA: vcDNA=SeqID_74746; Strand=-; Position=1 -334,415-515,558-674,1082-1281,1336-1525
MEESIGKDGTPNATGILPKPTFDILCIAINAVECAFCCPTVVLCFLFWRLVYQTSLLHNNLKFILVAQSIYAFLYAFVQIFSVIYGLFSPMALFFFVNAFRYFLLVYGNFIGHLLIAERIVATFCIKKYETVKNWWTLSFCVVIIILLSVLNAYYYSTTSMFVAPNVCIYTQIFATVASFSEIFLVENIRTGRQLSPAFLFHFLGVLLSFFMILVIRTQTITDLYLLLIIGKFALFLQGINNLLILFTTIKCHPILCRNALKFVQKYMKCSTTTAAVDPSILASYVNGITQRQIPVSTNMDNYFQLLQRSWEI

SEQ ID NO: 148324 - protein, 142 aa, Heterodera glycines
  Coding regions on vcDNA: vcDNA=SeqID_74747; Strand=+; Position=1 -67,116-210,257-403,488-604
MKNLRVSHENTVSDEKINVLFRDAMKMCVDSHDDLLFVALKDGRIVAIDRQMKLVERFGHSITNMGWDGKSRLIGFDYLYDDQQLCLLLDDGKVLLYATNTKELKCAIELKRNVLGCSWSPDLQLLIVATDSHLLMVSREFP

SEQ ID NO: 148325 - protein, 439 aa, Heterodera glycines
  Coding regions on vcDNA: vcDNA=SeqID_74748; Strand=+; Position=1 -385,451-599,646-710,805-979,1573-1666,1777-2228
  Homolog annotation: Hit_ID=CAG04536.1; Match level="QueryCoverage =96%, HitCoverage=54%, E-value=7e-18, Identity=25%"; Hit description =unnamed protein product [Tetraodon nigroviridis]
AFIESIEQFAAQVNDVESLCVFLSSLKTVDTTQQAMFAPFYPERQPTNQQKQQPKANRWTTSETPGKVNGICERIRNHLMSLGEGEEEAGRGHFLRLYPVVLCCYVMETPSRVSAALVNMCTQIAKAKENKNGDEHSELIRQWTRHLLNFLKESDLFRQALKTYDVEIALMVAQSTNLDPKEYLPILNDLKQKTPSTYQKFHIDMHLEDWNSALGHIATLSQLQQKDVIDTNDEDKSEVTEGEAVQNTPNYLEECLKLKNVEKILECYEKANAWIKLSAFVTENQSTLHGIVNRAQVLMSTRCAQIIEQIDSWRDTITKHTKRLEVLREEKRAKIEAKQTASGGDDQLDGFSESSVTSSSFSDSSSKESRSFFELSSNALKGGKDWFKLQRMERQKRKKLMIKEGSHYEDGALLVALKDIYQRIDTQQGHHTTHIPFEG

SEQ ID NO: 148326 - protein, 95 aa, Heterodera glycines
  Coding regions on vcDNA: vcDNA=SeqID_74749; Strand=+; Position=1 -172,233-460
SDELLELLPALLSMDLVDRACRLQNEMLTFLEFVAEVHAQLWPSHLEAFHLTGPLALHFDSNSCEPMPRKIHLTDELMPPKLRSKGTEWKLEIVK

SEQ ID NO: 148327 - protein, 220 aa, Heterodera glycines
  Coding regions on vcDNA: vcDNA=SeqID_74750; Strand=+; Position=1 -181,215-404,470-547,601-639,729-822
  Homolog annotation: Hit_ID=NP_491372.1; Match level="QueryCoverage =95%, HitCoverage=94%, E-value=8e-46, Identity=49%"; Hit description =BBP-like protein 2 (1F16) [Caenorhabditis elegans] gb|AAL08031.1| Hypothetical protein C41D11.9 [Caenorha
IMPKAPPPHLLACFLPLFSCLPECVLCRECALSAGLRCDFPPVCPFGDSVVVNCTPSAACANVPAVVRLQAKCANVPAVVRLQAKCRFCWQLEQREIVCEERKNCSTNELTLHRTKCRAKPNAICAGRRHFFKNVRCHWTSGHSCHWTSGHSWRKALFLSVTLGGFGVDRFYLGFYLGHWKSAIGKLFSFSFGGLGVWTLLDIVLIAFGYIQPADESLYI

SEQ ID NO: 148328 - protein, 42 aa, Heterodera glycines
  Coding regions on vcDNA: vcDNA=SeqID_74751; Strand=-; Position=1 -43,426-511
MGKYCNTFLNLFVYDLLKYLTVAPYGAVKCAMLLFAKTINMI

SEQ ID NO: 148329 - protein, 126 aa, Heterodera glycines
  Coding regions on vcDNA: vcDNA=SeqID_74752; Strand=+; Position=1 -135,229-309,1089-1169,1609-1692
MDVKFVIPKNPRGQVFPTYEKKMQNKVTLLNFSMALNRKNAILYWDSHVGISSTAPTSLHNAHIVGGGGGGCEKTELTKCKAQLEQSVKTLAPFEAKCQTMKQEEEKLMADKQNMAKESGGNEAAQ

SEQ ID NO: 148330 - protein, 81 aa, Heterodera glycines
  Coding regions on vcDNA: vcDNA=SeqID_74753; Strand=-; Position=1 -16,68-296
MLEPFAAFSKGHLSVLLPCFDTAFCSLSAKSQGDAVSRATIGTKQQRHRHFRSVAIDGTDSTEMPSAIVAMEMLDNEVKAP

SEQ ID NO: 148331 - protein, 49 aa, Heterodera glycines
  Coding regions on vcDNA: vcDNA=SeqID_74754; Strand=-; Position=1 -12,105-150,265-356
MAVKDPHTIAAVLFVPKSDATTVRKRDVQVKNQAKQSEPKHMPKTQRKF

SEQ ID NO: 148332 - protein, 208 aa, Heterodera glycines
  Coding regions on vcDNA: vcDNA=SeqID_74755; Strand=-; Position=1 -381,477-722
  Homolog annotation: Hit_ID=NP_113997.1; Match level="QueryCoverage =76%, HitCoverage=16%, E-value=3e-22, Identity=28%"; Hit description =cyclic nucleotide-gated channel beta subunit 1 [Rattus norvegicus] emb|CAA04133.1| cyclic nucleotide-gate
MSSSDRRRKLAEKPSKTNQKNSSKDKESRKISEKEDKRSKKEKTTTEKEKVDKRTKKTDKKKEKSKEEGGGEEEKKKRREEKEQQNGRKRSKKEEQKEAKNEEEQHMQEQQNYEQYEDDFEQYESDFDEEADEADGNDEEEKEQKIGINEAEKDGQESRNDEEEADDYPVKSSLLLRRIAEGGKLRTKELGKDVRTEVRREVNFDDER

SEQ ID NO: 148333 - protein, 211 aa, Heterodera glycines
  Coding regions on vcDNA: vcDNA=SeqID_74756; Strand=-; Position=1 -42,324-552,610-851,910-1029
MALRKQKNDVIWSNDLFAKYKQKTGKSDLQLNALPSLSGGLISFDPPSVLLRLLDAFVMKSSRSADQGIKAEGIILSLCDIICAKSDNAEERVVQRVQMGNWLKQQLNDRPQQRLGPSASVFDLIFHHLVCGACEKAIATARQSRHYNLALLLSLFKCPSPKLTRDQVKKQLSVTDKKPTTAIGYTKILELLSDDWSDKRKQCLEGLDWLQ

SEQ ID NO: 148334 - protein, 70 aa, Heterodera glycines
  Coding regions on vcDNA: vcDNA=SeqID_74757; Strand=+; Position=1 -114,203-250,1081-1131
MVRATTARTRASAARARSIKINRRNAKKARAAIGRAGHTRNAIAREKCMMCLGKVSFDQCPLAVSHSLAD

SEQ ID NO: 148335 - protein, 84 aa, Heterodera glycines
  Coding regions on vcDNA: vcDNA=SeqID_74758; Strand=-; Position=1 -94,1008-1170
QYPSFSAFCIPIRQQQQQKQQQQKQKQPVECKYLFQNGAAATNTEQLKRRLLRRQRQPRMWRWISIMAQQQKKDKKLPFIRLII

SEQ ID NO: 148336 - protein, 578 aa, Heterodera glycines
  Coding regions on vcDNA: vcDNA=SeqID_74759; Strand=-; Position=1-1737
  Homolog annotation: Hit_ID=AAG00553.1; Match level="QueryCoverage =86%, HitCoverage=67%, E-value=7e-33, Identity=25%"; Hit description =retinitis pigmentosa GTPase regulator [Bos taurus]
MPPPSKHLKSEEGRQTTTTAFNSSRETDGFGTSENGQKWRGGKEMREEGREKGKEGGMREEEGSANGRKEMRGERERGKEGEMRGRGERGESANGNGTGEREDKNSGRRSGMRKEEGSARGNYPMDTKTVPTNSSAAPSDGAATIAPFPQPPKRPFEEMMIKKERAELLVEKEPKTDMERVKKDGGNGEKKKRMEEEEERSAHNEKDNGGTAAVMGNAQNVPLAGRFAPMRNDKRGTGRQEEHGNRREEDEGGENNAEERGKAEGRQAERKESRRTETERGKDNGKAEETDRSRGSWERESSREWERGAKERGGNGWDGENKQQRERGPSDREEEEGKRRHEKGQSEREEEEGKRRHEKGQSEREEEEGKRRHEKGQSEREEEEGKRRHWGKGGNGRAATEESLLFSPLQGPYPNDGQSGKSGNGGRGERVRERGGRGGEREDGGEERARGRERWEMAEQQRSRNAQQSPSEADRSQHSPGIGRAVSRHQNSRTSPSSSSTEENVSRESVNPRQHARTVQQRPTSVHSRESPPPVALGFQRAIPDPNKFFPDTIREAFPPLPKPFEGLEEKHGKENGG

SEQ ID NO: 148337 - protein, 29 aa, Heterodera glycines
  Coding regions on vcDNA: vcDNA=SeqID_74760; Strand=+; Position=1-88
VFSVHGTEIRQQIYIICNEEDELDAETVA

SEQ ID NO: 148338 - protein, 74 aa, Heterodera glycines
  Coding regions on vcDNA: vcDNA=SeqID_74761; Strand=-; Position=1 -153,280-349
  Homolog annotation: Hit_ID=NP_496194.1; Match level="QueryCoverage =62%, HitCoverage=3%, E-value=6e-11, Identity=63%"; Hit description =HMG-I and HMG-Y DNA-binding domain containing protein (2K469) [Caenorhabditis elegans] emb|CAA88699.1| Hyp
MEFVGEKLIECSICSQSFPVTPPFNICRAIRHIKLKHPEVMPEHRGGQSARDGFQCQEKQQNGNGTEGPSNGEE

SEQ ID NO: 148339 - protein, 208 aa, Heterodera glycines
  Coding regions on vcDNA: vcDNA=SeqID_74762; Strand=-; Position=1 -224,692-758,865-1024,1357-1532
  Homolog annotation: Hit_ID=CAE60794.1; Match level="QueryCoverage =96%, HitCoverage=46%, E-value=1e-11, Identity=27%"; Hit description =Hypothetical protein CBG04485 [Caenorhabditis briggsae]
MLFGIQNDLVYALLLLFSALIAAALRLPNSNAIRLQLDGLIGLSIAYIVGGWMALCSLIIVFAHLALITFVRCPSRLTNFSFFGTFIFLALLRCQHFAIGLAYEIADIRRKKDGTDGGKNGNNDTAERYEHEPNALEAFNYLYSFTGLFTGPYYTYKTYADAIVRPTPIQWTKLAPLIWQKMQTLCWTLPALVLMTWLDPLNVRRNQK

SEQ ID NO: 148340 - protein, 36 aa, Heterodera glycines
  Coding regions on vcDNA: vcDNA=SeqID_74763; Strand=-; Position=1 -87,214-237
MNDDETEKRIFMIFYVNNSGLGSYQVTFQGMILFKN

SEQ ID NO: 148341 - protein, 34 aa, Heterodera glycines
  Coding regions on vcDNA: vcDNA=SeqID_74764; Strand=-; Position=1-105
RVFLSSISLIVYDLSSVFASFTVTSMAKVTLPRF

SEQ ID NO: 148342 - protein, 100 aa, Heterodera glycines
  Coding regions on vcDNA: vcDNA=SeqID_74765; Strand=-; Position=1 -101,281-482
MGLTIWTIRLGHFVTMSLTRKRAGSVSTISLPLRTISMDIKKVSEFAREIILSDRISETVYIGGFPWKIVAEINPKKGSTDNEKWLGIFLLCNAPKEGAN

SEQ ID NO: 148343 - protein, 31 aa, Heterodera glycines
  Coding regions on vcDNA: vcDNA=SeqID_74766; Strand=-; Position=1 -78,354-371
MERKGSIPPEIYNNKKIQKIKFYSQNFLSAC

SEQ ID NO: 148344 - protein, 15 aa, Heterodera glycines
  Coding regions on vcDNA: vcDNA=SeqID_74767; Strand=+; Position=1-47
MSIISSKPMNISFSN

SEQ ID NO: 148345 - protein, 68 aa, Heterodera glycines
  Coding regions on vcDNA: vcDNA=SeqID_74768; Strand=+; Position=1 -119,163-250
  Homolog annotation: Hit_ID=AAF68271.1; Match level="QueryCoverage =100%, HitCoverage=47%, E-value=5e-12, Identity=42%"; Hit description= ornithine decarboxylase antizyme [Pristionchus pacificus] sp|Q9NHZ4|OAZ_PRIPA Ornithine decarboxylase ant
RENFVDLLEYCEEHLKVRRILACFNKSDINPCQGIPRALRCIGFTLLPPERYPAGIDKNTIFAMVYKI

SEQ ID NO: 148346 - protein, 264 aa, Heterodera glycines
  Coding regions on vcDNA: vcDNA=SeqID_74769; Strand=-; Position=1 -90,142-261,308-346,568-684,736-785,835-886,1129-1222,1400-1449
  Homolog annotation: Hit_ID=BAA23764.1; Match level="QueryCoverage =99%, HitCoverage=95%, E-value=2e-72, Identity=55%"; Hit description =cyclophilin G [Tachypleus tridentatus]
AIFILIFASIINITQSNDAEKPKGPKVTEKVYFDIKIGDESVGRIEIGLFVYFDIKIGDESVGRIEIGLFGKTVPKTVENFVELAKKPKGEGYAGSVFHRVIKEGYAGSVFHRVIKDFMIQGGDFTKGDGTGGKSIWGEKFPDENFKLKHYGAGWLSMANSGKDTNGSQFFIWLSMANSGKDTNGSQFFITCKKTTWLDTCKKTTWLDGRHVVFGKVLSGMSVVRRIEATKTLGGDRPEKEVTIAAAGQIPVETPFSVHKEDSR

SEQ ID NO: 148347 - protein, 469 aa, Heterodera glycines
  misc_feature (38)..(38): Xaa can be any naturally occurring amino acid
  misc_feature (93)..(93): Xaa can be any naturally occurring amino acid
  misc_feature (179)..(179): Xaa can be any naturally occurring amino acid
  misc_feature (464)..(464): Xaa can be any naturally occurring amino acid
  Coding regions on vcDNA: vcDNA=SeqID_74770; Strand=+; Position=1-1439
  Homolog annotation: Hit_ID=NP_723377.1; Match level="QueryCoverage =98%, HitCoverage=86%, E-value=5e-44, Identity=34%"; Hit description =CG31901-PA [Drosophila melanogaster] gb|AAN11165.1| CG31901-PA [Drosophila melanogaster]
IRQLSQNATIRQLSQMSTIRQLNDSSTQPNVNDSSTQXFVNSAKCQRFVNSAKMRRFVNSAMSTIRQLNDSSTQPKCDDSSTQPNVNDSSTQXFVNSAKCQRFVNSMIRQLSQMSTIRQLNDSSTQQKCDDSSTSQMSTIRQLNDSSTQPKCDDSSTQSNVNDSSTQSQPNVNDSSTQXSSTQPNVNDSSTNDSSTQPNVNDSSNDSSTQPNVNDSSTQDSSTQPKCDDSSTSQMSTIRQLNDSSTQPKCDDSSTQPNVNDSSTMIRQLSQMSTIRQLNDSSTQPNVNDSSTSQNATIRQLSQMSTIRQLNDSSTQPKCDDSSTSQMSTIRQLNDSSTQPNVNDSSTNDSSTQPNVNDSSTQIRQLSQMSTIRQLNDSSTQPNVNDSSTQDSSTQPKCDDSSTQPNVNDSSTNDSSTQPKCDDSSTQPNVNDSSTQPKCDDSSTQPKCDDSSTQPNVNDSSTQXFVNSA

SEQ ID NO: 148348 - protein, 354 aa, Heterodera glycines
  misc_feature (32)..(32): Xaa can be any naturally occurring amino acid
  Coding regions on vcDNA: vcDNA=SeqID_74771; Strand=+; Position=1-1083
  Homolog annotation: Hit_ID=NP_723377.1; Match level="QueryCoverage =100%, HitCoverage=73%, E-value=2e-37, Identity=34%"; Hit description= CG31901-PA [Drosophila melanogaster] gb|AAN11165.1| CG31901-PA [Drosophila melanogaster]
NSMIRQLSQMSTIRQLNDSSTQPNVNDSSTQXFVNSAKCQRFVNSMIRQLSQMSTIRQLNDSSTQPNVNDSSTMIRQLSQMSTIRQLNDSSTQPNVNDSSTQDSSTQPNVNDSSTQPKCDDSSTQPNVNDSSTSQNATIRQLSQMSTIRQLNDSSTQPNVNDSSTMIRQLSQMSTIRQLNDSSTQPNVNDSSTMIRQLSQMSTIRQLNDSSTQPKCDDSSTSQMSTIRQLNDSSTQPKCDDSSTQPNVNDSSTQDSSTQPNVNDSSLNDSSTQPNVNDSSTQDSSTSQMSTIRQLNDSSTQPNVNDSSTHDSSTQPKCDDSSTQPNVNDSSTQPKCDDSSTQPNVNDSSNDSST

SEQ ID NO: 148349 - protein, 378 aa, Heterodera glycines
  Coding regions on vcDNA: vcDNA=SeqID_74772; Strand=+; Position=1 -966,1140-1322
  Homolog annotation: Hit_ID=NP_723377.1; Match level="QueryCoverage =99%, HitCoverage=73%, E-value=3e-50, Identity=35%"; Hit description =CG31901-PA [Drosophila melanogaster] gb|AAN11165.1| CG31901-PA [Drosophila melanogaster]
STIRQLNDTSTQPNVNDSSTQPNVNDSSTQDSSTSQMSTIRQLNDSSTQPNVNDSSTNDSSTQPKCDDSSTQPNVNDSSTQPKCDDSSTQPNVNDSSTQDSSTQPKCDDSSTQPNVNDSSTQPNVNDSSTQQNATSSTQPNVNDSSTQPKCDDSSTSQMSTIPQLNDSSTQPKCDDSSTQPNVNDSSTQDSSTQPKCDDSSTQPNVNDSSTNDSSTHPKCDDSSTQPNVNDSSLNDSSTQPNVNDSSTQDSSTSQMSTIRQLNDSSTQPNVNDSSTQPKCDDSSTSQMSTIRQLNDSSTQPKCDDSSTQPNVNDSSTHQNATIRQLSQMSTIRQLNDSSTQPKCDDSSTQSNSTIRQLNDSSTQPNVNDSSTQDSSTQ

SEQ ID NO: 148350 - protein, 403 aa, Heterodera glycines
  misc_feature (1)..(1): Xaa can be any naturally occurring amino acid
  misc_feature (182)..(182): Xaa can be any naturally occurring amino acid
  misc_feature (281)..(281): Xaa can be any naturally occurring amino acid
  misc_feature (304)..(304): Xaa can be any naturally occurring amino acid
  Coding regions on vcDNA: vcDNA=SeqID_74773; Strand=+; Position=1 -38,1413-1696,2085-3014
  Homolog annotation: Hit_ID=NP_723377.1; Match level="QueryCoverage =99%, HitCoverage=74%, E-value=4e-52, Identity=36%"; Hit description =CG31901-PA [Drosophila melanogaster] gb|AAN11165.1| CG31901-PA [Drosophila melanogaster]
XNSFFHHLLLLIFRQLDDSSTQQNATIRQLSNVNDSSTQPNVNDSSTAKCDDSSTQPNVNDSSTQPKCDDSSTSQMSTIRQLNDSSTQPKCDDSSTQPNVNDSSTHQMSTIRQLNDSSTQPNVNDSSTQPKCDDSSTSQMSTIRQLNDSSTQPKCDDSSTQPNVNDSSTQSQPNVNDSSTQXSSTQPNVNDSSTNDSSTQPNVNDSSTQIRQLSQMSTIRQLNDSSTQPKCDDSSTSQMSTIRQLNDSSTQPKCDDSSTQPNVNDSSTQSQPNVNDSSTQXSSTQPNVNDSSTQPNVNDSSTQXSSTQPNVNDSSSMIRQLSQMSTIRQLNDSSTSQNATIRQLSQMSTIRQLNDSSTQPKCDDSSTSQMSTIRQLNDSSTQPNVNDSSTMIRHLNQMSTNSS

SEQ ID NO: 148351 - protein, 340 aa, Heterodera glycines
  Coding regions on vcDNA: vcDNA=SeqID_74774; Strand=+; Position=1-1035
  Homolog annotation: Hit_ID=NP_723377.1; Match level="QueryCoverage =96%, HitCoverage=72%, E-value=4e-40, Identity=35%"; Hit description =CG31901-PA [Drosophila melanogaster] gb|AAN11165.1| CG31901-PA [Drosophila melanogaster]
KCQRFQNATIGQLSQMSTISSTNDSSTQPNVNDSNATIRQLSQMSTIRQLNDSSTQPNVNDSSTQDSSTQPNVNDSSLNDSSTQPNVNDSSTQDSSTSQMSTIRQLNDSSTQPKCDDSSTQPNVNDSSTQDSSTQPKCDDSSTQPNVNDSSTNDSSTQPKCDDSSTQPNVNDSSTQPKCDDSSTQPNVNDSSTQDSSTQPKCDDSSTQPNVNDSSTNDSSTQPKCDDSSTQPNVNDSSTQPNVNDSSTQQNATIRQLSQMSTIRQLSQNATIRQLSQMSTIPQLNDSSTSQNATIRQLSQMSTIRQLNDSSTQPKCDDSSTSQMSTIRQLNDSSTQPNVN

SEQ ID NO: 148352 - protein, 526 aa, Heterodera glycines
  Coding regions on vcDNA: vcDNA=SeqID_74775; Strand=-; Position=1 -222,672-804,1393-1570,1626-1685,1869-1949,2058-2088,2150-2172,2223 -2271,2332-2429,2481-2598,2711-2769,2844-3032,3084-3173
  Homolog annotation: Hit_ID=CAE65975.1; Match level="QueryCoverage =92%, HitCoverage=95%, E-value=1e-164, Identity=65%"; Hit description= Hypothetical protein CBG11160 [Caenorhabditis briggsae]
EEEDEFVVEEEEEEEKEREEEGEREEEEEEKERKTDREKSGKSKTKEKQRREGGDKPKGQREQRKERAGPKGGAPGWAVMFLGLVGLALLLGCLFALIRRIFGKKRHGEKNKQQQQQNAFGTFSGTTKCHSFVQFTADMEKLGDHMEQNERAQAEQKEEVNLGRIQYKLDYDFQQGQLAVTVIQLAVTVIQAENLPGMDMSGTSDPYVKLYLLPEKKKKVETKVHRKTLNPVFNVFNETFIFKAAFNELPSKFNELPSKTLVFSIYDTLVFSIYDFDRFSKHDQIGQVILPLGKIIGQVILPLGKIDLGQVIEEWKDIQPPPDDKEAEKNLGDICFSLRYVPTAGKLTVAEKNLGDICFSLRYVPTAGKLTVVVLEAKNLKKMDVGGLSDPYVKLVLMQGGKRLKKKKTSSIKKCTLNPYYNESFSFEVPFEQIQKVSLLITVMDYDKLGSNDAIGRVLLGCAATGAELRHWMDMLASPRRPIAQWHTLQPIEEWMDMLASPRRPIAQWHTLQPIEEEEKPKENGI

SEQ ID NO: 148353 - protein, 749 aa, Heterodera glycines
  Coding regions on vcDNA: vcDNA=SeqID_74776; Strand=+; Position=1 -150,280-607,719-826,928-1040,1094-1453,1601-1774,1927-2279,2324 -2576,2702-2892,2940-3012,3357-3503
  Homolog annotation: Hit_ID=XP_415380.1; Match level="QueryCoverage =36%, HitCoverage=15%, E-value=8e-35, Identity=32%"; Hit description =PREDICTED: similar to RIKEN cDNA 4432404J10 [Gallus gallus]
ESMTVAMELILNSNPASIDTIFPVHVADSNGSELFLQPAFVGTLREINVIQSYLKSAAIEEISDSALRKNLKNILKRLPDEFVENSSDVLPFASEHSPTSNRLKSLADKVQNAASRGHQRLMQTSSVSNFRSMGQRSNNFPASSSVNFLNDSLANATGKKCALLPHPRSKRPHWNGLRGIDHGTFSTSPVKKAKVVSDRTATDVVSDEDEEEGMDEAAAGSSVSSSNDNVVDETEDISALPDNFSDVVPISANVSGRGSPSLSGGRISGRETPFSGNAPEQNSGKWINCDKLNRVLCQKLPPFAPPSLPSPRNRWNHDELFPPFRLVCGSKILKDSRKNLENLVSHRKIHQDIVASDNEGFNELRCTESVTLGLPPQNVQATVGSSVPSAASVAVPSVQQQQNTPKAHSHYTQNEEDFRYYDPNNLTRCRAFLDAKRKLRLVLSWTTNLPYASHCQTQRNKNEENGKDLANGTNKNQTNGAKTEPNSELVALQQFLKLLLAEAVNSRDRKQSAQIREVQRCLSIFEPKGVRVLLRTLREEHRKRTAFHLYLQQSRLTLLQLDFCLDRMSRRIRRVKSLTSECLIEMLVRFSLQKKEQQFLQQFLQDFQQLNVQDEKIDLVESHLCHLYEQLVLESMWRSASIEDIEYARKCLERSLMGQIYVYALFPNGEADYFRDEVLNKSVHKLSELISVGHPELAIPKANPPALLSNLQFIDGFYGKRMQGSEAYWWTQVTSAVEFLKTLLNKLCN

SEQ ID NO: 148354 - protein, 79 aa, Heterodera glycines
  Coding regions on vcDNA: vcDNA=SeqID_74777; Strand=-; Position=1-6,92- 239,481-566
MTCRDKRLGTAHEGTFVHRTVRRLQQRQNGGKWPKQRRTLLHNHQQSALHSENFAGTFLPFLPGQHVGLLRNGPVSAQF

SEQ ID NO: 148355 - protein, 98 aa, Heterodera glycines
  Coding regions on vcDNA: vcDNA=SeqID_74778; Strand=+; Position=1 -89,110-526
FVKNYLIYPPLFLLIMPFAFPSLFKTHPSEVHFVDDCAEAFSAVLAIFRRFASAADGEQFDEQTFPHVPCQGAYLGTEIAHFLENENSIPNFLNKQIN

SEQ ID NO: 148356 - protein, 196 aa, Heterodera glycines
  Coding regions on vcDNA: vcDNA=SeqID_74779; Strand=-; Position=1 -113,434-701,1200-1316,1380-1469
MCQRQGTRPNNFMRETEQQQNMAKFEQMEMSNEEAGQSLLAISSAISREIRTEAGKLYALLGEASPAAQQWSLLECALPSAFTAPPPAQHNAGAEGGVGGGPIGGGDSGNASPSSSVYASPTEQQQNAFFVACCSSAIIRPQINPAFCAFDNEIPLISEIVRGYRRFQSLRISAFRLTGISDEMNGTTNGKENEDK

SEQ ID NO: 148357 - protein, 170 aa, Heterodera glycines
  Coding regions on vcDNA: vcDNA=SeqID_74780; Strand=+; Position=1 -110,168-570
MARCVTSLAFLPIGDLTPGIIALDMALPDELTPVLDWFIMNYTGRLKHDGSRTRPRFDPNIWSVYTRTLQGDDRTNNIQKPQTDACNTHLPVHIHRFGISLTFCERIKSYRMMTSRSVQLDKTHRKRQRNIAKQTAEFSRWFKIIYHSTMETPMFFHLSSALIIYLSLPF

SEQ ID NO: 148358 - protein, 37 aa, Heterodera glycines; identical to SEQ ID NO: 127515
  Coding regions on vcDNA: vcDNA=SeqID_74781; Strand=-; Position=1-117

SEQ ID NO: 148359 - protein, 25 aa, Heterodera glycines
  Coding regions on vcDNA: vcDNA=SeqID_74782; Strand=+; Position=1 -19,194-252
MVIFDKKRAENSWLEDLMVILTKVK

SEQ ID NO: 148360 - protein, 15 aa, Heterodera glycines
  Coding regions on vcDNA: vcDNA=SeqID_74783; Strand=-; Position=1-46
MTFYASLVGYTGRNN

SEQ ID NO: 148361 - protein, 48 aa, Heterodera glycines; identical to SEQ ID NO: 133532
  Coding regions on vcDNA: vcDNA=SeqID_74784; Strand=-; Position=1 -46,200-300

SEQ ID NO: 148362 - protein, 68 aa, Heterodera glycines
  Coding regions on vcDNA: vcDNA=SeqID_74785; Strand=-; Position=1 -102,961-1065
MNRRYGTVHNTDRVCRSASLLARSKGNAKTVNNSILSKQKPDTKSLFIYYDNSGHFEAIVDPKKIEFF

SEQ ID NO: 148363 - protein, 219 aa, Heterodera glycines
  Coding regions on vcDNA: vcDNA=SeqID_74786; Strand=+; Position=1-660
  Homolog annotation: Hit_ID=XP_309989.1; Match level="QueryCoverage =79%, HitCoverage=63%, E-value=2e-25, Identity=35%"; Hit description =ENSANGP00000015194 [Anopheles gambiae] ref|XP_319667.1| ENSANGP00000022407 [Anopheles gambiae]
MDAQQLQQILDAALKKSAEVFAAALNIQNQNPNPGSSTTASLAASINARLEKFNYNPEVGQTYDAWLNRYGKIVQQDGASLPEQSKVQLLVGKLDEEEYKRYIDSIAPKATEQFNWLETVANLKKIFGETRSLFLHRFDCFQIRQSQNQDLSSLLAQINSSCENAELDLTKEELKCMILIISLRDEFSDLKQRYLQRMEEARTNGKSITLQELGEECKK

SEQ ID NO: 148364 - protein, 1361 aa, Heterodera glycines
  Coding regions on vcDNA: vcDNA=SeqID_74787; Strand=+; Position=1 -1578,1638-1689,1761-2049,2103-4269
  Homolog annotation: Hit_ID=NP_491240.1; Match level="QueryCoverage =80%, HitCoverage=84%, E-value=0.0, Identity=33%"; Hit description=zn- finger, CCHC type and RNA-directed DNA polymerase  and Integrase, catalytic domain containing protein fa
MDAQQLQQILDAALKKSAEVFAAALNTQNQNPNPGSSTTASLAASINVRLEKFNYNPEVGQTYDAWLNRYGKIVQQDGASLPEQSKVQLLVGKLDEEEYKRYVDSIAPKATEQFNWLETVANLKKIFGETRSLFLRRFDCFQIRQSQNQDLSSLLAQINSSCENAELDLKKEELKCMILIISLRDEFSDLKQRCLQRMEEARTNGKSITLQELGEECKKYQILKESTLALSTKQYNANAIRAKPQQVKDKADATKQYAKPKAVPKPYESKHKLPNRPCQSCGSTNHWRSDCGHRDAKCPKCGKIGHLGKVCRSNSSIRHIQTVNTTERHAQINTVIIDLNCMEIKADHPKWWKIPIKVNGADYPMHVDSGAQITLFTIQTWIQMGKPPLTSANIRVKNCNDQTFAINGQFMCKVQYMDRPPMKLLAYVSPEISHNLLGMPWIEALEVIPKEIMHPNLHPKINTISTKTNEIKDTETLISALKSTHSDVFSPELGHCTKFKANLILKNGAKPIYCKARPVPHGALDTPLGRSNFGSQKEEWQNTKDIYNAIAGSKYFSRLDLRDAYLQLELSDESKKLCTINTHRGLFQCQRLPFGVKSAPAIFQSLMDKIITPINGAFVYLDDVISPTRLSTNTSKRLPNFLQKETVFLGYIISENGIRPDPSRAEAIRKMPAPHDKSTLRSFLGALTYYGKFIKQMREIRSPLDELLKKDVPWNWEDEQQKSFEKAKEIMLSDLLLTHFDPKLPIIVAADASKGGIGATISHQFPDKRERVIEHASCTFTAAQQNYSQIEKEALGLVFAVQKFHRMLYGRKFTLLTDHKPLLAIFGSTKGIPIYSASRLQRWALILSNYEFDIKYVNTKAFGNADVLSRLIANYPRPSEDILIANICNDTDCCVNFVFEAKIEQLPITAKIIAEETAKDEILQQISAFTKQGWPQKLNDIKLSPFLPKKGQISEIEGCLAYGERIIIPSSLRNNILKSLHFAHPGIVRMKAIARNHVYWPGIDSEIERVVKQCEECHSAAKNPTKANLQPWKAASEVFERIHIDFAGPCADGQTYLVLVDAYSKWPEVWQMERTSSQLTISMLKSFVHRLGIPKEIVSDNGSQFRSAEFAQFCKEFGIKHTFTPPFHPMSNGAAERFVDIFKRSMKKCRQEGKDWLQKVLLAYRTTPNTALNGHSPDELFLGRRMRTRIALVHPEKQKLQPPNLENFQQFQGQYIKKMENQFNIKHGAKSAIFQNEEPIYFWNLKYNKATWLPGKIIEKLGTSPTYRILAPTLGRAIHRHANQIRRRFPIELEDNDQVEENDQTQAQNPPHSPIAHKPQTNRQQTPAAEPVHLRRSGRAKQAPQRLDLDPSKPKYGLIRS

SEQ ID NO: 148365 - protein, 143 aa, Heterodera glycines
  Coding regions on vcDNA: vcDNA=SeqID_74788; Strand=+; Position=1-432
MENHSNIKHGAKSAIFQNEEPIYFLELKYNKATWLPGKIIEKLGTSPTYRILAPTLGRAIHRHANQIRRRFPIELEDNDQVEENDQTQAQNPPHSPIAHKPQTNRQQTPAAEPVHLRRSGRAKQAPQRLDLDPSKPKYRLIRS

SEQ ID NO: 148366 - protein, 880 aa, Heterodera glycines
  Coding regions on vcDNA: vcDNA=SeqID_74789; Strand=-; Position=1 -29,299-2910
  Homolog annotation: Hit_ID=NP_491240.1; Match level="QueryCoverage =91%, HitCoverage=58%, E-value=1e-148, Identity=36%"; Hit description= zn-finger, CCHC type and RNA-directed DNA polymerase  and Integrase, catalytic domain containing protein
MRTAESEMRGLLAQINSSCENAELDLKKEELKCMILIISLRDEFSDLKQRCIQRMEEARTNGKSIALQELGEECKKYQILKESTLALSTKQYNANAIRAKPQQVKDKADATKQYAKPKAVPKPYESKHKLPNRPCQSCGSTNHWRSDCGHRDAKCPKCGKIGHLGKVCRSNSSIRHIQTVNTTERHVQINTVIIDLNCMEINADHPKWWKIPIKVNGSDYPMHVDSGAQISLFTIQTWIQMGKPPLKSAHIRVKNCNDQTFAIKGQFWCEVQYMDRPPMKLLAYVSPEISHNLLGMPWIEALEVIPKEIMHPNLHPKINTISTKVNQIKDTETLISALKSTHSDVFSPELGHCTKFKANLILKNGAKPIYCKARPVPHGALNDVNAEIDRLLKMEAIKPIEFSHWAAPILAVKKRNGKTRVCIDFSTGLNDALELHHHPLPRPEDIYNAIAGSKHFSRLDLRDAYLQLELSEESKKLCTINTHRGLFQCQRLPFGIKSAPAIFQSLMDKIITPINGAFVYLDDVIIANTTLDQHVKTITKVFDKIKQFGLRIQLEKCSFLQKETVFLGHIISENGIRPDPSRAEAIRKMPAPHDKSTLRSFLGALTYYGKFIKQMREIRSPLDELLKKDVPWNWEDEQQKSFEKAKEIMLSDLLLTHFDPKLPIIVAADASKGGIGATISHQFPDKSERVIEHASCTFTAAQQNYSQIEKEALGLVFAVQKFHRMLYGRKFTLLTDHKPLLAIFGSKKGIPIYSASRLQRWALILSNYEFDIKYVNTKAFGNADVLSRLIANYPRPSEDILIANICNDTDCCVNFVFEAKIEQLPITAKIIAEETAKDEILQQISAFTKQGWPQKLDDIKLSPFLPKKAQISEIEGCLAY

SEQ ID NO: 148367 - protein, 121 aa, Heterodera glycines
  Coding regions on vcDNA: vcDNA=SeqID_74790; Strand=+; Position=1-366
EICIDQQAFYYVEHLVFQVEWIASDKWSTSAQINEHDQNFLAQIGQILSISRANKIEDSEPPILSYFELNAPTLGRLNALFGRLCQNWQIFVAKFNDKNTKFNAWTKLCKKNVFKDFYQQK

SEQ ID NO: 148368 - protein, 130 aa, Heterodera glycines
  Coding regions on vcDNA: vcDNA=SeqID_74791; Strand=-; Position=1 -126,676-736,1169-1317,1533-1589
MRAILSGCDAVELKRLLGAEQNGATLLDVAAQNDKTEVAKLLLENGQNPNEFGTFIRDKKKQIKLLVEEGNADIESTDSEGDTPLHWALLKHNFEIARFLSDKGARTDRPNKVLSPPEIFDADHESDLYF

SEQ ID NO: 148369 - protein, 113 aa, Heterodera glycines
  Coding regions on vcDNA: vcDNA=SeqID_74792; Strand=-; Position=1-342
MLLLVDFFVFFLFVLCPSFVIFCIFSTFASDGLKNGTADNSESGSIVDGQQRQSSAIVAAVPSPSSTVSVANLSPMAAAFNEAIVQTEQQPKATGTQNKVMANESEKVWQNKI

SEQ ID NO: 148370 - protein, 69 aa, Heterodera glycines
  Coding regions on vcDNA: vcDNA=SeqID_74793; Strand=+; Position=1 -45,259-423
MRSIWSSFSFTIRPLTIKNCVKSFMLNGVLLAHNAGEVGTVTLNVVPPAARVPHLDTLFRGLIICEYFN

SEQ ID NO: 148371 - protein, 56 aa, Heterodera glycines
  Coding regions on vcDNA: vcDNA=SeqID_74794; Strand=-; Position=1-171
AQKICAAMGGQIVSIHSEEENTLVARLIDEDYMLCNGVNVPLAEAPKMDAMRVENY

SEQ ID NO: 148372 - protein, 103 aa, Heterodera glycines
  Coding regions on vcDNA: vcDNA=SeqID_74795; Strand=-; Position=1 -52,165-221,270-472
MEKLKQQTVAPSANFDDAEICWISWLGYEPPSNLEGADKWDNWHALNNGWPTEETDEQKERVKIWVFGILNLAFVFQKSIKFRVQANGCSNCCKGCAIFCLTK

SEQ ID NO: 148373 - protein, 35 aa, Heterodera glycines
  Coding regions on vcDNA: vcDNA=SeqID_74796; Strand=-; Position=1 -67,174-214
MQIRHWQILRESEGRQSARLFNEYKNCSTASKALS

SEQ ID NO: 148374 - protein, 116 aa, Heterodera glycines
  Coding regions on vcDNA: vcDNA=SeqID_74797; Strand=-; Position=1 -141,229-256,321-452,764-800
  Homolog annotation: Hit_ID=NP_495773.1; Match level="QueryCoverage =99%, HitCoverage=9%, E-value=3e-38, Identity=64%"; Hit description =golgi apparatus protein 1 (131.7 kD) (2I714) [Caenorhabditis elegans] emb|CAA91405.1| Hypothetical protein
VQYFMSRDWSLDPQLYEACHQEAVTRCHATDNWHENTNKLPGQDQKVQVLACLYRSGYDEAYDEANPLGKECALHVRRVLRERAARVNLLPDIEENCRDALSEYCSQNVKPTEEMH

SEQ ID NO: 148375 - protein, 288 aa, Heterodera glycines
  misc_feature (6)..(6): Xaa can be any naturally occurring amino acid
  misc_feature (217)..(217): Xaa can be any naturally occurring amino acid
  misc_feature (219)..(219): Xaa can be any naturally occurring amino acid
  Coding regions on vcDNA: vcDNA=SeqID_74798; Strand=-; Position=1 -46,1091-1258,1314-1348,1411-1497,1546-1582,1786-1841,1909-1986,2995 -3230
  Homolog annotation: Hit_ID=NP_495773.1; Match level="QueryCoverage =98%, HitCoverage=20%, E-value=7e-63, Identity=43%"; Hit description =golgi apparatus protein 1 (131.7 kD) (2I714) [Caenorhabditis elegans] emb|CAA91405.1| Hypothetical protei
FFYCRXPTFFSTHTNVLILPNSGSTLECLIGYMVNVPKDAYKAKIVEGISQECRKEVMRVAELQSDDWHLDRPLFFACRIDREPLFFACRIDRERFRFCGEIPAGEGKVFHCLMEHKQDEKMSPQCSKILSERAGLMGCSKILSERAGLMGRDYKLAHPLLKSCDKELQAYRCVPQPGFEKSLQFAYRCVPQPGFEKSLQFHLSWVVLCLENVRFFXRXNPIPTDHRCQHEMMTHRQMMVQEFRMSPEIVMGCAQEIDKYCSPQGDIESEGKTVHCLMAHAQERDEKV

SEQ ID NO: 148376 - protein, 64 aa, Heterodera glycines
  Coding regions on vcDNA: vcDNA=SeqID_74799; Strand=-; Position=1 -112,163-245
MYRQCKFAFEADEVRSNRCGSSFHITPDEKDLQIIEINCDTVNGSDCGKKAKTNSEAPILWPIC

SEQ ID NO: 148377 - protein, 78 aa, Heterodera glycines
  Coding regions on vcDNA: vcDNA=SeqID_74800; Strand=-; Position=1 -107,157-243,302-342
NITFTPFKRIQKMQPNYYVALYGNGKEPQNSAKNYRLLNPTVDLIDIIGEETNCAEFTTDKSCKRIKNDNSIILDGLV

SEQ ID NO: 148378 - protein, 54 aa, Heterodera glycines
  Coding regions on vcDNA: vcDNA=SeqID_74801; Strand=-; Position=1 -57,213-320
MTPSSADTICAPISIKVASSTPFNYDDYLSNATLDIELRFSMNSGWLHEFEKIK

SEQ ID NO: 148379 - protein, 80 aa, Heterodera glycines
  Coding regions on vcDNA: vcDNA=SeqID_74802; Strand=-; Position=1 -93,240-389
MLEKCKDIGLPEDFGDKKGHHQKIQVPKDVEAIYNENMTIDLSWSQTSAPNGELTKIYLLQMETEFPNRQISQIVILKNK

SEQ ID NO: 148380 - protein, 166 aa, Heterodera glycines
  Coding regions on vcDNA: vcDNA=SeqID_74803; Strand=+; Position=1 -204,261-557
MYSPLFKTSLPKSSVSVESRRNTIYLLNPTGTVKKMCRGEAAQPQKGADATDVKQQQHHHQQQQRKHQGTEAIRAAEKKGADATDVKQQHHHQQQQQMKKGADATDVKQQQHHHQQQQQRQPMNWAKGIRGEDGKWCGLCKVVNHWPHECPLYLNQREDGGVGICL

SEQ ID NO: 148381 - protein, 49 aa, Heterodera glycines
  Coding regions on vcDNA: vcDNA=SeqID_74804; Strand=-; Position=1 -7,342-484
MKMVLGIPKLGKLTTLSPNIALDLVSRFSLNLYSSNFMNGVRAVQAQVE

SEQ ID NO: 148382 - protein, 242 aa, Heterodera glycines
  Coding regions on vcDNA: vcDNA=SeqID_74805; Strand=+; Position=1 -408,452-772
  Homolog annotation: Hit_ID=NP_001004509.1; Match level="QueryCoverage= 95%, HitCoverage=15%, E-value=7e-31, Identity=32%"; Hit description =si:busm1-180o5.3 [Danio rerio] emb|CAD60788.1| novel protein similar to DNA polymerases [Danio rerio]
MHIDNMLLFPNCYTCAKKTKKEFVLAKDVKKCNHRPERRALIGTFTSIELRKSLALGYRVIGFYRAYHFEQFDSQLFKGYVRMFLKIKVEASGWPSEVRNEEEKRAFIEMYKAKYNIWLEYDKMVFNHGLRMIAKLGLNSLWGKFSMRNTLSVTEIVNNLERWTELIKDDTIEFKRPIEINEGVMRAVYQKKQEFIKEHKVSNIILSLWTTSAARVKLYEYMEQVYRKEGCKLLYCDTGGQK

SEQ ID NO: 148383 - protein, 63 aa, Heterodera glycines
  Coding regions on vcDNA: vcDNA=SeqID_74806; Strand=+; Position=1 -75,839-955
MYSFKKYFETALEKEDFFWPKNRAEEKVKNLVGTICTLKVNVSVKEYGGKKGIYYTLIDIYEI

SEQ ID NO: 148384 - protein, 82 aa, Heterodera glycines
  Coding regions on vcDNA: vcDNA=SeqID_74807; Strand=-; Position=1 -181,590-657
MSKQALKNSKNYIAQLTPMYFSTVPEDQLGVNELANRVVTAVNNFLNAELTESGQRAGTYGLNKCFTAVILILLYNILMLNR

SEQ ID NO: 148385 - protein, 184 aa, Heterodera glycines
  Coding regions on vcDNA: vcDNA=SeqID_74808; Strand=-; Position=1 -78,170-366,411-554,601-734
MGTLEDNTGATSAIFGNSTGPNGDETVRFLHDHSEYSSRFVTGTWCSPAGSGGNVTLWTVQQQRDEQSQEGGRRIVQNGRIELPNCDVGDICVVNAQQFVVSTTAGDVQIVESPLASNGANLADGIAKISSVAKYPRVHKFASSTALCLLDEEIFSGSDSGQIIRIRPDSQSSQSTRPFAQDLT

SEQ ID NO: 148386 - protein, 77 aa, Heterodera glycines
  Coding regions on vcDNA: vcDNA=SeqID_74809; Strand=-; Position=1 -66,326-493
MRTQTKWDWQNRHGPTLNQCERVSTENCCEDEIIDVSSGENSNGQLDNLADNCNSRNCQHSHQKEEGNAERCSFKFL

SEQ ID NO: 148387 - protein, 197 aa, Heterodera glycines
  Coding regions on vcDNA: vcDNA=SeqID_74810; Strand=-; Position=1 -218,1226-1357,1606-1686,2635-2733,2774-2838
FGFAIKQQTDESYKSVRHKKDTYAYESNGCVWINEELKEANVEYSYCIGDTVGIGVNSITRQIFFTKNGLRLAIFPNLSTSEEMSVLIARIAELNRANTAEPSIASSADLFGQDGNGSDDDEFSPTDEEDEQKNEERETQTNEAGVEERFSQLQNDHKKLLERISEMEKQQKEQTKATADHLSKIQNDRENFFGKNQ

SEQ ID NO: 148388 - protein, 30 aa, Heterodera glycines
  Coding regions on vcDNA: vcDNA=SeqID_74811; Strand=-; Position=1 -54,258-296
MVTGQTLASPLLLLLLLVDWVRVRADFFYK

SEQ ID NO: 148389 - protein, 123 aa, Heterodera glycines
  Coding regions on vcDNA: vcDNA=SeqID_74812; Strand=+; Position=1 -129,327-566
  Homolog annotation: Hit_ID=CAE58998.1; Match level="QueryCoverage =84%, HitCoverage=17%, E-value=1e-17, Identity=49%"; Hit description =Hypothetical protein CBG02271 [Caenorhabditis briggsae]
MSVLHCSWEKEEARSRHVDFACPIVKSKSNPSLASAASDPLPQQRPTNDNDGSSGNENEAVHHPPPPSSSSQHHHHSQQPLFLNVGSAPPNYGHNGNSNNIGTTPQQLPYHLINNGAGGTQTT

SEQ ID NO: 148390 - protein, 26 aa, Heterodera glycines
  Coding regions on vcDNA: vcDNA=SeqID_74813; Strand=-; Position=1-132
MFKKLRLSRRLIIGTFLRFSFNRFHF

SEQ ID NO: 148391 - protein, 97 aa, Heterodera glycines
  Coding regions on vcDNA: vcDNA=SeqID_74814; Strand=+; Position=1 -75,136-354
MSGDQLVTDDWVAKETQTLGVCTARSSDSEKIPSAADQLLWPGHLPCPCAKKFGGKCPNGDHFWGCEQCGQTLKFAKQKNDDMEQKVRKCRQHISAK

SEQ ID NO: 148392 - protein, 30 aa, Heterodera glycines
  Coding regions on vcDNA: vcDNA=SeqID_74815; Strand=-; Position=1-90
TVYALIIAQSLLIPQSQLSPSLRGVFENNP

SEQ ID NO: 148393 - protein, 178 aa, Heterodera glycines
  Coding regions on vcDNA: vcDNA=SeqID_74816; Strand=+; Position=1 -162,432-524,674-952
  Homolog annotation: Hit_ID=XP_326403.1; Match level="QueryCoverage =98%, HitCoverage=13%, E-value=2e-20, Identity=36%"; Hit description =predicted protein [Neurospora crassa] gb|EAA33019.1| predicted protein [Neurospora crassa]
MDNQNMANTFGFLRGYDALHGVGIVLKENDNRADASFNYCINGLLSNLHKNVAQNIVFLITHSSGSGKTIALLRRLLKPIEEKAGVKIPLNESNVFSFDNAPFEALCLIKAMGVEYDVEEMEELSRKWTKSVQQFKRLLKHLATVKPHLTRETLSVYAARCAIADIMPIIASNGEQIQ

SEQ ID NO: 148394 - protein, 192 aa, Heterodera glycines
  Coding regions on vcDNA: vcDNA=SeqID_74817; Strand=+; Position=1 -3,116-280,529-796,945-1041,1090-1133
MPAKWFSFLKSSAMKAYNDNMERYIELAIQDAELRETSNEGQSNYEEQKKRTDGTRKLLEFYRKERDMFTEGLEKASVNVEEFKFPTENVEQIFDGLFALEITGKQMKANYETTKEAQREHQKQSNAEAMRAQNLVKAKPTKCQSAYNQKAIQCYLDEMTEKGQQQLGQGWKADGSAEASSNVDMTDGGESE

SEQ ID NO: 148395 - protein, 118 aa, Heterodera glycines
  Coding regions on vcDNA: vcDNA=SeqID_74818; Strand=-; Position=1 -177,233-367,620-664
MGFSKLNQFNGMYKTDDFVPGDFGIVPLKPKTWWIWMPESGRDETGEMALVEERIGMEQDYIVKWRSIVSEFLQNNQKMQFNYSRFAADEENNAPQKKLFDLTKNSVSFYFYEKQFIY

SEQ ID NO: 148396 - protein, 46 aa, Heterodera glycines
  Coding regions on vcDNA: vcDNA=SeqID_74819; Strand=+; Position=1 -55,1213-1298
MPSKIGSLEFCCFFMDQFCGHLTNSDQSTDILFELDGAENFFRENI

SEQ ID NO: 148397 - protein, 112 aa, Heterodera glycines
  Coding regions on vcDNA: vcDNA=SeqID_74820; Strand=-; Position=1 -297,347-389
HFSNASSPVNFIIVIRFPPSFADAVVPFALTNELTREQLALKRTADYHDCFLLVRCPIARDESKWTKWEEEEEAIYWHHYYQWNRIDIEIYSDDHVGDGLLDEIPGPSDQQQ

SEQ ID NO: 148398 - protein, 348 aa, Heterodera glycines
  Coding regions on vcDNA: vcDNA=SeqID_74821; Strand=-; Position=1 -203,283-561,612-764,816-857,1226-1309,1361-1646
MISHRFDYYVDEHFKTRKWTLALIRIHSKNGKDGTKEMNIFNHYWKLLPIPQIQMPRKVIGFECIEIKYIDQNVIAFLHRFAQLFATNCPINTTFFRRLRQFVPSLLNECPSLCFVSFYYGGFFTEFPANDNANASNGQAVAKWLFTPLQNNVPKMYKFSFGACHFLLIRCPIARDESKWTKWEKEAINWQIDDQWNIIDIRIYTENYIGDWLLDSTPGPSDQQQNLFGVPMFVGGCAILWIYWDRLKKPKNKIFISADCWLCVFDLLEPSQLGLGIALISHRFDYYIDEHFKTRKWTLNFMEIGRKFEEHGASNEMEIFNSDWKLMPIPLKPLPKKVVGFEAIRCDE

SEQ ID NO: 148399 - protein, 359 aa, Heterodera glycines
  Coding regions on vcDNA: vcDNA=SeqID_74822; Strand=-; Position=1 -47,100-378,434-860,1015-1295,1345-1390
  Homolog annotation: Hit_ID=AAL78214.1; Match level="QueryCoverage =47%, HitCoverage=84%, E-value=5e-12, Identity=28%"; Hit description =putative esophageal gland cell protein Hgg-20 [Heterodera glycines]
MSDRRKEAEEKLAKAIFISADCWLCVFDLLKPSQLGLGISMISHRFDFYVDEHFKTRKWTFGTVQFGGKIGENGTKQMEIVSSDGGIPLPIPQKPLPKKIIGFKRINIFFMDRNVITFLHHFRPLFAACQIILCINTDSDRNCISKLILRNIWPVLGKKIHSIEITATHFHHLRQMAPSVLNECPSLRFVIFYDGYLFTEFPADDSAAASDGQALAKWLFTPLQNNVPKVLKCYLDTDAAILVSRIEAFKATFANASSPANFIVVFWFSFASSAVPFALINELTREQLALKRTADYHDCFVLVRCPIARDESKWTKWEKEAIDWEDSDQWNEIYIEVFGDKVGDGLLDEIPGASDQQQK

SEQ ID NO: 148400 - protein, 60 aa, Heterodera glycines
  Coding regions on vcDNA: vcDNA=SeqID_74823; Strand=+; Position=1-226
QNVNMGTKQLKRDNVYELIGDFAKALLPSSFLYGYCKEANCAPSSILVNYAVELCKLSSS

SEQ ID NO: 148401 - protein, 162 aa, Heterodera glycines
  Coding regions on vcDNA: vcDNA=SeqID_74824; Strand=+; Position=1 -75,187-379,498-718
MDSAANAPVSNSGYEHDPLGLNNVQVGDPLIDDEQQQRHPETNIDEDEDVLRFDGGAFDDNDYGEEEGMTEFNADDNNNMGKENNASNASPVHSDVLQQPLALQQDFGTPPMSGVSNGGFDKADDNASQHRSGGVSAHRRTTGDATDRHFQRVVVGFPSTYL

SEQ ID NO: 148402 - protein, 91 aa, Heterodera glycines
  Coding regions on vcDNA: vcDNA=SeqID_74825; Strand=-; Position=1-280
KFFLTIIFYCYFFYTIAVFFLKISGGESHHNALKMTVRRVAGSATMGRNTTAPVLAGIVISFVKASVGNTGHRRSAKVLLKCQRLLKHIRM

SEQ ID NO: 148403 - protein, 87 aa, Heterodera glycines
  Coding regions on vcDNA: vcDNA=SeqID_74826; Strand=-; Position=1-606
TIIFYCYFFYTIAVFFLKISGGESHHNALKMTVRRVAGSATMARNTSAPVLAGIVISFVKASVGNTGHRRSAKVLLKCQRLLKHIRM

SEQ ID NO: 148404 - protein, 234 aa, Heterodera glycines
  Coding regions on vcDNA: vcDNA=SeqID_74827; Strand=+; Position=1 -160,228-368,475-878
  Homolog annotation: Hit_ID=CAF96846.1; Match level="QueryCoverage =65%, HitCoverage=7%, E-value=2e-09, Identity=29%"; Hit description =unnamed protein product [Tetraodon nigroviridis]
MMAPSSENGSGDGGGGRIHLIGLSDSRGVWEYVMQLRESWNKMVCLLVINRPEEEQDFLNYMDCFAFYNQGTQVGVLDFADHPTIKDGYVFTLSPGEPLPSVLLPLDGVGLPEWTQHNGCIMLMIVRRMDHEDKQWKRQRMGMGVGDESWRRQQQQHPQMMPMDIPLTPIGRGGGGERMAHLLSDPRLDYELTTRMGSRLYRFSRLYKSMPMIFNRIFSEINVDNSGNDENAKV

SEQ ID NO: 148405 - protein, 75 aa, Heterodera glycines
  Coding regions on vcDNA: vcDNA=SeqID_74828; Strand=+; Position=1-228
MEENNHRTAVQMAYKFRLIDYDSQGQITPIKLQRVLKNGTQQLFNLETCRLIVNQFDEQRCGYIGLAKFPALWDV

SEQ ID NO: 148406 - protein, 152 aa, Heterodera glycines
  Coding regions on vcDNA: vcDNA=SeqID_74829; Strand=+; Position=1 -249,299-508
MYCASCAHHANKAIRSIYLRLELRDCEDPEICQTVTVFSTVAEHYLGLKVERFAKMVEEQPEQLEALLKSKIERTVTAKLSIKAKGELKTMDWIVLSIQHENGENEGDDETAPDEQKKTDINNEDGEIIEIENTSVHSTLLGPPLKKRVKKN

SEQ ID NO: 148407 - protein, 349 aa, Heterodera glycines
  Coding regions on vcDNA: vcDNA=SeqID_74830; Strand=+; Position=1 -481,548-735,1185-1446,1959-2077
MKKGQSETAIIRSSSSATARNDNTVAASTLDGNAKRQRRNSWDFKTMAHFEEKRPKGEEDGHRKVKQPQQPAPLFEQKQHYVHRVERFALQRHVTEFVLNGKHDEPEEALLRAFEHIIARAIRNAEDSHQQTDDGRGTSAGDSAHRQRRVTRLGVLLNGRGLTDPIVLPIRPPEQNTAEVLMAELDKLGQSDGDEDVHGGGISKRSLLLSEPIEVVVTCIAPPDQNYAGIYRIVLFEDHSEELPRPIWKGPMGRRLCVSLFLSDGHYYGIKKIHCFFKLGRKYCVDCECVYTRDTKHTISCKSRCPQCAKVRVTCTECCDSERGVRTNCQICISEYGTMERIKDWYAVH

SEQ ID NO: 148408 - protein, 136 aa, Heterodera glycines
  Coding regions on vcDNA: vcDNA=SeqID_74831; Strand=+; Position=1 -60,195-251,314-407,792-991
  Homolog annotation: Hit_ID=NP_694482.1; Match level="QueryCoverage =91%, HitCoverage=77%, E-value=1e-11, Identity=33%"; Hit description =crystallin, alpha A [Danio rerio] gb|AAH83177.1| Crystallin, alpha A [Danio rerio] gb|AAK61363.1| alpha A
MLSPFSYDPFYRRSLLPMATLRDHAAQLNVTDKGELTYKVDVSGFRPEEINVEVIGNEIIVNGEHREQNDSESVHRQFSRRVLIPEGIQKESIKCELDGGRLCICGMKTAGEGGRTIPIEMKKKAAVEHQPQVEKK

SEQ ID NO: 148409 - protein, 21 aa, Heterodera glycines
  Coding regions on vcDNA: vcDNA=SeqID_74832; Strand=+; Position=1-63
MSGRGKGGKGLGKGGAKRHNK

SEQ ID NO: 148410 - protein, 200 aa, Heterodera glycines
  misc_feature (91)..(91): Xaa can be any naturally occurring amino acid
  Coding regions on vcDNA: vcDNA=SeqID_74833; Strand=-; Position=1 -250,355-465,525-585,639-687,878-985
  Homolog annotation: Hit_ID=CAE75263.1; Match level="QueryCoverage =98%, HitCoverage=98%, E-value=6e-58, Identity=54%"; Hit description =Hypothetical protein CBG23226 [Caenorhabditis briggsae]
KALTVSIFTPYLSASYFMVRFLHRYNMNMLPWDLKPVQDFIGLWQMDRSSGNFKELPPPNLIDLAINPIPKFGARTMNITLVYFRLHTLAXGDYGFMPVKNATRRDPRVHVAYLTTSSEGWSMWSMMEQGFFKDGKLIFHLKQFLKRSFLKRSFGAGSNLDIREFERQFELSGFHSMTLKVRAETSFQTEAYTAWYTKIL

SEQ ID NO: 148411 - protein, 110 aa, Heterodera glycines
  Coding regions on vcDNA: vcDNA=SeqID_74834; Strand=+; Position=1 -115,236-337,715-830
MSSSTNDPVSEFLAREQSALADLGDDFVAAVPPPQTNNDGILLTNGGSDFGSIANLDSFDANEPKLPVNGVNDKIEEQKKEELREQAKKELEQFYAQRKNELEERKKMNR

SEQ ID NO: 148412 - protein, 69 aa, Heterodera glycines
  Coding regions on vcDNA: vcDNA=SeqID_74835; Strand=+; Position=1-210
MKKYAYAYTFDVVRLLGICNLGTDIWGPDFWDPTLRESDILGWGSNVFWGSDIWGTRHLGTPTLGILLK

SEQ ID NO: 148413 - protein, 215 aa, Heterodera glycines
  Coding regions on vcDNA: vcDNA=SeqID_74836; Strand=-; Position=1 -81,122-218,558-737,1451-1642,1794-1891
MKFKLFIFSYCFILFYAQSVPNDNFNEGSPSADEQPNQTPLNFEEKNPLIESNETGTANWTKIYSNEQKQELINKFHERRSEIKNCDKKTYNKIEEEIAKDLDVSRHNIYKWKKELGLSSVRNSHNYSNEEKLKLVHQFHKMKTEFKKDEKINTSSKVEHAIAKGLGVTRYSIYKWKNELGVSNEFRCSHNDSKEQKLKFVHSSRFIIILIILGN

SEQ ID NO: 148414 - protein, 177 aa, Heterodera glycines
  Coding regions on vcDNA: vcDNA=SeqID_74837; Strand=-; Position=1 -180,738-807,855-1029,1451-1559
MAIRSFLGPACCSPTGAAVLLLISGLANTVSLASIATGNGARLGIFRPTRSISYDGQQEETEYEVEPGFEKRSMTLGRLSFRPGKRWSFPVSGAYAHDRQNRRYDLLLLSEKQPSYGLAPSEVEYNVPIQAKPNVVRHINFRLLPETGNEQENDLAEIGLRESAMGKRTAALGNKLK

SEQ ID NO: 148415 - protein, 97 aa, Heterodera glycines
  Coding regions on vcDNA: vcDNA=SeqID_74838; Strand=-; Position=1 -84,1609-1818
MAERVEEAADEGEGGEHGEGEGTPEAPFDIKMKNLSLYSVLMMILHILIGMGMLFMMVANGQCIFNEKAGACDSIGCPGGACLQSGKECACFFGMHK

SEQ ID NO: 148416 - protein, 64 aa, Heterodera glycines
  Coding regions on vcDNA: vcDNA=SeqID_74839; Strand=+; Position=1 -81,128-241
MKYNFYFFLYFCVLFYALSVPDETFNEDSQSAGPSKQTPKNSEKKPLIESNETGAANCKEKNKG

SEQ ID NO: 148417 - protein, 52 aa, Heterodera glycines
  Coding regions on vcDNA: vcDNA=SeqID_74840; Strand=-; Position=1 -68,390-480
MGTIGWSKCAQCRERRNGPIPLRRRWARVAMVCQKRGGTPKGGLYAHQKQQR

SEQ ID NO: 148418 - protein, 55 aa, Heterodera glycines
  Coding regions on vcDNA: vcDNA=SeqID_74841; Strand=+; Position=1 -19,804-938,1009-1022
MACGIMGTKIYSNEQKQELINKFHERRSEIKNCDKKTYNKIEEEIAKDLDVNIKI

SEQ ID NO: 148419 - protein, 151 aa, Heterodera glycines
  Coding regions on vcDNA: vcDNA=SeqID_74842; Strand=-; Position=1 -3,104-280,2732-3007
MHVANNDMKQAKKSADVAKGIARHAKTKYTSILEEYNDKSEKGCSGMVDRLNEALVNILNARPTVTANVACGKDPTDWKSANCICGKAIDSALSLYLGMGPRKNNGVWVSFGRTPGHPFCPIGTFNTCKGLSPGGSAGVIESPPGSTTMAT

SEQ ID NO: 148420 - protein, 56 aa, Heterodera glycines
  Coding regions on vcDNA: vcDNA=SeqID_74843; Strand=-; Position=1 -3,218-385
MHYYMYEKKDKINVWFEWVGKSEEMRKEESIVWEREEEMGNVEQEEEEEKEQEEDK

SEQ ID NO: 148421 - protein, 256 aa, Heterodera glycines
  Coding regions on vcDNA: vcDNA=SeqID_74844; Strand=+; Position=1 -104,183-285,941-1138,1616-1744,2272-2442,2782-2846
MISANGGSAAKVLKCLMCGQSESRSTFMAHIAEHLNYRPHQCAECDFRSVTAEQMADHEATTEHVGQLYSTSSTVTGNNRNSNNNSSNQSQQQQQRVSSDELKLEQLLMDTVGVGGGAVLGAVANVSAAGGGAGVANFLGDDIGAADEQQQDKSPSANACSSMLQQFITQHQQPQQQALMTQHFDGVVEQYIHGQQQPPPPTAPLQLANGEAHGEQQPKTVKGHKPCKQVFENVQCLKCRQWVKGRGICLLYHMNT

SEQ ID NO: 148422 - protein, 77 aa, Heterodera glycines
  Coding regions on vcDNA: vcDNA=SeqID_74845; Strand=-; Position=1-234
MTSGQKVVTEANEIVHCAPQRPDLHAVARIRLQTDDRRGFEGRPSAEASTCPAESALRQSVLGILAQQSSKVNKWYP

SEQ ID NO: 148423 - protein, 316 aa, Heterodera glycines
  misc_feature (5)..(5): Xaa can be any naturally occurring amino acid
  misc_feature (11)..(11): Xaa can be any naturally occurring amino acid
  Coding regions on vcDNA: vcDNA=SeqID_74846; Strand=+; Position=1 -171,1078-1220,1261-1337,1459-1521,1689-1887,1939-2089,2133-2202
  Homolog annotation: Hit_ID=NP_001002618.1; Match level="QueryCoverage= 86%, HitCoverage=91%, E-value=8e-66, Identity=50%"; Hit description =zgc:92263 [Danio rerio] gb|AAH75969.1| Zgc:92263 [Danio rerio]
SVGQXRFVGRXRVSVRHLAQTPTHRRSTEQSASNFYAVVLAQTADLFLNGTTLEPLGQQEAIDIDRELFTSCGFSVDQLMELAGLACAQAIGETFEKGTLTDKLRNVLILSGPGNNVLILSGPGNNGGDGLVCARHLKHFGFSPSILCPKPSQNDLMQRLMLQLECLGIPFVESFPDPNSIEKFNFLVDAIFGFSFRPPIREPFNKILKQMESVQNRVPIVSIDIPSGWDVWDVEKGPPDDLSPLALISLTAPKQCAQFFKGEYHFLGGRFVPPALVQKFGLENMPPYEGSSQLVQKFGLENMPPYEGSSQFMRLN

SEQ ID NO: 148424 - protein, 91 aa, Heterodera glycines
  Coding regions on vcDNA: vcDNA=SeqID_74847; Strand=-; Position=1 -92,147-330
MERNQFPEDNPAFDAPDKQSLAEFVIILTIRGNNQQFNSVLPPSNRTAMAFVELFERIQQITVSHQKLIYKAFFKSFNLIFYGLRYKKTLI

SEQ ID NO: 148425 - protein, 152 aa, Heterodera glycines
  Coding regions on vcDNA: vcDNA=SeqID_74848; Strand=-; Position=1 -51,199-606
MYSRSPTPKSERRHQIRLNSRDDNDGINNNMNINACGGTNISGEQQQAAAGQSNRTSVYHQICTINGHEMMTSSSTTNNEPQLVTNNNYPWALAEPGTGGCSMASANQQMMVATEHFGCASAESGISAKLKNKKMLWISLDLAECFLQKKNL

SEQ ID NO: 148426 - protein, 58 aa, Heterodera glycines
  Coding regions on vcDNA: vcDNA=SeqID_74849; Strand=+; Position=1 -13,1007-1170
MTLSTTAHNAWMDILPSFDHAQLGLKLALLSPRFELLVDKYFDDKSKMTVDQKSQRQF

SEQ ID NO: 148427 - protein, 95 aa, Heterodera glycines
  Coding regions on vcDNA: vcDNA=SeqID_74850; Strand=-; Position=1 -85,570-772
MWASNLGLKDIVQRLLKAGARADQADKKGDTAIDIAARKGHVEVVKILRDAALYIHRYIFIYKYIFLIFKRLIFVFESFQTQRIVTGAGERQTLK

SEQ ID NO: 148428 - protein, 229 aa, Heterodera glycines
  Coding regions on vcDNA: vcDNA=SeqID_74851; Strand=+; Position=1 -136,194-330,562-978
  Homolog annotation: Hit_ID=BAC23047.1; Match level="QueryCoverage =39%, HitCoverage=19%, E-value=7e-11, Identity=37%"; Hit description =ankyrin-like protein [Solanum tuberosum]
MLAAESGSLEMCRLLIEEWAAEVNQQAIDGTTPLMGASSEGRLNVVIYLIDHGAEVQHTDAEGYNSLMHAVKNGKTEVARHLLTNGASTDQIAKRRPTAAADDNERELRLTNNRTDLIYIRSFSCMMYCKCIIAMYILICLSRSDICCSDCTYCIIVPNNIKYSINKLFVHQFLVILVFFYRRNYSEFSSRVHSHPHNLQGLPVLHSVAELRPQNEKIKKRAAPSIVLP

SEQ ID NO: 148429 - protein, 29 aa, Heterodera glycines
  Coding regions on vcDNA: vcDNA=SeqID_74852; Strand=-; Position=1-92
TDEKMLRSFSRLTGAGECDSFAYVRQSKR

SEQ ID NO: 148430 - protein, 200 aa, Heterodera glycines
  Coding regions on vcDNA: vcDNA=SeqID_74853; Strand=-; Position=1 -141,206-342,972-1296
MQFLAFLIAFVGLLLIVMPTPTVSRTNATTESFHFQLDHTDQNLKVQKIEMEAHNGTEADQNNDSRTNTTNSSAIAGQNVYDQLQAKTDADLGVVILSVFKWLLFACIGLSSSSICCCVFAVGNPLSRQLPFPFLVMNVVSLTVLTLSMFAMALLMFHGFVGTLSLIICASLIAFCALCSAAAGYVLIELAKKIVIFSDD

SEQ ID NO: 148431 - protein, 183 aa, Heterodera glycines
  Coding regions on vcDNA: vcDNA=SeqID_74854; Strand=-; Position=1 -281,415-685
MGTINQITFFVLLLFSLAVPDESANHTTATIVNFTGTQDGQQIDQQFDVEKNDGTDQKKANDGTDQKKANDGTDQKKANDGTDQKKADAKPAESLIWPIIGGVLFTIIAIFVSVTCFFVAKGKKISITKWVLPAFFIVGVLSIIVMAFLVFSGFVGVLAFIGSSALICCCGCCSCAGLLFQED

SEQ ID NO: 148432 - protein, 59 aa, Heterodera glycines
  Coding regions on vcDNA: vcDNA=SeqID_74855; Strand=-; Position=1 -92,377-464
MPRLFNLDASRKSYGADQKLIIFMVIKYSTKFESRIFLALYFSHKNAICLGNIKIIIKL

SEQ ID NO: 148433 - protein, 51 aa, Heterodera glycines
  Coding regions on vcDNA: vcDNA=SeqID_74856; Strand=+; Position=1-155
LQIYWLKLHMRYISRFFDSVRRFDKDGFRFAISRSTFGNWSRIFSAITCNH

SEQ ID NO: 148434 - protein, 89 aa, Heterodera glycines
  Coding regions on vcDNA: vcDNA=SeqID_74857; Strand=+; Position=1 -66,1037-1079,1352-1512
MTKKEMSEALDTWAQAQGQLFNQPIHYISGGEATNGGTNGKIPSGCAANTAPICALSVQQKVMPKNEMAQKKMAFLAFCRKNMPKQNKF

SEQ ID NO: 148435 - protein, 58 aa, Heterodera glycines
  Coding regions on vcDNA: vcDNA=SeqID_74858; Strand=+; Position=1-174
MSIAFRGRMAEEDSGGKKKKSDEVSLMRKKSCQEQQQLAAADQQQQQQQDEKEGPFRS

SEQ ID NO: 148436 - protein, 114 aa, Heterodera glycines
  Coding regions on vcDNA: vcDNA=SeqID_74859; Strand=+; Position=1 -72,599-763,1086-1193
  Homolog annotation: Hit_ID=AAA93455.3; Match level="QueryCoverage =88%, HitCoverage=6%, E-value=7e-15, Identity=40%"; Hit description =Hypothetical protein C52E12.4 [Caenorhabditis elegans] ref|NP _495437.2| uDENN domain and DENN  domain and d
MEEQRRPICDYFAIIGYDPASGLKQERIAEFGDPSLATCSTSSGPPVRKSPLDATYEPKVIAHFPTERPGRPFAPEIASLALPQGIRLRTERNVPREPFFHSFVVIREGVWPFE

SEQ ID NO: 148437 - protein, 47 aa, Heterodera glycines
  Coding regions on vcDNA: vcDNA=SeqID_74860; Strand=+; Position=1 -115,385-413
MPFFDYPIETLFAHIGVDQFVKLLTSFMLEQQILLISKKFTKKYISP

SEQ ID NO: 148438 - protein, 188 aa, Heterodera glycines
  Coding regions on vcDNA: vcDNA=SeqID_74861; Strand=+; Position=1 -279,821-1108
  Homolog annotation: Hit_ID=NP_997809.1; Match level="QueryCoverage =71%, HitCoverage=9%, E-value=1e-09, Identity=31%"; Hit description =zgc:77218 [Danio rerio] gb|AAH67136.1| Zgc:77218 [Danio rerio]
MKNTKPINNSLIRANATDCSRYYWSFPFKQCNICLLDIDARRLEVPEDLPSFPRQQRMISEINALIARSASAADQQQQKQAGEDKGVHTFYMRGLQFNAAIRQLFLDHFVSLFSTYEAYLLHAGTEHGGIVSVPKSRRKNGRMFRESSANFDKISFLVDQPESVLSFLSAFLETQVIMNDRSINRAPD

SEQ ID NO: 148439 - protein, 579 aa, Heterodera glycines
  Coding regions on vcDNA: vcDNA=SeqID_74862; Strand=+; Position=1 -116,260-488,537-1516,2792-3075,3125-3255
  Homolog annotation: Hit_ID=NP_507780.1; Match level="QueryCoverage =38%, HitCoverage=14%, E-value=9e-20, Identity=30%"; Hit description =predicted CDS, DNA polymerase type B, organellar and viral family member (5T899) [Caenorhabditis elegans]
MAGGGGRAALSAYAIRQDQHGADAADLLTNAGVALNKHTGLVNDILKNCRPLHLCILLERAHYNYIGRSEQLFKVPGYCIDCERRADARYHASGCKVACRLCLRFGAGYPCKSEQLPNGESSARRCNECGFVFPCDDCFNYHLVNQATDPLDGRGLRQRRTLCQWRRFCRDCGRVAYLGLHQCPPLGQADEGAQFRRLFFHSFDNAAADPVEQFLDYLTRHGPKNAHTVCIAHNGGKYDFNLVLEALHRRSMPPKRLCTTGLKIYSMKLGGYNQRRITFKDSVNFFVCQLDALVKSFNLPQHLATVKPFFPYMFIKRQHLLERLEGLPGLDYYQPDTMKAEKRAKLLRWHGENNNNGNRFQLREQLIMYCTNDVAILRESVIRFRHLIEEHAQGLDPFIVASTAAGLALATLRRCFLPANHLVHSPEGGYLRGRRASAESQRGKLAQRVGQTEIRYTRTPAEFHKLLDDPTLDKLDFVHVSDHMDRCVVRKRPVFAKAPLTNCLPVAAFVTSYGRLQLYSYMEHVLAIDGAELLYCDTDSIYYVNKMGGPCVAEGEALGQMKRMSTAPAASSNSLRVGR

SEQ ID NO: 148440 - protein, 120 aa, Heterodera glycines
  Coding regions on vcDNA: vcDNA=SeqID_74863; Strand=-; Position=1 -175,236-423
MDLILATDWINNAYPEMDLEDANNEKKESTKKQEEEAEDPSWISLIDEEMKREPLAPIGTPKKCTCAERRRPVPLVDHLCKRSNAVPMSCMCSSKALRNAGTLWSICAPSNCVPPTCGRP

SEQ ID NO: 148441 - protein, 935 aa, Heterodera glycines
  Coding regions on vcDNA: vcDNA=SeqID_74864; Strand=+; Position=1 -321,380-1019,1209-2095,2389-3237,3289-3399
  Homolog annotation: Hit_ID=AAA93301.1; Match level="QueryCoverage =34%, HitCoverage=86%, E-value=8e-51, Identity=38%"; Hit description =HASI
MRRSQMLARNEFFLETLCSSKKANTLIRGASDEQLLCLVEICLNILKGRVPLRPRHLNKLKAHTQVLRRLARTRCSRSAKKVLLQHGDGLPAIVGLIASIALPLIADHTKRYLLVPEEIYQSLAAPPPADGTPIGLVRTRIKQIKNDDGINEAERAIKYEQELKRLNKLTRDEDERPVGVKLENLSDVVDAMPKPVNVRRPIVVATRRHLKVGRARKENVEQLEDDDDDHDDHDHETPKPSSSNKRQPTQTEILKLIYKNAQSLGVSEEGQVLRAGGRPFITSSVYDIVSHLLNKDKRAQNKEPTAFKEFVERARQIPLLTSQRTYTLHRQAKRRYRRLPTLAPGLHTEWQADLAIFDRLAKQNRGYKYLLVCIDTLSRQVFVEPVKTKTSANMIIAFGRIFKRSKYIPWKVLTDQGKEFTARAVQHFFRAKDVERFCMLTSPQFHAGMAERANRSIKERLYRYFTERNTYKWIDVVQDIVRAINHSPNSSIEMRPADVNFKNAEALRQKLHDAAENVVRRQPKYRVGDRVRIEKYKHVFQKGYLPRFTNELFTVAEVHSERSPVVYRLRDDHNEIISGWFYANDLCKSLEDKQQKMYEIEKILVKKRQNGVDYALVEWQTGNTVRIELPSSNVTNPHELGKNLYRLLGEGSDPLAKKVRSTQNSFMLTINKARRWNREEYIKRKTKEKRGVRDEELLLQALLTDTGTVVDLNIMTHGLLAREKRAETSNIALRIPADDNDSYQQKLDEYFSRLSEKNLSILDELGMTKLTAEIKNLSEEERAILEATKEMGTEAWIQAYREIRLVCQFNYDVNKNRFVLNTDPRYVKKVKVSPQLAYILGFNNTEFMQAENEARFMPDMSGGVSSFHVYTPDLIEPMMIGDVTAPVLRIVTIRGDPDQEVSEILIEIRTNSGSLMPFQYGTCTLTLLFRKMSYF

SEQ ID NO: 148442 - protein, 92 aa, Heterodera glycines
  Coding regions on vcDNA: vcDNA=SeqID_74865; Strand=+; Position=1 -168,223-333
MPPNENSDRPFQQPDNVQPDQQPHQQQPDEDTELRAQIEDAEEDLLLNWWREDPTIIRFLFGHRRAPAIEAALRQRAEREAEILRQYAENQQ

SEQ ID NO: 148443 - protein, 366 aa, Heterodera glycines
  Coding regions on vcDNA: vcDNA=SeqID_74866; Strand=-; Position=1 -1091,1242-1251
  Homolog annotation: Hit_ID=NP_500227.1; Match level="QueryCoverage =87%, HitCoverage=30%, E-value=3e-54, Identity=36%"; Hit description =predicted CDS, reverse transcriptase like family member (4D351) [Caenorhabditis elegans] gb|AAK68554.1| H
MKKQLYKLRNEKESKIISQGQNSVNKFIRNKLSKVNEIPTLIDNAGNMFSSNVQKCKILAEIFQKSFLRKSIVNGPQTQSTQNKIKLSDIELNAGIIWNILRRLPRRNSTSPDNVPYILLKNCAEPITKILADIFRLILDSGQIPEIWRTSLVVPIFKKGEKTDPLNYRPVSLTSTVCRVFERILSSKILEFLNSTRFFDKEQFGFLKNRSTTTQILKMMDDIYNSIQKNQQIDIIYIDFVKAFDSVPIDLLLQKIKKIGIEGKIHNFLTNFLKNRSFKVKIGEELSESFRIFSGVPQGSVLGPLLFLIFINDLPSFIANEASSVGIKMYADDVKLYYAHENDDKTNHLDKAIEALEKWSKINGTY

SEQ ID NO: 148444 - protein, 249 aa, Heterodera glycines
  Coding regions on vcDNA: vcDNA=SeqID_74867; Strand=+; Position=1 -175,661-903,1185-1250,1402-1491,1660-1833
CISLLSLAAAHLGSELDTAADESANSTDDGGPKNGNRMPKRGADSHGQEEDDQHQTLQDAAPLNELDASAVYLPSLAKRKKCHKKAKQRQEQKWPRKTNWNQQQMEDNEQGEEENEDGNESMDEQMKAFRKTTLDHRKQYFDWFLFFEFDRVSDWNHKKLFEEQKKREEQQKAKQRQGHRKDEEEYFDASKMSFKAAHLQQTVAAVRNSLVGGCGTAAGSVNAIDSAGTANSSAAVASAGGSDDLSTRG

SEQ ID NO: 148445 - protein, 19 aa, Heterodera glycines
  Coding regions on vcDNA: vcDNA=SeqID_74868; Strand=-; Position=1-59
GLLGSWVRVPPGELPFMFY

SEQ ID NO: 148446 - protein, 18 aa, Heterodera glycines
  Coding regions on vcDNA: vcDNA=SeqID_74869; Strand=+; Position=1-56
IAGVVGSSPTGRVTFYVL

SEQ ID NO: 148447 - protein, 80 aa, Heterodera glycines
  Coding regions on vcDNA: vcDNA=SeqID_74870; Strand=-; Position=1-509
LLMLTKFYTNLIRSLLHVDLRTQKWLKTLYVLFYIILSVFRRHFVPPLKLSSSILYVSSYVSTYILKEILHLNFQTQIPW

SEQ ID NO: 148448 - protein, 152 aa, Heterodera glycines
  Coding regions on vcDNA: vcDNA=SeqID_74871; Strand=-; Position=1 -208,1408-1570,1715-1801
SSRSAECLCCGTATDAGRIVPDGTGRPVVGPKGGQMGGGPMRGGVQRHLLGEMRQLAGPTGVLLLPIGGVTVNCEKCEEKEKQIDVVGKKDFQIEMKTKEEKERIGRIKLQIKSLTDLGKQKRSNEWVIEEPSSDKIYKFFIGYFTPNADPK

SEQ ID NO: 148449 - protein, 99 aa, Heterodera glycines
  Coding regions on vcDNA: vcDNA=SeqID_74872; Strand=+; Position=1 -3,274-570
MFYFGQYFPTVFTFTRQLAAVKRPLAPRVDAFLRVNVVVRRPALVLRPFGRPSAPPRVVQCHPAQFDPRRSQFRNKGTQRIDSTLRSYEKTKRKTMCQE

SEQ ID NO: 148450 - protein, 334 aa, Heterodera glycines
  misc_feature (35)..(35): Xaa can be any naturally occurring amino acid
  misc_feature (75)..(75): Xaa can be any naturally occurring amino acid
  misc_feature (80)..(80): Xaa can be any naturally occurring amino acid
  misc_feature (112)..(112): Xaa can be any naturally occurring amino acid
  misc_feature (166)..(166): Xaa can be any naturally occurring amino acid
  misc_feature (290)..(290): Xaa can be any naturally occurring amino acid
  Coding regions on vcDNA: vcDNA=SeqID_74873; Strand=-; Position=1 -394,460-637,696-755,1002-1297,1542-1596
  Homolog annotation: Hit_ID=XP_397265.1; Match level="QueryCoverage =87%, HitCoverage=96%, E-value=4e-28, Identity=34%"; Hit description =similar to elicitor-like mating protein M81 (2A987) [Apis mellifera]
SLIATAAHHSFSVHLKIWSYDQPTKEVSKFVFQMXLTPSLIHRGPSLSFSVHLKISGAAISPQKRSLNLYSKCNXHPHSXHRGPSLSFSVHLKIWSCDQPTNEVSKFVFQMXLTPSLIHRGPSLSWSCHRGTSLHRGTSLSFSVHLKIWSCDQPTKEVSKFVFQMXLTPSLIHRGPSLSFSVHLKISGAAISHRGPSLSHRGPSLSFSVHLKISGAAISHRGTSLSFSVHLKISGAAISPQKRSLICIPNVINTLTHSHRGPSLSFSVHLKIWSCDQLTKEVSKFVFQMXLTPSLIHRGPSLSFSVHLKISGAAISHRGPSLSFSVHVKISGAA

SEQ ID NO: 148451 - protein, 58 aa, Heterodera glycines
  Coding regions on vcDNA: vcDNA=SeqID_74874; Strand=-; Position=1-653
FWTRSRKKSILSDQKMFRRFRYFDEFSYINAFVDYRNAPISSDQMYSVISNISFLKMP

SEQ ID NO: 148452 - protein, 140 aa, Heterodera glycines
  Coding regions on vcDNA: vcDNA=SeqID_74875; Strand=-; Position=1 -61,200-366,1066-1233,1442-1468
MPLAMPLLSLAFASALTMLSTVHLCSISRRIAKNGALYQLAHCTCGQAMAGAVALAQLLDQMAMLATVCHVLSDHINLLFHNAFAPLRFSPPPFWPSVAISSSSADSVVLLDLLAAVVLPFCAALVMTCSVRVPGSLGKK

SEQ ID NO: 148453 - protein, 221 aa, Heterodera glycines
  Coding regions on vcDNA: vcDNA=SeqID_74876; Strand=+; Position=1 -173,551-594,647-693,749-811,879-989,1097-1180,2062-2205
  Homolog annotation: Hit_ID=CAE67775.1; Match level="QueryCoverage =47%, HitCoverage=12%, E-value=6e-09, Identity=32%"; Hit description =Hypothetical protein CBG13350 [Caenorhabditis briggsae]
MPPLRPTQRHSAGQLANQLNGTNKKDSDRHNYSTKDENTVDRMETPYFWGSQRLGKLFDTCTDYDVRKLVQFIYEAAELSMGRKFVCNVSVHCSNSRPESQLYHDGKSMAVLCLLLAIGSLMLFGTFYDIYVHRPLERAVLESGQTNNNNKQQLNIARSVGQSKTILFIRLFSVSLCSLMSLRDLFGGQLLENIPQNLMMMAFLIRTQTFVETLGGPICCT

SEQ ID NO: 148454 - protein, 95 aa, Heterodera glycines
  Coding regions on vcDNA: vcDNA=SeqID_74877; Strand=-; Position=1-288
MPCSLFFPIFGFVAQCFFGFVPSLRQLRMGRRLQLVRRLRHWFLRIRRDGTNKSENANGKIGGWTKRWDNNRRRKWGNLRRRKTNKSIEQNDLNN

SEQ ID NO: 148455 - protein, 208 aa, Heterodera glycines
  misc_feature (199)..(199): Xaa can be any naturally occurring amino acid
  Coding regions on vcDNA: vcDNA=SeqID_74878; Strand=-; Position=1 -275,419-568,620-783,940-968
  Homolog annotation: Hit_ID=YP_046862.1; Match level="QueryCoverage =85%, HitCoverage=35%, E-value=3e-39, Identity=44%"; Hit description =putative permease [Acinetobacter sp. ADP1] emb|CAG69040.1| putative permease [Acinetobacter sp. ADP1]
FSPSFIVPMQTLSPPPPCPFQSPLRFAGLSPLGWLSFVLFWSVQVALFRAGLSAVRLLIDLAGPAVYVVMMALAAYLVTTAGMANLRMSLTNEPLSLSETVLTMFSAMALIVSSMGSAIFSFCDFSRFAKSWNSVKLGNFFGLPINLPINYLLFATLTVLTISATKPVFGQMTTDPIEMVAQIDSPVAVTVGALTLTVXSIALTATSF

SEQ ID NO: 148456 - protein, 407 aa, Heterodera glycines
  misc_feature (129)..(129): Xaa can be any naturally occurring amino acid
  misc_feature (257)..(257): Xaa can be any naturally occurring amino acid
  misc_feature (267)..(267): Xaa can be any naturally occurring amino acid
  Coding regions on vcDNA: vcDNA=SeqID_74879; Strand=-; Position=1 -45,583-725,1294-1378,1437-1517,1720-1947,2041-2103,2203-2351,2627 -2711,2840-2937,2996-3118,4697-4803
  Homolog annotation: Hit_ID=NP_498711.1; Match level="QueryCoverage =100%, HitCoverage=65%, E-value=4e-77, Identity=39%"; Hit description= tyrosinase and metridin-like ShK toxin family member (68.4 kD) (3I965) [Caenorhabditis elegans] gb|AAA27
RMDYRMLSDDRRERFHNAWLQMKNGYGSHEYDRLSFFHCNPSLIPSAHGGPTFLLWHREYLKRMEIAIRAIDPSVCLPYWDVTLDQRLPKATDSIMWTDSIMWSKLFMGAPDNGNKFIADGFLAFLSNXFRVLSMLTKSNMDFFFAFTNAVKKFKNNNFCFSQYFQTPTSECTQSYRTYENALELIHNYVHSWIGGQMTRLETTRLETSTEDPIFFVYHCFLDYIWEQWRQKWQNREQRETQYPPDAGDNSNFKHFXTIFKKLFIKXNRTGLSNEYTDNLYTYATRPSCTATNGCGSPYLFCDLTNEPLCCAKIKSGGDCSIFQGNKPCFDSPCFDSVCINGICQQAKKARQRNMVKQQHHKPRQVQPRLVKPPPPKKRVCHDGHECCAHAAKGACTSAPSHMNTWC

SEQ ID NO: 148457 - protein, 119 aa, Heterodera glycines
  Coding regions on vcDNA: vcDNA=SeqID_74880; Strand=+; Position=1-360
MEKHGDIRGSELFQIQEQRSTMSPRMEKEPRRQKPRKLTFSNIHGATKERWGPRGRKGLSWDCSGRRTAGRTRGNRNRSSFGATRCAKWQNRLISAESGKTRPPSQNISAISETRSLFF

SEQ ID NO: 148458 - protein, 113 aa, Heterodera glycines
  Coding regions on vcDNA: vcDNA=SeqID_74881; Strand=+; Position=1 -132,201-309,680-780
  Homolog annotation: Hit_ID=CAE60607.1; Match level="QueryCoverage =74%, HitCoverage=11%, E-value=7e-17, Identity=48%"; Hit description =Hypothetical protein CBG04247 [Caenorhabditis briggsae]
MWAPQGGWVVVMGVNTSSGIVSFIDATGAEANKAKTIEHTSLSQGSWDPTGRYFATCTFAGKSRYETGYRIHSFQGRELRRGIDQEIGEKDLVEETITVALNTEKEKIRDESK

SEQ ID NO: 148459 - protein, 374 aa, Heterodera glycines
  Coding regions on vcDNA: vcDNA=SeqID_74882; Strand=-; Position=1 -187,230-271,334-480,699-782,1144-1438,1482-1675,1960-2046,2202-2290
  Homolog annotation: Hit_ID=NP_741263.2; Match level="QueryCoverage =88%, HitCoverage=29%, E-value=6e-31, Identity=32%"; Hit description =UNCoordinated locomotion UNC-16, EGg Laying defective EGL-39, putative protein, with 3 coiled coil-4 doma
MSVDSELCTSGEYLSTVNVPAELVEEVKSLGSIEFVALQKCEEEDQIPTFSPPNEKLSPKRKLSVNQSIGANGETKTPKSVQDVLSSNKPSLHRTEAIPFEFGEENSSEKMDRENATIVMKKLTDGSLSAIANLPLHVRDALNSYEWCANGAEIGEWSASGYFVVKLGSATSSVCHLCTVGGNVWAACRNCVMVLDPTTLKIKVDEKQRNNYSQSEKPVFQHVFTAHPRKDSQVRQMICCGKGVWLSIRLDSTLTWNLTSPKCLVVFRFALSFLNPFVNSGANQLDSHLRITSLSELNRRIWVGTGSGIIVSIPLKEGFSDLTQSVETKKALMVSGGDGYIDFRLARDLAHLLIWETECPVKELTGLSRDEEGQ

SEQ ID NO: 148460 - protein, 183 aa, Heterodera glycines
  Coding regions on vcDNA: vcDNA=SeqID_74883; Strand=-; Position=1 -150,666-715,1116-1303,1408-1570
  Homolog annotation: Hit_ID=XP_396524.1; Match level="QueryCoverage =55%, HitCoverage=9%, E-value=2e-18, Identity=45%"; Hit description =similar to CG8110-PA [Apis mellifera]
NTMAMSAIDTNVRWNFRPDQCAYVTEYACRLELGKSHQHRKWALVFEIKKDVVDDGDGVSLGADLTGIAFIRKLILISDSFSEKEVFREEVRSLEMVKLKMSERIRELESEMKELKEKMNNSDTVIDEKEDRSQGKRFTRVEMARMVMEKNQYKEKFLELQETVKFTELKRAKKHEEELAQRR

SEQ ID NO: 148461 - protein, 111 aa, Heterodera glycines
  Coding regions on vcDNA: vcDNA=SeqID_74884; Strand=+; Position=1 -125,168-223,307-462
FSLSANSDETISFSVKFGDDWFWMIVDEKIGGKLRTSDLDDGTNTKFKLIPQTSGNFVIKASNGKFVSCRSENHWLVADMESPKSLYEEFVLDMVTKITDTVTARVPLKIQ

SEQ ID NO: 148462 - protein, 65 aa, Heterodera glycines
  Coding regions on vcDNA: vcDNA=SeqID_74885; Strand=-; Position=1 -79,134-157,240-334
MKLFSTFVLCLMLIIGLMGIIAPVNSEEEPGQEQASAKKEEDEKPKPPKGKGAGKFRFLGGRRMK

SEQ ID NO: 148463 - protein, 45 aa, Heterodera glycines
  Coding regions on vcDNA: vcDNA=SeqID_74886; Strand=-; Position=1 -70,165-232
MIIAIIEAITCIIFIVFAFVNTKEALTKKKFAEKMLKKQIFSRTY

SEQ ID NO: 148464 - protein, 450 aa, Heterodera glycines
  Coding regions on vcDNA: vcDNA=SeqID_74887; Strand=+; Position=1 -104,190-713,992-1079,1769-2406
IIAMKKALFNIILYVHLIIEKTSGNDVNDEAHLNETDAEDEKMINQYKMYLKYHERLLKLDAYGLEVENNNMDDDTEAFIKFKIEAANWHLKALTLELLEKASQIAKNNQKISKNEKDGQSQLNEALKKNVEELAKRMSMETIEKLVKMHGEVETKCAKMKDDIIGKIFKLYDRYNFVVRIVVIVDKWTTDKRAWSNIGHEKRITELFETNIKPSLEQMVGSSELIRLEDQFPEALRIDIMSQQTLLEIYRQILSPATNEEAIDDDKYGSKKMLARKMMAMTVQIMRENESQFKKQNPKNGNLKEIFGRKMKAILAKAFDNLFSAKSLCEMVKFISFTREKRAQKQLETELKKWEMNKCETEQEQKQTMYEFRQKELNSRFKQDILVLLEAGGEQKTKMGEILAKDGAKSGLVELIEWKQYKELDDGGYLLGIFPSNSWLFREIHLFSFV

SEQ ID NO: 148465 - protein, 553 aa, Heterodera glycines
  Coding regions on vcDNA: vcDNA=SeqID_74888; Strand=+; Position=1 -385,430-839,1415-1424,2067-2311,2357-2714,2930-3180
  Homolog annotation: Hit_ID=AAO52526.1; Match level="QueryCoverage =35%, HitCoverage=20%, E-value=2e-14, Identity=36%"; Hit description =similar to Xenopus laevis (African clawed frog). DNA ligase I (EC 6.5.1.1) (Polydeoxyribonucleotide syntha
MLSAQNDEQFFEWLNRKCSTDERLFVANAIHTVCSNRLQVREANFMAFRHLLLSSQQFRAYFCKLANSSQNNYVENKIYDAEIWCDDGWTKVCFEVQKIGEVKEKILALIGDEKMLLLEAQFPEVLKIDAIMLQTQPFLYKNILAHKSHTDETKFWSARLGIAHLVQMVNAMLSNFGLSVSFEFDIKYGFTVKSRDIFCEAFKHLTQQKFHGGIGRTLCALVQFKNYAQTFYEVFSAANDRLNLEAIAKWRPKCAENEEQDKAYQRTNVFTDQWLMELYLEFLNKFAIMDTETQMRYFLSLSYSVWVRWMDRQIDPKNANLPIGLRQIYEQIWKNQRIQYEQIAYDKIFDVFEPLKKFVETKRNEKNLRKFGIEITKRNDDKNSPQKQYKEHIEKSEKLLEQWEAIWTNAKQNIRIWKTTECQTTECHTTQCQEGKLKMARPTEWLQTLHFDTLMDFLENKAMQSQLKNKMRKKQKEKKEISEEKQKIYEEHLGNLEKELAEEEEKEQKKKEEKMAKEKEQKEKEKEKVAKDKEKKEEKMAKEKEQKEKEKEK

SEQ ID NO: 148466 - protein, 370 aa, Heterodera glycines
  Coding regions on vcDNA: vcDNA=SeqID_74889; Strand=+; Position=1 -634,1491-1669,1704-1793,1885-2094
  Homolog annotation: Hit_ID=NP_572750.2; Match level="QueryCoverage =57%, HitCoverage=34%, E-value=5e-27, Identity=35%"; Hit description =CG32662-PA [Drosophila melanogaster] gb|AAF48098.2| CG32662-PA [Drosophila melanogaster]
MQFMDKEIVEKIQLAIQLNNEQIGEMRKKQKEKKEISEEKQKIYEEHLGNLEKELAEEEEKEQKKKEEKMAKEKEQKEKKEEKMAKEKEQKEKEKEKVAKEKEQKEKKEEKMAKEKEQKEKEKEEVAKEKEQKEKMKIKQQKRKAKKEEEEKQKKSEKSSEVTKSSGNLGKSAEAIGKERGKNERDANSIEIGDEAEGDELEDVMANIGLKDQISINEHVNYTNSKMSCSNGGTEQIKMTNSHSFMLPQLNQQIFFNDNNDEEHLKEAYENLERILIEEHFVLTMDPTKALNELKAVVSNWSQGEAKLLEIGSLMLGTNTATSDVDIIYIVPQKTTKSEAMDKFFGTFQCDLSPRKCEDNSLYCLLCLVN

SEQ ID NO: 148467 - protein, 70 aa, Heterodera glycines
  Coding regions on vcDNA: vcDNA=SeqID_74890; Strand=+; Position=1-213
MEEKTAEQKQNLPSEKEEGQRDRMISHLNLKFNEQFNEKIVQKYFESLKGCFQRVSLVSKYVDEKELENQ

SEQ ID NO: 148468 - protein, 109 aa, Heterodera glycines
  Coding regions on vcDNA: vcDNA=SeqID_74891; Strand=-; Position=1 -195,1141-1179,1254-1349
MLTANEAVQRDQDEKEVEEEESWAKRFPPYSAETEIEQLDEFSLLHQQIVAGRVVPCCVNLPEITKSNIQERSYSLSPIYLFKIYRNINETIEINYKGVSNGGSYHYWK

SEQ ID NO: 148469 - protein, 62 aa, Heterodera glycines
  Coding regions on vcDNA: vcDNA=SeqID_74892; Strand=-; Position=1 -153,210-245
MLMDAWGILPGGDRLAVPLKWLPTDPTAPLTGSPLPFKRPSGWEEFIGVINLEKSSFQRRNI

SEQ ID NO: 148470 - protein, 85 aa, Heterodera glycines
  Coding regions on vcDNA: vcDNA=SeqID_74893; Strand=-; Position=1 -58,116-315
MYQREGTGRESPTNSTIAMDADTTISKRTASNAAPQSPKAFPAESVASRWTTGRGIVSGQSIPTEQQNSAVAPIANNVAQFIFES

SEQ ID NO: 148471 - protein, 43 aa, Heterodera glycines
  Coding regions on vcDNA: vcDNA=SeqID_74894; Strand=-; Position=1 -34,333-428
MSSNSANEPNNVSVEQFEQLQNDQKKLLERINKVANSQQQEKY

SEQ ID NO: 148472 - protein, 59 aa, Heterodera glycines
  Coding regions on vcDNA: vcDNA=SeqID_74895; Strand=-; Position=1-178
  Homolog annotation: Hit_ID=NP_702733.1; Match level="QueryCoverage =98%, HitCoverage=3%, E-value=1e-09, Identity=50%"; Hit description =hypothetical protein [Plasmodium falciparum 3D7] emb|CAB62854.2| hypothetical protein [Plasmodium falcipar
MDELGMDELGMDELGMDELSMDELGMDELSMDELGMDELSMDELSMDELGMDELSMDEL

SEQ ID NO: 148473 - protein, 68 aa, Heterodera glycines
  Coding regions on vcDNA: vcDNA=SeqID_74896; Strand=+; Position=1 -22,393-573
  Homolog annotation: Hit_ID=CAE71161.1; Match level="QueryCoverage =98%, HitCoverage=17%, E-value=1e-18, Identity=59%"; Hit description =Hypothetical protein CBG18017 [Caenorhabditis briggsae]
IHTQLIHIFPVAERDAATLLTLIADNIEPGTLIVSDGWAAYGGIQNMQQRYDHRWVNHRVFFVDPQDR

SEQ ID NO: 148474 - protein, 203 aa, Heterodera glycines
  Coding regions on vcDNA: vcDNA=SeqID_74897; Strand=-; Position=1 -144,197-284,447-535,692-865,922-1038
  Homolog annotation: Hit_ID=NP_610534.2; Match level="QueryCoverage =86%, HitCoverage=29%, E-value=2e-19, Identity=31%"; Hit description =CG1513-PA [Drosophila melanogaster] gb|AAF58878.3| CG1513-PA [Drosophila melanogaster]
MANANLQFPLPDWGHFDADRTNYDAIYDSDQQSASNSGNGVIQDLFKQVLRSGLTNLVLPISVLERRSMLEMYADFFNSLPCSSFTSTRSSPPGKKVSQKSRTLPSLLTFISEHISNSPRLSAFYAEHPDSAISCTAQIESKPFIAGLTSLGVHNVGTMVVRFGRHNETYTATFPDAVARDCHATPWVELAGKVGVNLFVFLY

SEQ ID NO: 148475 - protein, 167 aa, Heterodera glycines
  Coding regions on vcDNA: vcDNA=SeqID_74898; Strand=+; Position=1 -108,169-190,572-664,729-773,831-935,998-1128
MLLPLPSVLCPFQLLLLIVGAVFIILAQCCGCGGKKGKKADKKAKNGAGQANSGERSKLEKSAVGVGNGSPKEAAVPATTPQPAAGEASANAAAKAEGSQRKKEKPDIFITKKLPENKKREFVSGKNPDYETLKQLDMQIFLKKKLSGTQARPHDFQSQVSSQQSAM

SEQ ID NO: 148476 - protein, 44 aa, Heterodera glycines
  Coding regions on vcDNA: vcDNA=SeqID_74899; Strand=+; Position=1 -118,1109-1125
MRSMTASGIRNVSTNSSGNRSGHVYANAAKWRYTAATTDEITII

SEQ ID NO: 148477 - protein, 63 aa, Heterodera glycines
  Coding regions on vcDNA: vcDNA=SeqID_74900; Strand=+; Position=1-372
NRNYAQKASQTILAHPIPSTIAFIHPIMSAKIIRVPKIACDLSLEKNGVSKIVITLKKLFKQF

SEQ ID NO: 148478 - protein, 60 aa, Heterodera glycines
  Coding regions on vcDNA: vcDNA=SeqID_74901; Strand=+; Position=1-180
MARAHLAALKWLALSWPCTPPTPMGGYRNPDKMESLTTIMSAKIIRVPKIACDLSLEKNG

SEQ ID NO: 148479 - protein, 54 aa, Heterodera glycines
  Coding regions on vcDNA: vcDNA=SeqID_74902; Strand=-; Position=1-162
MALLLFLKVLIPFFVLSLCFVSAASIDGKSFAENRHKIGRLSAMVAMITNTMAM

SEQ ID NO: 148480 - protein, 78 aa, Heterodera glycines
  Coding regions on vcDNA: vcDNA=SeqID_74903; Strand=+; Position=1 -108,239-367
MWPSQCLDALNERKASKKWRILAKKALHGQLKGAQKTLREEIQRINRSESRAGEAQIGRTNAKGNESQAKGRIEVEEP

SEQ ID NO: 148481 - protein, 374 aa, Heterodera glycines
  Coding regions on vcDNA: vcDNA=SeqID_74904; Strand=-; Position=1 -169,314-390,437-546,741-933,995-1206,1269-1321,1376-1518
  Homolog annotation: Hit_ID=NP_491097.2; Match level="QueryCoverage =96%, HitCoverage=32%, E-value=2e-80, Identity=45%"; Hit description =phosphatidylinositolglycan class N (105.2 kD) (1D637) [Caenorhabditis elegans]
FRLLLCFVGFSVHLLLLYAVFDIYFSSPIVRGARPFKIAKNSESFTPADRIVFFSADGLRARTFYQHPHLSPFLHGLIRDGKAAWGNLESHVPTESRPGHVAMMAKAAWGNLESHVPTESRPGHVAMMAGFYEDVSAVTRGWKHNPVPFDSTLNQSSMAFLWGSPDIVHLFSDVANVRSDAYSPELEDFSDEDAAKLDRWVFDRVKLFFDEIRSDANAKSRLLLFFDEIRSDANAKSRLLGLRRAIFFLHLLGLDTNGHGHKPNSEQYLKNIATVDEGIRGIVQMVEGFFGDNRTAFLFTTAFLFTADHGMTDWGSHGDGTDDEVNVPDGTDDEVNVPFLAGAGIEPSGASRKLSLAPVDLAPLQSALLGTPFR

SEQ ID NO: 148482 - protein, 60 aa, Heterodera glycines
  Coding regions on vcDNA: vcDNA=SeqID_74905; Strand=-; Position=1 -100,213-292
  Homolog annotation: Hit_ID=CAA74204.1; Match level="QueryCoverage =100%, HitCoverage=22%, E-value=1e-30, Identity=100%"; Hit description=serine proteinase [Heterodera glycines]
GDSGGPLLVKSYDGQRWEQIGVTSRGNFVCESNGFFSCVYIYCEWLAKITEGEVQCLNNE

SEQ ID NO: 148483 - protein, 147 aa, Heterodera glycines
  misc_feature (146)..(146): Xaa can be any naturally occurring amino acid
  Coding regions on vcDNA: vcDNA=SeqID_74906; Strand=+; Position=1 -126,183-302,1373-1507,2646-2696
  Homolog annotation: Hit_ID=AAH56658.1; Match level="QueryCoverage =95%, HitCoverage=95%, E-value=1e-26, Identity=46%"; Hit description =MGC68584 protein [Xenopus laevis]
MEVIDPRNTLLSNQEVLELLNQAKGRHIPTKGQQMNPAQLNLNTINTIVYEALKYLNETPATAQRRQDIISLINALKKFKLTGAEIIQIVNLRPKQAVEVQLIVEESEERLTEEQVDELVETIINSLPRNPKIEIRKEIHMHRHCXK

SEQ ID NO: 148484 - protein, 81 aa, Heterodera glycines
  Coding regions on vcDNA: vcDNA=SeqID_74907; Strand=-; Position=1-246
EAYCGCHYCHHFGLCLCHLLCSDLHHLFLCDVKYCAGEAIPSSNVFPQPCWRWRVYWTCAVSILAFGGCRRHICLGHGLDF

SEQ ID NO: 148485 - protein, 119 aa, Heterodera glycines
  Coding regions on vcDNA: vcDNA=SeqID_74908; Strand=-; Position=1-357
MSFVNYPLDRMEDQVTIAIVERNLFQNISAPPNSNAPISLIDKVHQGVIRLEDATNRSLRVINRRATQNTDAINQTTADMNANMDTITTRLDQLVDKVDTLEWSDTNDNRTSLQGNCTV

SEQ ID NO: 148486 - protein, 42 aa, Heterodera glycines
  Coding regions on vcDNA: vcDNA=SeqID_74909; Strand=-; Position=1 -73,227-282
MAESNMNACPAFGVCPTCQWHCPCTAFPYELCSLQSLNVDDF

SEQ ID NO: 148487 - protein, 49 aa, Heterodera glycines
  Coding regions on vcDNA: vcDNA=SeqID_74910; Strand=-; Position=1 -49,1680-1780
MVPNLIGSEMTPMARMVLNSAQTLNASGTFGMYITCSVNGYYVVNNAGT

SEQ ID NO: 148488 - protein, 505 aa, Heterodera glycines
  Coding regions on vcDNA: vcDNA=SeqID_74911; Strand=-; Position=1 -299,345-916,961-1152,1343-1473,1524-1847
  Homolog annotation: Hit_ID=NP_001004509.1; Match level="QueryCoverage= 97%, HitCoverage=35%, E-value=4e-50, Identity=28%"; Hit description =si:busm1-180o5.3 [Danio rerio] emb|CAD60788.1| novel protein similar to DNA polymerases [Danio rerio]
MLLPHGKTAGQVRERDAKRMEYIRARVNRVDVYWECKITSMLERSKAMRKSFANYVDDGPLVIREAFTGGRTGPLKLLRKAGPGEKISYYDFTSLYPYINFTTRYPVGHPKVHVLNQQVQWTSAADNPFPLALLKVLVVPPRQIDVAVLPVKVDDRLCFPLCIACAKEYPTGGVDNDYHCQHTDQQRGWVSTCTSIELNAALDEGYRVTRVFRVLEYEQSDDKLFRPYIAEFMAQKIQASGFDSSIRGDAEKEEQFVQECAEQFGINIDPAKMVVNKGKRSLAKLCLNNLWGRFSLRNFGLSQTLITDDPVTLAEYLDNKSIEVTSIDQLDEMHILITYLHKKEWVDEHACSNIDTDSLILVHPEERCPLKTGPHLGQFTDEYPDHDIVEFCSGGAKQYGLCLRRKGAGADAEKEYVLKVRGLTLNYDVINNQGMRYETFKEEVVRYATTGDYEPIIVTYPNFLRPNIREGGRVVSMPLQKCYRPYVGKGIIGSDFNVKNFGHTL

SEQ ID NO: 148489 - protein, 374 aa, Heterodera glycines
  Coding regions on vcDNA: vcDNA=SeqID_74912; Strand=-; Position=1 -624,667-1164
  Homolog annotation: Hit_ID=NP_507780.1; Match level="QueryCoverage =74%, HitCoverage=20%, E-value=1e-11, Identity=24%"; Hit description =predicted CDS, DNA polymerase type B, organellar and viral family member (5T899) [Caenorhabditis elegans]
MVAKSRGWASWKFHRYLHSQHGQQGCLQRDALQLMQQIGARPGLNAYDAEIVVPRVVDHWNNSQQRHRFAVFIFGSTGQYKPLYKYINNYYDTPISLYLNNGHFDGVQKEYGLFGQHYCLECEKPYQRPSTHLNSCKARCMLCSRVGPRFPCSPLDGFFRECAGCNKAFRNNDCHQHHLTSNFCVESKQCKECGVIWNVRDNNRNGRKGHKCYETYCQLCNTYHNPERGCFIQQIEPKENDPYRIVAFDLETMQHQAMDPQQPDKREHQPNFIAARVACPDCIENGKWKRETAGCQICGPHRTVVFCQRRFLGTYVDKQVIAENPLEPFVNWLVFELPNKFDTYAYSHFGGRFDMVLVFRELFRIGFNPEMLRR

SEQ ID NO: 148490 - protein, 16 aa, Heterodera glycines
  Coding regions on vcDNA: vcDNA=SeqID_74913; Strand=-; Position=1 -28,289-311
MRLCNRNQKEKNNAIL

SEQ ID NO: 148491 - protein, 61 aa, Heterodera glycines
  Coding regions on vcDNA: vcDNA=SeqID_74914; Strand=+; Position=1 -125,701-761
MFGWAFSLNFDHLQLGLKLSLISPHFDVLVDKHFNGKSGFMPVFIVFLCLCAQKPGPPISK

SEQ ID NO: 148492 - protein, 125 aa, Heterodera glycines
  Coding regions on vcDNA: vcDNA=SeqID_74915; Strand=-; Position=1-378
MPEGPVSEPQMVRHMPEGPVSEPQMVRHMPEGPVSEQQMVRHMPRRASQRTANGATYAQKGQSANREWCDTCPEGPVSEPQMVRHMPEGPVSEPQMVRHMPRRASQRTTGATHAPKGQSANHKEM

SEQ ID NO: 148493 - protein, 1486 aa, Heterodera glycines
  Coding regions on vcDNA: vcDNA=SeqID_74916; Strand=+; Position=1-4458
  Homolog annotation: Hit_ID=NP_920205.1; Match level="QueryCoverage =60%, HitCoverage=55%, E-value=1e-54, Identity=24%"; Hit description =putative DNA helicase homolog [Oryza sativa (japonica cultivar -group)] gb|AAP52492.1| putative DNA helica
MTNKQKAKRKKNQERYQRQAEQSVSPGSSPVPDGSADENGVTSHPGIKTPNIGALKLSTPASSIGSKRRGRPPKAGAESIVTSQHSVSSVGTQIVSATQNEESSPRNKKGKINDFDRPMSALEAIASTPVSTQRNRGGRPSKKRGGHAGSGRSKANDSISESSLMDHSSEAITNVVVLPTVTDKINFSTVQINFATTRNFACKIWKWAAIGLYERDGETALAPRSGPRFIETCWNDLTQFLNDGFAATYLAYLASISQRKVVVVDPMVWENGLDRVMQYKNMTFGYDPNVQAEVILLPVHFPGHWTLIIHDVQCGTHFADSLPTPYGRLDWQLTEKIGKIISDILPSTVLTGIFNAVNLTVQHDGNSCGYFVCLYAESWLMNNRTFVLPDLSINYEKRRILWHINELYNSDNVPYHPREGVPTPCPIVYRHADEAPSTSKAAEPVEVDDHDDIMIIEPQTSGQAVDAIPTQAQVAGENQADTLGLVSETCVPQEPIAQTDDSIFVRPKTPPRRSSRIGRRQSASISRSPSPAPRRRSSTNAAEQVTAFTRRCYLVHKGWCCAAAAAKHYPEYSDSGKLGDKKCSHCGALHFPHEDSSICCRQGRVVLPKLNPHPKELEELIVEEKQSRKGKEFVRQMSRYNNLLQFASVSAGHKPSPAGGPMAVILNGEFHRRISSMQAGTTQIPGFGQLYILDPVEAMEQRRKNPTFTGEKITNEEEFVQGHQLNEETLEILEQMIQENHPAASAYKQAREQLQELLRQQRTEELRFFRMTLLDERSAPGGMKDPKLHPHQIITPSTGEGMFAIHADPTGAPAPKGIWVENKQGQLNEIAPFSAWTDSLTYPLIKPKGDDGYKIRIPYAKPAQRRRKSDMSADMFATEAMSDDDMCETESIAESDAGSEASIQSVTSRYDNSKKFVSLRDYCKYYLAIRDENLEWQYHHILSCGGGLGQRWVLDQASKIDWQIATFLRRPEMDLRVSTPKNLLQYLVNQYNKQQVRQNPNARQKTVDDIGSVVRLSEKNVNSLQYWKKMYEDCNTIFARCHDAKKARLFITFTNNREWPEFKENIYKNGQMFTDRFDMWMRVWCSKIAVFHQELYEKSFFGTILGSGESMEFQGRGGPHAHIVAQTDLDAVPEVIQEYIWAHIPPLPDKDDDSPIAQMHREVRDYMHMQLHRCSDSWCGPRDPNFGRCKKGFPAPYSKCTILHPDRPALYYRPSPTDGGAKIEVNGLIYDNSQVVPYNPYILLRYRVHYNVLFAYGNKANIKYALKYPFKGPGHCYVECKEESGSKIGIDEPAQYAKMNFRGATEAFAVVHSMQFAKLSHHVVQLSIHLPNQQPVVYRAFQLVSKAEEIQRGELPETPCSAYWKQWQNEWQHVPSLKDMLFEKVPEQFRWAKDRWVPYKRKPTKRPPIGRVVPVAPKDIERFALYVLMRHFPGDPDHLKLVNGQQYSTFQEAALQHGLLEDDQIWHKTLGEAALHRWPDQMRWLF

SEQ ID NO: 148494 - protein, 28 aa, Heterodera glycines
  Coding regions on vcDNA: vcDNA=SeqID_74917; Strand=+; Position=1-85
VFLDSNRQNDFDTHLLLIRLYILFQIKE

SEQ ID NO: 148495 - protein, 474 aa, Heterodera glycines
  Coding regions on vcDNA: vcDNA=SeqID_74918; Strand=-; Position=1 -99,150-274,318-354,725-811,866-1022,1085-1309,1388-1502,1557 -1651,1704-2188
MSLTNHDKSKDQAQMDASIRLIDDEMELIDAVKDFLIESNTKYSVIGAIGAQGEGIQKKQHLIENLRHWQVDHPQYARREQSGGYVPPLNCAPLLEDFCRARRVKGAEALDAIEVESLHLLLLLYSICHSVVLCVDWFIDLSIVRRLMRIELFYPILFPQSEARRVNLVVLHQRAKSIDLEPLLVSQRMRTLNAMFETSSFNVNGGLTMAKLGFGIYEHICADLNVNYILLGELKPRTRMDEFEKHVMHQDDYGTVIAKLRRQIYQLPNSRSIFAKKTEAQWFTELAEAWKRIREELPTMTEDGCTFKRQRGIVTPFSRNASNDVFMLKQRTAPQGSEIGRGRQRRRSRKGGTNWEDNTGSILRREAVNFTETATDETEEVESKANEHRKTTATAETEGQQHQKRRVWRTRNRTALDCKNMTRKQWNIEQKTKEGSSLKHKSVVEWVDREQQLDESGRSGTPDHGDNEEFDQRE

SEQ ID NO: 148496 - protein, 43 aa, Heterodera glycines
  Coding regions on vcDNA: vcDNA=SeqID_74919; Strand=-; Position=1-129
MPNIMGLHGGSMIAMRSKDSVVIACDLRLGEQAMKNIATNATK

SEQ ID NO: 148497 - protein, 677 aa, Heterodera glycines
  Coding regions on vcDNA: vcDNA=SeqID_74920; Strand=-; Position=1 -45,231-476,592-740,797-951,1137-1403,1645-1875,1975-2255,3017 -3241,3629-3830,3881-4113
  Homolog annotation: Hit_ID=XP_395419.1; Match level="QueryCoverage =22%, HitCoverage=30%, E-value=5e-09, Identity=26%"; Hit description =similar to CG10107-PA [Apis mellifera]
MSTLLSQKVFWNKANIFHLSISMDVANSVQEILVSLSFNSLFFQLTQINCSSVEIGVYFFAPTKQIELTHEFVTLPLDKGKETLMLSLSFKHITKVEFLDNSEGEGAGLVLFVNDFMARKIQTYIDREGAGFTDFGLESYTSNSKDKFIVLAIQNKELKFFHRLHEILHRADAYHRNYVIQQMNKIKKKHFDIPITFIGIARSDFKQRQLKLIDNNNQNGVGSHRVSVVSTLSDSPNVHPPVNVECQLRVQVGQVHQQQPKCHLPAYTVMALPILPHNQPSAVVTINASHNKSSPAFLAIPSLRSPSAAVTTVVASQLSPTLSTQLPISSQDTFDMLFQLEPVPNHLYNEQQTPSLNNHSPTVFAVVCLESPSVNKFLPRSLKLPKAPPTNGNSQICRSAPPFLSIQTPPSTSQDLQTQFSPQLQSHRMSKTTTSGSAKVGKREREVHLIDDEENESELIDPAEDKHLAVRDQLGEYLHLEYADKLGQDTKTYFNKQMMDVVVPTMLPQQKNFIDCGLFLLHFAQLFLSNPPKFISRHSSFRRWYPTFKIKHKRDELRSVIMQLASHVKSSDFVQLPTPKRKNKKIGRRSQVDKMQMILDGMALMGRTRRYSDSELDGIMKDEHFSCLYRPRSLDSLIYENREKPLVLQPPTIAEMSRFKQLRRVRQEIFASQVRQG

SEQ ID NO: 148498 - protein, 210 aa, Heterodera glycines
  Coding regions on vcDNA: vcDNA=SeqID_74921; Strand=-; Position=1 -508,1202-1326
MQICVLLILFLITLIDQTETEKKKLEQKSFDGIFGEKWEEREEEKRNELKKREIIGKYYKIKEKIKQKGRKYSTKEWNKINSKIAKKLGTNRHKIYEWIKEIGLYKYHKSKTDEQKRKIVQKFIVMKNEFKQNRKYSQKEWEKNYAEICKKIGVSLSVIKKWKKHFGIRKFYGHNSNNSNYMIILQAFFTVVPHCGSTFTDQYFPIELSK

SEQ ID NO: 148499 - protein, 44 aa, Heterodera glycines
  Coding regions on vcDNA: vcDNA=SeqID_74922; Strand=-; Position=1 -38,222-315
MRENAISKCIARNKTCRKNLTTTTTTTPATITASMRMLNYGSLY

SEQ ID NO: 148500 - protein, 133 aa, Heterodera glycines
  Coding regions on vcDNA: vcDNA=SeqID_74923; Strand=-; Position=1-402
  Homolog annotation: Hit_ID=NP_608540.1; Match level="QueryCoverage =83%, HitCoverage=54%, E-value=9e-12, Identity=35%"; Hit description =CG2839-PA [Drosophila melanogaster] gb|AAF51469.2| CG2839-PA [Drosophila melanogaster]
MAQNPAQNDDQVVFALTEEEMVEWDERERRWQEESRLRREERRREAEERRQERGGWHSDMLRRQHVWEQQKEERERDRERWEQRMEDEGRKCDERSAATRKKEKEEKDKNDVTDHYSFKWEEWREKEKLFFGK

SEQ ID NO: 148501 - protein, 190 aa, Heterodera glycines
  Coding regions on vcDNA: vcDNA=SeqID_74924; Strand=-; Position=1 -164,842-1250
MCQELAEEAKQSIEIAKNYRQEIGQIYRTAYSQPDLGIGDLANKLKETMRENQIRCKKETERAWRDVAALTDEVSDFAKSSRETLNRAIKSREKAPYANGIRELYLKMSDSIWEIFTILDKINLESEKAESTWRDFERCKTFDQATKLEEQSQNSLMEARRLHFESRRVQSQMLNYENRLQTIVWEHMGI

SEQ ID NO: 148502 - protein, 151 aa, Heterodera glycines
  Coding regions on vcDNA: vcDNA=SeqID_74925; Strand=+; Position=1 -243,306-518
MSKILRSLAILLAFLSLTDAIGFPMQQCCCPMQQQSCCGGGGGGCCGRKKREAAALEAVQPHFKSDETPCPQTEWRQVIDESIRTDDAIGSVNAIQTALYRRYANQKFLITCSAADEDKTGTNKVHFSSSGDGYCNLVKERIWCQAVALSV

SEQ ID NO: 148503 - protein, 153 aa, Heterodera glycines
  Coding regions on vcDNA: vcDNA=SeqID_74926; Strand=+; Position=1 -240,301-522
MSSSLIMNCLIALTILAVFVSTIDAIGMPMQCCGQQQQSCCGGGGGGCGRRKRDTEAVQPHFKSDETPCPQTEWKQIIEESIRVDDAIGSVSAIQTALFRRHADQKFLVTCSAADEAKTGTAGTNKVHFSSSGDGYCNLVKERIWCQAVALSA

SEQ ID NO: 148504 - protein, 128 aa, Heterodera glycines
  Coding regions on vcDNA: vcDNA=SeqID_74927; Strand=-; Position=1 -216,530-700
MSKFVPLFLFLFSALLLIFLCPSTSAQGRPPPSKSGRPTQHGRVTTDGEEKDGTAEGGAADVESGEKEEPGLSQKLLNVLLNHLSSHLPKISTESVVNWVQETFGLDRQTSRNYVRKAQEIKRHRGED

SEQ ID NO: 148505 - protein, 195 aa, Heterodera glycines
  Coding regions on vcDNA: vcDNA=SeqID_74928; Strand=+; Position=1 -51,461-629,683-1048
MPIMGSLPFFMKKSGTENNLFSLLSKWNKFVEQPTAIDEEEKAHFDETNWQLHFDALIDLILKSKSFREKLTEGFDNDENTKQRFLEFVLPNYQKAVLKLLNSGDFAEFENEIALKMEQENGEIIEKMDKEKAKADQKMKELIGEEKRTKKKNKRAMKRKQRQRSAADQKEGESEQKEEKGKERNREESERISEE

SEQ ID NO: 148506 - protein, 593 aa, Heterodera glycines
  Coding regions on vcDNA: vcDNA=SeqID_74929; Strand=+; Position=1 -918,1148-1768,1820-1962,2034-2135
  Homolog annotation: Hit_ID=NP_608540.1; Match level="QueryCoverage =52%, HitCoverage=67%, E-value=4e-34, Identity=28%"; Hit description =CG2839-PA [Drosophila melanogaster] gb|AAF51469.2| CG2839-PA [Drosophila melanogaster]
KRASERGDRKERNREESEQKEEKGKERNREESEQKEEKGKERNREESEQKEEKGKERTEEESQWNTKESEQKEEKGKERNREESEQKEEKGKERTEEESQWNTKESEQKEEKGKERKGEESGQDFAREENDVEIVNDQNGGERKQAKKNCENNSMELREKQERKIRKEKKTQKRESAQKELKRKKDNDGKSERISEEKIEEKGRKNNNERKESREKNEGESTQNERKRNKEKRKQKLKALEENKEININSWNKTATDSVTTEESQKQGQENGEETMEKGGKASAEKEREKCHRMLGAELAKVNLGSFILNSFLHSNYQEFLANPNESKRCFLDIGVYVNEIWHRMEIIGILSNFTGVKWMESAGIVVNWEKTMKLRHKWREMEREFANISTKSDEKAVDLDELESNLHKMLKSVILTTEGILIDDGQMEEKSEQNERKKVKMQLHLNKFAKTIIWQRRFENDFAEKNWENLDETEQNNILKMLTFNRNDKKLAHRFNEHLENWRKLTEQRQIDRKLFDQFYKHTTHSFGLGSVHLGVNFAENTQQIYFGSANNDRMHLSIINELLTENGYTDCPSVELALDKVKEIVSKWVGN

SEQ ID NO: 148507 - protein, 169 aa, Heterodera glycines
  Coding regions on vcDNA: vcDNA=SeqID_74930; Strand=+; Position=1 -58,330-425,471-609,662-878
  Homolog annotation: Hit_ID=NP_496067.1; Match level="QueryCoverage =92%, HitCoverage=28%, E-value=9e-20, Identity=34%"; Hit description =poly polymerase   family member (2J898) [Caenorhabditis elegans] emb|CAA87419.1| Hypothetical protein T15
MAQLANQTIPQEAMLQALSGYLANDAINRMIEHRNFAKFKNLLWIIKFWAKSNFIYGNKFGFFNGISLAILCTKIFLFYPNASVIFLFEKFLLIILTWNWPMPIKIDENKKGEFELFNWRPSRIEFENGEMQMPIITPIGLGQNTSKNMNNSTKKIIEKQLRQSLILIK

SEQ ID NO: 148508 - protein, 106 aa, Heterodera glycines
  Coding regions on vcDNA: vcDNA=SeqID_74931; Strand=+; Position=1 -127,874-1067
MHKTDQALISLDRAYFPGHYCDTKKSDNGNGSISKGGGRSSVGQHEKFGPWHMPCRYAYIVFRSRSDQLEWVEFRLEPELKVDSADDQRNDCASEEHNFAESLLKH

SEQ ID NO: 148509 - protein, 63 aa, Heterodera glycines
  Coding regions on vcDNA: vcDNA=SeqID_74932; Strand=-; Position=1 -54,101-238
MVGKRWKGIKICLAQWPYQWPSSGRKKVRKARQSQCAKSWPGSDEAKCFGEGLAQETQIILSA

SEQ ID NO: 148510 - protein, 26 aa, Heterodera glycines
  Coding regions on vcDNA: vcDNA=SeqID_74933; Strand=+; Position=1-79
DYFSKHLVDWGIIGDCGINRDWAIIR

SEQ ID NO: 148511 - protein, 138 aa, Heterodera glycines
  Coding regions on vcDNA: vcDNA=SeqID_74934; Strand=-; Position=1-417
MATRLLGICNLGTRLLGIPTFGDPTFGNPDIWGPDIWGSRHLGTERHLSKRHLGKPPTFGDPTFRDPTFGEPDIWGTRHLGIPTFGDPDIWGSRHLGTRHLGTRLLGTRHLGIPTFGDRTTFEHKALRETTDICRPDI

SEQ ID NO: 148512 - protein, 171 aa, Heterodera glycines
  Coding regions on vcDNA: vcDNA=SeqID_74935; Strand=+; Position=1-516
MSSIDNLRIYAYGEGGTGKMGSFKMGQICYPEKNGTYPFNTSREMPRRRQFAWRGERRGGGETYGGRREQQRKGSGRAVEEGNANRKDETAEKRRDSRNEASQKERAEEAAEDGQAEEGTGGGGDEAATARKRTTAPRTNCDTKTTKSGPNEDGAETGTDQQQQQQSRDYW

SEQ ID NO: 148513 - protein, 177 aa, Heterodera glycines
  Coding regions on vcDNA: vcDNA=SeqID_74936; Strand=+; Position=1 -112,711-908,1423-1586,1875-1931
MAGAGKSDTGKSDTGKSDTGKSDTSRKSDTGGKSDTSTQQKGRLTLKIEKFSDFSRGGESGTERYSDAVNIRGFSFKILANTYTMSADKSKKCLGFFIECNKNGSDFDCAVDRWLDDWHAEFFAFGTCHFRGDDGRECEQNNGGAWHLRWGEERGRMQLAGVGLFILFASNIWFIYK

SEQ ID NO: 148514 - protein, 90 aa, Heterodera glycines
  Coding regions on vcDNA: vcDNA=SeqID_74937; Strand=+; Position=1 -96,135-252,331-389
MPKQNEIVLKYSFLDLTWFLDIEAVFYAISKTKKCLVVKTIFHISLHNFVSSARIETGIRPLERAARALQEGPQPQPLASLPVLSLGFVK

SEQ ID NO: 148515 - protein, 113 aa, Heterodera glycines
  Coding regions on vcDNA: vcDNA=SeqID_74938; Strand=+; Position=1 -96,135-252,468-595
MPKQNEIVLKYSFLDLTWFLDIEAVFYAISKTKKCLVVKTIFHISLHNFVSSARIETGIRPLERAARALQEVKKLFEFLQFCFHNFRKVFGIIMPKQNEIVIKYSFSGLDLDF

SEQ ID NO: 148516 - protein, 114 aa, Heterodera glycines
  Coding regions on vcDNA: vcDNA=SeqID_74939; Strand=-; Position=1 -143,313-514
MANCGYQRNKIRWKLFEWANSEKVAEKLEHYHQIPQLERTTRGKDLKGKNAFCTVWVAGLVMKDENGDVQNFPPIYSPNSNGPFNSSYLMHTLFFTDAQQMNENEKFNGFDLTF

SEQ ID NO: 148517 - protein, 247 aa, Heterodera glycines
  Coding regions on vcDNA: vcDNA=SeqID_74940; Strand=-; Position=1 -477,1385-1508,1601-1740
  Homolog annotation: Hit_ID=NP_702308.1; Match level="QueryCoverage =93%, HitCoverage=4%, E-value=4e-14, Identity=30%"; Hit description =hypothetical protein PF14_0419 [Plasmodium falciparum 3D7] gb|AAN37032.1| hypothetical protein [Plasmodium
FTDYYSPTEETFGNLSSSECEEEIFKDTKETNEEEEEEEKEKEKEEIKEEIKEKEIEIEKEKEKAEQIWKSNYNYCDNWTEKRKWPKKKKGKAKKEKEEGNKREKAWKSEQQKGENLKAKSKGKKKNGKETLDQKWEQMEEKSELKCEEKPKKAEKKRMIYQFISKHSVNSFKRGQILELMDKIEQTIGEWVNRMSGKRTDAHLLVNGSHLMGTELDGSDLDLICVLSDELNFNGQIKGNLFSLLGM

SEQ ID NO: 148518 - protein, 65 aa, Heterodera glycines
  Coding regions on vcDNA: vcDNA=SeqID_74941; Strand=+; Position=1-195
MAFLLPRLALASSFLVLFAPLSDSANVLFSSTSLYPVHRFIQRELASELLRRNHSVTWFEYGLSP

SEQ ID NO: 148519 - protein, 107 aa, Heterodera glycines
  Coding regions on vcDNA: vcDNA=SeqID_74942; Strand=+; Position=1 -28,320-615
  Homolog annotation: Hit_ID=NP_496059.2; Match level="QueryCoverage =75%, HitCoverage=15%, E-value=2e-19, Identity=57%"; Hit description =UDP-glucuronosyltransferase (61.1 kD) (2J876) [Caenorhabditis elegans] emb|CAA85328.2| Hypothetical prote
MVRRPSGSDPHPKCRAHLSHGGVNSVIESVWHGVPVIGWPLSANGRDNLLRVTARQAGLMLDKKRPSKQEFISAFHRIYIKHYKEEMLIFQVGFPTNIECHLNNCAK

SEQ ID NO: 148520 - protein, 70 aa, Heterodera glycines
  Coding regions on vcDNA: vcDNA=SeqID_74943; Strand=+; Position=1 -141,201-272
MTSTRWAEIEGEEEKRAFVKREVRRLEGWAMRTARKELDAEWPDVLRLCDLLMERKTAGPTDLRTFVHFC

SEQ ID NO: 148521 - protein, 201 aa, Heterodera glycines
  Coding regions on vcDNA: vcDNA=SeqID_74944; Strand=-; Position=1 -154,1577-1800,2318-2545
MPKTVPNIIQVIPKRNIVITFKIQGYAWFCCCMLSLALREVGSNGCTVAAVIGFAFPFFDHAQLGLKLAFLSPCFEVLVDKHFDSKSELTLWRPIEIRRKNSVPDRPLTSKIRFKCLQIRSFNKIRKFLNATTSVRYKIQFIIDPLSTQIVTFELANERTKEKLTLIKASENHQEDQWIMKRCQNGETATAVQWEFVNLTI

SEQ ID NO: 148522 - protein, 168 aa, Heterodera glycines
  Coding regions on vcDNA: vcDNA=SeqID_74945; Strand=-; Position=1 -489,1461-1478
MLVATFFLFHLIYYHIMNIDGILGIGHDDDDDDDDDLFGELWKNIPRKNSNKQNNHGLKEEEAKRKIKIEQKPQDEEQKNVEEKKEVSKNHSMQIKIKKKATFLDDKKEEKSVGTKFSEENCRKVPKFDFEENLAKSLTEASPRTADMCDESEKPSSIDHNDKHKNVK

SEQ ID NO: 148523 - protein, 85 aa, Heterodera glycines
  Coding regions on vcDNA: vcDNA=SeqID_74946; Strand=-; Position=1-256
VFGVAEYEYTLYITPCLTLGNNSQKVGRRRRRWRTGKREGSQGGKEQDGEKTPFLEMPKTVNMKRRKERTKETEEKPNKRAPKSG

SEQ ID NO: 148524 - protein, 52 aa, Heterodera glycines
  Coding regions on vcDNA: vcDNA=SeqID_74947; Strand=-; Position=1 -18,414-554
MFLVFNLGFGWTNGAVLDLLVKYGDKMTLTQMPDVNCSKMTKDPEPEVFPPE

SEQ ID NO: 148525 - protein, 75 aa, Heterodera glycines
  Coding regions on vcDNA: vcDNA=SeqID_74948; Strand=+; Position=1-332
KPPCGRKTKKCKTYKFITWSIFNQINNSSYHSIALGVFYQNIILLNFLLKYIKRYGKIPQNLKSEFFVQNFFEPQ

SEQ ID NO: 148526 - protein, 103 aa, Heterodera glycines
  Coding regions on vcDNA: vcDNA=SeqID_74949; Strand=-; Position=1 -77,138-264,877-984
  Homolog annotation: Hit_ID=NP_726026.1; Match level="QueryCoverage =59%, HitCoverage=10%, E-value=1e-10, Identity=49%"; Hit description =CG9364-PF, isoform F [Drosophila melanogaster] ref|NP_726025.1| CG9364-PC, isoform C [Drosophila melanoga
MTEAQVSELKKFVRKNFGKAEGVLKQHDPEDWMENPPAFEKIKDKDLKEWAKDLNNLWKQLGRKMPDEELEFWETKRSVTVVVKKKPIKLCQYRADSNVSIKQ

SEQ ID NO: 148527 - protein, 604 aa, Heterodera glycines
  misc_feature (593)..(593): Xaa can be any naturally occurring amino acid
  Coding regions on vcDNA: vcDNA=SeqID_74950; Strand=-; Position=1 -128,226-312,365-482,700-884,1002-1126,1194-1274,1395-1512,1574 -1688,1736-1807,1868-1986,2097-2168,2280-2507,2609-2787
  Homolog annotation: Hit_ID=AAO38645.1; Match level="QueryCoverage =99%, HitCoverage=73%, E-value=1e-117, Identity=40%"; Hit description= Synapse defective protein 1, isoform c [Caenorhabditis elegans]
RADIVPSASFARPSNAPAASLPFYANPPFLRFRRAVPFPTSKGTGRTVADIFSAKEYRNWASEVGPKHTYDHFAGGRRRTRWTGDHFAGGRRRTRWTGTAGRMGAPRSNSLPPKAILMDNVNGSIIFPLNPNSALSTFPDILDRLHVSPLTNRRVPLRTAGPGFDVDGLSVANSLSGILSVTIVEGRNLKVPDRVHSKQLYCVLEVDEQHRARTGISTPEQHFRWAEQFDIDILNATNASWAEQFDIDILNATNASFFIYAWHPKLRHRFCHKGDIRLMDAFLVEGFGTDRMFTLQLESRGQLLLKVAFSDLAHSFVAFSDLAHSFCRIRRPSADCSGVFGRSLNWLVEHENVEVPVVLNRLATELERRGPVVLNRLATELERRGVDTAGLYFLCGATERKLPLRCGATERKLPLRMQLEKNSAETDIGERPVPDPNILTCLVKDFLRELPEPLVPFNIYSMLLDAASLATPNKVRREGHFCKQFVGIIPNVLQNSLVFLMAHFRTLLASEPHNGLTAQKLSVVFGPLVCQFSVFNFIYAIPSSLSNSLSNPANSLLNAQHAAKALRLLLDHWPREVKSENGKDKRTNTEAKXLIICFLRWEFR

SEQ ID NO: 148528 - protein, 103 aa, Heterodera glycines
  Coding regions on vcDNA: vcDNA=SeqID_74951; Strand=-; Position=1 -101,162-372
MCQGAGPEEQRKPKIVASSHRCSVLQRHKNGEPSQALHRATPAGRGQATQRTTETPVEAAPFSTRWDWYADRRLEIPRRAGMRNEWDGDSCTPPKNELCCLLY

SEQ ID NO: 148529 - protein, 156 aa, Heterodera glycines
  Coding regions on vcDNA: vcDNA=SeqID_74952; Strand=-; Position=1 -129,181-271,323-374,428-626
  Homolog annotation: Hit_ID=NP_871817.1; Match level="QueryCoverage =96%, HitCoverage=38%, E-value=3e-40, Identity=53%"; Hit description =oxysterol-binding protein (1G409) [Caenorhabditis elegans] gb|AAN84853.1| Oxysterol binding protein (osbp
MQAPDWGNYDTNGTDYDYIYNNSDERDNWNSEQAGVFRHLVGQLGTGQTLQNLALPTFVLERRSLLEMYADFFAHPDELIAGAYENTAEKRFLAVLKYYLNSFYPARKTDDAKKPYNPILGEVFRCRWTLPGVPLSASRTAGGPFPGSATNQVQFK

SEQ ID NO: 148530 - protein, 293 aa, Heterodera glycines
  Coding regions on vcDNA: vcDNA=SeqID_74953; Strand=+; Position=1 -83,127-179,360-426,465-530,572-678,740-855,1027-1114,1162-1247
  Homolog annotation: Hit_ID=NP_509854.1; Match level="QueryCoverage =98%, HitCoverage=62%, E-value=4e-82, Identity=58%"; Hit description =phosphoribosyl pyrophosphate synthetase-associated protein (39.0 kD) (XL693) [Caenorhabditis elegans] emb
NMTKSDVSTGMVLLTGNSHPELARLTSDRLGIALGDRLGIALGDTTIYNKPNKETSVDIRQSVRGKHVFILQSSNKNVNNCVMEMLILIYACNVNNCVMEMLILIYACKTSMAKSITVIMPYMPYSKQCRMFRRSITVIMPYMPYSKQCRMFRRSSVPMKLVADMVCKAGASRIASRIVSLDLYRKEIQGFFSIPVDNLRASPFLLQYMKYNIPDYKNAVIVAKTPGVMNKATSYSERLRIGIAVIHGEEKTDEGVQEDGRQSPGIAVIHGEEKTDEGVQEDGRQSPPPSPTD

SEQ ID NO: 148531 - protein, 25 aa, Heterodera glycines
  Coding regions on vcDNA: vcDNA=SeqID_74954; Strand=+; Position=1-77
DTPSEKTRCVPINRECQRKTLSFFL

SEQ ID NO: 148532 - protein, 769 aa, Heterodera glycines
  misc_feature (701)..(701): Xaa can be any naturally occurring amino acid
  misc_feature (748)..(748): Xaa can be any naturally occurring amino acid
  Coding regions on vcDNA: vcDNA=SeqID_74955; Strand=+; Position=1 -128,168-2192,2776-2927
  Homolog annotation: Hit_ID=XP_320889.1; Match level="QueryCoverage =95%, HitCoverage=95%, E-value=1e-122, Identity=34%"; Hit description= ENSANGP00000012033 [Anopheles gambiae] ref|XP_313651.1| ENSANGP00000013044 [Anopheles gambiae] ref|XP_31
VTNAAPQNATPANLSNANLASSIDARLSAFHYNPEVGTTFECCTLPEASKVTLPEASKVRLLLGKLGEEEYNKYRDTISPTQPDQVNWNDTISHLKSLFAETRSLFVRRYECFKIRQQQGQDVSSLIAQINASCENADLSLTKEQLKCIILIIALNDEHHDLRQKALKMLEDAQKNANISLKKIEEELRAIQLVKESALSLVNPPIATNAINTRPRQWTDPAQRQSGSNQRQHHNANSNGKQTRGRPTLPCASCGKSDHWRSDCSFKDAICLKCNKKGHISTICRQKKAKSAPNNNRSTQSKDTHCLHISTTQGRWWKLIILINGRQTSMNGDTCAQATVISLQTWRELGEPNLTPSDIDAKNCNDQPFALLGKFQCTVLSDKPPQTLIVYVSGEVGHNLLGLPWIEAFEIIPRQILFPTNKTADQATKMIDNFSTVKPPNKSINDVASLTAALQSDFSEVFDRVLQIGAIKPIDFSHWAAPILAVKKNGKTRVCIDFSTGLNNALELNRHPLPRPDDIYASLNGAKLFSNLNLRDALQMDEESKIVAINTHRGLFQCQRLPFGVNSAPAIFQHLMDQICAGVPGVFAYLDDGLIATKTLDQHITTLYTIFGRIKEYGLLIQLDKCLQTELLFLWHIVSANGIRPCPSRSDAIRKMPAPIDKNTLRSFLGALNYHGRFVKCMRELRAPLDKLLQNDVIWNXTSGQQNAFEKAKQMMMSDCAHRTPRHCAHEGTCSSPRVLAGNGLSEXKSCEHMRRVAIGPEKSNKSTS

SEQ ID NO: 148533 - protein, 55 aa, Heterodera glycines
  Coding regions on vcDNA: vcDNA=SeqID_74956; Strand=-; Position=1-217
CGLCKRVFPNSAASYRSPAIGRRRQSCAMILEVISGMSDQNDKKQIAIFFASFFV

SEQ ID NO: 148534 - protein, 229 aa, Heterodera glycines
  Coding regions on vcDNA: vcDNA=SeqID_74957; Strand=+; Position=1 -235,754-898,967-1276
ISRAISQAGPVLDPFTWSPSWVGHICRRTLSLAPDPIGGQPKLSVPVPAAFLYSSMSSTKWYQWRPAVSTTNGENWRERRPFRAVRPPAFGLSLLSDEGNLYKGITLSDRNLLMPFPMPLSGKKCRALFIVPYVETSNELNESLYLAINDDRRVHLVASFTHCTFFLRFVVCSSKTRETNIEKAVEVIREMADKVTTVEKANEATERDKAAKALADDGTEESGTLRRTN

SEQ ID NO: 148535 - protein, 43 aa, Heterodera glycines
  Coding regions on vcDNA: vcDNA=SeqID_74958; Strand=-; Position=1 -31,73-173
MPNLDEICFIDHEGTRKRHTRTGQIEMFLYYAVKKDNFRISLC

SEQ ID NO: 148536 - protein, 41 aa, Heterodera glycines
  Coding regions on vcDNA: vcDNA=SeqID_74959; Strand=-; Position=1 -69,125-181
  Homolog annotation: Hit_ID=NP_499689.1; Match level="QueryCoverage =100%, HitCoverage=8%, E-value=6e-11, Identity=80%"; Hit description =UNCoordinated locomotion UNC-25, glutamic acid decarboxylase, mutation leads to shrinker phenotype family
VGYQPDKQRPNFFRMIISNPAIREIDLDFLINEIVTLGEDL

SEQ ID NO: 148537 - protein, 336 aa, Heterodera glycines
  misc_feature (85)..(85): Xaa can be any naturally occurring amino acid
  misc_feature (195)..(195): Xaa can be any naturally occurring amino acid
  misc_feature (199)..(199): Xaa can be any naturally occurring amino acid
  misc_feature (267)..(267): Xaa can be any naturally occurring amino acid
  misc_feature (277)..(277): Xaa can be any naturally occurring amino acid
  Coding regions on vcDNA: vcDNA=SeqID_74960; Strand=-; Position=1-1031
  Homolog annotation: Hit_ID=NP_510671.1; Match level="QueryCoverage =97%, HitCoverage=34%, E-value=3e-67, Identity=43%"; Hit description =predicted CDS, endonuclease/exonuclease/phosphatase family and RNA -directed DNA polymerase (XR69) [Caenor
KHNVNPFEIIWKESIVFPLFKKGDKFNPENYRPISLTCSLCRVMERIFSKNIYKLKNNKISESQFGFIRNRSTTNQLNSCRRLVXSLLMEKKVDCIYIDFKKAFDSVPHNLLLYKLEKIGIRGKLLNWIKAFLINRFSVKIGDSLSSVKVCSGVPQGSVLGPLLFLIYINDLPDVIPSGVNIKLYADDVKIYLLXSKNXNGNYDKALHNLFEWAIKVSIQKTFVLYLGSKNPKETYKCDGNTINAVDTIRDLGINIDNKLQFSDHVXPNNEECLFMXRSLFRIIKSKSSKIWITLYKTYIRPLLEYAPEVWKPSLQKNIKKIEKMSKISTKIVFKC

SEQ ID NO: 148538 - protein, 102 aa, Heterodera glycines
  Coding regions on vcDNA: vcDNA=SeqID_74961; Strand=-; Position=1 -209,268-365
MEMVPFELVNECTKEKLTLAKANENELDKSWIMKRCKIGETAAVNWKDGNWDNNCNNVFFWLFSGTNCIGPLSPPPPASEDEEAGQSITKGEMSEGQTNKNS

SEQ ID NO: 148539 - protein, 38 aa, Heterodera glycines
  Coding regions on vcDNA: vcDNA=SeqID_74962; Strand=-; Position=1-117
LLIHSKFPCQQRNRLGWPSFLGECNHLDNAWPAEIVRR

SEQ ID NO: 148540 - protein, 58 aa, Heterodera glycines
  Coding regions on vcDNA: vcDNA=SeqID_74963; Strand=-; Position=1 -97,499-578
MVAQSEKRWHAEAIAFLFEGATKYGMGQHSQKGLCRHVANGVQLFEGDLMHLRNVRSF

SEQ ID NO: 148541 - protein, 262 aa, Heterodera glycines
  Coding regions on vcDNA: vcDNA=SeqID_74964; Strand=+; Position=1 -69,112-468,513-708,753-919
  Homolog annotation: Hit_ID=NP_503721.1; Match level="QueryCoverage =95%, HitCoverage=48%, E-value=1e-62, Identity=50%"; Hit description =transposase family member (5D107) [Caenorhabditis elegans] ref|NP _503720.1| transposase family member (5D
MDETAVWFDCPDSRCVDNKGAKDVTVVTTGHDKMRVTVCLTARNNGQKLKPYVLVNRKRPVPQIVKQFAGKLVINFAGSIWMNDDTTEDYLHKIIGAKLFVGERLLVWDAFGSYKSERTKKVVKGLGMETVFIPGGCTKFIQAPDVSWNKPFKERIRHFYSIWMSNEAEKEFTSAGNPKAPALHVVLDWIHRSWQEISKEVIIKSFKVCGLTTPLDGTEDEKIACFKPEGAIGPIGIKFLRKFRINETAKDGRKRSRRRRLI

SEQ ID NO: 148542 - protein, 76 aa, Heterodera glycines
  Coding regions on vcDNA: vcDNA=SeqID_74965; Strand=+; Position=1 -77,411-564
MVETVANELALSASQTHALLNKAIRRLSEYFDSICREALEHNTMPMIANNKQKQQQNQKENWWQKRKATNARRSKN

SEQ ID NO: 148543 - protein, 135 aa, Heterodera glycines
  Coding regions on vcDNA: vcDNA=SeqID_74966; Strand=+; Position=1-408
MAKCTKTQNKRSRSEPGQLRPANSVPPTPSRQLRPDQLRPSQLRPANSVPGQLRPEPTPSRANSVPPTPSQYKKGPGQLRPEPTPSRQLRTGPTPSRQLRPRPTPSQANSVPPTPSRQLRPKQKFKNFLKINLSL

SEQ ID NO: 148544 - protein, 433 aa, Heterodera glycines
  Coding regions on vcDNA: vcDNA=SeqID_74967; Strand=-; Position=1 -441,828-1163,1223-1423,1582-1905
  Homolog annotation: Hit_ID=NP_741632.1; Match level="QueryCoverage =40%, HitCoverage=3%, E-value=6e-15, Identity=29%"; Hit description =SMAll body size SMA-1, betaH chain spectrin homolog required for embryonic elongation and morphogenesis; e
MLLTEYGRMPLSAASPIGEGNRSVPSGNCPVGTIGQWHVRDGIRIGCGGRRGKGGGADGRRTGGSGATRGANCCAKGTGNGWTMRWLLQNASKVLYPYNGKGIEVLGGEELALIDGTNRDWWRVLTRHGVEGYVPANYCELAPDEEKKVRDEIRGQGSVQLRQLDATADELLEQEHSRSEDIDAAQKAMRHLWNQLQKAMNGKQNELERTARLAQFQDECADMRNWLTEKSALLEQKPGGEADMRTLQIVQRRFQNLERTTRGKNDRTQAKSGRNNGGAEAKRAAGDQRENGRIGQNVRTTADQGTAVHRRGGTKPRQGTIRADGEPTTHSLIKGAVGMDGKDQRLHSVGASLGPFSSGGCPPPARQNQRPNAGEGIRIFLCRRTRRASNEKRGSERSGKAIGRIGGSERDVGKRMGEARNGMQAVAGVTGRK

SEQ ID NO: 148545 - protein, 70 aa, Heterodera glycines
  Coding regions on vcDNA: vcDNA=SeqID_74968; Strand=-; Position=1-227
AQIYGETESFGNSFPIACTLIMRWISAPHNCLSTPNGHLKKSIFLFSGQSPRTDAPRFMGRPNPSGIASL

SEQ ID NO: 148546 - protein, 258 aa, Heterodera glycines
  Coding regions on vcDNA: vcDNA=SeqID_74969; Strand=+; Position=1 -99,1116-1150,1207-1354,1397-1568,1618-1800,1851-1989
MTVCLCGQRQMGGADSEQTRAAVAAVQQQSVGRDIIAIPCGTLLASATGVITKVMESEKKVSVVLVCGSGENFVVTEFKQNSANALQKYLSVGNVLKLQSVKAQRFNEKFDGQKFFQTPFPFEFVVTKHSKICLVKTEVLVAEKFTQLVAGQIKCVLTTPFSLIGEMFAAVVGDFCGKRADLFISGEKLPEMFGQLDSKDQLELKRCFVKIEDECMQLNVLASDVNVCGCKVTIDDKLVTPVKRKSDEAILSPQSAKK

SEQ ID NO: 148547 - protein, 163 aa, Heterodera glycines
  Coding regions on vcDNA: vcDNA=SeqID_74970; Strand=-; Position=1 -474,862-881
  Homolog annotation: Hit_ID=XP_528877.1; Match level="QueryCoverage =69%, HitCoverage=59%, E-value=1e-09, Identity=39%"; Hit description =PREDICTED: similar to endoplasmic reticulum membrane protein family member with at least 5 transmembrane
NPPAFQSLGLNSAFQSLALNPPAFQSLALNPPAFQSLALNPPAFQSLGLNPPAFQSLGLNPTAFQSLGLNPPAFQSLGLNPTAFQSLGLNPPAFQSLGLNPTAFQSPGLNPPESITETQFSGISSNATQIKQFSDILPVSQSPDKKLCQIHHCNIISSKHHPK

SEQ ID NO: 148548 - protein, 289 aa, Heterodera glycines
  misc_feature (18)..(18): Xaa can be any naturally occurring amino acid
  misc_feature (28)..(28): Xaa can be any naturally occurring amino acid
  misc_feature (38)..(38): Xaa can be any naturally occurring amino acid
  misc_feature (48)..(48): Xaa can be any naturally occurring amino acid
  misc_feature (66)..(66): Xaa can be any naturally occurring amino acid
  misc_feature (85)..(85): Xaa can be any naturally occurring amino acid
  misc_feature (125)..(125): Xaa can be any naturally occurring amino acid
  misc_feature (145)..(145): Xaa can be any naturally occurring amino acid
  misc_feature (155)..(155): Xaa can be any naturally occurring amino acid
  misc_feature (165)..(165): Xaa can be any naturally occurring amino acid
  misc_feature (175)..(175): Xaa can be any naturally occurring amino acid
  misc_feature (185)..(185): Xaa can be any naturally occurring amino acid
  misc_feature (195)..(195): Xaa can be any naturally occurring amino acid
  misc_feature (205)..(205): Xaa can be any naturally occurring amino acid
  misc_feature (215)..(215): Xaa can be any naturally occurring amino acid
  misc_feature (225)..(225): Xaa can be any naturally occurring amino acid
  misc_feature (235)..(235): Xaa can be any naturally occurring amino acid
  misc_feature (245)..(245): Xaa can be any naturally occurring amino acid
  misc_feature (255)..(255): Xaa can be any naturally occurring amino acid
  misc_feature (265)..(265): Xaa can be any naturally occurring amino acid
  misc_feature (285)..(285): Xaa can be any naturally occurring amino acid
  Coding regions on vcDNA: vcDNA=SeqID_74971; Strand=+; Position=1-870
  Homolog annotation: Hit_ID=XP_521405.1; Match level="QueryCoverage =99%, HitCoverage=88%, E-value=2e-34, Identity=45%"; Hit description =PREDICTED: similar to putative N-myristoylated protein (4I499) [Pan troglodytes]
GGLSPGDWNVGGLSPSDXNAVGLSPSDXNAGGLSPSDXNVGGLSPSDXNAVGLSPVEVGGLSPSVXNAGDLSPLFNAGDLSPSDXNAGELSASDWNVGGLSASDWNAGGLSPSDWNAGGLSPSDXNAGELSASDWNAGGLSPSDXNAGELSASDXNAGALSASDXNAGELSASDXNVGGLSPSDXNIGGLSPSDXNVGELSPSDXNAVGLSPSDXNAVGLSPSDXNVGGLSPSDXNVGGLSPSDXNVGGLSPSDXNVGGLSPSDXNAVGLSPGDWNVGGLSPQDXNAGE

SEQ ID NO: 148549 - protein, 224 aa, Heterodera glycines
  Coding regions on vcDNA: vcDNA=SeqID_74972; Strand=+; Position=1 -379,693-989
YVDLDVIAFLNRIQRLLQDGEMTLRVRIFHHQRRSLQIFCAQIWPLINKNIVTAVVYPSIWLPPLQQDNAQQQTTLNDLPNLKLLEYCDVSPSQEVIDWLHNSSADGRPKAVRCGLPRQMVDELRARFVAASSPTIFIVLVHCLHPIERFQIDNDVTNERMELQLLENARPNTTELHHRRLLVRCPIGRNEEQWAQFEENAQNWKLAEQPFLFIELDDRHLGEE

SEQ ID NO: 148550 - protein, 111 aa, Heterodera glycines
  Coding regions on vcDNA: vcDNA=SeqID_74973; Strand=+; Position=1 -39,2041-2337
MREAKARVTNESDRFVAASSPTIFIIVFQCLHPIERFQIYNDVTNERMELQQLPDADPRTTELHHRRLLMRCPVDRNEEQWAQFEENAQNWKLAEHPCLFIELNDRHLGDE

SEQ ID NO: 148551 - protein, 26 aa, Heterodera glycines
  Coding regions on vcDNA: vcDNA=SeqID_74974; Strand=-; Position=1 -30,120-170
MEDQMGTELAECFSSDVDWLHLKVVL

SEQ ID NO: 148552 - protein, 179 aa, Heterodera glycines
  Coding regions on vcDNA: vcDNA=SeqID_74975; Strand=+; Position=1 -206,292-474,701-829
  Homolog annotation: Hit_ID=CAA78915.1; Match level="QueryCoverage =96%, HitCoverage=40%, E-value=4e-55, Identity=61%"; Hit description =p46Eg265 [Xenopus laevis] gb|AAH72133.1| LOC397925 protein [Xenopus laevis] sp|Q91820|STK6_XENLA Serine/th
KEMNKFSWTLNDFEIGKPLGKGKFGTVYLARERETKYLTALKVLFKKDMDKHGVSHQMKREIEIQYHLRHPNILRLHPNILRLYGYFYDEDRVYLSLEFASRGSVFQLLRKSKCFSVPYSARLIYQLADALIYCHSSKMITKILKPENLLINTNGDLKIADFGWSVHAPSSKCVFVIFA

SEQ ID NO: 148553 - protein, 214 aa, Heterodera glycines
  Coding regions on vcDNA: vcDNA=SeqID_74976; Strand=+; Position=1 -207,1057-1366,1546-1605,2040-2107
  Homolog annotation: Hit_ID=CAE66832.1; Match level="QueryCoverage =53%, HitCoverage=59%, E-value=2e-18, Identity=37%"; Hit description =Hypothetical protein CBG12202 [Caenorhabditis briggsae]
MPCQPKLPFPSLAACPRPVHSHAIGGAAEAPVDCGEYAQESVQCAIGRFRESFGPQIVHFVIKLMFICLEKGTERERTRKRTRKEKKVEEKEEHKVEEEVKEKEDRKDDQKVEEKDKEDRKVKEEKKQEEEQKEEEKVEEEVEEKEEQKQEERKSRRKWKRERKRNGKRKSKMPVGHWFYYIFEKWGPNGNRWRYLLLPVCHGNLRFGMRPDVL

SEQ ID NO: 148554 - protein, 434 aa, Heterodera glycines
  Coding regions on vcDNA: vcDNA=SeqID_74977; Strand=+; Position=1 -81,671-1001,1227-1460,1564-1655,2539-3105
  Homolog annotation: Hit_ID=NP_494413.2; Match level="QueryCoverage =31%, HitCoverage=19%, E-value=1e-11, Identity=33%"; Hit description =nuclear Hormone Receptor (64.1 kD) (nhr-88C) [Caenorhabditis elegans] gb|AAF39914.2| Nuclear hormone rece
MRKYVLMCADWVNALFMLAGLDSPQEKLTLIKNAFVAFYTFEQATCTAKVCRNAAATSNAASAAGGGALLGGIPPQAICLCNGTLVARDVPQDCTTNCLLANNIVGKVLDELVTPLRRLNLSEQERVALTALILLDGGPVLSGRHFLDPVNLWHFYVVLIARFPLPDQTVAVRWAVSAATPATTALPLAAIMAPAPACTWSRTSCKTHCSNMCASDGQNVCAPIHGPVVGRNLRLGGVKPRPVVVMEFEPLLLGFDEVRRRQQQHHQLHQQQQQQQLDDIGVEQRPRRMSATEMDQLLLAPLFVNGGGGNFHHLHHQQHHEQQQHQQQQQKSNNNGTGSNELLLSSSSPEGTGGAATVTTTAATQPSSAAAVTTGGGGDSAAGAANMYFGCHSTTNVDRSGGANGTDDGQSHSREWVSRISQDPGQHSLPGFNS

SEQ ID NO: 148555 - protein, 74 aa, Heterodera glycines
  Coding regions on vcDNA: vcDNA=SeqID_74978; Strand=-; Position=1 -84,220-360
MADIVQILEKTISPSWLCTFIYWFDSFEPEFIQQLAVVLSNTSNSPIVRKAAGLQIKNALVSREQAVSDQKRTR

SEQ ID NO: 148556 - protein, 33 aa, Heterodera glycines
  Coding regions on vcDNA: vcDNA=SeqID_74979; Strand=+; Position=1-99
VCILYIEIAMDTLFDVRNNFYLGAFQQCINEAQ

SEQ ID NO: 148557 - protein, 391 aa, Heterodera glycines
  Coding regions on vcDNA: vcDNA=SeqID_74980; Strand=+; Position=1 -194,306-735,779-913,978-1394
  Homolog annotation: Hit_ID=NP_510527.1; Match level="QueryCoverage =82%, HitCoverage=60%, E-value=1e-114, Identity=57%"; Hit description= putative protein of bilaterial origin (59.6 kD) (XP828) [Caenorhabditis elegans] emb|CAB07528.1| Hypothe
FGRDYETDPNHFYFGDFERHNAEIATFHLDKSLTHCALSICHCFFRILGYRRAVPTVGRVMNMTTKNRCFVSKCDYYCDTTHAICGSPELKEGSVQVFLPDDTSVPRKHNKSPYRRYSMPTKVTVTVRLFRTYSKKTQLAAWQQDMNYCQSKVKGMKQYAHGRRLLDLIDLHLMDYLIGNQDRHHYETFSVFGTDIPSYAIHLDNGRSFGRTDFDDDDILMPFRQCCLIRPKTLGTFFGFYSGVKGLSETLHDSLSKDPVFPVIAFKHYAALERRLYKIMEYLLECMDKQNGDLTQMVVNEFHNPTVAEPLPGEESETEEDETNDAPAGPPADQQQKQREVGAAPAEAQHQPADENENAKNVLKAPAVEPILKEEQRQSAEGHGKFPKPPA

SEQ ID NO: 148558 - protein, 55 aa, Heterodera glycines
  Coding regions on vcDNA: vcDNA=SeqID_74981; Strand=-; Position=1 -138,340-369
MIDIDCFFEQETNSLDPGCLVRLDEYGFYLVWEPKGKDAGILDMNQRFFGNFLKT

SEQ ID NO: 148559 - protein, 77 aa, Heterodera glycines
  Coding regions on vcDNA: vcDNA=SeqID_74982; Strand=+; Position=1 -125,246-354
MYFPGHLSINISALINQYFTDQPFSSYIVITVKHIATQQCLRQLYVQQEIVGQKMVWEEANSHANYTPPIRHGRSVN

SEQ ID NO: 148560 - protein, 24 aa, Heterodera glycines
  Coding regions on vcDNA: vcDNA=SeqID_74983; Strand=+; Position=1 -64,249-259
MAKQKPVLFLQMECVLCLLGVEIN

SEQ ID NO: 148561 - protein, 126 aa, Heterodera glycines
  Coding regions on vcDNA: vcDNA=SeqID_74984; Strand=+; Position=1 -130,185-371,420-503
HGAVTSEISPNQRLISFGSASFIRLSSSTRNSEDTLLDEVPPPTQWALSHASSFRTGPTRGPFLRLPYPPSPHFHRPMDRPAALAFLPTIGSLYGSISGVLIVLMILLVALFGSALWSCRNYKKKC

SEQ ID NO: 148562 - protein, 430 aa, Heterodera glycines
  Coding regions on vcDNA: vcDNA=SeqID_74985; Strand=-; Position=1 -177,227-347,716-792,1547-1819,2724-2985,3242-3622
  Homolog annotation: Hit_ID=XP_306289.1; Match level="QueryCoverage =50%, HitCoverage=99%, E-value=3e-33, Identity=38%"; Hit description =ENSANGP00000000039 [Anopheles gambiae]
MSDVPENANENCPGTASANAGKTSACAGCPNQSACSTGERAVDPDIALITERLAGVKHKLLILSGKGGVGKSTVTASLAYAIANLQEGAKPFKVWRRFTRWTPIFVQNNLFVMSIAFLLDTRDEAVNFCVKTKVPVLGVVENMCQFVCPCCSTASQLFPNTTGGAKKMCADLSLELLAQLPLDPRLAKSLDEGQSYFEHFADSPVAKQFSDLAQLVRKEKRRQRKNHSLVGLDAEEDTDASDFSSSSASSSSDGSSEDSSDSASGDDNDDAEQFTADSLPGCSSSVAVQQPQKRKKTATESDGTTAPSVLDGVVKRENGEPKRRGWSTTDAAWDEDEALDIGKTAEECDGTVPSVAGGTARGKRTAQQQKTEMAEQTAEEQHKREAEEEQKRAEAKERNQRNRAANRKRRLRAVVEEQMMRRHLGPNHHR

SEQ ID NO: 148563 - protein, 188 aa, Heterodera glycines
  Coding regions on vcDNA: vcDNA=SeqID_74986; Strand=+; Position=1 -124,1258-1355,1729-1879,1964-2157
MSGSTALSPVEQALWLGQPAQADVLPALALAVPGQFSLAFSAFSHFSQNVPFAIFSNCWQTVSTGNVNATNCETVRDNAAKLGIDEKGNFTYSVDTSGYRPEELNVSIEGDEVVIQGEHKETVEDETVHRQFVRRVRIPDGFQKEGLKCAMDDACRMCVTAPKAGAEPAAERRSIPIEVKAKAIDEKK

SEQ ID NO: 148564 - protein, 301 aa, Heterodera glycines
  Coding regions on vcDNA: vcDNA=SeqID_74987; Strand=-; Position=1-904
MKFKLLLLLSLLMILLYTIKQTVQVKLKQGKSFDEIFGQRCDDGAEEIVCRIDHKIHGEIDDQNNQIQQNSRQFDQFFDEILEVKKEDSEEMSNNCDELEQLNENNGQSYDHNKRIVEKFHKIKDKIKQMGNKYSAKEWKKIERKFAKKLGSTQKKIYEWKKEFGLNIRNRYSDEEKLEILRHFDQIYGQIKSKLKGKLDGKREKCQKILAKHLGTNIKTIYKWKKQLKDGNSMKKQKINDEKTETVEKYFKIKNEFMQNGKHSRKEWEEFRAEIKQMFGVNYTTIERWANKLEIEQNVSK

SEQ ID NO: 148565 - protein, 45 aa, Heterodera glycines
  Coding regions on vcDNA: vcDNA=SeqID_74988; Strand=-; Position=1-137
FEDICKLLIINTQSYRTTPTMLNLIDNEQSYGSKSLPTMFRPTTF

SEQ ID NO: 148566 - protein, 94 aa, Heterodera glycines
  Coding regions on vcDNA: vcDNA=SeqID_74989; Strand=+; Position=1 -92,237-429
MLFKNKHSLALECFYICRMYKQLQEQQKKNKPLSPPAYKEEEADQSNEKVCSTIHGPSDQRNEEEDNEEADQSNEKVCRTIHGPSDHQRNAKGL

SEQ ID NO: 148567 - protein, 101 aa, Heterodera glycines
  Coding regions on vcDNA: vcDNA=SeqID_74990; Strand=+; Position=1 -20,380-665
MPSSALRFISADCWLLVFDFLSPSQLGFGIALISRRFDLRVDEHFKTRKWKLNKQLLIQWDIEENGTKKMQIVEPNGNPLPIPQEPLPSKVIGFNGRINIM

SEQ ID NO: 148568 - protein, 202 aa, Heterodera glycines
  Coding regions on vcDNA: vcDNA=SeqID_74991; Strand=+; Position=1 -294,790-1058,1425-1470
MFRASIRGINLNAITFRRMCQLAPSMLTDCPALRYVDSEDAIFPEFLLPDDDNAHAADGQAVAKWLFTPLPDGASKRMKCLVNLSVDQWTASMEQLRTAFSNASSPVTFHINLTLSSTLVGSVVPFFMMNEATGEQLALEQYDLDDFELFRCPIEWDWENWKNEWKESCAARPRRISFWIRDGGFEEGLLEAASPGPSDQQQ

SEQ ID NO: 148569 - protein, 98 aa, Heterodera glycines
  Coding regions on vcDNA: vcDNA=SeqID_74992; Strand=+; Position=1 -11,71-356
MNKRWICGDVWMDILPSFNRPQLGLKMALLSDRFDVLVDAHFDGKSELTIWRMIRIGKDEGPKAKLLVEINGYFVQFPMPNRPLPNKIRFHFLLIRVI

SEQ ID NO: 148570 - protein, 350 aa, Heterodera glycines
  Coding regions on vcDNA: vcDNA=SeqID_74993; Strand=+; Position=1 -276,329-755,813-1099,1155-1218
  Homolog annotation: Hit_ID=AAL78214.1; Match level="QueryCoverage =42%, HitCoverage=75%, E-value=7e-10, Identity=30%"; Hit description =putative esophageal gland cell protein Hgg-20 [Heterodera glycines]
WICSDVWMDILPSFDHAQLGLKMALLSYRFDALVDTHFDGKTELTIWKWITIFKDKGPKPRLSVWIAGKFLDFPLPDRPLPNNVRFQCLQIEYIDHSVLTFLHANKHIWDRSGTKLTLWPYRTEDEQRIWDVFIREIWPLFATNIRHLSFASSVDLDNLRLRTSPTILTDLDQLHSIDSGHLCPDGIADFDVLNPTAGQVLSKWLHTPSKNGQPKRLRYSNFPLNLGWVNSFKEAFRRAITSVSYHIQLYLFTTTMTTEPFELVNGRTNEKLTLKPSKEYNLVIWLLQRCPIGETSTAPVKWADQHENSGANANLNNINFSLWIFNKTIGPLSPPAEEENEEEADESNEN

SEQ ID NO: 148571 - protein, 88 aa, Heterodera glycines
  Coding regions on vcDNA: vcDNA=SeqID_74994; Strand=+; Position=1 -39,816-901,1396-1537
MDQSSMINQNSLFSTNLPALSSVAFLLDVYMPGQSDLLFALLYFSFCAHLVGMASSVVALLLQMNSVCVLLQLPRPAPRGWTHSQLMR

SEQ ID NO: 148572 - protein, 178 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  Coding regions on vcDNA: vcDNA=SeqID_74995; Strand=-; Position=1-547
  Homolog annotation: Hit_ID=BAB33421.1; Match level="QueryCoverage =94%, HitCoverage=60%, E-value=1e-61, Identity=72%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLHPAYALTDVP

SEQ ID NO: 148573 - protein, 163 aa, Heterodera glycines
  Coding regions on vcDNA: vcDNA=SeqID_74996; Strand=+; Position=1-616
RTSRRWTQLRGQCTGTHTSTPDFPVRTLPQAKGLRALMPRVFSNASTLVPRQGVPIHELIGLVNHGNTPLTRIPTPPPTLGSASPVLSSPQHLCLRPHLHKSINSPNFFNTQTSCMFYSFRQLPNAGETEATTKVAPQQQPSPFNAEHKRKQALEPRRPRSPQ

SEQ ID NO: 148574 - protein, 174 aa, Heterodera glycines
  Coding regions on vcDNA: vcDNA=SeqID_74997; Strand=+; Position=1 -269,319-498,1183-1258
  Homolog annotation: Hit_ID=NP_495787.1; Match level="QueryCoverage =49%, HitCoverage=19%, E-value=1e-14, Identity=41%"; Hit description =t-complex 11 (2I759) [Caenorhabditis elegans] emb|CAA91410.1| Hypothetical protein M05D6.2 [Caenorhabditi
MLADHLEGDHLKHSLNAVGEILDMGKLKSLANQRGGLNFEMGHICSFIVFHNFVVVIKDVLDVVGRLCAPIRDEMVANLKKETDIVKLFDGVFSLVEMMEIDMTNFKISQNRQLIGSYSAQIEFEEFEKLMQIDESWSYFAYLTTNNFSRKTFVRFCWPGPLTQEQPHANTVRP

SEQ ID NO: 148575 - protein, 250 aa, Heterodera glycines
  Coding regions on vcDNA: vcDNA=SeqID_74998; Strand=+; Position=1 -187,235-318,417-895
MQKSQITFAPVSSYTLRKQKRPISRSTEEPPPVLTKGSETEFDNCEEPPPPLLEAETATDGDGSEHDFVQNGSIKSVRDLSVIMTSAAEIASLIDRHLPSWFRNCPGCHPDQNSELLFRGRIAGGPQSGPIVSIECAFCGSPIYNSDCHWERRPTRAESVEKKSTKGSQSACDLTDNELEPSTSAAEIGGKTADKTQAKLTTRKKKEIGFDQNYSHQFGLSFPVMFETEDGQRKSHCERITFRGFVYCHV

SEQ ID NO: 148576 - protein, 108 aa, Heterodera glycines
  Coding regions on vcDNA: vcDNA=SeqID_74999; Strand=-; Position=1 -157,986-1155
MAASDVFETMFRFDAQNAATKHNANGKGRKKIRFNWSFNRDARKKRQSKIVVEEGPSPILITDIDVDAFKTMLRFIYADDLSGLDGENVISVLYAGPKNTYILYMFLL

SEQ ID NO: 148577 - protein, 143 aa, Heterodera glycines
  Coding regions on vcDNA: vcDNA=SeqID_75000; Strand=+; Position=1 -204,974-1112,1508-1596
MPFSDFGGRAMQNDFLRLNGPSFLSDYADLWLLGLDMLPMAHQTEEQKEQLKMKLFSSRSSKCFIEAWNDQSHKFCVHTRRGDFVKRGWDSKKEPTEKGIDLGFEYLKVIQMANCLHTRDHFLPEWIPIKLINGTMALDYQAE

SEQ ID NO: 148578 - protein, 89 aa, Heterodera glycines
  Coding regions on vcDNA: vcDNA=SeqID_75001; Strand=-; Position=1-270
MKAAQAFEVPKLGLLNYALIWLGGCAEYALIWLEDFAELALIWLDDVQNLSDPADCAKIVVYQQFINKQIKINAQNGEVGGVQRRRRTK

SEQ ID NO: 148579 - protein, 94 aa, Heterodera glycines
  Coding regions on vcDNA: vcDNA=SeqID_75002; Strand=+; Position=1 -163,1925-1976,2290-2357
MTAFHQTTNRQGNLTTSERNHRRMTAFHQTTNRQGNLTISAREQTTGNRKIVNVPPINVMDERNRRDKVKGIKKRNGPSSSAAKKRGRFMFGTR

SEQ ID NO: 148580 - protein, 28 aa, Heterodera glycines
  Coding regions on vcDNA: vcDNA=SeqID_75003; Strand=+; Position=1 -25,397-458
MRLIARKKSPQGLPMHCFGGNKVLMITG

SEQ ID NO: 148581 - protein, 34 aa, Heterodera glycines; identical to SEQ ID NO: 145298
  Coding regions on vcDNA: vcDNA=SeqID_75004; Strand=+; Position=1 -152,195-259

SEQ ID NO: 148582 - protein, 52 aa, Heterodera glycines
  Coding regions on vcDNA: vcDNA=SeqID_75005; Strand=+; Position=1 -43,313-428
MTRRIRSFFTPSATVNRECSTRVEEAMAAPLEDFDSLIDDTESASDDSIKCI

SEQ ID NO: 148583 - protein, 190 aa, Heterodera glycines
  Coding regions on vcDNA: vcDNA=SeqID_75006; Strand=-; Position=1 -213,269-496,744-875
MGLFFVWLSLFVLSPPFGGLCSANANVTSFPTIANGAVPTTLSPGRSPVVISPCAPIEIAFANVVKPGEASVCQCILNVPPPIGGKTVPTPHQKGNGDQFWIGCTRHKMTAVFRALQTLNGTRVPHLHIWDSLINILPNDPKPMFTQLLADRLTIERSRVGLIREGAFATIGRTLRGLSLRHNILKAFFN

SEQ ID NO: 148584 - protein, 73 aa, Heterodera glycines
  Coding regions on vcDNA: vcDNA=SeqID_75007; Strand=-; Position=1 -43,90-211,996-1052
MSKPIIKVRIVQIIEADEAAGQPKQVVAEYVDGTGRRVTMKASGEVRIGQLVGFFDGPDKRHIQTCFTNNNNN

SEQ ID NO: 148585 - protein, 181 aa, Heterodera glycines
  Coding regions on vcDNA: vcDNA=SeqID_75008; Strand=+; Position=1 -67,268-423,605-927
MGSRPMLNRPETIGDRQIVKKKTVGNGQQNQLKGFGPELKDVALVAGDNLKRTASKTGTLVKRAFSNQQNGGKAELVKEASENVLNKSEEKSKSKTEGSKNSEKWETNSENGRTNGQMAINDTKKDNENDETENDQNGKQTEQSDQKKEKYEHKAAEDDGSMIEKNEKSKTIGEGSSIFSN

SEQ ID NO: 148586 - protein, 101 aa, Heterodera glycines
  Coding regions on vcDNA: vcDNA=SeqID_75009; Strand=+; Position=1 -83,327-381,578-713,784-814
ATPEHGGPSYKKRFIGVEKKQGIIDRKPNEKKTPSVPGNIASASLEEPSEGKIYMVEKGSTVDTVLGVRRDRPAVVALVRYMDEQYELVPTPLLVKHNPAK

SEQ ID NO: 148587 - protein, 45 aa, Heterodera glycines
  Coding regions on vcDNA: vcDNA=SeqID_75010; Strand=-; Position=1-136
MLAPNASAETPAPKRQRRNAVDPPVPGFFAVPVEKLGPGPDFSGP

SEQ ID NO: 148588 - protein, 19 aa, Heterodera glycines
  Coding regions on vcDNA: vcDNA=SeqID_75011; Strand=+; Position=1-58
PVPGFFAVPVEKLGPGPDF

SEQ ID NO: 148589 - protein, 82 aa, Heterodera glycines
  Coding regions on vcDNA: vcDNA=SeqID_75012; Strand=-; Position=1 -75,134-307
MPSIAMIYQFRWQMPINLANFCLILCQNVHGFVVPTPSEFLAPKIFLLTLQFLGQTKTFAQIWPSSSRFSYNLRLLQLIVDV

SEQ ID NO: 148590 - protein, 224 aa, Heterodera glycines
  Coding regions on vcDNA: vcDNA=SeqID_75013; Strand=+; Position=1-675
MKLHLLLVLIIFLIIEIDQIKTEKKKLQQKSFDEIFGEKWEEKEEERRNELKKREIIAKFYKIKEKIKQKGRKYSTKEWEKIELKIAKKLETNRKNIYKWIKEFGLQKQIHKSYKSKTDEEKLEIVKKFIGMKNEYKQKRKFSEKEWKENYDEICKKIGVSHYVIMKWKKHFGMSKFITEKEKMEKIIIYWEIKKENPKMSDKEIAKTLQINRKSISRWKKLFG

SEQ ID NO: 148591 - protein, 310 aa, Heterodera glycines
  misc_feature (24)..(24): Xaa can be any naturally occurring amino acid
  Coding regions on vcDNA: vcDNA=SeqID_75014; Strand=+; Position=1 -81,598-651,690-800,847-959,1002-1047,1093-1129,1185-1301,1346-1461
  Homolog annotation: Hit_ID=BAA14323.1; Match level="QueryCoverage =89%, HitCoverage=61%, E-value=4e-53, Identity=39%"; Hit description =collagen alpha 1(V) chain precursor [Homo sapiens] sp|P20908|CA15 _HUMAN Collagen alpha 1(V) chain precurso
LEQREEEDERERGGRTRTKRCSCXASQGTPGRKGMKGTPGAKASKGAPGIPARLPCEPLKGAPGIPARLPCEPLQDLKKYCPEKCPLGLQGPPGLRGHMGEKGRRGPIGPSGKNGDDGLRGHMGEKGRRGPIGPSGKNGDDGKTGPRGMPGPPGVPGLDGEDGESGTDDGEDGESGTDAQPMQFVPGPPGAGGESGFVPGPPGAGGESGDPGPPGPRGDPGPPGPRGLPGIDGPQGPQGRKGAQGNAGKMGAPGTSGPPGPIGEPGEDGHKGPPGPIGEPGEDGHKGVCPTYCAMDGGVFFVEPPEWFFK

SEQ ID NO: 148592 - protein, 177 aa, Heterodera glycines
  Coding regions on vcDNA: vcDNA=SeqID_75015; Strand=+; Position=1-534
MLKAEVKKKREEVERAKEERLKKLESEAEGLRAMVAEACFPHKPAEKSGEEEKSGEEEKEARAPASPPRTIRHVVIDEDCLSIDSEDGPEEERQRAAGGSVANFSIGNERAEEGSGRRPTPGRGVGDLGFLVFNRDDGTPVELDEEEENEWGGGVLDHPAAPPRRAPEDAKRKKWRR

SEQ ID NO: 148593 - protein, 106 aa, Heterodera glycines
  Coding regions on vcDNA: vcDNA=SeqID_75016; Strand=-; Position=1 -69,601-852
MKPLGESYKKRQLACGNYCELDHVIWQIFDLNKAVLYITSKSEFKLAFRVRPGPGSRPGFFLDSGPGHFLTTWIFPGPDFPGFLSRKSRSRSRQNRKKPGFSWTKF

SEQ ID NO: 148594 - protein, 527 aa, Heterodera glycines
  Coding regions on vcDNA: vcDNA=SeqID_75017; Strand=+; Position=1 -89,130-297,352-460,531-673,719-804,848-1297,1650-1720,1787-1966,2169- 2234,2285-2420,2524-2609
MSIVNLLFFAVLFKLPPFLHSLDKAYVTEPFSFLLTGGKIGKVSVPYFALDQCKPYKSITHDPKAESQNFGLYFLMKHRGGHCDEGILICYPGTLMRNHMTSEFKKMSDFRLKRTFQVGNKECAQKAEQFVGISNPKQWRGIKVYTKLTNSSNPLSARELILETSLTNRSYTFEPMTRQLSLNFGTRVSMFTWVTTHFGQPFHDEEFDLAEQYAQQMGYGPFLEQHVGLWLLGMDMLPWMAEEYVSLYVYRGCSCTMDAWVLYYYLKFYCNLLGYNLMKFTRPTDENDPIEPIVPSAGSSQCPTKQMDETFELGQLDAQHLQADLVFTVLTDEEWQNFTVELLQQEEEGKKLSVVMNFTIRTIDDMKVPFSGINTSVVNGTQMPNGIQQLRFDIFLLEHWHVIMVNGEQLGEVFWPKEWWQGAAWKNITAIRLNGQVLLLYGPELDEYGIENENFNVSVPLPFSQRIDGFRVNSTFFFRVQLLNETHNTVNITFTNGNSTDATDQTEMNIKIENFETIEITAYYVIF

SEQ ID NO: 148595 - protein, 93 aa, Heterodera glycines
  Coding regions on vcDNA: vcDNA=SeqID_75018; Strand=+; Position=1 -78,858-1061
MEFNVDAGGLGKEFFCEHIYVENASIVTRQGPVQENSLNILSRRALSLKILMAQDGFYGRSYGDYIKLCPYFWTYWQYWGMWPWTIDHVQVVN

SEQ ID NO: 148596 - protein, 30 aa, Heterodera glycines
  Coding regions on vcDNA: vcDNA=SeqID_75019; Strand=-; Position=1 -74,138-156
MALVDFTKKFCDFFFLDVWHRRCLWGFDGR

SEQ ID NO: 148597 - protein, 43 aa, Heterodera glycines
  Coding regions on vcDNA: vcDNA=SeqID_75020; Strand=+; Position=1-130
YGTKRLPISDIFGVGIPTSEIFDEKSEIFLIFFFQKTSKFCTI

SEQ ID NO: 148598 - protein, 389 aa, Heterodera glycines
  Coding regions on vcDNA: vcDNA=SeqID_75021; Strand=+; Position=1 -83,547-861,923-1367,1439-1704,1756-1816
MGSSFMESVGNRRSSRLKMKKKNRKISCEILSSFFPHFSWICNDVLMDILPFFGLRQLGLKLALISDRFDVLVDAHFDGKSELTIWKAIRIHKDAFTEVPKLSVLIDNANRVEFPWPDRPLHNKIRFNFLLIDYIDHSVVEFLRSNQPIWDRGTNLYLHFCSSNTESNFRPIWDVFVRQIWPIFTTINVHHLGLHFADHLDTLLRLTSPTILSDMNINSIQSVRLFPEAIDDDDGPTNTNSHGQMLSKWLHTPRTDGRPKKLRCDKHFESPNLEWINSFKEKFLRATASISYELYFELKSSTPIEPFELENERTKENLSLEKIPPYPGSWLLKRCPINGETAPIKWENEIRLTNFNGVRFVLNINKQCIGPLAPPAEEEKADQSIENVV

SEQ ID NO: 148599 - protein, 25 aa, Heterodera glycines
  Coding regions on vcDNA: vcDNA=SeqID_75022; Strand=-; Position=1 -68,221-230
MPSLIGTAGPSVPSFLKNCTAKNIF

SEQ ID NO: 148600 - protein, 43 aa, Heterodera glycines
  Coding regions on vcDNA: vcDNA=SeqID_75023; Strand=+; Position=1-128
YGTERLPISNIFGVGIPTSEIFDEMSEIFLIFFQKTSKFCTIS

SEQ ID NO: 148601 - protein, 84 aa, Heterodera glycines
  Coding regions on vcDNA: vcDNA=SeqID_75024; Strand=+; Position=1-255
  Homolog annotation: Hit_ID=YP_075717.1; Match level="QueryCoverage =71%, HitCoverage=10%, E-value=1e-13, Identity=53%"; Hit description =hypothetical protein, proline- and glycine-rich [Symbiobacterium thermophilum IAM 14863] dbj|BAD40873.1|
MKNLIQKIKTCRERKGVWRPFGWRPFGWRPFGWRPFGWRPFGWRPFGWRPFGWRPFGWRPFGWRPFDWRPFGFDPVRKDHCFFY

SEQ ID NO: 148602 - protein, 366 aa, Heterodera glycines
  misc_feature (32)..(32): Xaa can be any naturally occurring amino acid
  misc_feature (45)..(45): Xaa can be any naturally occurring amino acid
  misc_feature (81)..(81): Xaa can be any naturally occurring amino acid
  misc_feature (320)..(320): Xaa can be any naturally occurring amino acid
  Coding regions on vcDNA: vcDNA=SeqID_75025; Strand=-; Position=1 -241,454-1071,1293-1521,2284-2302
  Homolog annotation: Hit_ID=NP_500227.1; Match level="QueryCoverage =73%, HitCoverage=26%, E-value=4e-44, Identity=36%"; Hit description =predicted CDS, reverse transcriptase like family member (4D351) [Caenorhabditis elegans] gb|AAK68554.1| H
YIFTTELKKLFYKYVPMKLLKTTIKQKHDEKXKLVREKAEHIACXKEKLSVVSLKLNTKYYAGNIKNILINYIVKMRLNTXILLRKLPRRNSTSPDGIPYILLKECAFPLAPILTELFRIILDSFKIPEIWKTSTIIPVFKKGETDNPINYRHISLTCTLCRAMEKVIRLEILKFLNKNQFFSPFQFGFLRQRSTTTQLLSTNDFYKSIENKSCVDVIYIEISKAFVSVPIELLLQKLKNVGINGKIHKFIKNFLNDRSFRVKISEQYSNSKNIYSGMPQGSVLGTLLFLIFINDLPNNLPKNVGIKMFADEIKIYIEHXNDKNRENLSSALEAINKWQKKWPKNINRKNNGPFGPGRSRKPIEKE

SEQ ID NO: 148603 - protein, 466 aa, Heterodera glycines
  Coding regions on vcDNA: vcDNA=SeqID_75026; Strand=-; Position=1 -193,340-594,720-1670
  Homolog annotation: Hit_ID=NP_701428.1; Match level="QueryCoverage =76%, HitCoverage=12%, E-value=2e-14, Identity=25%"; Hit description =hypothetical protein PFL0315c [Plasmodium falciparum 3D7] gb|AAN36152.1| hypothetical protein PFL0315c [P
MLPTITSLVIMLVEILSFRNVEANDTVTIQAYCIVEEPYPPEPVFKHVKEYIENCEKLGYVQQPEVKAIKDGIYYAFTLERPQDFSAVDIPKENKCMDYEDEKDNKLENLLNNYQNAKKEMESEREYQQKLDDSESVQSQLTLALEAMLKKKRWCEIEKFKLDAYIKTMEEEKDLVEYRKYYDANGMDEQFEKLLKTYKETREKKEKCLKDYIQIIQEPEQADMMYFAKQALTNEEESCEIEKFKLDAYIKTMEEEKDLVEYRKYYDANGMDEQFEKLLKTYKEIREKKEKCLKDYIQMSSIPELADMMYFAKKALTNKEESCEIEKFKLDAYIKTMEEEKDLVEYMKYYDANGMDEQFEKLLKTYKETREKKEKCLKDYIQIIQEPEQADMMYFAKQALTNEEESCEIEKFKLDAYIKTMEEEKEKHKSDSPKRGKFFLNFFKLPKIAKEGKEKRRKFEKWRRKI

SEQ ID NO: 148604 - protein, 69 aa, Heterodera glycines
  Coding regions on vcDNA: vcDNA=SeqID_75027; Strand=+; Position=1 -94,149-264
MNIYEYSNIYGFVESAFYDLAYTCRRLTSFNLAFSLALRCPLSQLFVNRCEFLFRLRKANYVPKTTADQ

SEQ ID NO: 148605 - protein, 297 aa, Heterodera glycines
  Coding regions on vcDNA: vcDNA=SeqID_75028; Strand=+; Position=1 -270,445-1068
MAPFSLSLFPSVCLFFSLLFPIEFAASSADQQKSNLDKFFTKFADELPPNERSADTLALFAEMDEADALLTDQMSKVIPPPPSPAHPTFQTLYLDKNKGPNSAEKNSAFQSDPKSAVVRRLKGSKLSKLRSLFPRTKFMKQTERIVKVYLKLKDNPGGGWGPLIQKMFGEMILAKKLGKGDGASLRANCQLALELIGEGDGATEAMVDQLAKAKPYSNFWTLTKRTTKAILCLLKGNGTESERQRSTEDILRMLKTFAEDGESLKMVQKGGKREADKAGVIRDSRYRKISNSRLPPP

SEQ ID NO: 148606 - protein, 62 aa, Heterodera glycines
  Coding regions on vcDNA: vcDNA=SeqID_75029; Strand=+; Position=1 -80,577-685
MPTTILERPNTLPHDGGNTEPGSGSFSLIEHLKSSRMIPRLLDLDVKEKSYSPKTCAGAQLR

SEQ ID NO: 148607 - protein, 241 aa, Heterodera glycines
  Coding regions on vcDNA: vcDNA=SeqID_75030; Strand=-; Position=1 -70,168-292,343-436,595-738,987-1151,1694-1822
  Homolog annotation: Hit_ID=CAE68642.1; Match level="QueryCoverage =99%, HitCoverage=29%, E-value=2e-18, Identity=26%"; Hit description =Hypothetical protein CBG14532 [Caenorhabditis briggsae]
GTAKEAVTQNYEQRLWKGWDIGEEILNEAFSKLATNSENANSNESDALTLKFCRRINDSYCAESVNNKKFVIVVFNGNSKTYTGPIRVPINAPNARVIPTFVRPYQIPMRKFWPSKWELVFYAEIKGLGYEAFYVDTTLRQKRLYISLTFGGNGLLASFEDLIGQVKMDFSQKFAFYTGANGRRSAEGEEKQQQTSGAYNDLVHEARQIVQPWLSQIVRLYMDKPFVEFEYLIGPLHKDQE

SEQ ID NO: 148608 - protein, 269 aa, Heterodera glycines
  misc_feature (4)..(4): Xaa can be any naturally occurring amino acid
  Coding regions on vcDNA: vcDNA=SeqID_75031; Strand=-; Position=1 -114,167-259,342-421,469-571,854-1032,1105-1218,1412-1492
  Homolog annotation: Hit_ID=XP_314689.1; Match level="QueryCoverage =97%, HitCoverage=20%, E-value=1e-60, Identity=42%"; Hit description =ENSANGP00000013096 [Anopheles gambiae]
EKFXKKANKEVRHLQMELKMICNSGQLEFVGGGWTQPDEAATHGWTQPDEAATHYYELVDQYALGLGKLSEKYGVCGRPKVAWQIDPFGHSREHANLVSMMGYEALLFARMMGYEALLFARMHYLERKFRIENKSLEMMWSTDDTVGNNSLFTGALSGTYSAPKGFCFDVLCDDDPMIDDPKLEGFNVEQKVNAFLEAAVEEAKTKRHNHVMFTMGGDFSYGSANRWFTNLDILINAANERVTNSTGIRLFYSTPSCYAKSVRESIKIL

SEQ ID NO: 148609 - protein, 460 aa, Heterodera glycines
  Coding regions on vcDNA: vcDNA=SeqID_75032; Strand=-; Position=1 -36,142-198,252-276,325-365,413-474,520-570,629-677,733-816,868 -945,998-1045,1205-1261,1302-1396,1453-1512,1565-1762
  Homolog annotation: Hit_ID=NP_502222.1; Match level="QueryCoverage =84%, HitCoverage=97%, E-value=1e-85, Identity=47%"; Hit description =putative protein, with at least 3 transmembrane domains (4M505) [Caenorhabditis elegans] pir||T23162 hypo
MQLVHIDGDADLTIHNISILPADQCTTEEQRTAKCCCGTGTAKCCCGTGFFYDFNQQKCLVSFFYDFNQQKCLVSANVAFMANVAFMFGRINDAWPHVAVYGFVYPMLVLLMFVYPMLVLLMIAPLSAVMLGMSRREKREGDRMLGMSRREKREGDRRFPNPLYQLISLLCFCAWVSLLPNPLYQLISLLCFCAWVSLLSPLPFTVWYYVLGDGLRQMNQSVYYVLGDGLRQMNQSVAMCHLYRTSMEVIPHTMDTLVTVIPHTMDTLVTLFSVLLKILRFLTQYHRSTLKLRTIERFSRAILFIERFSRAILFIIVISVLLGILRFFEHDAALYSFCMDTEPGPFWAQRCMLTDFCMDTEPGPFWAQRCMLTDGPLISLLGRPFWKVFLPLADLGPLISLLGRPFWKVFLPLADLFAQFLLPGSCLILLHIGFNREPVLEIGNENSHNRFGRSLRDQTK

SEQ ID NO: 148610 - protein, 193 aa, Heterodera glycines
  Coding regions on vcDNA: vcDNA=SeqID_75033; Strand=-; Position=1 -136,525-680,783-1071
NELLVIRERQTKDSQHENWLLRGRLPRGAYSGYKAQPISALFRYSFRLVCLVFLEALAKRVLEVRSGQMESLANLATKDRSETQAKIMDDISKIKIVRLTGPRGGPGNAGFDGQPGERGPNGPRGYQGGRLIPDDFAKWNEVQNVGHQARPAFMARGALTVHLVNPAKQNSSPTKCHHKTQKKRWKKAPMARM

SEQ ID NO: 148611 - protein, 202 aa, Heterodera glycines
  Coding regions on vcDNA: vcDNA=SeqID_75034; Strand=-; Position=1-606
MINSNKSKEKPTEEEKAWTNACQIIQNLDSKKIIEGQNEIAEIVKNIGEMCQRERIATDSDETKRQIQKFTTNGPFILSHMKATEKELQKLNEKNANEKFRHKFAHLASKLCSKVLPEGHYKNAVIEFLQIKKDQMLWPSDLAQFLLAKLDDCLATDTFRLRRMRRALELESSREAERSERSIWFHIYCVFIMVAIAIVFIY

SEQ ID NO: 148612 - protein, 47 aa, Heterodera glycines
  Coding regions on vcDNA: vcDNA=SeqID_75035; Strand=+; Position=1 -134,247-256
MTPRNDTRTETHKTREISRLGNREPKNLNEIDSNAFLNQKHIKRGTY

SEQ ID NO: 148613 - protein, 68 aa, Heterodera glycines
  Coding regions on vcDNA: vcDNA=SeqID_75036; Strand=-; Position=1 -74,543-675
MALKKWAANLRDKIRGSDPDLYAYGNIRQLACDLLNYPLSLTIQLIPRLSFAFVLCHLFLLLFYARKM

SEQ ID NO: 148614 - protein, 171 aa, Heterodera glycines
  Coding regions on vcDNA: vcDNA=SeqID_75037; Strand=+; Position=1-516
MTAQFSAIAERLGEIERKINNNGIGSAEEKERKRSLVLIGLPESEEEVSSLRAKDDAKTVEEVLDRLDVEVCPQMVYRMGRRIDEKRKGPRLVKVVLPASTFQRFALMQWGRRRTELKKRPGWERLLVRPSLTKEELEIEREQRQKKWMEFGKKKTGENITTRRGGNEKNF

SEQ ID NO: 148615 - protein, 75 aa, Heterodera glycines
  Coding regions on vcDNA: vcDNA=SeqID_75038; Strand=+; Position=1-226
RDSNVPLRPEIFSISGKKSKFFRKKYQSIELEKLCLWKWSPFLWEKSLKNPKIQKPENLFLGLARKIFKIFEILK

SEQ ID NO: 148616 - protein, 453 aa, Heterodera glycines
  Coding regions on vcDNA: vcDNA=SeqID_75039; Strand=+; Position=1 -1114,1160-1407
  Homolog annotation: Hit_ID=AAC06263.1; Match level="QueryCoverage =97%, HitCoverage=61%, E-value=3e-56, Identity=32%"; Hit description =pol [Schistosoma mansoni]
MTAKIPEIWKKSIICPVPKIQNPVNPVDFRPISLLCSVSKILEENIAGKIKNFVEKNNLLPNCQHGFRKAHSVTTQLLEVVDDFSFALENRKSIDVIYFDLAKAFNTVPHNRLISKLQNIGINNSLLKWIQNYLENRKFFVKIGSDFSDEYPCLSGVPQGSILGPLLFLIYIYDLPKFCETENVKIKLFADDLKAYHVLSNISFSPLQNFINKFNRYCKLNGLKIASNKCLTLHLGHKNQKINYFIDDFPIPKNPGNEPVRDLGIYFTNDLKWAQHIEIISKKALRSAFAILKSIKTGDTKILVNLFNIYCRPILEFGSPIFNPYLKKDIEKLENVQKTFLRVIFRRNNYAADLPNYAELLNIYDQKSLESRKINLQNNESFSFSKNIVKNEYTIRTAYCSTNARYNSFFIRTSRLYRLLPKETRLLNSNEFAKLLERSDLNLLISLPPQLQK

SEQ ID NO: 148617 - protein, 382 aa, Heterodera glycines
  Coding regions on vcDNA: vcDNA=SeqID_75040; Strand=+; Position=1 -128,178-262,823-933,1645-1731,1846-1905,2042-2125,2172-2295,3429-3898
  Homolog annotation: Hit_ID=NP_498954.1; Match level="QueryCoverage =17%, HitCoverage=43%, E-value=4e-15, Identity=55%"; Hit description =PilB-related protein (3J934) [Caenorhabditis elegans] gb|AAA28039.1| Hypothetical protein F44E2.6 [Caenor
MYKKQAPFTGKFDKHFVAGGKYTCVCCGAALFVSEQKFNSGCGWPAFSKSIGDDQNIVRLPDNSYGRQRIEPGLGRGTVVQIQHYEAADCHRLFLSEHCQDISHGPFEVQLLTDAYVAANRLKLTNSAFDQKARQLQLNMERHMISTGAATVDDVDLAQIQTDDKLREAFGLWRDFRDSSVAYLEDFYARFGTKFDRWDAESYHVVEGARLTDEMIQSGLCRLTRDDCLPSSKQSLHFLFSQLFSSGWHQRFAAPCTSPQGLLESLYSNHFGAISESAMHTLMVPFQEKFSRLCSLEHAHHEHMERIRALNADGEWKLNMEMREPGQKLARRIQEFDTVVLTAMKKMDPNPVAIYLVGDDGLESNLCQCFSNKNTRRATLSA

SEQ ID NO: 148618 - protein, 19 aa, Heterodera glycines
  Coding regions on vcDNA: vcDNA=SeqID_75041; Strand=+; Position=1-57
MNGFFSVWRRRWVVKLPAR

SEQ ID NO: 148619 - protein, 121 aa, Heterodera glycines
  misc_feature (6)..(6): Xaa can be any naturally occurring amino acid
  Coding regions on vcDNA: vcDNA=SeqID_75042; Strand=-; Position=1 -65,138-221,392-475,578-709
  Homolog annotation: Hit_ID=XP_320857.1; Match level="QueryCoverage =77%, HitCoverage=27%, E-value=3e-26, Identity=45%"; Hit description =ENSANGP00000004837 [Anopheles gambiae]
ICTGHXIDIHQRIHTGEKPYQCHLCDARFTQDGQLKTHILIHTGEKPYKCTYCPQKFTRAGNLTTHLRRHTEKKPFMCSHCGKQFAESSNLQIHLLTHYRKRKANGQLSNRMNELVPQKIV

SEQ ID NO: 148620 - protein, 146 aa, Heterodera glycines
  Coding regions on vcDNA: vcDNA=SeqID_75043; Strand=-; Position=1 -48,324-716
  Homolog annotation: Hit_ID=EAL35225.1; Match level="QueryCoverage =100%, HitCoverage=15%, E-value=5e-12, Identity=37%"; Hit description= hypothetical protein Chro.30409 [Cryptosporidium hominis]
MEDNNHHLLFAQKINECVTVEQEEVRKLGGEEENERIKEELEQEEKEVNEEEEEEWEENNGRGEEEEQEEENNGREEEEEEGERVKDEGIMAEGHDNYGMENGTESTLGTQFQAHTKFWHNENLEIKKTNFLRIRIFEDLFFRIFY

SEQ ID NO: 148621 - protein, 149 aa, Heterodera glycines
  Coding regions on vcDNA: vcDNA=SeqID_75044; Strand=-; Position=1 -126,521-604,679-762,1016-1171
MFATVVTALEHQKLKSAHNALQQKVEQMEEKFSQKIQEKENEIAQVKRANERMQKKMDEALERIGRLNELMESQMIHFYEQQQQRLDNDGTFIAGIDEDNIMMKKNKPFEIFMRETFSEVIQNKSCIQKSRVPRDREFLPKPGPGLAGT

SEQ ID NO: 148622 - protein, 107 aa, Heterodera glycines
  Coding regions on vcDNA: vcDNA=SeqID_75045; Strand=+; Position=1 -185,229-367
MKMTNLKRKCIKSVSRKCQHKQKCQMKNGQMCRLGTAAFVDYYQFLCASLARNGREMKTEKEKIEEIGRENRESKKAKEIKEKKKRKRSDTERKDREDVCGVQCEKR

SEQ ID NO: 148623 - protein, 48 aa, Heterodera glycines
  Coding regions on vcDNA: vcDNA=SeqID_75046; Strand=-; Position=1-145
MKLISLAPLVICSLFFVGTPVVLSDGKGAPPPPPPPPPPPSSYGGPPP

SEQ ID NO: 148624 - protein, 353 aa, Heterodera glycines
  Coding regions on vcDNA: vcDNA=SeqID_75047; Strand=-; Position=1 -127,163-324,385-641,958-1029,1520-1963
MNFHFHFLFSFFFAATVVIGNTIDCFKLNLRINFSKEADLYVLIVREIKGAEKIVNSNCTKCQIEIEEEIQILGNYWPEKIQFEAEIHTKTTNESEVIVRQFELFVYNPNLKKVLELNLGNLTTSGKVEKNVIFGEMVPENVLLFGAFFVDLGKTNLSPNRRAKEVVHLGTEQIEIKRGNSNDFQENAQIVQMHSNSNNNDNSSEKSFNLPPFLTANNNGNGQQQQQQSGILYWNYQQKLSKILDHEQNGTFKHRQAAGALNEIKQYIRELNNKIAEFFGGKGYLDKLTLKQQNDSNKIASVDTVRNLLKLIAKVEPGQNAKDLLQQVENVGQVLDAIAKQAFDTMEMMTENE

SEQ ID NO: 148625 - protein, 117 aa, Heterodera glycines
  Coding regions on vcDNA: vcDNA=SeqID_75048; Strand=-; Position=1 -103,209-459
MDEFDNKNCQSKSIKRRKFSLLIGHKKLNIRIVNANSPPQQLPPADVPLPFQCHLCTAQFLKQCHWAWHCFIAHYGERADTAGETLLMTSTGEEHGEESAAIGTNDDGIPSLMVIKA

SEQ ID NO: 148626 - protein, 140 aa, Heterodera glycines
  Coding regions on vcDNA: vcDNA=SeqID_75049; Strand=-; Position=1 -156,208-290,350-448,591-674
  Homolog annotation: Hit_ID=NP_494974.2; Match level="QueryCoverage =97%, HitCoverage=16%, E-value=2e-39, Identity=64%"; Hit description =Adenosine/AMP deaminase (85.4 kD) (2F499) [Caenorhabditis elegans] gb|AAO21474.1| Hypothetical protein C3
MSPLSNNHLFLPYQRNPMPEFLMKGLNISLSTDDPLQFHITKVIHLNEGFDYEALMEEYSIAHQLWKLSSCDMCEMARNSVIQSGFEVSLALFLGVDHFLPFVQFFCSFGRTGTNVPDIRVSFRHEALVSELYNLFKALM

SEQ ID NO: 148627 - protein, 216 aa, Heterodera glycines
  Coding regions on vcDNA: vcDNA=SeqID_75050; Strand=-; Position=1 -56,164-185,244-307,399-499,545-585,635-756,898-1042
  Homolog annotation: Hit_ID=CAE59064.1; Match level="QueryCoverage =91%, HitCoverage=19%, E-value=2e-60, Identity=63%"; Hit description =Hypothetical protein CBG02349 [Caenorhabditis briggsae]
QVPHRDFYNIRKVDTHIHASSMNHKHLLRFIKKKMRTDAHLLRFIKKKMRTDADEVVQEKNGQNGQKVTMAQLFEKLGIRAYDLSVDMLDVHADRHTFHRFDKFNTKYNPLFHRFDKFNTKYNPLGQNEGQNELREIFIKTDNYVKGKYFAEVMKEVLTDLEESKYQQMEPRLSIYGRAKDEWDKLARWAIGHDVSEQNFKKEMIQWHNVIPLIGK

SEQ ID NO: 148628 - protein, 192 aa, Heterodera glycines
  Coding regions on vcDNA: vcDNA=SeqID_75051; Strand=-; Position=1 -136,191-631
  Homolog annotation: Hit_ID=EAL19820.1; Match level="QueryCoverage =98%, HitCoverage=9%, E-value=3e-09, Identity=25%"; Hit description =hypothetical protein CNBG1130 [Cryptococcus neoformans var. neoformans B-3501A]
MAKKSVIRKLQSKKGAQKRWTKWENKREERQEKLERARKAKSAKKTALQPNPNAETPQQDEAGPSTSAASAEEAMEPPPPTPGPGPTPEMDEEILEFDDPPPSTPATPIGDLVPFPSTPTAPMDTGETTPPPLAIDERSERIEQLEKQLKDRDDTIQFLREQVRNREALISDLRRQLEQCAAPPTATPTTSK

SEQ ID NO: 148629 - protein, 25 aa, Heterodera glycines
  Coding regions on vcDNA: vcDNA=SeqID_75052; Strand=+; Position=1-76
REKKIMFFSGTLYLLVHISFFETVC

SEQ ID NO: 148630 - protein, 323 aa, Heterodera glycines
  Coding regions on vcDNA: vcDNA=SeqID_75053; Strand=-; Position=1 -172,427-530,583-672,722-831,1102-1334,1382-1501,1543-1683
  Homolog annotation: Hit_ID=AAT28330.1; Match level="QueryCoverage =99%, HitCoverage=66%, E-value=1e-133, Identity=65%"; Hit description= catalase [Haemonchus contortus]
MAHFARERIPERVVHAKGGGAHGYFEVTNKDIAKYSKTAMFSEVGKRTPLFIRFSSVGGEAGSADTARDPRGFAIKFYTEEGNWDLVGNNTPIFFIRDPFLFPNFIHTQKRNPVTHLKDPEMMWDFWTLRPEALHQVMFLFSDRGTPDGFRHMNGLSNVVIGMGLLKDYAIRDLYNAIASGDFPQWDFFIQVLPYIPFLLLHLSFEVMTFEEASRFRWNPFDLTKVWPHRDFPLLPVGRIVLNRNPQNYFAEVEQSAFAPARIVPGIEFSPDKMLQGRLFSYPDTQFHRLGPNFMKLPINCPYRTRVRNTQIDGWACFDDNRG

SEQ ID NO: 148631 - protein, 78 aa, Heterodera glycines
  Coding regions on vcDNA: vcDNA=SeqID_75054; Strand=-; Position=1-236
TIVQLFALVVQYSQSSNWEGRVTAAELLNALLEETDKNFEDELVKTKVKFNREKLAQCLRAIDALSMREVLDTYRTLV

SEQ ID NO: 148632 - protein, 508 aa, Heterodera glycines
  misc_feature (34)..(34): Xaa can be any naturally occurring amino acid
  misc_feature (503)..(503): Xaa can be any naturally occurring amino acid
  Coding regions on vcDNA: vcDNA=SeqID_75055; Strand=-; Position=1 -208,347-513,565-664,888-936,1001-1185,2224-2337,2466-2630,2959 -3168,3452-3589,4003-4161
  Homolog annotation: Hit_ID=CAE70374.1; Match level="QueryCoverage =97%, HitCoverage=34%, E-value=1e-142, Identity=53%"; Hit description= Hypothetical protein CBG16933 [Caenorhabditis briggsae]
RNVYLIENGCHLFFVFPKFLCWEICIVFCLFILXLGLINSRFAIFSCVFYFASVSLYQGILMVAYSTAYTMLPVFSLVVDTDVTAKNALTYPELYKELGKGRSLSYKTFCIWVLISLYQGAIIMYGALYAFAIIMYGALYAFDDDLIHIVSISFTALIITELIMVAMTVHTWHWAMLVAQALSLTLYALSLTLYGASLIIFDKYFDRQFVLSWEFLAKTTVITLISCLPLYVIKFLRRRFSPPSYAKVKMGVAFVLCCFSVAFTPSLFIFRRFVAPDPLRIILFVLGAFFWLCSLLLSAVVFAVRPNLLLVAIFFSILFQEVARALFYLLLYKTQRCENHGADANRTGTVSSMRLLYSSRHILAIVCGLGMGTAAALFHLANVLAAYWDDGVVGLPGAVQANRTMAEPTDAFFPLFYALGCALLTLFNIVWTVCSWDAFHRCCYKIGRPSAWVTTAVSIVHHIFVCLCQSLYLGVSPLVVLSLQLFLLLLGVVYAYFLIKRTXKSCSN

SEQ ID NO: 148633 - protein, 116 aa, Heterodera glycines
  Coding regions on vcDNA: vcDNA=SeqID_75056; Strand=+; Position=1 -69,117-194,406-482,538-665
CVKSSSLCSMVIAVDHVSVFLPMTLRSRHCAAFLHHRRPQLQFGQQHRKTFPFNNKAVMDGLPNNKRNKHKPLYALASIPEEEETKKNGREKPALVKDDKYGDNYFEDCYYQSTWV

SEQ ID NO: 148634 - protein, 105 aa, Heterodera glycines
  Coding regions on vcDNA: vcDNA=SeqID_75057; Strand=-; Position=1 -142,267-442
MSPCRRFKSRPQKKNSEYKWLHIVKRQKHRQQRHQQNHFNEMCVAFQRCAFLKEDIDKQMTNLIFTITKIEERSNGLPDPQAAHLYGIVKEQLERTVRQIEKDCL

SEQ ID NO: 148635 - protein, 637 aa, Heterodera glycines
  Coding regions on vcDNA: vcDNA=SeqID_75058; Strand=-; Position=1 -118,220-1068,1252-1459,1815-2233,2318-2634
  Homolog annotation: Hit_ID=CAH93732.1; Match level="QueryCoverage =77%, HitCoverage=71%, E-value=8e-09, Identity=19%"; Hit description =conserved hypothetical protein [Plasmodium berghei]
MFAWKQMVEEYGDNLADLYKITERVNKKFGLCVIIEGETQLKCSAINVENAEVFVNHFYKIVFEPEFEKNLAKRSELIATNFFNLLRTEQRKSFQDLEGENEQKAKNNAKNWKLAEPSMRVRVQVLVNTAGTKCQQLIKSHYKFVSNKNKQKVKETKAKKLQQENKNQKDKKKKDIDSKNEQNLTEEEEERKDLMTENYTKRLDELNSDFATCIYHYMYAFSENLIKKIEDINGENSYNKELKDIYKNLRQKTRKRMESVYNSEGLENMDKWLNGENEPSASTAKKGEDEDENEEETWEDPFNDCANVVEDHVEADTLMNREGELMDKSFDDHLFQCASQFFEAVRRDQFDYKLFVNQHTMQLDTAMKFPSSMNGIQLNNGQNTKDKCLIMRELLLSLNQNLAHRLNYEKITLREEKENLVSLNEKYGKLRLDKMDNKWLLLEIGKKIGQGYEKWRLTNSLGTLTHPIRDQYRIGREFVGQMLEDYGISDTYKKGQEAVVLTINKLSESLGTPKNQKTKIDRKEDGPVKDLGNEKIGQVRKTLKECIEEDQDKDECDQKIMEMQIKIQKHPLTKRLEAYKMFFRAFYIALAMELFERMSNQAEENWHFVFRSNETDQVGILTEKDKANVAKIKEQRE

SEQ ID NO: 148636 - protein, 113 aa, Heterodera glycines
  Coding regions on vcDNA: vcDNA=SeqID_75059; Strand=-; Position=1 -73,134-402
MLTNYMQLFLLTLLLFVFMNNFSEAINCRNFSVKSAQFAAENFHQIPIEGKGKDKIVQNFVESIKQKISESKKAATDQPKKLEDIIGDPDTIVNNARKMITLATRCSLSREEV

SEQ ID NO: 148637 - protein, 58 aa, Heterodera glycines
  Coding regions on vcDNA: vcDNA=SeqID_75060; Strand=+; Position=1-174
QKPFPGGVHVRLLPNSKNNGRPLIQSANISSTNGEQQKNLIAVVEQHLEQYTKDLVKE

SEQ ID NO: 148638 - protein, 194 aa, Heterodera glycines
  Coding regions on vcDNA: vcDNA=SeqID_75061; Strand=-; Position=1 -48,598-747,1244-1343,1400-1686
MKETQMKKEIDELTPEKTYIFAIVLMVNMVQIIASSLIYLNGYDSQMNSLETIDNYFLIIGRIFKSSHWATNVQLEGTFCVFFSVILYALIAVAVQCRKVPSNSNSTQFNNRIFRSLFAIIFANFGGYLFACSVALIYKLLNINESNAIVLWHSSQIVGILCHISASSSGLILYLTRSKWVNGNSYNKIFTKKA

SEQ ID NO: 148639 - protein, 45 aa, Heterodera glycines
  Coding regions on vcDNA: vcDNA=SeqID_75062; Strand=-; Position=1 -120,474-491
MALGGWKRERARLRSLQNLNRLFVRPALTKEQLKEEYEARTYFKV

SEQ ID NO: 148640 - protein, 272 aa, Heterodera glycines
  Coding regions on vcDNA: vcDNA=SeqID_75063; Strand=-; Position=1 -73,445-714,1112-1209,1709-1898,2150-2336
MQIRDQGLQILREQVNKQSTGRSIPFVPPYVWRLAVLKHNDFIFEEMQRNTEEMDRKFEEMEKRLTTKFEQFREDTFELLDTIVERIEDGNKEIAHFCRHTAQTMDLLALNITTTMTAEGTFGGGQLTAAAPSAATSAARGGEFSAKVSLSTAIRQGRLDNPGVDSAIKSNCEKSDKALFYEHAESLQSLLHDFPRKLRNECTDRTSINIAISDFEARFMSSLDEMNSVMNGLRSSIDAEEVAKLKEIVQTLSKWALHIHEKAENVSKVSTI

SEQ ID NO: 148641 - protein, 23 aa, Heterodera glycines
  Coding regions on vcDNA: vcDNA=SeqID_75064; Strand=+; Position=1-68
DINIYLIYFTIFTIDQNIGGQKV

SEQ ID NO: 148642 - protein, 188 aa, Heterodera glycines
  Coding regions on vcDNA: vcDNA=SeqID_75065; Strand=-; Position=1 -161,217-429,489-578,717-816
  Homolog annotation: Hit_ID=NP_872022.1; Match level="QueryCoverage =80%, HitCoverage=43%, E-value=1e-15, Identity=32%"; Hit description =Cystinosin/ERS1p repeat (42.2 kD) (2I426) [Caenorhabditis elegans] emb|CAD56564.1| Hypothetical protein C
MRWPIVLSIFLMGIYRTESILHDHLKISKDLPVECPKELSVSIGHEVSLVLSSKKRFEYNLNLVLNTSWTVLKLTPERITLKKEKDSQVQVNVTGLSLSSRTYIELQNCSLVFDNGSFADICPFDPLDFFIPVTVVRSKTISVLVILSGWIYFVAVIGLNFDFLLLNVIGFSCYTVYNVLLYFDPNVQ

SEQ ID NO: 148643 - protein, 91 aa, Heterodera glycines
  Coding regions on vcDNA: vcDNA=SeqID_75066; Strand=+; Position=1-277
KLVDNLRHRSLSVDQHIGLELMSIAAGFCSRDRTTGVGGIPSRDPDRIPIPMNPEDFFRDPAGLSGFAKTQFFLNGFLIFSFVLSFVQVLI

SEQ ID NO: 148644 - protein, 75 aa, Heterodera glycines
  Coding regions on vcDNA: vcDNA=SeqID_75067; Strand=+; Position=1-228
MEIFRKIIVTSVPRDPAGLVKWSGGIPIRDPDEILIPINSDEFKKSLGMDPEFNPAGSRSRPVSILQTEQLWLPP

SEQ ID NO: 148645 - protein, 105 aa, Heterodera glycines
  Coding regions on vcDNA: vcDNA=SeqID_75068; Strand=-; Position=1 -304,549-560
MAYEALTDKVSQAFCWGKWLGEKCVHYGKVLLGFLVEKLLTALAACPKLEKVAKTITDIFGIGEKANPIEVKKGMSVCEVVKQYTIMQVKQEIPNVVNTVSRTVP

SEQ ID NO: 148646 - protein, 82 aa, Heterodera glycines
  Coding regions on vcDNA: vcDNA=SeqID_75069; Strand=-; Position=1 -61,285-472
MVAAQLELFRLNRIPPIMLHGALYQRMCRRIPEIRAMCEKAGDKCLYAFIQILEAWAFWNNKIAYEIDKKIAETQKEGKSVK

SEQ ID NO: 148647 - protein, 144 aa, Heterodera glycines
  Coding regions on vcDNA: vcDNA=SeqID_75070; Strand=-; Position=1-435
MAAPMRIVPVDNMNSGIIEKNSQYSNGLQQCVQSLQDVELTPPSLHISHKNNLGFFLSKKADITSITGTTGNTDEQDFSGNTFNIMNITLPRFKERKYTKDDDKLCESDEEWLKSIREKVEEASQPTEFIALKIWNSGGGKFSN

SEQ ID NO: 148648 - protein, 170 aa, Heterodera glycines
  Coding regions on vcDNA: vcDNA=SeqID_75071; Strand=-; Position=1 -220,282-571
VNSVRPSSELSSTNGGGSAATNAGGAMNGNGFMAPSLPYAVSPLLPSSVVQQPSVAAADPLAQSPCCVRTSANVCCRTVSMGPMPGPAPPATAAFFLPTAHIPSPTGEKMSPPAPTAPLAAVAAAAVASTAAAGATTVAAPLMAPPTATSVQFAAQLPQPQQQQQQQQIR

SEQ ID NO: 148649 - protein, 72 aa, Heterodera glycines
  Coding regions on vcDNA: vcDNA=SeqID_75072; Strand=-; Position=1 -54,140-304
MCRNPKINNDETYARILTAYGKLHTMQPAYAALLYIVEIQQCEGYGEELFPCKVCERFAKQKKKKMPTFKFE

SEQ ID NO: 148650 - protein, 80 aa, Heterodera glycines
  Coding regions on vcDNA: vcDNA=SeqID_75073; Strand=-; Position=1 -111,410-541
MRWVEPDKPIRRQLERWACRRGQKWAVNLAILHACANVFTLHDTVSRSIYYTLLKLDVLQSNKFATLELDKCINLGNLNI

SEQ ID NO: 148651 - protein, 77 aa, Heterodera glycines
  Coding regions on vcDNA: vcDNA=SeqID_75074; Strand=-; Position=1-234
MRSIGNSALSAAVTQLALIGSSNVVARRHQTEVHNRESENRSGSRTRAPGAAVIGDGWSEAEKCRFFLCLSAGFTIQ

SEQ ID NO: 148652 - protein, 36 aa, Heterodera glycines
  Coding regions on vcDNA: vcDNA=SeqID_75075; Strand=-; Position=1 -85,354-379
MTNILMDDEQNGAEKYQAKTRSKDQIFPGIKTKYII

SEQ ID NO: 148653 - protein, 232 aa, Heterodera glycines
  Coding regions on vcDNA: vcDNA=SeqID_75076; Strand=-; Position=1-699
MTEHNFEQNRRTNSSIVHEGNVQFDNENNGIEMDENEIRRLLLQVKVLQDGNAELARHGEQDIGRRENGRPISDEAQRPPITRRAQPYADSLHMPNEFRENDRSLHPGLVFDGMMAQAIRSLDGFSYTMTLNAIPNLDGNRGSDSVNAFFKQFDVATEEWPEDKRLRALRSKCFGKAERAFNSAVDANRHDYQLIKRAIIRQLDNTDAKQLTSFDQLMRGIRRRPNESIDEL

SEQ ID NO: 148654 - protein, 74 aa, Heterodera glycines
  Coding regions on vcDNA: vcDNA=SeqID_75077; Strand=+; Position=1 -69,559-705,1139-1147
MDRKASTSKRKEQTKKARNEQEKEASDSEDTDYESDLNSNLTCVRDGKFEELLVRVRNALKKRKQPKIDSLRDV

SEQ ID NO: 148655 - protein, 33 aa, Heterodera glycines
  Coding regions on vcDNA: vcDNA=SeqID_75078; Strand=+; Position=1-103
LNFLIFLFLAASIFYSNLSVWSDVRQMEKIIKI

SEQ ID NO: 148656 - protein, 307 aa, Heterodera glycines
  misc_feature (51)..(51): Xaa can be any naturally occurring amino acid
  misc_feature (137)..(137): Xaa can be any naturally occurring amino acid
  misc_feature (216)..(216): Xaa can be any naturally occurring amino acid
  Coding regions on vcDNA: vcDNA=SeqID_75079; Strand=+; Position=1 -87,1291-2136
  Homolog annotation: Hit_ID=NP_493879.1; Match level="QueryCoverage =76%, HitCoverage=60%, E-value=5e-40, Identity=39%"; Hit description =transposase family member (2B289) [Caenorhabditis elegans]
RAGPGPKHGQLSTTEYRGPGFDRDRDQSRFIDTDIKVRKLLPILLNENFLXASVGWLQKFLKRHNFVLRMKTSVCQKPPSNYAEAVAKFINFVEQRRKAKNNFPGGIFAMDETAVWFDCPDNRCIDMKGAKDVISFXKLFRAISSNYVTVVATGHEKMRVTVCLTARSHKLKPYVLINRKRPVPQIINQFAGKLVINFDGSVWMNDDTTEDYLHKXSGQSFVGERLLVWDAFGSHKSERTTKVVKGLGVETVFVPGGCIKFIQVKASFSMKFTFFPRLPMSFMVLDWIHRSWQEIAKEVIIKSFEGQ

SEQ ID NO: 148657 - protein, 80 aa, Heterodera glycines
  Coding regions on vcDNA: vcDNA=SeqID_75080; Strand=+; Position=1 -107,484-619
MEQALTKHIRSLADFSAQQRTDAGVPFYLENPAFAGSPLQKGRNIRTKSLEEEYQIMKFKADSIQKATKEMTNFFAKPVI

SEQ ID NO: 148658 - protein, 408 aa, Heterodera glycines
  Coding regions on vcDNA: vcDNA=SeqID_75081; Strand=-; Position=1 -156,274-408,719-878,1032-1100,1185-1272,1337-1430,1899-2033,2285 -2415,3274-3532
MRRVTTEYNILSGASFDTLAHLGKISEKAKNFLKLTGPAGSILAAFAETVFPPEHPVLKSLAFLHQHIDRKFEAQGRFIEGALSSLRSAQDLNHYDTFINTKVNINCKKQKTREMLPIISEVKSVFDEVFVIINDQKYATSYENFFTTYIVVLESFESLSLGQANETLADLRELFTKKDGPDFDLDELIRSIFAVVPGPFSDVCLLRSVYESYAAKRNELLRLSESVTIDVIETALIGGFCANLSFSGAAEQVKEQLDELGSYVRDITGNMSQWIGKELSDAWPEEVIRNIKREITKDITDPYAYNTTANRINNEVLSRGPLGQNDKLFDLGTMIATIEQQTGDLTEHSRFRSFVILHISTWTSKACVIPIGLSTNQFLNYSGFGYVEMYAHHLFTTNDELYKLFLFL

SEQ ID NO: 148659 - protein, 108 aa, Heterodera glycines
  Coding regions on vcDNA: vcDNA=SeqID_75082; Strand=-; Position=1 -114,852-1064
MWRKELDAEAEEGAKWEEEKEEEKPWDVIDLPIFGKLEIWINDRASNKMLQKCLISAIDNLIKTLEIPFVAIKQFAFRVRVYGDAYFDNTYTASLKMCSIKTFNELNL

SEQ ID NO: 148660 - protein, 115 aa, Heterodera glycines
  Coding regions on vcDNA: vcDNA=SeqID_75083; Strand=+; Position=1 -9,257-319,833-984,1047-1167
  Homolog annotation: Hit_ID=AAC47723.1; Match level="QueryCoverage =71%, HitCoverage=31%, E-value=7e-09, Identity=39%"; Hit description =adult-specific muscle protein-1 [Angiostrongylus cantonensis]
MDEESSTPPLETDNGQCEMCANYEIFMDSVNRSEERVALLAKKQETDLADMGHELDVAKEQQTALQTELKTLYEKYQRMLHKNAQKADEMREQCIDLPQTVDELTLLALQLREDL

SEQ ID NO: 148661 - protein, 106 aa, Heterodera glycines
  Coding regions on vcDNA: vcDNA=SeqID_75084; Strand=+; Position=1 -206,457-571
  Homolog annotation: Hit_ID=CAE56846.1; Match level="QueryCoverage =100%, HitCoverage=20%, E-value=1e-12, Identity=34%"; Hit description= Hypothetical protein CBG24673 [Caenorhabditis briggsae]
GSASSATQSQAAPPKKLTAEELEERRRAMLTNASWRDDMRERNLRDAADKLRKEQDEMANNRGGAGFMRPMMNTATEDASIEKRLQSNRMNIQRQHDHMDKSFVRK

SEQ ID NO: 148662 - protein, 264 aa, Heterodera glycines
  Coding regions on vcDNA: vcDNA=SeqID_75085; Strand=+; Position=1 -152,215-335,385-645,805-1063
  Homolog annotation: Hit_ID=AAC47722.1; Match level="QueryCoverage =96%, HitCoverage=49%, E-value=9e-22, Identity=29%"; Hit description =Native 66kDa protein [Angiostrongylus cantonensis]
IFMDNVNRSEERVALLAKKQETDLADMGHELDVAMEQQTALQTELKTLYEKYQRMLHKNAQKADEMREQCIDLPQTVDELTLLALQLREDLISEKASREHECQELRDELTVAREQMLESEQQLLIYAQHAQQQQDHMEQLLHQHRISVGEEGGGAAGGETGGNSGGSRRQRAGGQPDMHPSNAVVRSPREQRRQQQQQTPTVVEVGDADCCCPDAKCHEQTVELERRLHRSMNERAQLQELLIEQRNKCSQMQSELDTSEAVQK

SEQ ID NO: 148663 - protein, 82 aa, Heterodera glycines
  Coding regions on vcDNA: vcDNA=SeqID_75086; Strand=+; Position=1 -143,403-508
MTNHHPSDPSKILPGENPANASNLLRKINTIQQKCSKFFISIGLLGPSGELAKPEQTQLDKLARRGELERDIEQLNEQLAKL

SEQ ID NO: 148664 - protein, 265 aa, Heterodera glycines
  Coding regions on vcDNA: vcDNA=SeqID_75087; Strand=+; Position=1 -85,312-701,889-1211
MANFFIIPRRKTIQLLLFIILFKITLQQDSLIETKQLVDQAKSLFNQVNEGKFDADSSIEWIQKNAIGILSNSEFESKMDESLKKLQNEFCDSLENGNYQKMMKIFQTTKIEKKTFDKRQMDKAIAKDQINKGKNKQMFKQLFNNSSKILEIHEDLIEAERLAVRQQQMPNGFMGRRKKRARDSAIKGCVTAVLLTLISAPYLGYYSNKYANEGNVMVQVNRCKKRFNVRHCYQVQQSVVTQIFEWTILLAIGLICALIFCSCVR

SEQ ID NO: 148665 - protein, 158 aa, Heterodera glycines
  Coding regions on vcDNA: vcDNA=SeqID_75088; Strand=-; Position=1 -237,794-1033
MAGEGRMRKKIDYDVKKDGKEFDQCQNALKIPKKYIYLFLYRNFVKRLYLSFLKDNNNVMMVYPSKESQTSVSNLNRTKVNRASEGSRMIPKLLDLTDKEKSYGCRGPTEVYRSKTLFEGIDSFPYHRFLTTVSLPPFPYQTFPYQPFPYHHFLYTFP

SEQ ID NO: 148666 - protein, 45 aa, Heterodera glycines
  Coding regions on vcDNA: vcDNA=SeqID_75089; Strand=-; Position=1-136
LILLFILLILLNPFRPTHPISSMATTVASIVLQLLILGTVVHLSY

SEQ ID NO: 148667 - protein, 130 aa, Heterodera glycines
  Coding regions on vcDNA: vcDNA=SeqID_75090; Strand=-; Position=1 -57,666-880,1486-1606
MSWHSFVQLVIIMAFTLDGGVDNESVIRFRFRHRQSPRIPADILDPSWRGAFYWRGAFYQRGALYCWISEIGHLIGGGILPERGIQIADLRPRTINYSTFSKIMTRKAETGLGFFVAPGVPGPVPTLTLE

SEQ ID NO: 148668 - protein, 248 aa, Heterodera glycines
  Coding regions on vcDNA: vcDNA=SeqID_75091; Strand=-; Position=1 -85,129-788
  Homolog annotation: Hit_ID=AAS07042.1; Match level="QueryCoverage =91%, HitCoverage=22%, E-value=1e-44, Identity=35%"; Hit description =minus agglutinin [Chlamydomonas reinhardtii]
MGWKLVSLFLCIAIIGIVTGYYPPPTTTACPPVTCPCGCKECYTTTPYEVPGTGSTSTPGPESSTSTPSEEPETPSSETPGPPGPSTETPGPPGPSTETPGPESSTSTPSEGPGTPSTETPGPPGPSTETPGPPEPSTETPGPPGPSTETPGPPGPSTETPGPPGPSTETPGPPGPSTETPGPPGPSTETPGPPGPSTETPGPPGPSTETPGPPGPSTETPGPPGPSTETPGPPGPSTETPGPPGPST

SEQ ID NO: 148669 - protein, 200 aa, Heterodera glycines
  Coding regions on vcDNA: vcDNA=SeqID_75092; Strand=+; Position=1 -572,1652-1687
  Homolog annotation: Hit_ID=AAC38846.1; Match level="QueryCoverage =99%, HitCoverage=88%, E-value=9e-38, Identity=40%"; Hit description =flagelliform silk protein [Nephila clavipes]
VLGPGGPGVSVLGPGGPGVSVLGPGGPGVSVLGPGGPGVSVLGPGGPGVSVLGPGGPGVSVLGPGGPGVSVLGPGGPGVSVLGPGGPGVSVLGPGGPGVSVLGPGGPGVSVLGSGGPGVSVLGPGGPGVSVLGVPGPSDGVDVLDSGPGVSVLGPGGPGVSVLGPGGPGVSLLGVSGSSDGVDVLDSGPGESGGSGSNSK

SEQ ID NO: 148670 - protein, 95 aa, Heterodera glycines
  Coding regions on vcDNA: vcDNA=SeqID_75093; Strand=-; Position=1 -102,147-211,297-417
  Homolog annotation: Hit_ID=CAE56797.1; Match level="QueryCoverage =92%, HitCoverage=17%, E-value=2e-26, Identity=65%"; Hit description =Hypothetical protein CBG24609 [Caenorhabditis briggsae]
DAQRLWRAGEARLGTDEIAFNSILAVQNFAQLRMVFDEYQRQHGHSIEQAISNEFSGDIRDANLALVKSIRNRASYFAELLHNSMKALINFQLLL

SEQ ID NO: 148671 - protein, 252 aa, Heterodera glycines
  misc_feature (60)..(60): Xaa can be any naturally occurring amino acid
  Coding regions on vcDNA: vcDNA=SeqID_75094; Strand=+; Position=1 -205,534-591,1030-1118,1221-1303,1352-1456,1632-1818
  Homolog annotation: Hit_ID=NP_741200.1; Match level="QueryCoverage =96%, HitCoverage=1%, E-value=7e-66, Identity=52%"; Hit description =mesocentin, extracellular matrix adhesion molecule required for proper gonad positioning and sensory map f
KAMMALAFWSCIICWTLANLGIVLATWPNQSLSRAPTDIGMQAAMRSLRRMERNTAADQXWHRRNGTGRCIISADQAVHFCGFEEEVNEPPIPPPFDGICMQSARSGRVICYPKYEDLDTTCTDAASINERSGLVAPPVIAHANVRTMAFVPPDNLVRTMAFVPPDNLQRLIRHYYRRYGKKDPKNETDKTRPFLFVKYGCDAGYEMVDEADTMFCRKGQWVQTAPICRGQGLCEMDNGGCSHSCISFSHNA

SEQ ID NO: 148672 - protein, 207 aa, Heterodera glycines
  misc_feature (5)..(5): Xaa can be any naturally occurring amino acid
  Coding regions on vcDNA: vcDNA=SeqID_75095; Strand=+; Position=1 -222,499-607,726-854,1019-1197,1361-1388
  Homolog annotation: Hit_ID=AAQ11020.1; Match level="QueryCoverage =84%, HitCoverage=1%, E-value=2e-40, Identity=43%"; Hit description =mesocentin [Caenorhabditis briggsae]
LESYXSPENNFESNSLMKKRPFLVKGLDAGNERDEADTRRKGQGEQTAPSSRGQGGEKDNGGGTHIYYGCFKVECRCPKGMVLEPDRKTCLPVPKNLCRKLAGCTCASIDDHQYSCACPSPTDRCLLMRGQPKIYLSPPPDYQVEPGGNLNISCAAVAFPFPQIFWEKGADAPQSGAGAGLVKSEQVLIIKEVSNISEMSCRFKAIH

SEQ ID NO: 148673 - protein, 182 aa, Heterodera glycines
  Coding regions on vcDNA: vcDNA=SeqID_75096; Strand=+; Position=1 -260,394-474,630-698,793-872,1195-1240
  Homolog annotation: Hit_ID=NP_741200.1; Match level="QueryCoverage =100%, HitCoverage=11%, E-value=4e-50, Identity=34%"; Hit description= mesocentin, extracellular matrix adhesion molecule required for proper gonad positioning and sensory map
WPHENVSEPHRLHTLRGLSPDTTYTVRIRAHDSMGPGKLSNPVSVHTLPPAKRPLLAIPEGNELRVPPKVPFAINCNLSRGDPIPQMHWESNGRPIRPAQDSKHIALQHIGLLMTTEFQCVAENEAGRTVQKVLVTVTGPVTGPSQPEQIRYHVDGITVILQWDEPKITNGPMADYEVFYTD

SEQ ID NO: 148674 - protein, 218 aa, Heterodera glycines
  Coding regions on vcDNA: vcDNA=SeqID_75097; Strand=+; Position=1 -378,437-715
MNTNLELSIWSNKTEDDQRIWDVLACQIWPIFAKSIRHFGFHDGDYLDKLRRRISPTLLTDLDQLISIDSGLLLPDGIADDRPNATAGQALSKWLHTPSKNGQPKQLHRNNYFGPPKLEWVNNFKETFRHATTSVTYKICFGVFLSLIEPFELVNERTKEKLTLTKGGDGTGEFNWLLERCPIIGETAAAVQKQQQKKDGNSDANLNKVFFRLYDDIG

SEQ ID NO: 148675 - protein, 218 aa, Heterodera glycines
  misc_feature (26)..(26): Xaa can be any naturally occurring amino acid
  misc_feature (36)..(36): Xaa can be any naturally occurring amino acid
  misc_feature (41)..(41): Xaa can be any naturally occurring amino acid
  misc_feature (43)..(43): Xaa can be any naturally occurring amino acid
  Coding regions on vcDNA: vcDNA=SeqID_75098; Strand=-; Position=1-671
  Homolog annotation: Hit_ID=NP_502797.1; Match level="QueryCoverage =68%, HitCoverage=43%, E-value=5e-27, Identity=43%"; Hit description =HASI (4P602) [Caenorhabditis elegans] emb|CAB16520.1| Hypothetical protein Y57G11C.19 [Caenorhabditis ele
YTPSEKTRCVPINRECQRKTLSFFLXFFVSFWRTIXYFYYXEXQHSLRSIELFFRLTEFFPRLKTIPSGFHTDWQCDLCIFDQLKKHNDGYKYLLVCIDVLSRMIFSAPAKSKKSEDMIEAFDRVFEKSKIIPMKIYSDSGLEFQAGKIKNILRKNFIKNVMYSPDLHAGVVERANRTIKERLYRYFTKKDTLRVDVIDITTNINNSVRTLVKPSSIT

SEQ ID NO: 148676 - protein, 125 aa, Heterodera glycines
  Coding regions on vcDNA: vcDNA=SeqID_75099; Strand=+; Position=1-378
MTDTALVTSVEDGLAGIVRQFASVILSSKVRAVLVVLGRDALLSGETMDTITEYVKRIKGLCLRYQDIQIVWAIPPYVHTQKVAYDQFLEALLTLTENCPIQMAFVTRKGRSLAEIFRYGGTHNG

SEQ ID NO: 148677 - protein, 72 aa, Heterodera glycines; identical to SEQ ID NO: 139926
  Coding regions on vcDNA: vcDNA=SeqID_75100; Strand=+; Position=1-219

SEQ ID NO: 148678 - protein, 313 aa, Heterodera glycines
  Coding regions on vcDNA: vcDNA=SeqID_75101; Strand=+; Position=1-942
MEYDESIVDDGAVSLVGEADENELLGVSDAHHEQNERDLAGFYHFPRNTNMQQSLVRQKRTVGDENSGRHVNRMPILENLEAFGGHDFEYSFQRHHREQQSRQRPNFEGDSRAYPPPPPWYGSYPWMPPPWFNAEKAPPNQCQNQREATEMQQSASHSTYNRLEAILILDKLPDINGREGSDRIRAFFRKFEIGTEGWTNAEKLKALQLKVTGKAERSLNAAVDFERTASKIGMREVKFDLIKKEMLQTLDELDARETSAFDELFTGLQRRSNESIDQLADRVGRTVQRAYPNLNSRDIDELSIKHFTGLRQP

SEQ ID NO: 148679 - protein, 177 aa, Heterodera glycines
  Coding regions on vcDNA: vcDNA=SeqID_75102; Strand=-; Position=1-531
HREQQSRQRPNFEGDSRAYPPPPPWYGSYPWMPPPWFNAEKAPPNQCQNQREATEMQQSASHSTYNRLEAILILDKLPDINGREGSDRIRAFFRKFEIGTEGWTNAEKLKALQLKVTGKAERSLNAAVDFERTASKIGMREVKFDLIKKEMLQTLDELDARETSAFDELFTGLQRRS

SEQ ID NO: 148680 - protein, 484 aa, Heterodera glycines
  Coding regions on vcDNA: vcDNA=SeqID_75103; Strand=-; Position=1 -187,366-421,593-710,762-842,894-1065,1152-1317,1363-1491,1542 -1631,1684-1855,1901-1938
  Homolog annotation: Hit_ID=CAE65828.1; Match level="QueryCoverage =97%, HitCoverage=70%, E-value=1e-86, Identity=39%"; Hit description =Hypothetical protein CBG10950 [Caenorhabditis briggsae]
FRCPFLAFVFLFLADGLSFLFFLIGTNQFERHTFEFMAQEFARRAHKVMTVKPILVPEEPRLVKPILHMVNEKVLKDVLPRRLSEPLAHVGQNVPWGEETDAENALRVPYWAAHNHSCGKMLNSMLNSNLMEVMARGDFDLAILYAGNPCLMGLVHSVGIPFVLFDLEGITMGLVHSVGIPFVLFDLEGITEETLVASGVRLQHFRNISHGKFVKAPEFARVGLGRHSLSLLSESFAQSAVPWLAQLLSKRFRHLDAPIDALFASDFEINRKFRGKFPKVAELRRMARLFLVNSDPFLEAPSSAFPELRRMARLFLVNSDPFLEAPSSAFPNNLLPVGGVHIDSIRPLFSPWNFPWNFSMEANGKGVILCSFGTQMDTGTMPTEFIRSLLDTFALLSDYRIFIRSLLDTFALLSDYRIFWRISPKLSLPGLSPSQIDGLSERMPHLNITSFFPQNELLAHHRTRLLITNGGAHHRTRLLITNGG

SEQ ID NO: 148681 - protein, 151 aa, Heterodera glycines
  Coding regions on vcDNA: vcDNA=SeqID_75104; Strand=+; Position=1 -234,658-879
MTNPRGDQSLFGDSLEVEQHKRNAHGVHQAHLNTSSNIAIYSLYMASNQTRVSRVENGQVEVTPGHHFHEIAVQHLHNGKGGNQMANVRCFSPFIKLVGDLTIEFLNPPGICPVFHFFPFLCFFVPIAVPPAPKWASPSSLCEPFAQIPVP

SEQ ID NO: 148682 - protein, 168 aa, Heterodera glycines
  Coding regions on vcDNA: vcDNA=SeqID_75105; Strand=+; Position=1 -21,66-175,433-590,799-1014
MADLRMEAGNDVIVPVNVAIRIFGFVSRDDLENCKLTCKSWKDVEIDEIEVKKVRHLTSQFDEKKYVFPCGEHLPIRQSHSFVFPAVDIFHQHRCKMVRPTVYQDHVNYTRKLFTPPLSFYERLQQMLKKCKIRLVIFHAFTFTDFFVEKMREFASDAFTRVVFLSLH

SEQ ID NO: 148683 - protein, 159 aa, Heterodera glycines
  Coding regions on vcDNA: vcDNA=SeqID_75106; Strand=-; Position=1 -124,201-364,424-610
  Homolog annotation: Hit_ID=NP_001002205.1; Match level="QueryCoverage= 95%, HitCoverage=47%, E-value=6e-43, Identity=56%"; Hit description =dehydrogenase/reductase (SDR family) member 1 [Danio rerio] gb|AAH72703.1| Dehydrogenase/reductase (SD
RALEGKIAVVTGASRGIGRGIALQLGQAGATVYVTGRAPAALFYVKLEIKSRGGEAHPVYCDHANSDDVRRLFKRVEEEQNGRLHILVNNAYSGVPSLIENSLIENAGKKFWECEPEFWDDINEVGLRNVYFCSTLAARLMVPHGSEIIIALTVNCFRG

SEQ ID NO: 148684 - protein, 107 aa, Heterodera glycines
  Coding regions on vcDNA: vcDNA=SeqID_75107; Strand=+; Position=1 -127,853-1049
MCRNFQAVEAHPKIEDGQGTVGPEIRAGGGVSDQRFDAKIDTVGRRTGRIGQSVEHGPKLGGGKSVAENPQIGSRNPEQPQSNEGIYLARTLRLGLALTSFFTQIFP

SEQ ID NO: 148685 - protein, 47 aa, Heterodera glycines
  Coding regions on vcDNA: vcDNA=SeqID_75108; Strand=+; Position=1 -94,163-212
MAGTEEPQYTREGRGIRKMQISGPPQPNTHLVFGAVAPRKGGLGEFA

SEQ ID NO: 148686 - protein, 353 aa, Heterodera glycines
  Coding regions on vcDNA: vcDNA=SeqID_75109; Strand=+; Position=1 -194,244-688,741-1018,1066-1210
MALVDKHFNGKSELTIWRPIEIRKDKGPEPKLYVQMDRKFDKFVPFPLPDRPLPSKIRFDSIQIEYIDHSVIAFLRSNHQIFDKRGIDLHLWLPSHTTNGQLIWDIFGREIWPIFAPNIGHLTISNAEHLDNLRRRISPTILTDLNQLNSIYSGALLPAAFGDDFDGPNSTISAGQALSKWLHNPRKDGQPKRLRCDNYYEQTDLDWINNFKEHFLRANAISSVSYEIHFYVHVPSIQMVPFELVNEWTKEKLTLAKANENELDNRWIMKRCKIGETAAVNWEDGNWDNNCNNVFFWLFGTTNCIGFALNLGLCLRHRQKKRDKASQIGRLLLAISDGQKNKKHNDEQGFRGR

SEQ ID NO: 148687 - protein, 256 aa, Heterodera glycines
  Coding regions on vcDNA: vcDNA=SeqID_75110; Strand=-; Position=1-771
  Homolog annotation: Hit_ID=NP_500972.1; Match level="QueryCoverage =84%, HitCoverage=79%, E-value=2e-09, Identity=27%"; Hit description =predicted CDS, putative protein family member, with a coiled coil-4 domain (4H108) [Caenorhabditis elegan
MGKKRRTTPNLNESDDILDRLDRLEQQINSIQSPPLNSVLERLENLEKLVQNLVNKTKNQCQCHAGDDQINNSATQWGQPPHFVRQSSHLQPGSISQMVNNAILDADQIKAKSMRAVLEKVPEGINVNELVQKVTDECGITEHLNAGDVHRHPWTVVGSDQSNKKPRIVKIPFTERKYRDIFIKNFRKTLKKHQNFPQNITVRRDLTRSELQVLYQLRTQAYERNKSEGLFKYIVVDLSIITLKNPHPLKTRENNA

SEQ ID NO: 148688 - protein, 160 aa, Heterodera glycines
  Coding regions on vcDNA: vcDNA=SeqID_75111; Strand=+; Position=1 -93,200-358,793-1023
  Homolog annotation: Hit_ID=AAU15052.1; Match level="QueryCoverage =97%, HitCoverage=100%, E-value=2e-27, Identity=42%"; Hit description= arsenic transactivated protein [Homo sapiens] dbj|BAC11206.1| unnamed protein product [Homo sapiens]
MEVNPADLNFPKAVIARIIKEALPDGVTVSKEAKNAIARSAAIFILHATSLANDNAQSKKRKNLIADDVLYAINQLECDELENPVKEALTLYTQKKNQRQQHRRERRAKQREEKRFETKGKGETEEKGQQEDGQSDCEQGMENGDDDGEEEEEMEDEVGQ

SEQ ID NO: 148689 - protein, 15 aa, Heterodera glycines
  Coding regions on vcDNA: vcDNA=SeqID_75112; Strand=+; Position=1-48
GDFGGKKFNQGKIFK

SEQ ID NO: 148690 - protein, 76 aa, Heterodera glycines
  Coding regions on vcDNA: vcDNA=SeqID_75113; Strand=-; Position=1-289
QVKEALTLYTQKKNQRQQHRRERRAKQREEKRFETKGKGETEEKGQQEDGQSDCEQGMENGDDDGEEEEEMEDEVE

SEQ ID NO: 148691 - protein, 154 aa, Heterodera glycines
  Coding regions on vcDNA: vcDNA=SeqID_75114; Strand=+; Position=1 -33,98-287,339-461,504-583,628-658,699-853,905-937
  Homolog annotation: Hit_ID=CAE56103.1; Match level="QueryCoverage =64%, HitCoverage=28%, E-value=7e-26, Identity=57%"; Hit description =Hypothetical protein CBG23701 [Caenorhabditis briggsae]
MKYTDSKIHDGKTNTQSDTETKNLLDDMGEEMDDDLSILHEMNCRSKQNGSSELDSKLFELSDEQLNYYTNCFLFLMQKSQGFFSLQGALQGNDRTILDFFRKSSLDDSILSKIWSLSDVNEDGFLNLAEFILAMHLVVLHTKGSVPIPSRLPS

SEQ ID NO: 148692 - protein, 399 aa, Heterodera glycines
  Coding regions on vcDNA: vcDNA=SeqID_75115; Strand=-; Position=1 -94,198-298,370-823,877-1424
MTMAFLPNIWDNDQNKPLIKWLWMDGNMADELFYNDPLLSAQYSELLSTLVRKNAVSSWLNLKLKLDLFVFVRWMDAKILQQKEQKNALRCANFWARNKFLLAILYDRLFDEHSDEMPTFEICQTNLLNEFYLFLDSLLSAKNAKSEKAMENGLRKIIEKTEQIYELLKVTAELKIVKYSQMGQYKHFEGLMMEKHVETINELMAKDGQFKEQLQFVFDCSQLNKLQQFNDGSVGAEKCLNILNSIKIDHSALIGQLKKIGEKIEKGNEIKFKSKKSKMKKQKNIKEKNREGEKEKEKEGEKEALGTVETITDNWPTAEKDTVETVMDKGPTAEEKHKQSSSPAAVMEEKSIRDTVQASPMVAKSAADQDTVQSLLAAKFVGATVPDVPSMRAKSKGDT

SEQ ID NO: 148693 - protein, 361 aa, Heterodera glycines
  Coding regions on vcDNA: vcDNA=SeqID_75116; Strand=-; Position=1 -574,852-1363
MTNESAFVRVRRFLLRRSDAPLADNDNFLQFGTALLIDYMIKFGNHLRNDWPKMPPGIATLATKIADVRRDAFRHFGSARHFCVMLKLILFGTRIKQTLVAKKEKTLLKLRTDECDERKAREKLIEGSSGTELGELIEFAIAGMVKASPARFRSLIKCSGTKRRFARLIGTPERFKAFAKRFNLTALFAENAFTSDDSLWDHYFCALQKPDTLAAKAHKISADLAVFVRWVQRQLSAAGRDRRLLPKFFEFVDEFYEEIFDLDQMQLTVREHFLRRKLIVETKKYAEENLGEKGSEKSGEKRGTKVIRNGKKQFDGGEMKPTEEEIGQIGPWIWQLHNAELRSILESDQNKNAAFMGWKIS

SEQ ID NO: 148694 - protein, 48 aa, Heterodera glycines
  Coding regions on vcDNA: vcDNA=SeqID_75117; Strand=+; Position=1-144
MLRAASGPTITSRRQSNCASRTQSDSRPATVSAWKFSGTAKALRSEEK

SEQ ID NO: 148695 - protein, 124 aa, Heterodera glycines
  Coding regions on vcDNA: vcDNA=SeqID_75118; Strand=-; Position=1 -77,133-230,320-457
  Homolog annotation: Hit_ID=AAG45917.1; Match level="QueryCoverage =100%, HitCoverage=10%, E-value=1e-50, Identity=83%"; Hit description= guanylyl cyclase [Heterodera glycines]
GLAMPRYCLFGDTVNTASRMESSSSPNKIHMSSETLENKIHMSSETLELLHKNFNGSYHTESRGEVIIKGKGVMETFWGKGVMETFWLLGQVENGTTINADYAHRMHLPVIKFGEEGNETGKNA

SEQ ID NO: 148696 - protein, 18 aa, Heterodera glycines
  Coding regions on vcDNA: vcDNA=SeqID_75119; Strand=-; Position=1-56
MLVISGWQTLVQGRQDGE

SEQ ID NO: 148697 - protein, 34 aa, Heterodera glycines; identical to SEQ ID NO: 124987
  Coding regions on vcDNA: vcDNA=SeqID_75120; Strand=-; Position=1-103

SEQ ID NO: 148698 - protein, 39 aa, Heterodera glycines
  Coding regions on vcDNA: vcDNA=SeqID_75121; Strand=-; Position=1-185
KWENLNLIGNVPPLRRSIQKIFVCLHSILIHFSHKNVLI

SEQ ID NO: 148699 - protein, 371 aa, Heterodera glycines
  Coding regions on vcDNA: vcDNA=SeqID_75122; Strand=-; Position=1 -191,426-616,751-1482
  Homolog annotation: Hit_ID=XP_307468.1; Match level="QueryCoverage =62%, HitCoverage=27%, E-value=1e-10, Identity=26%"; Hit description =ENSANGP00000016246 [Anopheles gambiae]
KGGQQQPAATVAGAVAASRAISHSATNDGGDTHQQNANTANANDDAGNNGNANDDDADNGNNPRAISQAGSGSLSIHLEPVMVRANLPEDPQPRPRPCRWPTKAKLAGTSGFFVQLDELYKTVSMASEWSRDSIDMCLCALFINGISNDAIRVELIKKGDKDLKFKDAVESAVLLEQSNLDAQAIGSNAMPEVAKVGNQQRGPRTPTKSTRSCFRCGKPGHFANVCPNQNSTCRKCGKIGHWAVGCKSKNRDGNANFGQQFGQKPRTNGRQIKNIECSNVSVIHEIKGISADPGFIQLNIHNGKLEFELDSGADVTVIDEIDWKRIGKPKLEPSQGLVAYGGKSIAGILGKAKVKLTHEGRTIESNIHVIS

SEQ ID NO: 148700 - protein, 52 aa, Heterodera glycines
  Coding regions on vcDNA: vcDNA=SeqID_75123; Strand=-; Position=1-156
MHAENIVWLEKYPRYFRINWNGMEDRRIDRYEAFVKQLSGVDDWARIGSLPV

SEQ ID NO: 148701 - protein, 205 aa, Heterodera glycines
  misc_feature (27)..(27): Xaa can be any naturally occurring amino acid
  Coding regions on vcDNA: vcDNA=SeqID_75124; Strand=-; Position=1 -99,561-626,686-787,857-1006,1066-1153
  Homolog annotation: Hit_ID=NP_082086.1; Match level="QueryCoverage =94%, HitCoverage=21%, E-value=4e-27, Identity=34%"; Hit description =Bardet-Biedl syndrome 7 [Mus musculus] gb|AAO16027.1| BBS7 [Mus musculus]
MEVVLSRVDYAHVGTTSKGWRKGMKAXNNGQSEKVVIGGQNGVLLCMERRNNDTNVLFKTPPGSPISRIVLFKTPPGSPISRIYLGGALGSVQDKAFVACGTEVRGYSRKGKQFLTFESNVRGYSRKGKQFLTFESNLTEDIRSLFVYGVDMFIGGTNSLYHFHDCVEKSHFSSADPHFSSADPITDCVCLPVTEGGWVGRGLTR

SEQ ID NO: 148702 - protein, 329 aa, Heterodera glycines
  Coding regions on vcDNA: vcDNA=SeqID_75125; Strand=+; Position=1 -149,200-290,340-428,470-565,610-691,1057-1178,1454-1592,1638 -1727,2183-2314
  Homolog annotation: Hit_ID=NP_498989.1; Match level="QueryCoverage =94%, HitCoverage=97%, E-value=2e-48, Identity=53%"; Hit description =amino acid transporter family member (51.3 kD) (3K84) [Caenorhabditis elegans] emb|CAA77582.1| Hypothetic
METLSISLQQGQEVQQNETNSVSTSSTDSNDIDIQALVRPSARRQGDVISPHRAVLTLSKSMFNAGCFSLPYAWMLGGKWVSLALTFVIAGFNWYGNHILVRSSQHLAKKSGVASLDYGHFAKRVCDYSELPFLRRHSKRIMYVVNITILFYQLGPFPCPSFSFTFFRNVIFIGMSMYAFEGQTMILPIENKLATPEDFLDNFGVLPTTILYSAVNGFLCIQSMLGHSIAMYVVFDMFYKGFRRKFTARFPNVPSLVVDKGFRVGWVFLTYLMAILIPRLAVMIPLLNMSPVRRAFLIGRNCFVIVLGFFAIGAGVAANVLQILNPPPS

SEQ ID NO: 148703 - protein, 66 aa, Heterodera glycines
  Coding regions on vcDNA: vcDNA=SeqID_75126; Strand=+; Position=1 -193,310-317
MPKKKPARLLNFEEEEDEEMEPELDHELFGKLTEELDEAIEKSMERTYSDTLNTFNEILRNPSKYN

SEQ ID NO: 148704 - protein, 19 aa, Heterodera glycines
  Coding regions on vcDNA: vcDNA=SeqID_75127; Strand=+; Position=1-58
SGLGEARLCTRSRSRKRSP

SEQ ID NO: 148705 - protein, 307 aa, Heterodera glycines
  misc_feature (206)..(206): Xaa can be any naturally occurring amino acid
  misc_feature (211)..(211): Xaa can be any naturally occurring amino acid
  Coding regions on vcDNA: vcDNA=SeqID_75128; Strand=-; Position=1 -48,316-440,685-842,885-929,1102-1175,1235-1313,1690-1922,2441-2533
  Homolog annotation: Hit_ID=NP_872170.1; Match level="QueryCoverage =99%, HitCoverage=28%, E-value=5e-59, Identity=37%"; Hit description =ankyrin and patatin family member (5V188) [Caenorhabditis elegans] emb|CAD54162.1| Hypothetical protein W
VSAGLAMGQTLHQIQRLYLRFKDMVFDNRRPHNTQVLEKFIRQEMGAETMFSDLKWPRLMFTTTRAEFFPVQLELMRNYKLPTNDEENEELGYRTPDDLLLWKVLRRSSAAPTYFASVDNKPTYFASVDNKYIDGGIIANNPSLELLQEIQFWNSFNKYKNFPNAVNVGCFLSNFPNAVNVGCFLSIGTGVIPPTPLKVSLKMENXIFSLXKVDIFPPFSPQKVAATEGVPVLRAGAFCIQQRAPFFRLSAPLFRNISMDEKNDADIARMMWDCMVYIYKHQDYVERLCTLLRRVGHAEHRRRLFQT

SEQ ID NO: 148706 - protein, 214 aa, Heterodera glycines
  Coding regions on vcDNA: vcDNA=SeqID_75129; Strand=-; Position=1 -75,246-603,850-1058
MSKFFRVDLLKSLIICDARRCPLTKVGCVSGCVNEKQLHELKRTSTSSMPSSATGNTTSTSSTASSSSSSSSTTSAAASATAAAAATAPPAQPATSSQPAAGASTTAPKPASYTSVTVEDFENRAFDKEHFRFNKLLDIQHNVKTIFGKFLPFKWPEINGEFSILRQYVVKDIYDEVLEKLPEVSSDEDSPPDHNFINVLSLDGGGIRGLVIIQ

SEQ ID NO: 148707 - protein, 46 aa, Heterodera glycines
  Coding regions on vcDNA: vcDNA=SeqID_75130; Strand=+; Position=1-166
NFFIWTSLFVTRNHYFGDFVTKIVKNHYFGVLSLFFHYFDIFWKIP

SEQ ID NO: 148708 - protein, 165 aa, Heterodera glycines
  Coding regions on vcDNA: vcDNA=SeqID_75131; Strand=+; Position=1 -28,882-1351
MSTSIVLGAVQSNSFNSNAHQKLLQRLRHAIEDTNAEADRLENDYFLLQEQIAAMRHQLVVHLRRQLEQQKKIKKHIKKEQQGGGKRVGESERGGEDGQEQREADEEKDGGGGEKEERQRGGAEKEGDLSHLLDSCFLMCFLMSEMCKYCLKKSKNNTKFEKKDG

SEQ ID NO: 148709 - protein, 55 aa, Heterodera glycines
  Coding regions on vcDNA: vcDNA=SeqID_75132; Strand=-; Position=1-165
MLSSSSCCTLLVALISAAFVSVANAQKVKQCLCSKIQPCTQKYMNTWKTCMRQCK

SEQ ID NO: 148710 - protein, 35 aa, Heterodera glycines
  Coding regions on vcDNA: vcDNA=SeqID_75133; Strand=-; Position=1-106
FFDSVRRFDKDGFRFAISRSTFGNWSRIFSAITCN

SEQ ID NO: 148711 - protein, 79 aa, Heterodera glycines
  Coding regions on vcDNA: vcDNA=SeqID_75134; Strand=+; Position=1-242
PSYRTKAQIDHSGTKKVVNSRHSPAPAPHSQRKEKQGKKEKAKSSSSSSSAEEEGKKHRKKGNGRQIVKHFGKGKKKDD

SEQ ID NO: 148712 - protein, 490 aa, Heterodera glycines
  misc_feature (274)..(274): Xaa can be any naturally occurring amino acid
  misc_feature (294)..(294): Xaa can be any naturally occurring amino acid
  Coding regions on vcDNA: vcDNA=SeqID_75135; Strand=+; Position=1 -82,474-601,648-729,781-930,1105-1220,1304-1395,1434-1659,1730 -1781,1870-1971,1999-2055,2145-2314
  Homolog annotation: Hit_ID=NP_504988.1; Match level="QueryCoverage =97%, HitCoverage=80%, E-value=3e-63, Identity=31%"; Hit description =cytochrome p450 2C33v4 family member (5I160) [Caenorhabditis elegans] gb|AAA98571.1| Hypothetical protein
IVLFLFISSLIALSFYNFYYKRRNFPPGPTPLPIFGNLIAIHLSGAGELAFKKWAKEFGPIYTYWIGELPVICVAAYEQMVQIFQKDAENYALPVICVAAYEQMVQIFQKDAENYANRYIFQKLNISDGQPAFGILISNKLNISDGQPAFGILISNGQRWRQHRRFALHVLRDFGLGKNLMQQRVSKKIAKIDLNIDQSENNEINLAEFVEHSIASIVNQFLFGVKLKNAAKNAADFYEIKQMMDEHSGEVGGHSLFWIYILKTLDLILISINXFGILRVTIKTLDLILISINXFGILRVTIGVHRYFEKRIFERQMKMENPINSSSDYVEAYLKEKARRDAAGEKGHQSSTYQLGMMCFDLWITGQETVVSVLSWGIALLLNNGEPLVKMCEEIDQLISSRMITVADKANLPRMITVADKANLPYTCAVTNEILEILRCANIAPQNFIRTVASDVRLANGFVLLKGTSIPQISVVPVKKRVKSSNKYLP

SEQ ID NO: 148713 - protein, 256 aa, Heterodera glycines
  Coding regions on vcDNA: vcDNA=SeqID_75136; Strand=-; Position=1 -135,531-724,1848-1920,1998-2167,2217-2415
  Homolog annotation: Hit_ID=CAE69584.1; Match level="QueryCoverage =42%, HitCoverage=16%, E-value=4e-47, Identity=79%"; Hit description =Hypothetical protein CBG15803 [Caenorhabditis briggsae]
MIVTTDLHHSCTKSHTGTSASAPLAAGIAALTLEANPNLGWRDLQHIVVRTAKPVNLRAGDWRLNGIGRNVSHSFGYGLLDAGAMVRLAKVWHNVPKQRKCRATYPNPYKKDSSPKRKKEASSGDKSELSEHQCPHFHGVNFAKNNLTTKITNMASVEMVALQYRAERTLLGLSSDEMKQYLIRVSKFFENEFRSDLIHVMSISQSYVEAEFVRASLSMLPYLGFGFAVMAFCTAISIPLSAAYFQQATVHKAFTH

SEQ ID NO: 148714 - protein, 80 aa, Heterodera glycines
  Coding regions on vcDNA: vcDNA=SeqID_75137; Strand=+; Position=1 -74,150-318
MFKLLTAFTFVLVLSIAWCSQWKRPYQSELDILKKTFTWTCIPCGPGLPGQKARKNPGSSRPGSRPGPGFFDCFKKQTNV

SEQ ID NO: 148715 - protein, 74 aa, Heterodera glycines
  Coding regions on vcDNA: vcDNA=SeqID_75138; Strand=-; Position=1 -125,593-692
MQAILTEKNRTKLQHNGHSYIFHKPSADGEVRFGRVNTITQNFCPYNHFWATLSRCISAFVWHRDQSLSEKRYS

SEQ ID NO: 148716 - protein, 49 aa, Heterodera glycines
  Coding regions on vcDNA: vcDNA=SeqID_75139; Strand=+; Position=1 -9,142-267,547-561
MNKQIAITTKESLREFKHLLTQLYGEQIFECRGTLSLMLDLVEILELKL

SEQ ID NO: 148717 - protein, 159 aa, Heterodera glycines
  Coding regions on vcDNA: vcDNA=SeqID_75140; Strand=+; Position=1 -146,190-525
DEVDTDPSPEEVEKWTPKQVIKWDQRCYEKMPAEEELWQEFLDKGEANPQPGTSAPAPSTGLSTSTVSNRSPQSVRPEATSRDQALAHQPQARGWALAPYPTFVLMRQAGGHKPRPGTSTPTPSTGLGTSAVSNRSPQSVRPEATSRDQALAHQPQARG

SEQ ID NO: 148718 - protein, 247 aa, Heterodera glycines
  Coding regions on vcDNA: vcDNA=SeqID_75141; Strand=+; Position=1 -211,262-386,431-595,644-886
MLCKCGECFECEDEKRRLKRNRELNTRKEQIKNCTGNHLAPAMMDLKRRNMELFKKAYRPVKGVINKITGGPWNVECEVCHETFTYFMVEWENSRTDFSWGPGRTMVEADNINQKEILAHYVGQNDLLQNEVDYYQNLGNNPPLNVSPMGEDAIILTRDDGMPIGAEANDGARSVAGESIVSKRGGGQRKRERERKKRAEEAKKAQRDGAEEEEDDDFFFFARNGGEKRGEMDMESMVVKMKYKFKN

SEQ ID NO: 148719 - protein, 182 aa, Heterodera glycines
  Coding regions on vcDNA: vcDNA=SeqID_75142; Strand=+; Position=1 -52,369-554,603-913
MPKKSETRKAKLATALVNPNKTNGTFILKIEKLSEFAQEKNGTKRSSEIMFIRGIPWQIMAIKEEDALYFYVQCSDDKTDSKWKCPYSVTYQIDAQNKGNEHFVFGTGGHIGTNFECRSCRNRRGFQVINKCQIWSINVISGIVTGIIKKSYLVSDERVQRLVQQSGGHVDFACRCAYWRTI

SEQ ID NO: 148720 - protein, 59 aa, Heterodera glycines
  Coding regions on vcDNA: vcDNA=SeqID_75143; Strand=+; Position=1-290
GMCLGFAFRISPFALFAFFGVSHFAFRFLARNATFTPLRIGLNSHKIFQNFTYKLANFQ

SEQ ID NO: 148721 - protein, 85 aa, Heterodera glycines
  Coding regions on vcDNA: vcDNA=SeqID_75144; Strand=-; Position=1 -226,673-704
MNFMIPTFLKKNATRVTKGIVSSTVLAPLPEGTTTTTTTTTVSTTTTSTASKTISTPSANLVTDISDEMSETTVDAILALFFIPI

SEQ ID NO: 148722 - protein, 162 aa, Heterodera glycines
  Coding regions on vcDNA: vcDNA=SeqID_75145; Strand=-; Position=1 -129,193-551
MNSQQRQAERAQLRARLNLLVDEVDFVVQGLISNYQADGLINEAPHEGQLMGMDHGQGLQHEQQQQQPWELDPPMPAQQLEIGPQLPDAWELVPYQPTPQWAQVAHVEQHPQQQQHYHHQQQQQQQQQGAWDEEWEGQLSPNALAQIQDEVKGLRQDLSKDF

SEQ ID NO: 148723 - protein, 122 aa, Heterodera glycines
  Coding regions on vcDNA: vcDNA=SeqID_75146; Strand=-; Position=1-367
  Homolog annotation: Hit_ID=EAL20892.1; Match level="QueryCoverage =100%, HitCoverage=16%, E-value=3e-16, Identity=42%"; Hit description= hypothetical protein CNBE2530 [Cryptococcus neoformans var. neoformans B-3501A]
MEIKFEKKKSFDNENFPIKKEAAIIKEEQLSFGEEQIMMGDQKRLKMVKEEKMIKKEENIDEMERKIKIEEEEEQTIVKEEQEEDEEWEEEEEEQMEDEEWEEEEEGEEEQMEDEEWEEEEE

SEQ ID NO: 148724 - protein, 34 aa, Heterodera glycines
  Coding regions on vcDNA: vcDNA=SeqID_75147; Strand=+; Position=1 -86,462-480
MLAFCSLLVPAILKIWQKKANENKNVVKRNRDLH

SEQ ID NO: 148725 - protein, 144 aa, Heterodera glycines
  Coding regions on vcDNA: vcDNA=SeqID_75148; Strand=+; Position=1 -138,331-627
MASLLLCLLLILCFSIFKTAEQQQQPDEKDHRQLLFVQAIWRHGDRLGMTQMRELGQFLRQRYVTELNFLDPAYHREDVIGGLSKVHRNLHLDKGFCPILRLRPGIGFRAGTAPRDVPTGGGVGAVRPHTQLAAHPRALDWAKP

SEQ ID NO: 148726 - protein, 68 aa, Heterodera glycines
  Coding regions on vcDNA: vcDNA=SeqID_75149; Strand=+; Position=1 -147,1156-1215
MKKEVKQQLEQNLTNTYPELFTFIQQNVYKSAQPISLHQAAKLSNIKREQCKKDGFCEIPIEKGKEDD

SEQ ID NO: 148727 - protein, 127 aa, Heterodera glycines
  Coding regions on vcDNA: vcDNA=SeqID_75150; Strand=+; Position=1 -121,289-448,552-654
MFSIAIHPIFLVAVLLTFFSLFLSSTDGAIARRQHNTQKKATDPNSSDEYDYRVDDDYSIGVFVDAVPIAKNGDESAKTPQTNEDGKAYKRTNRYPTKKLRRFFDESKARREWYESLFSRTAERRRR

SEQ ID NO: 148728 - protein, 79 aa, Heterodera glycines
  Coding regions on vcDNA: vcDNA=SeqID_75151; Strand=+; Position=1 -197,414-456
MEKCLDRKDVEMCQELAEEAKQSIELAKNYRKEIGQTYRTAYSQPDLGIGDLANKLKETMRENQIRGVHLMGHIRECLN

SEQ ID NO: 148729 - protein, 151 aa, Heterodera glycines
  Coding regions on vcDNA: vcDNA=SeqID_75152; Strand=+; Position=1-456
MNSEKSEKANSILLEAAKKETERAWRDVATLTDEVSDFAKSSRETLNRAIKSREKAPYANGIRELYLKMSDSIWEIFTILDKINLESEKAESTWRDFERCKTFDQATKLEEQSQNSLMEARRLHFESRRVQSQMLNYENRLQTIVWEHMGI

SEQ ID NO: 148730 - protein, 175 aa, Heterodera glycines
  Coding regions on vcDNA: vcDNA=SeqID_75153; Strand=-; Position=1 -172,346-567,907-995,1040-1084
MAHPTISSRFQGQVHGLRTADLPLGRGGSWPIPPFPPDFKAKFTVFGLQNFPWDGLDHYAERQWILSEDCYGLELCVDFTRQAATEATLDVLSGKPVPAEHRALMESNQKFKKRNNENEAGSADDGYDILFLHKKLALSATQHTNDGILWMPRVPRAIKTEASKCIDAFVDEFMK

SEQ ID NO: 148731 - protein, 121 aa, Heterodera glycines
  Coding regions on vcDNA: vcDNA=SeqID_75154; Strand=+; Position=1-366
MSMQQNQGSDDVLPMWAVPDFDEMDQMPQRQKQKKIPTLKEFRHQWKERRLLWEREQAEKKDPKTWKKRTDEMKKICEERLEQSKGAGGSNKRQEPDTYTWNWDELLRQEREYLDGGLWGK

SEQ ID NO: 148732 - protein, 54 aa, Heterodera glycines
  Coding regions on vcDNA: vcDNA=SeqID_75155; Strand=-; Position=1 -42,89-172,363-401
MAKIVIAPYKKITPEQSGPSKKTLRQKQKRKNKSMRKKQPKKTHKTSLVTYCQK

SEQ ID NO: 148733 - protein, 51 aa, Heterodera glycines
  Coding regions on vcDNA: vcDNA=SeqID_75156; Strand=-; Position=1 -149,328-334
MSCAMALLLLMLVQLQLLRLLRRTKARTASDRWHRTKAAAATMANNMGRSF

SEQ ID NO: 148734 - protein, 134 aa, Heterodera glycines
  Coding regions on vcDNA: vcDNA=SeqID_75157; Strand=-; Position=1 -37,468-587,1195-1442
MDKERHNFLFGAAAREPGKRQFKPNAAFFDQLQLIAADGADDDEEDDDVIFPSPNVSRSSSDNEQQKEEGDEEGEQSSTNDNGEDDETGGNSSDDEDSGDGEEEQQQQQGKPWKSKRQKGAAPNAAQVRNKMGK

SEQ ID NO: 148735 - protein, 323 aa, Heterodera glycines
  Coding regions on vcDNA: vcDNA=SeqID_75158; Strand=+; Position=1 -738,1059-1291
MANKLILLPYEHYKGLVAARETKNDDDDDIAERTNLGFVKRQVTAAVQKRKGNVSERNAMYNQHLRRYLKMRKEHKERPVRVQLSNGVQLLNKTVETGVQVRPGPDEPKDKSVMVTDEDEEEEEIEVPKFLTPTSQTQGSSRSPRTNKKAAKQQKLIEKKDHLLAIIMSDPQRFGATDRGKIINPKTGREFIDSDLAWSIERLVDPRPENAPSPRGTKELKRKLAQNPLASSLLNRLFVGSGFVGQALSRKNSGYRYLLLAVDVLSRRMFGAPVKSKRPVDMKRAFEELFEQMPRVPDTMYTDRGLEFVAKPLKEFYAEKGIQ

SEQ ID NO: 148736 - protein, 1434 aa, Heterodera glycines
  Coding regions on vcDNA: vcDNA=SeqID_75159; Strand=+; Position=1 -4258,4500-4546
  Homolog annotation: Hit_ID=NP_498959.1; Match level="QueryCoverage =77%, HitCoverage=52%, E-value=5e-97, Identity=27%"; Hit description =zn-finger, CCHC type and RNA-directed DNA polymerase  and Integrase, catalytic domain containing protein
MPNLRSPPLTRQRALNLGIRLNNNANQQGGQQIVEPQHLADRRLENEARHNSVSSVASSLLDPTEIRRRLLMSGIGENAAGVENGPRDEQQFDALLNQHGNDLFQNENRGENFERDVFQPVVREPPLQFSENFENGPRQYELVGVRPVVTSTPHAVQPQRRPNSEPLNPGLVRPQAMFLNSFQQNIAANPNGNQRQRAEQRFIDEDERQAALVRHRQANLTHYVNNDRDFNAFHPIAGAQHVWRAQIQHVSYPNNPQIGEVNPQQIPRQNQGFVGNQQIFRPVAVRNDFHPENYGDNFNFGHPEQQNFGQQRTEQIQIANLEYVLTLDRLPELKGNEGADKVKIFFKKFSNATEEWPEHKRVKALETKVSGRAERAFNAAISSGPHRFDSIRRAMQNQLEETDCREMGAFDELMSGVKRRSNENLDALADRIQSLVSRAYPGLTQNLCDDYAIKHFVRALANPELSLTLEMSRKSGMSFDEFVALAARAESIQRATRVSSNENKYSDNRNRGFYFSNNFSRPQSSEFQGNSQQPRGRIVCYNCNEPGHLSRDCNQQIKGQRVNSNENERIRNQFATGSNSVAIRNNEESPRNNQRNFQPKSQNFLKQNCIVMQEDQPPDAFCCGVQLTSEFSNFLENELHEENQSEESKEKDHVGKILVIRVETNNVRTDAMLDGGAQISLIGAEFLYKLIKEHGLDLRKSGFSRTKARIADVNGQQLKCFGMVTIPISRKGREKTPICFHITTAQFGYNLLFGTNSMTKLGFLLYDSVNKEMIEFEEGQQNDGNSARIIFSTKIEPRTTKLIEIGVDKEWNGKDVIILPSNMESGVKVEPTVGKVEDGRVIAQITNYSTLSQRINEKTYIGMIEKVDEIFDTENSILSAEISSTMAYGKNESGKLGRADLHIGEILGHHKTELLELISQHTEIFATSEQELSQTDLIRHKIETGKALPIKSQIRPVPYAYREKVSAMIQDYLSRGIIRSSNSPWASPIVIVPKKDGTLRFCVDYRKLNSVTVKDAFPLPNIDNTLLALGGKKVFSTLDFISGYWQIKMDRNSIEKTAFSTEFGLHEFLVLPFGLCNAVATFQRFMTRLFAECLNKFVFIYIDDVLIASESWDKHIEHLKEVFKRIENAGLKLNVSKCHFASNELPFLGHILSREGLKMDMAKVKPVLDLPIPSTKKQLQSLLGFLAYYRKFIYGFGGIAAPLYSLLKKDINFKIGDLEKKAINTLKSKIVSDVMLHFPNFEAAKNDTTRKFILLTDASKIGIAAILCQPNEKGNIRPIYFASRQCKNYESRYCPTELEALAVRFGTKKFSQFITMMPTKIFTDHRALIPMFKSKKETGNSRVDKWLMEMNAKFILEVEYHAGKKNVIADVLSRSLALKCLDSPSEAEKVIIGQVRRFENGQRPQEILSHQEWVKKTKEIGREVFLAEYVFRLC

SEQ ID NO: 148737 - protein, 391 aa, Heterodera glycines
  Coding regions on vcDNA: vcDNA=SeqID_75160; Strand=+; Position=1 -302,350-1223
METDNIDFALTWDMQCGGLGPEHRNCVQLTTADLDPVLERAGFGLKVAESRLKPQNAKFGLKVVGTPLKALLATFLLKTNAISSSAAGRKLAQSVIGAPVGGRIPVEEDLEAILEKWTECCAVTRTKLAKCGFGAINVPIPRSIEDLPEGEGKPWTELLGKAGFVLEKVKATSVLRKHQFVTSPRIIIGDSSAKQLEDLWPTSQFIRATQGSVGDVMPPPFIRDQQIEHDMLIDRMKDHFALIRGNIRYVSTTPSGRSLLEIWRYGNGYNTEHVSAEGTMKEKGLYMLKAWLMTQVNDFPGDRELGIEKKRAESEEKGRGKTEGKNVRTGEPDRKPSHRPIPSPFRHTGRAFHRSNRTPTHHPYANPVDRHQPQPFRMPNQQGPSRRQFQR

SEQ ID NO: 148738 - protein, 44 aa, Heterodera glycines
  Coding regions on vcDNA: vcDNA=SeqID_75161; Strand=-; Position=1-135
CTHSGTLPGGIGYQRSSPLMMFVRWASCGRRNGPSTSDRFFTIF

SEQ ID NO: 148739 - protein, 17 aa, Heterodera glycines
  Coding regions on vcDNA: vcDNA=SeqID_75162; Strand=+; Position=1 -37,244-260
MAVHSPSGQCAKVNNIH

SEQ ID NO: 148740 - protein, 96 aa, Heterodera glycines
  Coding regions on vcDNA: vcDNA=SeqID_75163; Strand=+; Position=1 -11,72-351
MNRRWICNDVWMDIFPCFDHTQLGLKLALLSPRFNALVDKHFDGKSELTIWRRIEINKRIGTKPKLSVRMDDKFVPFPLPDRPLPSKIRFKFLMIE

SEQ ID NO: 148741 - protein, 69 aa, Heterodera glycines
  Coding regions on vcDNA: vcDNA=SeqID_75164; Strand=+; Position=1 -197,533-545
MPFELVNERTQEKLLMLTKGNENGFDDWLMKRCKIIGKTVAFQQQKKDENWNNVFFWFFSGTNCIGITF

SEQ ID NO: 148742 - protein, 102 aa, Heterodera glycines
  Coding regions on vcDNA: vcDNA=SeqID_75165; Strand=-; Position=1 -59,195-280,374-537
MLSSAIIQWWRCRRIQKQKNSHFGEGGVTATNELGNLPQNKNHSIAANVARKQAGISAFFKGRSRLWKKPVSVGKSTLFLVIFVFSYKTKLIRFLDAKHIMN

SEQ ID NO: 148743 - protein, 118 aa, Heterodera glycines
  Coding regions on vcDNA: vcDNA=SeqID_75166; Strand=+; Position=1 -180,270-446
MFIPSNTHELFMANAWPSIPTTSASAAGCGPTAAEQSVAADPTVVDPQFHIAILYGRIIIMDGKSVLVVYKMLPCTADAFQKNPNYHRYVEPSTGEVRAMNVSGRPYNLALAIFGVPT

SEQ ID NO: 148744 - protein, 322 aa, Heterodera glycines
  misc_feature (7)..(7): Xaa can be any naturally occurring amino acid
  misc_feature (319)..(319): Xaa can be any naturally occurring amino acid
  Coding regions on vcDNA: vcDNA=SeqID_75167; Strand=+; Position=1 -72,2738-2810,2891-3013,3059-3187,3475-3570,3741-3806,3856-3987,4053 -4143,5218-5253
  Homolog annotation: Hit_ID=NP_502317.1; Match level="QueryCoverage =97%, HitCoverage=49%, E-value=4e-68, Identity=46%"; Hit description =proline HYdroxylase (61.5 kD) (phy-2) [Caenorhabditis elegans] emb|CAA93469.1| Hypothetical protein F35G2
GCDIKIXKKRIENGNYPFHFKYFSLCRGKFISPEAQAKLHCYLKRDKPFLLLAPHKVEVVHLDPLVLIFRAVISDTEIFSIKTLASKKLCRAKVVDPNSGKTALANYRVASKKLCRAKVVDPNSGKTALANYRVSKSAWLKDGVHQVVERITKRVHDMTNLDTESAEDLQVASYGIGGHYAPHFDFFRSNEVDKRTFELYGNRIATVLFYLTQPHDGGFTIFTDLNLTQPHDGGFTIFTDLNIGIEPTEHDALFWYNLRSDGSVDPRTRHAACPVLSGNKAACPVLSGNKWVANKWLHERGQEFIRPCPLKKKIQDEFXGHM

SEQ ID NO: 148745 - protein, 375 aa, Heterodera glycines
  misc_feature (83)..(84): Xaa can be any naturally occurring amino acid
  misc_feature (356)..(356): Xaa can be any naturally occurring amino acid
  Coding regions on vcDNA: vcDNA=SeqID_75168; Strand=-; Position=1 -193,1239-1484,1688-1747,2072-2337,2813-3122,3349-3406
  Homolog annotation: Hit_ID=CAE62109.1; Match level="QueryCoverage =98%, HitCoverage=89%, E-value=2e-69, Identity=39%"; Hit description =Hypothetical protein CBG06147 [Caenorhabditis briggsae]
KGAADDNDRTGGSVAAIIQRSQLNRRNNSHQQRRRRHNIKNTSTSTKRAVSATSCTSEESEESGNSSKRKKYQSVVPENSVCXXLITDKPVQYAFLMLVFCGTLNDIVLSYITSGPGNAPLPDIAFTYLPYWPWALVVSECLMITMFFIMMLIAVLHKHRWVVLRRIFLIGSLLYLGRCVTMFVTQVPVADTNYYCSPRLNEQRTFWNILARALSVVVGLGLKINGRHTLCGDYIYSGHTIVHVTCCLFIREYSPRRWRLLHLGALCLASVGVLSLLFSRGHYSIDVIIAYWVATRLFWIYHTLADLPALRNELQGRNHLTKTVWYRLFLWMEGGVQRPIPRKCVPKTNKITIANXFRLVSDRAMIGLKSNPNFV

SEQ ID NO: 148746 - protein, 56 aa, Heterodera glycines
  Coding regions on vcDNA: vcDNA=SeqID_75169; Strand=+; Position=1 -61,622-695,737-772
MSNYTKKFGLTNYDARLFLRKRVPSRKVHLGSYGTLEGAKVLLEKKKTKTPSRLQK

SEQ ID NO: 148747 - protein, 30 aa, Heterodera glycines
  Coding regions on vcDNA: vcDNA=SeqID_75170; Strand=+; Position=1-6,91- 177
MRAIVLRNLHRIMCKILMAMRKIDQFLTII

SEQ ID NO: 148748 - protein, 96 aa, Heterodera glycines
  Coding regions on vcDNA: vcDNA=SeqID_75171; Strand=+; Position=1 -50,757-997
MFGNGSRKSEFRAIPDVKDEKGLLVHKLKRRFALFAKMDLQEMECWELHERLAKLKVAKKKKKPNKFERFDADFGKAMMTEGPVFVEDFIKAILLC

SEQ ID NO: 148749 - protein, 88 aa, Heterodera glycines
  Coding regions on vcDNA: vcDNA=SeqID_75172; Strand=+; Position=1 -88,166-344
MFCRFPLPLSFASSLLILLLSSNLVLLVGGVFKLLDGNAKLVSNPLENVVYLFQFPRTSTTPSQAPYNLMVETWLHWKHIPFHVPYYL

SEQ ID NO: 148750 - protein, 134 aa, Heterodera glycines
  Coding regions on vcDNA: vcDNA=SeqID_75173; Strand=+; Position=1 -249,303-455
MVDREAGLEWMTKDEALVEIIVPQTFTDRPLTVQLGEDGNFNVSVNQQFWEQYFDAYNAKGQTEKVAFVNAFLKPLNGTDQKEENGSTLTDGRLWVDFSAWLRQNVIKRTMETVLMVTVNGQPNTANPGNSQAK

SEQ ID NO: 148751 - protein, 118 aa, Heterodera glycines
  Coding regions on vcDNA: vcDNA=SeqID_75174; Strand=-; Position=1 -68,523-641,934-1010,2119-2211
MVSVPKDYRAWKAAIKVGTDMIMQHTCVQFKIVNVEEKDNYSEGILIREIEFAEAHKVLKTCLFGESKAGKVGGWQELKLAMEHTCPHRSVLSDHSATVLPANDWPTRQNIFQRRGDN

SEQ ID NO: 148752 - protein, 70 aa, Heterodera glycines
  Coding regions on vcDNA: vcDNA=SeqID_75175; Strand=-; Position=1 -101,145-256
MLRSLSIILLINIGGYLITLALYRFIDIISSIFGSLIRIWQNECFLGILLNLAAGSNAIVLYFSRSFIIF

SEQ ID NO: 148753 - protein, 63 aa, Heterodera glycines
  Coding regions on vcDNA: vcDNA=SeqID_75176; Strand=-; Position=1 -137,657-711
MLSYWVRRWRFKIPEIKKPKCERISKERRQTIKCISPNTKVSLYERNYMVSLKFSFSFPNSIK

SEQ ID NO: 148754 - protein, 229 aa, Heterodera glycines
  Coding regions on vcDNA: vcDNA=SeqID_75177; Strand=-; Position=1 -106,625-782,1198-1343,1711-1799,2579-2769
  Homolog annotation: Hit_ID=CAE58677.1; Match level="QueryCoverage =71%, HitCoverage=18%, E-value=3e-18, Identity=32%"; Hit description =Hypothetical protein CBG01851 [Caenorhabditis briggsae]
MVVSAKQVFNELFITSELGKSIPTFIKLVMAKVVCGKFPGPLLEQFNKFKYLNESAQNLPPLDNDAAKFALMGMVASGDTLESYLKKEKTKNEQRYSIFLQIAFALAVAEKKYDFEHRDLHTGNVLVEHCRDNENIRFLYGNQQFDVASKGVRVTIIDFSLSHFRIEMMHSNNTLANGCSTPCWCCCCSFPATHCTATGAFGLPATNGGGSGATNPWKEMQWEKRMEPN

SEQ ID NO: 148755 - protein, 44 aa, Heterodera glycines
  Coding regions on vcDNA: vcDNA=SeqID_75178; Strand=-; Position=1-153
IFLFSPLTFCVPPYSIFCAVGCQCCQFNHADDHLFSMPVLEFLL

SEQ ID NO: 148756 - protein, 1050 aa, Heterodera glycines
  Coding regions on vcDNA: vcDNA=SeqID_75179; Strand=-; Position=1-3153
  Homolog annotation: Hit_ID=NP_508324.1; Match level="QueryCoverage =94%, HitCoverage=36%, E-value=2e-96, Identity=28%"; Hit description =predicted CDS, peptidase family A16 and RNA-directed DNA polymerase and Integrase, catalytic domain and Z
MCNAVNGSDTRALLMTATSTVFNPAQPHLSMTAAIFIDPGSHRSFISAKAAQLLDLPVVHTEECHLTSFGEREPKRYISDLVKLGFLCTSGEKLIFNLNAMKFLVNDMPMIQLSELDKTELRQQKLNPPHEQRQPDIMLGIDVWHELQVQPIEKLPSGFTLCRSKIGKILSGSGRIEMHQASNVTFVLSVHGTEQEEANQSVTFESTKEDKEVFTSEDDVKKDEQLNNFFGLNLIGMDDTSTPTDQDQVMVYFKKNLTFVNNRYQVALPWNDRVDALPSNIHQAKARLVSLIKKLRSLNLIDEYQTILDEQVRQSVIEYIGPPESPSSAWPLHFLPHRAVIRADKATTKIRIVMDASAKPKNCPSAPSLNDCLHTGPQLLKDLTGILLRFRRMEHVILADIEKAFLQLGIRYVDRDACRFIWLNNPETAELNPIDHSELRIYRFCRVSFGLTVSPFLLNATLREHLALFDSDLARRIEENLYVDNIMFDAKPTEKLQDLVTQAKTIFEAAGMKLREFYGSNIEELKKLQPDDLAKDLEDNKVLGIRWKPKQNRLIFKLPIFEGKITKRTILSQIAKVYDPLGLMSPVLLPAKLILQEVQNMNPKWDDELPANISKDWLKLMAQWLDRGEAITIEFPRHIQAIDSVEFHCFCDASKYGMGIAVYQKAKTTIMKDECNLIYAKSLVKPIKVAAHDGTIPKLELQALTLGVKAVKFIQAQIKFADHQVIMWTDSQCSVERLRENKRQDRFVANRLQKIREANFQVRHVRTDSNPADMASRGADPQCLRSSLLWRFGPVWLSKADKWPKSNVIYRPGDEFKEVEEPPIIELTTTPVHVEEQFKPSIHFERFSNWNRLKATAAHAMRFIKKLRTIENGTISEPHQNNKPLTMAQLQQAENWILREAQRLHPPSNDQIRELQLFRQEGIWRCGGRLEEAPDLPYDSKHPIFLPPHAWITKLIIRHYDKQLKHCGPRILLSTLREKVWIPRGRKTVQQLLNSPQHGCLECRRERVKPYTYPEASDLPRGKSQRSTTIDKNGEWTTFVHSRSNKAMTW

SEQ ID NO: 148757 - protein, 40 aa, Heterodera glycines
  Coding regions on vcDNA: vcDNA=SeqID_75180; Strand=+; Position=1-123
FSFSLLTEIKKIVRQNERCFFLCTLYLLVHFSFLKRCVGY

SEQ ID NO: 148758 - protein, 23 aa, Heterodera glycines
  Coding regions on vcDNA: vcDNA=SeqID_75181; Strand=-; Position=1 -24,415-462
MDIITHCHGVFFVFLIKSWRDFK

SEQ ID NO: 148759 - protein, 170 aa, Heterodera glycines
  Coding regions on vcDNA: vcDNA=SeqID_75182; Strand=-; Position=1 -30,711-1193
MYIIKRFAHHPTLTATEHARQQQGKPLSADRQQHDIDQQKDFDQCQNGEIEDQNTTPDILDLSLGQLDAMNDQQNLKFTGLNRSQSDAFYYHDDQLCFAQNNCQNTAHRSGKPNGVGQASITCADQQRSRANTVTAADQQIFMHYKNQCEEAEWADCETTLPLSTTAEND

SEQ ID NO: 148760 - protein, 220 aa, Heterodera glycines
  Coding regions on vcDNA: vcDNA=SeqID_75183; Strand=+; Position=1 -529,830-960
  Homolog annotation: Hit_ID=CAE63752.1; Match level="QueryCoverage =99%, HitCoverage=14%, E-value=5e-18, Identity=30%"; Hit description =Hypothetical protein CBG08287 [Caenorhabditis briggsae]
ASKEFKEFHRSAQARVQKLRNEKIRMMKLMEEDDVGYRQLLDEKKDKRLVHLLKQVEDQFLKKKFFTKNGRMSCGEFDRPGAPASADGEEAEAGRAQGGQAGGAQAANAPNSTMPAAMVAPTEAAMTHCTSLFGTVPPAKRSKACAGGTGRGRPGTNDCTCARSGLGQGPYNGRLNDLDEEQRNRRIIEKARNDEDEYDNKNALAQMESYYATAHRVKEK

SEQ ID NO: 148761 - protein, 72 aa, Heterodera glycines
  Coding regions on vcDNA: vcDNA=SeqID_75184; Strand=+; Position=1 -44,680-854
MPVYITSSRKSTLILRSFIYLFNTNCECSFHFKIDESVQMSATLKQCRVTDQQFKMAIKVFILPEIIIGTGN

SEQ ID NO: 148762 - protein, 49 aa, Heterodera glycines
  Coding regions on vcDNA: vcDNA=SeqID_75185; Strand=-; Position=1 -89,138-198
MHLFILSNFISFFIVLFHLLSYGQLSPIKPFYLTNGTDGVKRIKVEAPS

SEQ ID NO: 148763 - protein, 192 aa, Heterodera glycines
  Coding regions on vcDNA: vcDNA=SeqID_75186; Strand=+; Position=1 -165,368-406,602-976
MKVNNNKQRKALPQELVYELVNALPFCVRWAAVRVASNFDQFVMERQLDWIKTVNACYATYLTFKESLNAYKKSISVHYDEWTAYQEKWTIYQQKWTIYQHHQQQQQDGSQGEEVDEQKMDEFIQEMKGVFEKIKKTSQQMKVVFGLGWKVFQKNKEIFGLLLKAYPKINTEFWSGGENDDEDEDVEEEEEH

SEQ ID NO: 148764 - protein, 84 aa, Heterodera glycines
  Coding regions on vcDNA: vcDNA=SeqID_75187; Strand=+; Position=1 -145,1461-1570
MAKFRTKWYTKQAMVLYFLSQGYKKSGIFGHPGQDLRRIYLYRQVTLTRVSKSLNRKMASLFGKTLEPELNLEPKVVLKTQPAT

SEQ ID NO: 148765 - protein, 229 aa, Heterodera glycines
  Coding regions on vcDNA: vcDNA=SeqID_75188; Strand=-; Position=1 -78,364-524,966-1088,1256-1340,1528-1670,2111-2210
  Homolog annotation: Hit_ID=NP_505750.1; Match level="QueryCoverage =92%, HitCoverage=92%, E-value=6e-64, Identity=57%"; Hit description =proteasome Alpha Subunit (25.3 kD) (pas-2) [Caenorhabditis elegans] emb|CAA98441.1| Hypothetical protein
NSGHFEVSDHEYGVCFVLFRLEYNIKHIFNPTNSFIFAAKDCVVFATENKHSVLTQPVSKISKLSDHIACVYSGMGPDAQLLVKKARKIAMDYQVLYGYEIPVPQLVSRVAAVMQEYTQSGGVRPFGVSLLIGGWDSEKGLLFQADPAGSYFGWKSTAIGKNDQLAKKLLEKRYNEDIEKVDAIHMALLAMRETYDVAMTEDNVELVVCTKDGFERMTKEALREQIQAL

SEQ ID NO: 148766 - protein, 44 aa, Heterodera glycines
  Coding regions on vcDNA: vcDNA=SeqID_75189; Strand=+; Position=1 -45,717-806
MSKIKKPQAILEMACFFPGKIRCQKGFLVSNPKEICCQQFLTFS

SEQ ID NO: 148767 - protein, 45 aa, Heterodera glycines
  Coding regions on vcDNA: vcDNA=SeqID_75190; Strand=-; Position=1-136
MAKLAAFFKQHINFFPLSHSPSGKLMQIEYALNAVKGSAPSVGTR

SEQ ID NO: 148768 - protein, 23 aa, Heterodera glycines
  Coding regions on vcDNA: vcDNA=SeqID_75191; Strand=-; Position=1-71
MNKTFISLHSIFLQYILPLHYKL

SEQ ID NO: 148769 - protein, 249 aa, Heterodera glycines
  Coding regions on vcDNA: vcDNA=SeqID_75192; Strand=+; Position=1 -124,661-746,1304-1648,2405-2599
VSTNPSGKPISFEEANKECQQHNPNAKLASIHSPMEEDFVAAFTKNRPFRSQKQGQSLYWLAQIKSAVEHPNNDMDGNYDNEGGSNSNGPFVWSDGTNVGYGNPTDKKSGKNFPWYTKPSTKYLEKHPGVVMYGKKKDGENNPWMDEKHTGTWSAISTQSATHGESVPDVHGYVCKMPTMKATNTHHLNPRAPPNADEQQQFSTKMAQNFNSPNPTENIDEKDEEPHFSRNNGNQYGLGSDDEHRRRWP

SEQ ID NO: 148770 - protein, 29 aa, Heterodera glycines
  Coding regions on vcDNA: vcDNA=SeqID_75193; Strand=-; Position=1 -56,722-755
MALLPYLVFKKCTVSLTILFLNFHFSEME

SEQ ID NO: 148771 - protein, 15 aa, Heterodera glycines
  Coding regions on vcDNA: vcDNA=SeqID_75194; Strand=-; Position=1 -6,365-406
MGVIYSLRSLILVLN

SEQ ID NO: 148772 - protein, 518 aa, Heterodera glycines
  misc_feature (234)..(234): Xaa can be any naturally occurring amino acid
  Coding regions on vcDNA: vcDNA=SeqID_75195; Strand=+; Position=1 -59,125-200,311-516,728-808,998-1089,1231-1382,1963-2210,2663 -2783,2887-2969,3452-3589,3633-3867
  Homolog annotation: Hit_ID=AAA57305.1; Match level="QueryCoverage =97%, HitCoverage=96%, E-value=7e-61, Identity=31%"; Hit description =cytochrome P450
IKFPQFFFFFIAVVAAWILYFQYHQKKHWHRFQYHQKKHWHRLDVPGPNVNIFFGNKISQNMEIHLGKILLLINIKYLLSSFLFDRREFCTKDPDMIRQIFIKEFAHFQNRFVSFSGIDLINGYINMLRDDDWKRVRNRVTPAFTTGKLKKLIPILCECTERLCKVLDEYASKKKEILLKDLYGRFLLDVIGRCGFSLDLNTYEEENVFLEQSRLVFNFGRKAQRIRTILCELXNLNQIIIEICLPEVLDIFQLLMNAVEEDDDVAENSAISAEDAQIIHSEMRSDEKQQKQGKHLTKIELFAQGFIILVAGFDTTGTTLTFATYMLAIESEVQEKLRKEVNEVLGEKVSENITYEITYEHLKQMHYLCAVVQETLRMFPVAPKTNRECNTDCVINGVPQKGDLVTLPIYVIQHDEAYYSNPDAFDPERFMPEQKAALDPLFMPEQKAALDPLAFLTFGIGPRNCIGMRFAEFQMYVTLALLVRRFRFCASSNTPVKPKINSNKNKFTNPGIIGRKFA

SEQ ID NO: 148773 - protein, 53 aa, Heterodera glycines
  Coding regions on vcDNA: vcDNA=SeqID_75196; Strand=+; Position=1 -130,464-495
MSDCGRDSVVMVSEEFYDKRVLIRSGSPVRHSTIMEEMESSDEAAQFALLALL

SEQ ID NO: 148774 - protein, 47 aa, Heterodera glycines
  Coding regions on vcDNA: vcDNA=SeqID_75197; Strand=+; Position=1 -21,514-636
MKFHQAMAFIRCELETQCSKWHRSASALSWASRICPEAEFDAFRANR

SEQ ID NO: 148775 - protein, 84 aa, Heterodera glycines
  Coding regions on vcDNA: vcDNA=SeqID_75198; Strand=+; Position=1 -94,149-309
MVKEQWQNDADALIDFELFFRKYGVTKSEEKLSLLQEVSQRAIGAKSHCDEQIYLRDYGTVEKIGHSFFSVDRSIIIEEKNIKV

SEQ ID NO: 148776 - protein, 202 aa, Heterodera glycines
  Coding regions on vcDNA: vcDNA=SeqID_75199; Strand=+; Position=1 -87,286-446,548-696,770-981
MNGYQPSRNEHTGDESSKKTRHNTNYFRYIYNGNSEQFGLCVAITEFNTENMPNYITEKLKNEFKIYRKLSKDSKHMLKVFESEKNGKIFKLVSEVVKYDFWELFQYGAKNINETRNILYNEMLKALEEFHKSGMHLSINLTKFYLVEKNNGNAKSYDKNDDDNDNNEMEIEGEKWKMNTKLADFGAAILFNEKPPKINVNG

SEQ ID NO: 148777 - protein, 75 aa, Heterodera glycines; identical to SEQ ID NO: 132731
  Coding regions on vcDNA: vcDNA=SeqID_75200; Strand=-; Position=1-225

SEQ ID NO: 148778 - protein, 83 aa, Heterodera glycines
  Coding regions on vcDNA: vcDNA=SeqID_75201; Strand=-; Position=1 -104,145-292
MLEMNCNWYRAMWANWFKKSLTRFCETIRDLTEFWKLVWFCAANTFKRICRRTLLQCSNKRPFSRVKWSVPFQHTKIFWQTIG

SEQ ID NO: 148779 - protein, 29 aa, Heterodera glycines
  Coding regions on vcDNA: vcDNA=SeqID_75202; Strand=-; Position=1-91
DEMRCTSCDHIVKSPMKSVFLRVEIADRF

SEQ ID NO: 148780 - protein, 131 aa, Heterodera glycines
  Coding regions on vcDNA: vcDNA=SeqID_75203; Strand=-; Position=1 -231,519-608,662-736
MNTISSRDNLLQFASPSLNMLSILMYSMLLFAALVLLISPATVVANEDVVGLAMRGTQQFFRRNAKWINLPSGGGSLVSGRGNFRPGFHSLHRSRTQLAEPLFITFKRSPTNLASMMVRLQKNPRHNDGTN

SEQ ID NO: 148781 - protein, 278 aa, Heterodera glycines
  Coding regions on vcDNA: vcDNA=SeqID_75204; Strand=-; Position=1 -155,310-430,475-662,1258-1451,1728-1906
LYDVSSAVDSPLIQFDFNALLPDRTPDDSEASGDEFGRGRAHSTLGFITQLVSFDFGPPQSVDGNRTVLGSLLALDSNGQLYATLFPFDGIGPCAPPKGPLSLFGFPASSQHRLLCSALDLLHIRHPFGVQHFSLWAMASEDGLLTHFILPMVRKFCDHCAYLVVGQRDVFRVELTALADHLWHQCTMKSNANPTKAMDEVNRSSSNVHQLLMFADSGESPSIGSVVCVQAPIGTDVDEDDDGGTDENRQQRRDLLIAAECSFSIKMGRKSAFLANVA

SEQ ID NO: 148782 - protein, 59 aa, Heterodera glycines
  Coding regions on vcDNA: vcDNA=SeqID_75205; Strand=+; Position=1 -135,459-503
MPTSNHGKYEMGQQSVLRCHSPQRKVLNTERMTNVQQIERRTEQTGALIERNLGIWQII

SEQ ID NO: 148783 - protein, 88 aa, Heterodera glycines
  Coding regions on vcDNA: vcDNA=SeqID_75206; Strand=-; Position=1-264
MDFLRLFPSSSSSTLSATNEQSQIAPSQSLLFSAYRNLGLLCYSNGEPNKLHLVISASAGPPSTAKTLEKSSNSSQPVKTCVLFKRIT

SEQ ID NO: 148784 - protein, 140 aa, Heterodera glycines
  Coding regions on vcDNA: vcDNA=SeqID_75207; Strand=+; Position=1 -158,411-489,569-754
MIDAICQKIDTKTAPISREECAKFDNNLFSSAIHMVLQLTGEEVMCKLIAGPCNSTNSSASAGPVKCDFCLLLHKKSENIINNFITLFESFNMMCDRLSSGVDVCKKYVKAMMNGISNIVGIHLEQTHAQFFCKNIFKCT

SEQ ID NO: 148785 - protein, 113 aa, Heterodera glycines
  Coding regions on vcDNA: vcDNA=SeqID_75208; Strand=+; Position=1 -52,381-456,500-617,799-894
MSLLNGKNATGHCQSDGDFKHELHYVLTTIFDEKAAENLKSLSLVQLIKKAIIPQFRNFLRTKSVQLEKLFGVLNELSSNSSNCFRLISELLRQDSQRAKMDEEHKKHTETVP

SEQ ID NO: 148786 - protein, 355 aa, Heterodera glycines
  Coding regions on vcDNA: vcDNA=SeqID_75209; Strand=+; Position=1 -39,91-273,454-518,587-701,753-1043,1094-1179,1235-1418,1474-1578
  Homolog annotation: Hit_ID=CAE75378.1; Match level="QueryCoverage =98%, HitCoverage=46%, E-value=1e-115, Identity=57%"; Hit description= Hypothetical protein CBG23365 [Caenorhabditis briggsae]
PIGVNPNVNEVTKLWCPKGTYSAVANLFFQNPEESVKSLFHSPSSSFRPFTLFVFAVEYFVLTLWTYGLSVPSGGQIDPGKYALVGAAAQLGGIVRMTISLTAIIVEATKNITFGLPIMLVLMIAKWVGDWFTGGLYDEHIDLAEVPLLGWDPPKLSRNILAKKVMRRDVVALERVENVGRIVEILRSTRHHGFPVVNRIDASIGDSQFPNYGNLLGIVFRSQLIVILQKKHFTLDYEGKYPANGHTPISLEDFSEFYPRVESKISQLGLTVADERSWVDLKPFMHPSPYRVPLDSSLDSIHRVFRGLGLRFLLVVDRENRLRGIITRKDIARFKERRVKGAYLVHEIHISPYNN

SEQ ID NO: 148787 - protein, 58 aa, Heterodera glycines
  Coding regions on vcDNA: vcDNA=SeqID_75210; Strand=-; Position=1 -103,617-690
MASICDELRNLRGKSGEKAGDFMGKEWKRDCQFKGVCLTFDADQKGLLHQLDQITPSW

SEQ ID NO: 148788 - protein, 31 aa, Heterodera glycines
  Coding regions on vcDNA: vcDNA=SeqID_75211; Strand=+; Position=1 -49,1048-1094
MDIGHCPNYSWLCNVCKHLNSLEEKVLFLGY

SEQ ID NO: 148789 - protein, 139 aa, Heterodera glycines
  Coding regions on vcDNA: vcDNA=SeqID_75212; Strand=+; Position=1 -125,343-637
MDRLKPYEDEIVDGRTCAEIIAGRENANGTSQSRTNAAGDGCASSSTPITSGSSSVIDAVIDAVIDASSSNSANAQGTTVTKLSTAKRGSRAKLTIVGKETGADQPKKPPASTTKRSEPKEEVGNGKEKRERLASRIGI

SEQ ID NO: 148790 - protein, 36 aa, Heterodera glycines
  Coding regions on vcDNA: vcDNA=SeqID_75213; Strand=-; Position=1 -8,316-418
MEKVIKCQSDRMNMAFIFIIPKPEKRTQKLKAQIVE

SEQ ID NO: 148791 - protein, 21 aa, Heterodera glycines
  Coding regions on vcDNA: vcDNA=SeqID_75214; Strand=+; Position=1-63
MMMIDWVVTSTTTNSRSELEN

SEQ ID NO: 148792 - protein, 232 aa, Heterodera glycines
  Coding regions on vcDNA: vcDNA=SeqID_75215; Strand=-; Position=1 -278,737-927,1001-1109,1323-1443
MEQCRMDVDFSLMDRLSPLLCVQPFFTTKNAVQNKLSPPPALFLSSSESVFVGGLKDDFEMGGGGCCGQGGEQPMPKTFHAKCYFNKLLLNLRIPIANPSSSVSSPADGTADYRKRCLHPEYLHLALDSANLELPKFSLADLSLFWTLSLECKTAKGTFVGDPTVLQCPREAMTFFFADTSNAEKTFGNKGMNFFLNFFESETNCSPNRLPFKKNCANSQWIFWWKPRKSMC

SEQ ID NO: 148793 - protein, 199 aa, Heterodera glycines
  Coding regions on vcDNA: vcDNA=SeqID_75216; Strand=-; Position=1 -358,1153-1279,1730-1843
TSIATLVERRPDIFAVSVRAPALVAVITHDDPLSADAILQQQQINGDEERLSFSSSSSSVLSPHPPHPSPLLVASVVQQMNERAQKFFAAAKCIKIGKQRRLEEQREQFGELCDGDCLRFVANDFFTSFTFTTDLQRVLFESKSHLKECDFIECLQSAQNGMPPQCIDILNIAAPDERRTVLKNDILTFQINNSFEKQN

SEQ ID NO: 148794 - protein, 59 aa, Heterodera glycines
  Coding regions on vcDNA: vcDNA=SeqID_75217; Strand=-; Position=1-178
CLVNIRSLYNKIDEIALNLVNKNIDIFLLTETWTKEENPILFSPWIIENYNFIFCHRKS

SEQ ID NO: 148795 - protein, 274 aa, Heterodera glycines
  Coding regions on vcDNA: vcDNA=SeqID_75218; Strand=-; Position=1 -133,363-1054
MYLHKISIPSHDTLSYYEDLYPYDPRKLDFCWGPDSCVEASCSFDNASKKSTSDYPYTALSDQLAAISQQMDNNSVDPITKQLLKICVELLQQVQQQQAVISEQDLQLQHLKQQKMMEEAIQDHERRRSVVVMGLPESQKQKPSERVAEDRTAISGVLDELGIESPITVYRMGSPDQAKTGQNRPRLMKVIFGCSKHQKQTLAQWNKGRAQINQKLGMSNIRIRPSLSQEELKARRVLQEECSRKRKEDGGEWVVYADKVMLRSDIAAFKNNTN

SEQ ID NO: 148796 - protein, 108 aa, Heterodera glycines
  Coding regions on vcDNA: vcDNA=SeqID_75219; Strand=+; Position=1-327
MMSAKFFTHLINSASVRPISTSCCRKELRELWKLDKRNPFQEIPEAWVTSLDDVEQKNCGLIQLHPGMASIWSENGTMIGHWQKIYSKHFLNVHKQHKHCLISVDEKR

SEQ ID NO: 148797 - protein, 58 aa, Heterodera glycines
  Coding regions on vcDNA: vcDNA=SeqID_75220; Strand=+; Position=1 -39,471-670
QKQSLRRWLTLTFVCWLFFAAQCDLLRLLDFKIFAPFCGKLDYLHCFFFVALPVTFFV

SEQ ID NO: 148798 - protein, 52 aa, Heterodera glycines
  Coding regions on vcDNA: vcDNA=SeqID_75221; Strand=-; Position=1-158
FAQRGGLNSHGRNGGVKKAPHSQRSIDHFETEHNAAEHQQQIPAENDGSHRD

SEQ ID NO: 148799 - protein, 478 aa, Heterodera glycines
  Coding regions on vcDNA: vcDNA=SeqID_75222; Strand=+; Position=1 -80,482-583,1243-1335,1502-1648,1696-1827,1872-2073,2136-2278,2327 -2374,2451-2543,2592-2796,2848-3041
  Homolog annotation: Hit_ID=NP_740899.1; Match level="QueryCoverage =93%, HitCoverage=16%, E-value=1e-73, Identity=32%"; Hit description =chorein A (356.5 kD) (1J482) [Caenorhabditis elegans] emb|CAD27608.1| Hypothetical protein T08G11.1b [Cae
PVQCELAGGDGLDIMNLVAGFPLIFTCLGLNWSTELLRTNLMLYAPYWMVNETGKQLAYYSKSVQISHPPGTNPMILPLKESEFMSEKKAKMTVDVQLGQSGLTKVVTILPFFLLQNDSKVDIEVREPHLTKWIVVPAESVIGFWPAEKKKHKKLVARYAKTKEESVQFPITEAFEGFCQIRNNLIGLYVIVSLLDESSVIHMEIFVPGMVPAILMNDTKYPIRYRQTGHRQWQIVKPNQMAPFAWTDSLNDCKLEWESGDAENSDELLRNRDISYLPANNDGYHYCVSFLDGRQRVLLFTADKKVSFIAHQAYEMEQPDIELELHLHGLGISLVNNLKSIEVLYMAISPGKQKKSDEKSLKMATGFWCQYRQTTHQQTLHVKLHNFQMDNQLPASTFPSLLAMVPQPKYMVKNDPKPFLECAFVMSQSEHTNIVQIKLLEALVQEFAIRIDRTLLNELLDIIPKGIIQTGYTVNKDD

SEQ ID NO: 148800 - protein, 27 aa, Heterodera glycines
  Coding regions on vcDNA: vcDNA=SeqID_75223; Strand=-; Position=1-84
LSTSPPNRRCPFWRTEDRNWKMDPIRA

SEQ ID NO: 148801 - protein, 750 aa, Heterodera glycines
  misc_feature (145)..(145): Xaa can be any naturally occurring amino acid
  misc_feature (360)..(360): Xaa can be any naturally occurring amino acid
  Coding regions on vcDNA: vcDNA=SeqID_75224; Strand=+; Position=1 -192,244-433,485-618,671-892,971-1543,1638-1811,1858-1971,2020 -2149,2252-2483
  Homolog annotation: Hit_ID=CAE73337.1; Match level="QueryCoverage =98%, HitCoverage=87%, E-value=2e-91, Identity=30%"; Hit description =Hypothetical protein CBG20766 [Caenorhabditis briggsae]
NPIKAYSNFTERLTKSLNLSQSPCDNFYEYACGNFKGPISFDQLTVQNVKTFVGLVEDERYSKNLPLPVKQSIQFYQKCVGALPLPVKQSIQFYQKCVGAMSDWSAEVGDGSRLRKKMIMLENLLDGVPFPAVSAKTQLNVSTDXTVDTLSIALGYLSNDVDTLSIALGYLSNDEGVNTFVSVGVSTNWLEPHGEHPYTLHFDQARLLLPTNYYLKARLLLPTNYYLKAWENVRAMLHANLVSSLKAYTKFAGANVTNEQIDADAREVMDMELTIATNLLKAPDERRKFARTHSRKRTKRWARTHSRKRTKRWASIWTLDCSPWALKVPEGVDPAHRAFLHPRAQSDQKHNAIFGHGKHXSLFVNYPLFHISPRTLYNYLYIRLLSANLNYLPCPIDLAKSRAFSVPVGLEFPLSTTVALSKTRGHMTRMASILVAPRGERAMCASINAQYFTYANARIFLDAQLPEKEQRTKLRENLRTMVAGVVDSFRGMVAQLDWGMVAQLDWMSSEAKRASFLKMDNLVTNLAWPDFVEDDAALSEFYSLLAFREEDTFTQMKDKLRDFWTNSQAEKDKLRDFWTNSQAERLFFANDTDRLDFGIPSIVNAWYSSSRNSITFPLGILSKPFYDPSSRNSITFPLGILSKPFYDPNFPASVNYGALGVIAGHELSHGFDDEDEGIQWDGTGTLRGWMDAASEANFEQMAQCVVDEYAQFEPLSGMHIDGTMTQGENIADNGGHVGKNEQISQNFPVL

SEQ ID NO: 148802 - protein, 288 aa, Heterodera glycines
  Coding regions on vcDNA: vcDNA=SeqID_75225; Strand=+; Position=1 -53,343-771,845-939,1253-1542
MTATIPLIQNLDFYSNSDFGSFIDDLDDLPLSPANSSCTLLACDDEYKNNTDADDHLNFADKASSSAARDETASTTSTVSHSYRMEKLVPMPSSSATAASSSKRRRKMVHSNSQRQQKKKQNLTKQQMSKINKKDTKSSKLDYELELKRRQEEEEELIAISSISGPTTSSHQHQQFDFTKVKGKRGRKSKDNSQFLSRLTCFAPTNTGRNKLAAQKCRERRVNQKQEWESEGWSVEADEDEIFFMKEEDDDDELGEGIHTFDDVSTQQTAAEDKHLHYHPNYYAFCNN

SEQ ID NO: 148803 - protein, 97 aa, Heterodera glycines
  Coding regions on vcDNA: vcDNA=SeqID_75226; Strand=+; Position=1 -149,961-1105
MPSAISVGLGRIAGGFVPALFGGSFGPVSAWLTRGWYGQHAVPLGKRFDRIILNSFNSDNYEEFYQKENWVVAQLSSLSGTLFTKITLEGKMLPIVQ

SEQ ID NO: 148804 - protein, 116 aa, Heterodera glycines
  Coding regions on vcDNA: vcDNA=SeqID_75227; Strand=-; Position=1 -69,223-427,950-1026
MPSLIGTAGPSVPSFLKNCTAKKHFLIFGNFLNLIEIFSNFPKSRNPARDPANFKCGIAEFAGLIPRDPVPQKVLSSSPAAGSANLKFPGSNGLSNAYTDNLYTYAPRPSCYGAGQ

SEQ ID NO: 148805 - protein, 43 aa, Heterodera glycines
  Coding regions on vcDNA: vcDNA=SeqID_75228; Strand=-; Position=1-130
YGTERLPISDIFGVGIPTSEIFDEKSEIFLIFLFKKLASFVQF

SEQ ID NO: 148806 - protein, 76 aa, Heterodera glycines
  Coding regions on vcDNA: vcDNA=SeqID_75229; Strand=-; Position=1 -133,1495-1592
MGEFFACNFSLALEVVMSPMREFFDSYGHVNVNVNPDIISDYLVEVNGAAINLENDGQFDGNNELIADKQQLKVGE

SEQ ID NO: 148807 - protein, 255 aa, Heterodera glycines
  Coding regions on vcDNA: vcDNA=SeqID_75230; Strand=-; Position=1 -69,194-469,512-707,757-983
  Homolog annotation: Hit_ID=NP_507845.1; Match level="QueryCoverage =94%, HitCoverage=39%, E-value=7e-47, Identity=37%"; Hit description =transposase family member (5U321) [Caenorhabditis elegans] emb|CAB81975.1| Hypothetical protein Y116F11B.
MDETAVWFDCPDNRCVDNKGAKDPYVLVNRKRPVPQIVKQFAGKLVINFAGPIWMNDDTTEDYLHKIIGAKLFVGERLLVWDAFGSHKSERTTKVVKGLGVETVFVPGGCTKFIQAPDVSWNKPFKERIRHFYNTWMSNDAEKEFTPAGNPKAPALHMVLDWIHRSWQEISKAVIIKSFEVCGLTTPFDGTGDEKIACFKPEGAIGPIGTKFLREFRENETVKDGRNDHEEAGLSDDDGDVELDGVGDDDEFFIC

SEQ ID NO: 148808 - protein, 58 aa, Heterodera glycines
  Coding regions on vcDNA: vcDNA=SeqID_75231; Strand=+; Position=1 -97,498-577
MVAQSEKRWHAEAIAFLFEGATKYGMGQHSQKGLCRHVANGVQLFESDLMHLGNGRSF

SEQ ID NO: 148809 - protein, 376 aa, Heterodera glycines
  misc_feature (368)..(369): Xaa can be any naturally occurring amino acid
  misc_feature (375)..(375): Xaa can be any naturally occurring amino acid
  Coding regions on vcDNA: vcDNA=SeqID_75232; Strand=-; Position=1 -182,245-316,359-428,478-513,713-802,858-893,977-1131,1180-1297,1343 -1450
  Homolog annotation: Hit_ID=NP_493756.1; Match level="QueryCoverage =90%, HitCoverage=94%, E-value=1e-59, Identity=41%"; Hit description =lipase, class 2 precursor family member (32.1 kD) (2A845) [Caenorhabditis elegans] gb|AAC26254.1| Hypothe
LFPLSLCFLLLFPSSISATFSVTFRQFLRERYGDAVDKELSREDVGGGGSFGGGTHQKGQQRRPVIFVHGIRRPVIFVHGITNNAGTFGSIQHFLQNNGYGDEEVYGQNNGYGDEEVYGTTYGDSGRTNVAFVTMSCHYVKVAFVTMSCHYVKVIRMIIVAVSAYTDNKVNIVAFSMGSPVARKAILGGMAILGGMCVDTNEDVGPPLTDVGPPLTNLVRAFVGVAGANWGSFLCVLPGSCNLLNGMSCGSRFLKDINSKKRYEGEFIYTIYSTGDEKRYEGEFIYTIYSTGDEKVGYQTCGRIASAIDGENAAFQKEGLNHDGVIFGTANLQYNLVTYFQKEGLNHDGVIFGTANLQYNLVTYNRPXXTFERNXI

SEQ ID NO: 148810 - protein, 187 aa, Heterodera glycines
  Coding regions on vcDNA: vcDNA=SeqID_75233; Strand=-; Position=1 -50,128-203,303-425,482-571,616-641,693-756,957-1001
  Homolog annotation: Hit_ID=CAE67866.1; Match level="QueryCoverage =100%, HitCoverage=100%, E-value=2e-51, Identity=55%"; Hit description=Hypothetical protein CBG13458 [Caenorhabditis briggsae]
MVQMWCMETYPCGDPRLPPHHCFPPKLVNPDELTKRTGALYYKLDLLDLEDQVALSKRIAIMKLERNFTKEDTYTLDAQTTNDFKEKIAEIAELFEETESDEDQARMVLEGSAYYDVEAKDGVWIRIFCDGVWIRIFCEYGDLLIIPKGIAEYGDLLIIPKGIAHRMTTTPKNYVKVRRFFKSSDSD

SEQ ID NO: 148811 - protein, 30 aa, Heterodera glycines
  Coding regions on vcDNA: vcDNA=SeqID_75234; Strand=+; Position=1 -17,346-421
MAGITILFVTLLALFLTVLVNYFEIFRNLK

SEQ ID NO: 148812 - protein, 37 aa, Heterodera glycines
  Coding regions on vcDNA: vcDNA=SeqID_75235; Strand=+; Position=1-111
MQQMSVKFAQEMQRMFSATFPFGPPAAPPPQFHLPPQ

SEQ ID NO: 148813 - protein, 17 aa, Heterodera glycines
  Coding regions on vcDNA: vcDNA=SeqID_75236; Strand=-; Position=1 -13,443-483
MWLYVQWPMCQSQPTND

SEQ ID NO: 148814 - protein, 93 aa, Heterodera glycines
  Coding regions on vcDNA: vcDNA=SeqID_75237; Strand=-; Position=1 -60,190-411
MSSIVYIFYCFCFSVLFNLTEKNPIEYGEEAKLKIEQKIIGKNIGNFVKKETKSENIQENNRKKIKMEEKDEEMSQKFGRPQIKWEEKFFKIN

SEQ ID NO: 148815 - protein, 21 aa, Heterodera glycines
  Coding regions on vcDNA: vcDNA=SeqID_75238; Strand=+; Position=1 -33,218-250
MANSAKKITIKSTGKNGNPNN

SEQ ID NO: 148816 - protein, 47 aa, Heterodera glycines
  Coding regions on vcDNA: vcDNA=SeqID_75239; Strand=+; Position=1 -54,139-228
MKAMLQTTQRQNKMRKTVQFFRYKKNLRTNLPLELPFPENDVTKNER

SEQ ID NO: 148817 - protein, 98 aa, Heterodera glycines
  Coding regions on vcDNA: vcDNA=SeqID_75240; Strand=-; Position=1 -96,147-347
MTTPANAARARSAKAKLRDAKRRRAAVGRAGYTRKAQRGERCAICMRNVGDITRTTLGCTHPFHHRCLYRWLRYHTNCPVCRYNFVRTIPRSERRQPL

SEQ ID NO: 148818 - protein, 88 aa, Heterodera glycines
  Coding regions on vcDNA: vcDNA=SeqID_75241; Strand=+; Position=1 -176,385-472
MLSLYTMLEFSLLVLNGIAIINRERVLNKVNKHIAVFYPIVFPLFEVFEESAAQFRSRNLFVPSVVIKFFHFAYLTDKSLPNFQHTNE

SEQ ID NO: 148819 - protein, 76 aa, Heterodera glycines
  Coding regions on vcDNA: vcDNA=SeqID_75242; Strand=+; Position=1 -16,329-543
MVADSAVVSARTECPLQFPISFWNVHPRAQMITSVEIKKVMKELMMPMEIEFYHFQHFIFIFSLEFNKYLFAYMYF

SEQ ID NO: 148820 - protein, 50 aa, Heterodera glycines
  Coding regions on vcDNA: vcDNA=SeqID_75243; Strand=-; Position=1 -77,1263-1338
MLLIITVTTIIYFFIPPNFSIQICVRIVKQLENCFSADGSFFLPVWSKIW

SEQ ID NO: 148821 - protein, 66 aa, Heterodera glycines
  Coding regions on vcDNA: vcDNA=SeqID_75244; Strand=-; Position=1-200
MCGLLSQVLNDYGVNAEKVHLIVRDNESAMQKATRIAGFESLHCTAHNFNLVILINQKFHDYLFLI

SEQ ID NO: 148822 - protein, 137 aa, Heterodera glycines
  Coding regions on vcDNA: vcDNA=SeqID_75245; Strand=-; Position=1-414
MPPQSKYIKYFKISHGTAKCLSCSYSYGSKSTTFPKTCLREHLQRHHPDKYEELLKEEEKAKVKPNGQQSIQSLLLASTSTGRLCLSPTPAKMPRNESPFSSSQPKIVKSFCNYLDILKFQSRLSTMEFGWRNDKKG

SEQ ID NO: 148823 - protein, 16 aa, Heterodera glycines
  Coding regions on vcDNA: vcDNA=SeqID_75246; Strand=+; Position=1 -25,377-402
MLKVIAGRYFVLVKGT

SEQ ID NO: 148824 - protein, 203 aa, Heterodera glycines
  Coding regions on vcDNA: vcDNA=SeqID_75247; Strand=+; Position=1 -106,1799-1945,1988-2131,2187-2401
  Homolog annotation: Hit_ID=CAE72497.1; Match level="QueryCoverage =88%, HitCoverage=29%, E-value=5e-52, Identity=56%"; Hit description =Hypothetical protein CBG19676 [Caenorhabditis briggsae]
MARVEDEFDVVIVGGGPAGLSAAIRLKQLAAEKAKAITPLNYATALDDSPVMKELQMCRNVRPSFNSRLGFWGGMAYTGTFFVMGRGIEPWTMHHGHPDNEKTELKEKHSEIEYPKPDGALTFDLLSSVHLTGTNHEEDQPAHLTLKDDSIPETVNLALYAGPESRYCPAAVYEFVPKEEGSAVSAQQRLQINAQVAKANWQC

SEQ ID NO: 148825 - protein, 60 aa, Heterodera glycines
  Coding regions on vcDNA: vcDNA=SeqID_75248; Strand=-; Position=1 -93,874-963
MKNAMDDDDKTKVTHFQNVKKEFLIFCYQKFIMCNLIRFTYWIFDQRVKMLRAKTLIRDH

SEQ ID NO: 148826 - protein, 151 aa, Heterodera glycines
  Coding regions on vcDNA: vcDNA=SeqID_75249; Strand=+; Position=1 -63,789-878,999-1053,1635-1792,2134-2223
  Homolog annotation: Hit_ID=A41101; Match level="QueryCoverage=96%, HitCoverage=9%, E-value=1e-49, Identity=61%"; Hit description =phorbol ester-binding protein unc-13 - Caenorhabditis elegans
MATKRTALATAAKTTVQDQNLKQLVYRKCLQALIYPISATTPHNFCTTNFQTPTWCYECEGLLWGLARQGAAEKSNKHGEGDRAQNLIAVIRDRMKAQERNKPEVFRRIADAFTMDDRTQQEALRVVKNSILEGSSKWSAKIQLTGGIFMC

SEQ ID NO: 148827 - protein, 132 aa, Heterodera glycines
  Coding regions on vcDNA: vcDNA=SeqID_75250; Strand=-; Position=1 -17,179-277,333-615
  Homolog annotation: Hit_ID=AAL78214.1; Match level="QueryCoverage =71%, HitCoverage=49%, E-value=5e-10, Identity=35%"; Hit description =putative esophageal gland cell protein Hgg-20 [Heterodera glycines]
MSSGLLWRAVLLLLVDCASILFWFFLDNVKKRRRPHKEIFICADCWLLVFDFLAPSQLGLEIALISRRFDLRVDEHFKTRKWTLNKQLLIQWDIEENGTKKMQIVKSDGNPLPIPQKPLPNKVLGLRGITIA

SEQ ID NO: 148828 - protein, 140 aa, Heterodera glycines
  Coding regions on vcDNA: vcDNA=SeqID_75251; Strand=-; Position=1 -56,100-140,646-972
MEDEHLFDSYSFVGLSELDDELEKCADDPDEQIYEILKEFPTGITSTFLEQKYMERLIIAFEMLRIEASLLFRYVTKRLAKPLPRNWLSLMRSTEEFELKDVSTFTMLVGQTNQMSSVEEDFRGTFDPSGRFPSKSILEH

SEQ ID NO: 148829 - protein, 150 aa, Heterodera glycines
  Coding regions on vcDNA: vcDNA=SeqID_75252; Strand=-; Position=1 -126,172-303,523-717
  Homolog annotation: Hit_ID=NP_573330.1; Match level="QueryCoverage =41%, HitCoverage=10%, E-value=3e-09, Identity=47%"; Hit description =CG7274-PA [Drosophila melanogaster] gb|AAF48893.2| CG7274-PA [Drosophila melanogaster]
MEYESNELPPIYLPVGTEVSAKFKGAFCEARITKLVKSVKIKVQLKNSNIIAVDESAIQNGRMEINQNVEVIYMKQIHKGQIICIKLYHPDKRSKKKKEEAEKNSSTFNSPSSQRSPRYFRSSSVTPLKGIASTRSATRAIAHLQFEVKN

SEQ ID NO: 148830 - protein, 415 aa, Heterodera glycines
  Coding regions on vcDNA: vcDNA=SeqID_75253; Strand=+; Position=1 -123,170-335,471-709,767-909,960-1007,1607-1709,2219-2268,2829 -3022,3131-3311
  Homolog annotation: Hit_ID=NP_491034.1; Match level="QueryCoverage =64%, HitCoverage=80%, E-value=3e-40, Identity=37%"; Hit description =putative cytoplasmic protein of eukaryotic origin (37.0 kD) (1D303) [Caenorhabditis elegans] gb|AAF36018.
MRSQLLALLHGASLPLNTVSHAFAYGSGAIPQREEDPNTKMVDFLIVCNDSLLFHQQNLLQYVSIALLGLSSLHPIQFAKKPKPLLSSLPMVRCELGRLIKYGIIQEDDLETDLLDWTWLYAAGRLQKPVLEVYNGRGETSDVQRTGRNIGRALFDNYRAAAHAALLQLDGWFTMDQFLNKVVSISYGGDVRRYFGAEDPQKEEKLVAGASRQLRALYKPILEADREVHLHADDKIEQDCSTPIVFFRLTQMPRAVLERISKTYYPQRKAADTEQTFIKINNVYGKKRMTSSDSVVIERLGKVSSAWPFTFSVGEFANLLLVRCDQMRNCFTLSVRIERRRQQQQRMVSQTFGDCREGQLKPAELLSQSQRLAAVLCDFCGHCPQGIGPTVAVFVLVPISKESITANFGTVVEKT

SEQ ID NO: 148831 - protein, 54 aa, Heterodera glycines
  Coding regions on vcDNA: vcDNA=SeqID_75254; Strand=-; Position=1-386
ELLVLFDSSMCLLLICKISKIFVKFQKSYDQKELKNPVIRTFFALIFLCINKNF

SEQ ID NO: 148832 - protein, 74 aa, Heterodera glycines
  Coding regions on vcDNA: vcDNA=SeqID_75255; Strand=-; Position=1-225
MCLFRESHVRDHLRKVYGTLALTMLSAILGIVVNAVMDFSSLLPVFSLMELGFLIGIPFFGSTVYVSNQVLRVE

SEQ ID NO: 148833 - protein, 85 aa, Heterodera glycines
  Coding regions on vcDNA: vcDNA=SeqID_75256; Strand=+; Position=1 -31,109-335
MPTVRISSPIVYRGQKTLKEYEKTITLGYEKMIGVWFSLTKRILAEYVTCYGDKMGEEIFFEMTLIKKAFVWQRNILCVICTITV

SEQ ID NO: 148834 - protein, 183 aa, Heterodera glycines
  Coding regions on vcDNA: vcDNA=SeqID_75257; Strand=+; Position=1-552
MLFVRPTFLLLLLFFCSTNFFPIISASADQNVENSEAEQSENILLQRPLNIIEVRTKQIKNCTKFQCFKKVKLADTDGDGRISLDGELKQFLESTKFERMFKALFDHQSRGELRLEGFRKTLTKHFEGRKYAPKLPTLVNEVNVNKNGGIDWHEFKLFMYELGKQVADKGRKFDHFEKGFRKQ

SEQ ID NO: 148835 - protein, 49 aa, Heterodera glycines
  Coding regions on vcDNA: vcDNA=SeqID_75258; Strand=-; Position=1-154
MIARIAEKIRDQFPNVDRLIAKRKPSLSKRLTESKNLEMYLICNFNQQI

SEQ ID NO: 148836 - protein, 82 aa, Heterodera glycines
  Coding regions on vcDNA: vcDNA=SeqID_75259; Strand=+; Position=1 -186,330-392
MAIKYGPKIAKYGHKMAKISKYGNKWQKCQNMDINFSKLSAKFLQICWLKLHMRYISKFFDSRKINNKSEIFAFLLIFDIIY

SEQ ID NO: 148837 - protein, 73 aa, Heterodera glycines
  Coding regions on vcDNA: vcDNA=SeqID_75260; Strand=+; Position=1-222
MKVDELFIIVMRSLVRECLDWGPKGEAVPLMCLLTFFKGNSKNSDMPSNLSKELHTFFLSFLFILYFTLVFFI

SEQ ID NO: 148838 - protein, 207 aa, Heterodera glycines
  Coding regions on vcDNA: vcDNA=SeqID_75261; Strand=-; Position=1-623
ERDDETDTHRKRKIEDEEIDPLQNQSLTKKARIEALEEAARQRDDGKEEKEERTGQEFLEMYSVNYREKLNEVRLELIRDLFNIQDHMKKYQGVTDGRTIQALNEEALRMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQL

SEQ ID NO: 148839 - protein, 837 aa, Heterodera glycines
  Coding regions on vcDNA: vcDNA=SeqID_75262; Strand=+; Position=1 -156,596-716,1002-1511,1955-2582,2729-3825
  Homolog annotation: Hit_ID=CAE56395.1; Match level="QueryCoverage =27%, HitCoverage=30%, E-value=5e-33, Identity=36%"; Hit description =Hypothetical protein CBG24082 [Caenorhabditis briggsae]
MGVHVHKGPPRDELLSSLKKPLLLILDDLLTIIDEKSLSELFIKKAHHLNMGGYFPLTKRQKYRLLPYANFVRKLARVRTEKGAKKVFQQNGDGSLMVFKPKQRERDSKIPTQIVNDEGLDETGSIPTLEDPYTTAEESDAEPTTSTPKTRPLIRPMRVGTTKFRQKQKSFVVKKQQKIMSIINNDPEKFGVGSRGHILRADGTAYLKSNVNQALERILRRSPENAPSPIGTKALEQRLRNDPRTSGILKQKFNEQSGSGVKNRGTEFENREIHKYFQEKNIQKHKAHTSTVKAALAERCIRTLKQRLYRYFSQKHTIKWVDVLPKIVNALNNSKSRITGMKPVDINPGNAQKIWKRVYGDEFSRKAYRKPRFKEGDHVRLAKYKSSFEKSYLPNYSDEIFQVYDIKKAKPHRYGIKDDKEEPFDTRFYAEDLAKTRKDAETTYRIERVLKTRTRSGQKEHLVKFYGYKEPEVHLPRTLTFGGHWLCGLHSIIYTNSWPAIGTTENQWIKVHLKNGDKIKIDIPAGSYQNEQELENAINESIKNGIKQPATRVKRQLEDGVDLFFHYNPDDYWEKIEEERQRYKELLKLIDTKSRERDDETDTHRKRKIEDEEIDPLQNQSLTKKARIEALEEAARQRDDGKEEKEERTGQEFLEMYSVNYREKLNEVRLELIRDLFNIQDHMKKYQGVTDGRTIQALNEEALRMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQLRRLVDYRKKRFAALEYEAKKRDALQQQPMALALTH

SEQ ID NO: 148840 - protein, 64 aa, Heterodera glycines
  Coding regions on vcDNA: vcDNA=SeqID_75263; Strand=-; Position=1 -21,947-992,1099-1226
MIRISRRIFCEQSQTWRRLTIEDFERTVSEEMQTSNSYKERAEMEMISSGAEMTTTACEYEKNN

SEQ ID NO: 148841 - protein, 37 aa, Heterodera glycines
  Coding regions on vcDNA: vcDNA=SeqID_75264; Strand=-; Position=1 -46,225-292
MENYDNFLLGQFVHDGFSECHDQNLSEGLSCQNRPRK

SEQ ID NO: 148842 - protein, 225 aa, Heterodera glycines
  Coding regions on vcDNA: vcDNA=SeqID_75265; Strand=+; Position=1 -72,379-439,537-681,847-928,1196-1324,1379-1567
  Homolog annotation: Hit_ID=NP_501209.2; Match level="QueryCoverage =47%, HitCoverage=19%, E-value=1e-16, Identity=36%"; Hit description =putative protein, with at least 6 transmembrane domains (4I264) [Caenorhabditis elegans]
MLVAHWLVCGRAEQRADELIRRRQEKKSVRRMLHGMMGDVSKVYGVDPTAQHRRELPALDIPPGLSCALLLLASVTAVLALLNWFVGLYFAINYDLMMPSVLDDFVECVASGCQLILFGTLWWWTRRVITFKRWDPHHKAESRGDLVLIGGSAAFMTVKLFLQVLELNFQRIDGFLPLSEAILRTASLVLIQSAEWLQFCSLQRVMALHFEYSFGDQQQGCPSLN

SEQ ID NO: 148843 - protein, 210 aa, Heterodera glycines
  Coding regions on vcDNA: vcDNA=SeqID_75266; Strand=-; Position=1 -189,387-564,900-1162
MPFNFALLLPLISVILFQFVHHSSSSSSSSSSQIPTTIPDQFELNPAKIDIFLRRTALMALLRAKANTLMDTVPLVEQVLFKQCVAESKEAICPVKLAKCLAKLIRSSRDQQQLHRQNKWAERNESTKAAEKARQMFISQHSSKDNNRKLRRIRHFFALWRRREGRRKRKELMGMKQRRRKRAMERRTTEWSRKMKRMGRMGEAVRTAAG

SEQ ID NO: 148844 - protein, 89 aa, Heterodera glycines
  Coding regions on vcDNA: vcDNA=SeqID_75267; Strand=+; Position=1 -256,382-395
MVFMMCRNLFLFLAIPYDETPPPKFVYTFQGPGRGRWTFSCQFTSADALDLFRKGHGMYQTKKDGCRYFFCSVKRCPYKMIGIENEIFV

SEQ ID NO: 148845 - protein, 126 aa, Heterodera glycines
  Coding regions on vcDNA: vcDNA=SeqID_75268; Strand=+; Position=1-381
MCRDAFSKCPPTDALPPISDKMQTKSSSSSPKKQQNSPKANRPRIVLKLRWNAGGFLPDHSPNDSTAASSSSCTATADDCANMKVPKSETQPPLPLPQAKLFELAMCVQEMRQIAAGWNLLFREKR

SEQ ID NO: 148846 - protein, 396 aa, Heterodera glycines
  Coding regions on vcDNA: vcDNA=SeqID_75269; Strand=-; Position=1 -321,488-767,1421-1578,1793-1879,1927-2142,2198-2325
  Homolog annotation: Hit_ID=XP_309937.1; Match level="QueryCoverage =50%, HitCoverage=24%, E-value=2e-35, Identity=39%"; Hit description =ENSANGP00000004373 [Anopheles gambiae]
MFCYTGATMKLCCERFENEKSQPIQSHLTTQVSGEVTISNSGEKQRTEKSTKSGQKGDGQRVKPQKELARKSSAQIQSVGTVKKESKSNYPALTHKTTADPNETDIPQQEESVSAFSVDVPPSQIPSTQQMVKMENIMAKNERAPGKDYAEGKALKETIEKEREDAEERRSQKAFQQYFLEKINDGWPYDDKFYRPTNNEGEFGKTVVELTTKSSTTGEELDWEKLLPINTAKDLFMALQPSGIRDLRDGQPNALSILCYKAVKLLVRATQTNPPQKEHRKVMLNCIRLLTRLMPFFFEQNEWREFFWTNLPQDEKAGLNDSQKELPLSKLLLTALSDLLFCPNFTIGILDKNIHLENISKVDSCENIWQSGVGFANKTPQSAVYDANRTEILKLL

SEQ ID NO: 148847 - protein, 57 aa, Heterodera glycines
  Coding regions on vcDNA: vcDNA=SeqID_75270; Strand=-; Position=1-172
KWKMLDGWENEHEAMQGGDRRVGKGTFIGQILCKKRILGIFMARGPGKIANNNQLEL

SEQ ID NO: 148848 - protein, 35 aa, Heterodera glycines
  Coding regions on vcDNA: vcDNA=SeqID_75271; Strand=+; Position=1 -32,1493-1568
MSVSFGSAVVFDESLWAKGKKRREKVKRMKADENA

SEQ ID NO: 148849 - protein, 180 aa, Heterodera glycines
  Coding regions on vcDNA: vcDNA=SeqID_75272; Strand=-; Position=1-543
  Homolog annotation: Hit_ID=CAE58851.1; Match level="QueryCoverage =71%, HitCoverage=26%, E-value=6e-10, Identity=29%"; Hit description =Hypothetical protein CBG02074 [Caenorhabditis briggsae]
LVLLRYNGLDKVNGKKTKIEFWQIFLLIGIFPKALRSGGQSSSQTRQALSTVDNYLRKIQVIWRTQLIQALIPQKEELDTMDLHQSTNLVVLSDHGLMAVEEEDQFYIDECLADPSMVRRVANSLAFAMVWPIDGEEVLRPMSLYCISATPSFRTQLSSNLKCAISGLSSAITKMKRRHL

SEQ ID NO: 148850 - protein, 19 aa, Heterodera glycines
  Coding regions on vcDNA: vcDNA=SeqID_75273; Strand=+; Position=1-58
GLLGSWVRVPPGELPFMFY

SEQ ID NO: 148851 - protein, 80 aa, Heterodera glycines
  Coding regions on vcDNA: vcDNA=SeqID_75274; Strand=-; Position=1 -42,934-1017,1669-1785
MFFMQKLVLIEKKLIFDKNQQCSSPKSADLMGTGEKAADVKWKNLSDENKPHLPQTLQTQERYVIKRMPFNLLIIPLKIN

SEQ ID NO: 148852 - protein, 66 aa, Heterodera glycines
  Coding regions on vcDNA: vcDNA=SeqID_75275; Strand=+; Position=1-201
MMPNILEAQLPNDYFFYILRLFAVKLDQNAKERHELKTRNLLINEILVSRLVALGAKLSQRQELLS

SEQ ID NO: 148853 - protein, 369 aa, Heterodera glycines
  Coding regions on vcDNA: vcDNA=SeqID_75276; Strand=+; Position=1 -146,194-315,375-508,630-758,808-1053,1374-1703
  Homolog annotation: Hit_ID=AAC13679.1; Match level="QueryCoverage =97%, HitCoverage=61%, E-value=1e-110, Identity=54%"; Hit description= GLY9 [Caenorhabditis elegans]
MSFIHPFFLPERWFMNVHASDKISLDRSLPDFRLSECKGIAYELSLLPRASVVIIFTDEAWSPLMRTVHSVVNRSPPELLEEVLLVDDANELKDNLDAYIRRFGGKVKLLRKTERQGLIRAKLFGALHSKGEVVVGAVVGPNKGKAVGHCLSVNRSHRCRNTFLQRLVRTRLHWGLLVEFAFSVGSNPRPNSQRAKVENRSHSVGQLLSVCFYHLFFTFSSPTMAGGLLAADRNYFLEIGGYDPGMDIWGGENLEISFRVWMCGGSIEFVPCSHVGHIFRAGHPYNMTGPGGNKDVHGTNSKRLAEVWMDDYKRLYYLHRSDLKHKDVGNLEGRKALRDKLRCKSFKWYLDNVIPEKFVPDENVKEYGA

SEQ ID NO: 148854 - protein, 56 aa, Heterodera glycines
  Coding regions on vcDNA: vcDNA=SeqID_75277; Strand=-; Position=1-170
  Homolog annotation: Hit_ID=AAC13679.1; Match level="QueryCoverage =98%, HitCoverage=9%, E-value=2e-26, Identity=92%"; Hit description =GLY9 [Caenorhabditis elegans]
VWMCGGSIEFVPCSHVGHIFRAGHPYNMTGPGGNKDVHGTNSKRLAEVWMDDYKRL

SEQ ID NO: 148855 - protein, 81 aa, Heterodera glycines
  misc_feature (53)..(53): Xaa can be any naturally occurring amino acid
  Coding regions on vcDNA: vcDNA=SeqID_75278; Strand=+; Position=1-436
  Homolog annotation: Hit_ID=NP_573176.1; Match level="QueryCoverage =98%, HitCoverage=33%, E-value=7e-11, Identity=49%"; Hit description =CG9099-PA [Drosophila melanogaster] gb|AAF48679.3| CG9099-PA [Drosophila melanogaster] gb|AAL28305.1| GH2
LTKGVDLKTASKFFANRFACGCSVTVGSADELVIQGDFKVKVCSPSHTLPFCXLKDKLFVEIPKKWGVDEEVIEDLDDQKK

SEQ ID NO: 148856 - protein, 343 aa, Heterodera glycines
  misc_feature (49)..(49): Xaa can be any naturally occurring amino acid
  misc_feature (51)..(51): Xaa can be any naturally occurring amino acid
  misc_feature (68)..(68): Xaa can be any naturally occurring amino acid
  Coding regions on vcDNA: vcDNA=SeqID_75279; Strand=+; Position=1 -204,309-466,785-893,937-1003,1053-1224,1505-1630,1684-1788
  Homolog annotation: Hit_ID=CAE67649.1; Match level="QueryCoverage =96%, HitCoverage=51%, E-value=2e-70, Identity=45%"; Hit description =Hypothetical protein CBG13209 [Caenorhabditis briggsae]
RQRRRRKSERCRWLLALFLSVVFFAIYVLFYAFLSGRQHFGTDYFSDGXSXIQILLSLWHNVPSLFPXKSAPEGQPGENGAAVTLTGEEAAEGRRQMSYWFMNVKASDKMSLDRAVPDVRPNACRSLSYDLANLPSASVVIVFTDEPTSVLLRTVHSVFNRSPVFNRSPMSLLREVVLVDDFSQREELKAPLVELKAPLVAHLRRFGSRVRLFRANERLGLIRAKIVGAKYARGDVVVFLDSHCETSPGWLEPLLHRIKDKRSAVVCPVIDMISDSSMQYSGGSAAGIGTFWWSLHFKMDPIPERVAKMWSLHFKMDPIPERVAKMRKHADHLDSPTMAGGLF

SEQ ID NO: 148857 - protein, 868 aa, Heterodera glycines
  Coding regions on vcDNA: vcDNA=SeqID_75280; Strand=+; Position=1-2606
  Homolog annotation: Hit_ID=NP_498959.1; Match level="QueryCoverage =98%, HitCoverage=38%, E-value=1e-138, Identity=34%"; Hit description= zn-finger, CCHC type and RNA-directed DNA polymerase  and Integrase, catalytic domain containing protein
MAAPECYEKFFECLQVRIGQLNEANDKEVGKMICTFPEIFALSDDDWKQTNLVEHQINTAENSPVKMKMRLVPYAYREKIAEMLQNYLARGIIRPSMSPWASPIVIVPKRDGTLRFCVDYRGLNSITRKDSFPLPNIDNTLLMLGGQKFFSTLDFMSGYWQIRMDENSIEKTAFSTEYGLYEFTVMPFGLTNAVATFQRFMSRLFEGMINDFLFVYIDDILIASKSFDEHLKHLEAVFSRVKAAELKLKFEKCNFCTTELPFLGHILTREGIKMDADKLKPVMDLPMPTTKKQLHSLLGFLTYYRKFIHSFGTIAAPLFKLISEKAEFKIGEQEKQAIEELKSKIIRDVVLHFPDFDAAQNDLTRQFIIMTDACKTGIAAILCQPDPEKQIRPIYFASRQCNVHESRYSATELEALAVRFGVKKFAQFITMIPTRVITDHKALIWMFRSKNETGNSRVDRWLLELSSRFILKVEFQPGKKNIIADVLSRSGKSNESVTESLQEEDIAFIGKVRVFELSNNVEDFNEHREKWIEETKNSEMRPIYEFLEKKIMPADPRIRQSTMDKCHRFVLIEKFLHLCENDGKLRLFVPLSFRENLVKERHEGKCSGHMSAKKLYKQLAELYFWPNMFSDCIHAHNACRICAHTRNARSNEPPLKVVHSSEPLELVCMDILDVGPSQSNFKYICVIIDHFTKYLVAEPIPNKSADSVAKVFVEKFLLIFGTPKKIHSDKGKEFMNTIFKKISEILGFERSFTAGYDPQANGLAERVNGVLIQILKKSTASNWTWDERLPYSVFAYNITPSESTGFSPFLLMFGTSAHIPMDKITEMKFNPLYTIDYENYFQFVFGNLLNIQNDGQQNLDEYRKRSKD

SEQ ID NO: 148858 - protein, 229 aa, Heterodera glycines
  Coding regions on vcDNA: vcDNA=SeqID_75281; Strand=-; Position=1 -313,517-578,665-981
EVFTANQDGQGPCGYSTSQVALETAGAASSTPQQQVPTAGGPPGAAGSPYPPNTVGCPPVGPGNQFPPYTKTPQHSLFPHYFGNGASSTLPRPLFSSSLWGASTFYVCLLISLFVPQIPNSLMLHHNDQIVEIDSKYLSCDPINNKVPVEDDEQEEEEDEEEEEEQGGYYCKFSVCLEQQEGNKCVSKALDFGEMGGARDKDKSGPIDERNDNAKKRITDQEYSGLTDQ

SEQ ID NO: 148859 - protein, 66 aa, Heterodera glycines
  Coding regions on vcDNA: vcDNA=SeqID_75282; Strand=-; Position=1 -141,952-1011
MVAELEKKSNNECKGKPIYCACDPLHFDHIMTGMCCDKTTSCECCSKLFLDTTTKTRKTVKHMYVN

SEQ ID NO: 148860 - protein, 135 aa, Heterodera glycines
  Coding regions on vcDNA: vcDNA=SeqID_75283; Strand=-; Position=1 -164,220-246,301-376,574-707,900-906
MNREMFARVTEFIHLTVNISVIVISWRTQWCVIHAANISTEALGRKNIHATVAQRTRELQNYQSFSNLQNGVKTTSANWRPQSIILKEMKTITSHAISKKEKRRQNVAMKIMRFQLLNPLSGEKQARWNMLVLLL

SEQ ID NO: 148861 - protein, 128 aa, Heterodera glycines
  Coding regions on vcDNA: vcDNA=SeqID_75284; Strand=-; Position=1 -84,357-530,690-818
MIGFLRLIISLCAMRNVLSIKRISAVGKPMPWHLFVSQECKEEAQVVCTECGWANCVPSEYNNEPNDVTCCPHVRKRPGSINRHGKPFFYPPDLELRDQSDLGFCCPTNYVFKCCTLVHIKTVFAYER

SEQ ID NO: 148862 - protein, 87 aa, Heterodera glycines
  Coding regions on vcDNA: vcDNA=SeqID_75285; Strand=-; Position=1 -160,537-638
MAKIGKAYGNDISREITTAEEFAVRIAKDRRDQLCFRRGIQLKMEAEESKAGDGDFLRFARPSSPARLKAASPHFPMFAEHEHSQRE

SEQ ID NO: 148863 - protein, 48 aa, Heterodera glycines
  Coding regions on vcDNA: vcDNA=SeqID_75286; Strand=+; Position=1 -129,740-757
MKGTHLRRKKVSGKAINGPLVKMQLAMVAVDPTDGKAFVEADEPFPFK

SEQ ID NO: 148864 - protein, 215 aa, Heterodera glycines
  Coding regions on vcDNA: vcDNA=SeqID_75287; Strand=+; Position=1 -256,363-489,532-561,605-735,782-885
  Homolog annotation: Hit_ID=CAE63062.1; Match level="QueryCoverage =53%, HitCoverage=11%, E-value=2e-41, Identity=63%"; Hit description =Hypothetical protein CBG07340 [Caenorhabditis briggsae]
MQQMMQSATTPVLSTGGGGLGNTQFLYERQSALGSGTMGRGTGGEVAVASQFTTTLQQPQQQRSLVQPQQQQQLQQAVTSGTPLQGSQFQCPRRPNHGTEGRAILLRANHFKVKIPGGFIHYYNVDIQPDKCPRKVNREIVNRMVESFGKIFNGINPVFDGKKSMYSKDPLPIGHDRVELEVVMPGDSAVDRKFKVAIKVIIIHYGCSIYLLCAC

SEQ ID NO: 148865 - protein, 232 aa, Heterodera glycines
  Coding regions on vcDNA: vcDNA=SeqID_75288; Strand=-; Position=1-699
MKRTNASNITPPRAKRAMPPALDLDQNTATLEEQERQRTLVFIGLPESNAIRPSERVQEDREAITKILDHLEVEAQPTAVFRLGRYDPQRTTPRPLKVVMPTPTHQHVVLGGWKRERARLRSQQNLNRLFVRPALSKEQLKEEYEARLRKRQQNPAPPAPPTQLPKTTNDQTPDVAKGPNQNEASEDVSKPPDVFDQTILACYEALISLPPTDKIIHQIQSLKKQYPHLFNK

SEQ ID NO: 148866 - protein, 201 aa, Heterodera glycines
  Coding regions on vcDNA: vcDNA=SeqID_75289; Strand=-; Position=1-604
MKRTNASNITPPRAKRAMPPALDLDQNTATLEEQERQRTLVFIGLPESNAIRPSERVQEDREAITKILDHLEVEAQPTAVFRLGRYDPQRTTPRPLKVVMPTPTHQHVVLGGWKRERARLRSQQNLNRLFVRPALSKEQLKEEYEARLRKRQQNPAPPAPPTQLPKTTNDQTPDVAKGPNQNEASEDVSKPPDVFDQTILA

SEQ ID NO: 148867 - protein, 54 aa, Heterodera glycines
  Coding regions on vcDNA: vcDNA=SeqID_75290; Strand=-; Position=1-235
ESIGNMFMGVFRVADHEYDLHWTNFESRTRIRTKSLKLKILKILTLVPKLIKTC

SEQ ID NO: 148868 - protein, 414 aa, Heterodera glycines
  Coding regions on vcDNA: vcDNA=SeqID_75291; Strand=-; Position=1 -186,476-730,962-1354,1495-1653,1888-2138
MVVGRHTFVADGQNATAQQQHHHHQQHQQKPINNMPTGKNVILQSADESAADTAFLQELFMKHVPAAQPSPPMPNAVVAVCQNEMPKMAVMVKQEEPEVVEMDQQHHQQQQLKWKANNTNNQNNNNGTTTGNELSNGTSQVYLSYNQINCLENVHRLLKSQSSNGSAADGEPCGGGKMPADSAPPSQPLPPSQLVPSASPPYATTVAAAATTPSAGGGVGTALTRELLQLHDQRWEERCRAHWRRRLSQQTTTVVAASPRCHQTQQQQKQKRPLSQEQPGNFASRSPPGVADWHHHPQQHHHHVAKLARCRSEQRRSAWPMQAAVAQFEDELSPLHAVPPSAAGAVVAHNEQPPCGGALPPTELIALIAAVLQNVPPPSPPAETAKIGIVASPPIMNDSNGTPLGLHPQLLDQL

SEQ ID NO: 148869 - protein, 45 aa, Heterodera glycines
  Coding regions on vcDNA: vcDNA=SeqID_75292; Strand=-; Position=1-149
SEDAKIKKMSHNRDLYYLMYCTFVCIYHLLCIITLFPSVFRNKLN

SEQ ID NO: 148870 - protein, 83 aa, Heterodera glycines
  Coding regions on vcDNA: vcDNA=SeqID_75293; Strand=-; Position=93 -308,364-399
MSDMSAYMGSGPAEPAPSSGAAEASSSSGVASAYMGSGPAEPAPSSGAAEASPSSGVASAYMGASPAYEPPAPEKSPDQSAYM

SEQ ID NO: 148871 - protein, 184 aa, Heterodera glycines
  Coding regions on vcDNA: vcDNA=SeqID_75294; Strand=+; Position=1 -90,522-695,788-1078
MPFATLPEQNQPNFGGCENAFIQQQQLTENADLSSIPPPTPQSHQKFGSGSGGTLSETGNQLPRSTGHKRIKKTKPKGEELAKKAKENVPPPFGPPNQLPQQTIGYVPPATEPNNFFPNPNLAWLQALAYARMNPGAGTSTSAYIGGTMPTTVWQQMPYSAADGMPSSTAANHHPMTNIQSASN

SEQ ID NO: 148872 - protein, 315 aa, Heterodera glycines
  Coding regions on vcDNA: vcDNA=SeqID_75295; Strand=-; Position=1 -378,629-1198
  Homolog annotation: Hit_ID=XP_320889.1; Match level="QueryCoverage =59%, HitCoverage=23%, E-value=8e-42, Identity=45%"; Hit description =ENSANGP00000012033 [Anopheles gambiae] ref|XP_313651.1| ENSANGP00000013044 [Anopheles gambiae] ref|XP_314
MQQMRKSRTLGDRVQDKWRQQKFVKTESRPWKGSNRVKQIQLQCGAKPLAISSLEQKSAKTVTVPPSFIQLKVHEGNADFELDSGADVSIISSQDWSHIGKPELKQCQGLMASGGIPIEGVLGMANPGVQPKRCKARPVPFALKAEVEKILDQWVQQGVLEPMNNSDWATPLVIVPKPNGKIRLCCDYKVTVNQWLDVHQYPLPRPDDLFSVLNGGQKFSKVDLKDAYLQLMLDDEAKKCLAVCTHKGLFQFTRLPFGVASAPAIFQQVMDEILQGIEGVAVYLDDILITAPTQAEHLCRITQVLQRLKANGPES

SEQ ID NO: 148873 - protein, 85 aa, Heterodera glycines
  Coding regions on vcDNA: vcDNA=SeqID_75296; Strand=-; Position=1 -124,362-495
MGREGKGKALYYSPGTPTSSYAEGQKSRDGGEATSEAPTMLGGKPNAAEKCARSQLIAAPFPFIGGNASGVTTLLIKEVWTLGTS

SEQ ID NO: 148874 - protein, 326 aa, Heterodera glycines
  Coding regions on vcDNA: vcDNA=SeqID_75297; Strand=+; Position=1 -238,896-1123,1183-1488,1587-1796
  Homolog annotation: Hit_ID=NP_491447.1; Match level="QueryCoverage =19%, HitCoverage=40%, E-value=3e-11, Identity=52%"; Hit description =programmed cell death 6 (1F340) [Caenorhabditis elegans] gb|AAK71383.1| Hypothetical protein M04F3.4 [Cae
YESKQIERIEMLPQSITEMIFDKVGKDGSSKIDKDGLQTILSNGTGRAFNPDTCRLLIALFDFNRNGVIDRNEFGPLWKHPSPLFPVAILSTQCTKMNRNNLKRFQIKPLSAESKGSEEQPTSRTKTLSEVKEFDSAGTFFLRAKLVSVLFCIYKSCPMRSKGIPCRKKLDSEDFCVSCVHRAKKPSRNLYLRVVLQDCDDEECEQETTAFSYAAINFLSIASVEAFYNLSENAPNKLESILQSKIDQPVLVKVNIKENNDTAKLDWIISSISVEKPVSVKLLDDKNNDDGVEEEASSSEPPKKRTKNNQVERAIDEDADDIHTIE

SEQ ID NO: 148875 - protein, 86 aa, Heterodera glycines
  Coding regions on vcDNA: vcDNA=SeqID_75298; Strand=+; Position=1 -140,186-306
MKRTASVTASKEMESCKKEESIGTGCRKGVKRRYPYPLLSARSQDAWSAKLDQLEEKYSKMQEELSEDSDDAINFFEDSIEDIVEK

SEQ ID NO: 148876 - protein, 1408 aa, Heterodera glycines
  Coding regions on vcDNA: vcDNA=SeqID_75299; Strand=+; Position=1 -970,1019-1280,1324-1532,1578-1964,2009-2520,2563-3574,3619-3779,3828- 3918,3959-4582
  Homolog annotation: Hit_ID=NP_001004509.1; Match level="QueryCoverage= 74%, HitCoverage=70%, E-value=1e-120, Identity=29%"; Hit description =si:busm1-180o5.3 [Danio rerio] emb|CAD60788.1| novel protein similar to DNA polymerases [Danio rerio]
DMSSNRKRTAAENNCKQSKPKQPKWDFRSMVYFEQYPTEPQLEEETTQQQQSSSEATNQTGMGDRSSDSDGGQQQLPLYKEITNHSHTIERFSVQRHVTEFVLNAQHEQPDEALRQAFDELIARAIQNAEKGSGRTVSKLGIMVTGKGLNDPVVLPIRSPLQNNVDVVMAELDKLGQSEGDEGGANKKTLLLSEPVEIVVTCLTPPAGSAPRLHKYQNWGYDEAQRIRIHNVDNYCLFHALAAGRAYHDHDIFCSNPNSTNSPFFSNIKKRRDFCKNYEAFNRLVSNNERMRTVAEELMNASGIQIGQTSYGIEHLQHVQQYWDNVFPGTYRIVLFEDRPEELPRPIWKGAGGHRFNVTLFLSDNHYDAIKKIHCFFKLGRKYCVDCECTYTLDAKHTFHCKSRCPQCAKVGPEQPCSKQQGIQILCPECNRYFFSQTCYENHRGSTCRVIKRCSLCNRTHWSDTGEIHKCYTSYCKRCKVYHAEKTSCFIKRIQIPKEKQRYRIIVWDTETRLEQLEDECQRIHRVNFLSARITCTDCCESSESNNDCEICCQNNRVLEREKEWWDVIEKINLNSDNRSEAYGNEQPVAAFVEWILRAWNKKFKTYIWAHNASRFDGHFALNHLCKTARRPDVVMNGLKIFEFRVQYSRKHSMLIWRDSCLIMPIALAELKKTFNLDCEDKPFFPYAFNRRENYTIRLENLPDESEYEPGTMKADKYEKFKKWYNDNKETPFFLPDELRAYCLNDTEILLKALVKFRQILMNEITDGFDVLPISCTIASACMNIFKVQFMQEDQIAMVPELGYERNDRASVIAIKYLDWRAKSEGIEIQHAGNGREKRWKQFKLDGWIERQQRCIEVLGCYWHGCEKCFKPNEELVDGKTCRELNETTHDRLRQLREPDDNGICLQVEEVWECEINDQLKKNDEMKEFFDDLGNERGPLDPRLAYCGGRTGPLRLFAEPAEDEKISVFDIVSLYPWVNYDTDYPVGVPTVVHPSAEEMIVNWTKPEHLSYRGLYRVRVIPPRGLQIPVLPMKIDERLLFSCCHRCAALFRKSLTRCSHKCNHTDQQRAFTGNFTHIELEKALEMGYIVDRFWRAWHYTEWSDQIFKGYVRQFIRLKVESSGFPEGIETLEQKQEYIDEYRRIYGVDLDFGHIKKNPGLRFIAKLMLNSLWGKFSMRNQFGSNKVMTRPQEFYDLVFDHKTEISSIIPISDAAIRVMYKPKKNFITEHTSSNIVLSLWTTSRARLKLFDYMQQCYNTPGAELLYTDTDSVIVRHKRDLVPVQTGEFLGQMSEEYADYDILTFACGGAKQYALKMVHKQTKEITYVQKIRGITFDVNNSQALQFERFVHKVLNYGKEDEQNDAAVFNYKKIQPTKDSRIITRKQNKRYLPVCQKGIITENLDVLPFGYE

SEQ ID NO: 148877 - protein, 76 aa, Heterodera glycines
  Coding regions on vcDNA: vcDNA=SeqID_75300; Strand=-; Position=1-231
MSLLSALRVPYNCAIVRPATRKPFAFGCFADGQPRDNAFVATENAQKLCTRFAQRKEFDGFVVGTAQQFAMVSEKS

SEQ ID NO: 148878 - protein, 91 aa, Heterodera glycines
  Coding regions on vcDNA: vcDNA=SeqID_75301; Strand=-; Position=1 -149,292-418
MATNDSVLPQRPNSTMNGNTSKWYSWPELSGGAICSEMFGCVGFMGNNQIPQFNKYWTDTYTLTSNGQRRKMEIIGKLAKIFHKSVGNAFG

SEQ ID NO: 148879 - protein, 247 aa, Heterodera glycines
  Coding regions on vcDNA: vcDNA=SeqID_75302; Strand=+; Position=1 -391,754-1003,1227-1329
  Homolog annotation: Hit_ID=NP_505724.1; Match level="QueryCoverage =42%, HitCoverage=24%, E-value=3e-10, Identity=41%"; Hit description =somatostatin receptor 2B (5L92) [Caenorhabditis elegans] emb|CAB08739.1| Hypothetical protein H09F14.1 [C
MITEFADVLLCYLFPCCVVVVLNSVIASKVRRSEKCFHIGPSPTPSATKKSYCTLPTSASTGSTTAAAAVASASAIAPPRRQHYASPKAMTTVVGGGASPSADADERPAMRKLSTRTAPGNVPVGARTAGGSSSGNPAGTTRILLVVPVVYILLNTPFYMFRILDTVALNVFNSTMFQYDGLNRNPVLAWCYNVAHYLYYVNFACDVIVYAFSRLKLSLGIRFLKILGPGMPCIKCQIGRTFTGANE

SEQ ID NO: 148880 - protein, 151 aa, Heterodera glycines
  Coding regions on vcDNA: vcDNA=SeqID_75303; Strand=+; Position=1 -131,565-724,792-868,931-1017
SIELETIVVEAVTGRGVHSPHVFCFCYDCSQKPNNYIIRIGLNEVDELPTPGQWVRVVMKQEVHGKRVDYSLWEAQNMSKAKHETDFTIDNGIRTVLVRVPLKVSGDGFYNQFLGPVSDIKRRLKIPTGKERRFVSAWCRKVMPLSICTMD

SEQ ID NO: 148881 - protein, 240 aa, Heterodera glycines
  Coding regions on vcDNA: vcDNA=SeqID_75304; Strand=+; Position=1 -117,180-407,695-849,901-988,1046-1117,1165-1224
FVGSRYRSQPTTTEGQLAKGTTPPMPQTSQQQQIQQVEGPMTISKPNQHHNANTGGHRANASLSPALGSSGFGSSASSNASAQVERDLIDLFDEKCSIGPPLKWTPSPPPLQQHQFSGVMYPHTGVIASMDLKSRGYYVYSNEFDNELYLLTEELLEKGSWIKFNILDDYYRLTIGQYALLKKSPFDVRVERNTIYMCVSAYITPEALTQRTIDTSYVKNVYDRCRLLQHAHVGKELKLE

SEQ ID NO: 148882 - protein, 51 aa, Heterodera glycines
  misc_feature (25)..(25): Xaa can be any naturally occurring amino acid
  Coding regions on vcDNA: vcDNA=SeqID_75305; Strand=+; Position=1-311
FQTAQCCAPLNVGLFKLEFRSIGRXGKEERKHTGILKVVLLSCGSSIGGSS

SEQ ID NO: 148883 - protein, 104 aa, Heterodera glycines
  Coding regions on vcDNA: vcDNA=SeqID_75306; Strand=+; Position=1 -111,182-385
MADPPALSRDRPRSVVSNIEHGVVLHHRLPHATNTAGQPSPLHHAQAVAATPPPPSSSAVASALFHHHRSPQNVTSSNSASSLMTMAAMMHHQQQRQQQQQNSG

SEQ ID NO: 148884 - protein, 173 aa, Heterodera glycines
  Coding regions on vcDNA: vcDNA=SeqID_75307; Strand=-; Position=1 -231,490-564,657-872
MANNSSLSSPLPPADKSCIDIETALFGSNYLVIHIQLFLLGVVLIAICSLIHKYNKNCIPIHKNLKVKVSFISMDYTLLLVNTIILYIINSLVWIVFFLRYRIQMFTYKHPCDFLSPVWMVPMFLGPPKLYSIAYPCFHFAIAFERIRSTFLAKRYERMGTQSTVIIIWIIVS

SEQ ID NO: 148885 - protein, 89 aa, Heterodera glycines
  Coding regions on vcDNA: vcDNA=SeqID_75308; Strand=-; Position=1-269
MNIKFFFKIHTKIKSFLNFNYLTNDRFTVLPCGAPLQYDGHDNRQWPRRKRHFGKRYHLWTRDRNQNRFTKANMDKTQESIISIALSLP

SEQ ID NO: 148886 - protein, 60 aa, Heterodera glycines
  Coding regions on vcDNA: vcDNA=SeqID_75309; Strand=+; Position=1 -135,184-228
  Homolog annotation: Hit_ID=CAB88203.1; Match level="QueryCoverage =100%, HitCoverage=20%, E-value=1e-23, Identity=88%"; Hit description= putative cuticular collagen [Globodera pallida]
MQETHIVLGIASLCSLLAIIVTVVTLPSLYSEMSQLNNKVRDGVQAFRVNTDSAWTDLMD

SEQ ID NO: 148887 - protein, 59 aa, Heterodera glycines
  Coding regions on vcDNA: vcDNA=SeqID_75310; Strand=-; Position=1 -40,341-480
MLLYLVALALLCHLCGKTSNIYWAFVRTAIFAMFAIIGANWQPKSRRPLALCGRVERTL

SEQ ID NO: 148888 - protein, 44 aa, Heterodera glycines
  Coding regions on vcDNA: vcDNA=SeqID_75311; Strand=-; Position=1-131
VVDVQNYVMEKHPFSGQFHEHAQKVVIPNIRRLIETARQLKIEV

SEQ ID NO: 148889 - protein, 123 aa, Heterodera glycines
  Coding regions on vcDNA: vcDNA=SeqID_75312; Strand=+; Position=1 -152,893-1112
MTESRCRICISAAHDKEMLDRVLDAIDEVGDISATKHSHRTHRYRQLDVKCLGNASEFRLFGGTNAFINQNQLKIPATEERVRTKCCAEGCSLEEMKEEMCCMTDACLRRCYPGKGYRLGSVY

SEQ ID NO: 148890 - protein, 19 aa, Heterodera glycines
  Coding regions on vcDNA: vcDNA=SeqID_75313; Strand=-; Position=1 -20,290-329
MFFIDIRQFEEKMVYLVIQ

SEQ ID NO: 148891 - protein, 145 aa, Heterodera glycines
  Coding regions on vcDNA: vcDNA=SeqID_75314; Strand=+; Position=1 -267,439-609
MLENRVGRVRVFGQKSGPEKRGPSPSFSTGYPGMGPGQVPEPGQPLYFNKKFAFCCTKMQFPQRKTESESVDVGLVLTEALSNGAEPFKVPIVPFYALRDTKPGEEELSMDYGTYNILGSQGRSSEERNWKSETETTQNYRKIEN

SEQ ID NO: 148892 - protein, 48 aa, Heterodera glycines
  Coding regions on vcDNA: vcDNA=SeqID_75315; Strand=+; Position=1 -94,210-262
MCSDKQLPEHKSKKYEYIIQAMYGIFIDNIKAWILIYLNFIAYLSVRH

SEQ ID NO: 148893 - protein, 41 aa, Heterodera glycines
  Coding regions on vcDNA: vcDNA=SeqID_75316; Strand=-; Position=1-474
IFYRFLNVWIFFRLTKTSSNLALSILIQIAPNFFYSLTRPN

SEQ ID NO: 148894 - protein, 48 aa, Heterodera glycines
  Coding regions on vcDNA: vcDNA=SeqID_75317; Strand=-; Position=1 -33,210-323
MNVIEKEEKKKWRRSPHQCFERCIRAPTSKNDDELWCGSVVTDQSGDR

SEQ ID NO: 148895 - protein, 34 aa, Heterodera glycines
  Coding regions on vcDNA: vcDNA=SeqID_75318; Strand=-; Position=1 -73,250-281
MAATDASLLSFASTAGTKAFVAAAVLKKAFRPKL

SEQ ID NO: 148896 - protein, 145 aa, Heterodera glycines
  Coding regions on vcDNA: vcDNA=SeqID_75319; Strand=+; Position=1 -78,856-1214
MEDVDRDELSAAASQTGAADQHASTAENPTTVVPQPSYSVGTTAATAATTADAAAGDNSSSSPFSPVAVELTASQPKLPEAAEPFPSSSSDNAPRVAAAAQRSPSAAAADSDGNINMNNEAKNTHAVGELDLKSDRELAKLMRRT

SEQ ID NO: 148897 - protein, 103 aa, Heterodera glycines
  Coding regions on vcDNA: vcDNA=SeqID_75320; Strand=-; Position=1 -88,144-367
  Homolog annotation: Hit_ID=EAL24286.1; Match level="QueryCoverage =79%, HitCoverage=18%, E-value=1e-13, Identity=46%"; Hit description =ankyrin repeat and MYND domain containing 2 [Homo sapiens] ref|NP _064715.1| ankyrin repeat and MYND domain
MLNQKDNFTLKELKNQTDEEKQLFQLINEDKIEETEELVKSGKVRVNSLDNSGMNALDHACFKGNEALVEFLLENGSDSDNRAHSDGYTALMFAALAGVATSY

SEQ ID NO: 148898 - protein, 15 aa, Heterodera glycines
  Coding regions on vcDNA: vcDNA=SeqID_75321; Strand=+; Position=1 -24,384-407
MGIVLELQLCTWKSV

SEQ ID NO: 148899 - protein, 166 aa, Heterodera glycines
  Coding regions on vcDNA: vcDNA=SeqID_75322; Strand=-; Position=1 -28,2159-2258,2704-2839,3201-3266,3342-3377,3453-3518,4424-4450
  Homolog annotation: Hit_ID=CAE62065.1; Match level="QueryCoverage =100%, HitCoverage=16%, E-value=1e-41, Identity=53%"; Hit description= Hypothetical protein CBG06086 [Caenorhabditis briggsae]
FCASKVAAGGDILNARVQKGPKGLGFTLIGNDGTNLHDEFIQVKTIIANGPAAAEGTLRSGDVLVMVNDRCMLGASQDDACQVFRAINVGEFVRIQVCRGYPLQMDPTNRIFTENIFTENVYAAASSREQHVVELREQHVVELCKGQKGFGFTVYDDLNSFNLKII

SEQ ID NO: 148900 - protein, 131 aa, Heterodera glycines
  Coding regions on vcDNA: vcDNA=SeqID_75323; Strand=-; Position=1 -231,940-1104
MEAFNPDTKICFKIDQFSTFFQQRTDTKKRYPNTLNNGQFEIKCHLSSVDIRDEAHGALSPIGIRKAFRIALECRGHYCQWSFPVEVASTTDDFGNGPYNSTETRPVTIRLSIPILKFRTRRDCIETLLVI

SEQ ID NO: 148901 - protein, 364 aa, Heterodera glycines
  misc_feature (13)..(13): Xaa can be any naturally occurring amino acid
  misc_feature (360)..(360): Xaa can be any naturally occurring amino acid
  Coding regions on vcDNA: vcDNA=SeqID_75324; Strand=-; Position=1 -136,192-303,433-625,873-991,1040-1090,1137-1244,1303-1554
  Homolog annotation: Hit_ID=XP_318086.1; Match level="QueryCoverage =95%, HitCoverage=94%, E-value=4e-46, Identity=35%"; Hit description =ENSANGP00000017696 [Anopheles gambiae]
SQLAIYSFCICWXPFFFMFPKHMGVQLKVMEGKLRTVDLVIEVHDARVALTGRRVALTGRNPSFGAKLYSVRPHILVFNKMDLINMKRYKEPIEEYYRNEQNITNICWTNCKNLTNKTLQNLMDKMLDLLRNEHRFNRNSEEEYPVMVVGIPNTGKSSLINALRNVNLDFGKAVKEGARPGVTIRVQNRVRILDRPPTDRPPTYLMDTPGVLNPWANNIDAAMKLAICANNIDAAMKLAICNLVLDTTTRPNFVADYLLYFMNKYRDFSYVDFLRIREPSDYRDFSYVDFLRIREPSDDIKQVLIAVSKLRNCMSNSYKVPGIEVTWDLHSAALQFLNLFRKYAKDPFLDRDLLCYNTFXLKNL

SEQ ID NO: 148902 - protein, 78 aa, Heterodera glycines
  Coding regions on vcDNA: vcDNA=SeqID_75325; Strand=-; Position=1 -26,896-1023,1159-1241
  Homolog annotation: Hit_ID=CAE56930.1; Match level="QueryCoverage =100%, HitCoverage=37%, E-value=4e-26, Identity=70%"; Hit description= Hypothetical protein CBG24775 [Caenorhabditis briggsae]
FSKNFYILWYTGHYFLSALLYSIFLGPFAVDRFYLGYSAIAVGKLMTLGGLGVWWLVDIFLLLFGHLKPADESEWQPF

SEQ ID NO: 148903 - protein, 157 aa, Heterodera glycines
  Coding regions on vcDNA: vcDNA=SeqID_75326; Strand=-; Position=1 -98,145-269,316-513,599-650
  Homolog annotation: Hit_ID=NP_509383.1; Match level="QueryCoverage =100%, HitCoverage=17%, E-value=6e-62, Identity=70%"; Hit description= zn-finger, RING and zn-finger, cysteine-rich C6HC (XI804) [Caenorhabditis elegans] gb|AAK68189.1| Hypoth
MNDGSCNHMQCVLCHAEFCWLCLKQINELHYLSPTGCTFWGKKPWTRKKKLLWQIGTLIGAPLGIALIAGLAVPGIICGVPIFVGRFPIFYLQNCNCFFSTRRKVYQRFENLSKMRRRFVTALAVFGSLIVSPVLAVLSVGVGVPVMLAYVYGVVPL

SEQ ID NO: 148904 - protein, 121 aa, Heterodera glycines
  Coding regions on vcDNA: vcDNA=SeqID_75327; Strand=-; Position=1-363
MESDKQKMVPLTDSGTEKDGGGCSASGHRLTKSLCGKAADELRHAHTDGTDGGGGGGADRDHGTTSYCAVNIEKGDSSSSGTGCCGGGGMASIGKANGCVGNVMVADRLSIKSGASSTSSS

SEQ ID NO: 148905 - protein, 45 aa, Heterodera glycines
  Coding regions on vcDNA: vcDNA=SeqID_75328; Strand=-; Position=1-136
GFARQMRAGLELVEIGGVLSNVTDGAFPGLHLFAHTQIALGLGMG

SEQ ID NO: 148906 - protein, 89 aa, Heterodera glycines
  Coding regions on vcDNA: vcDNA=SeqID_75329; Strand=-; Position=1-267
MISSSNSSVGAGGSKCLKNLDIVMESADEGQALLQDNPNNTTTITSVSAADGIPDGEGTSSSSAEQQQPNRTDSAQAQHAQPSTTMLKM

SEQ ID NO: 148907 - protein, 51 aa, Heterodera glycines
  Coding regions on vcDNA: vcDNA=SeqID_75330; Strand=+; Position=1 -58,1287-1384
MYHKKMPIEECEAAKQPSHKISATNTMQFRIRSAMRTSQGIRIDLTEIYYL

SEQ ID NO: 148908 - protein, 78 aa, Heterodera glycines
  Coding regions on vcDNA: vcDNA=SeqID_75331; Strand=+; Position=1 -130,640-746
MKIVGEALIFSHWKCHFWAMALLCLSLLGQLCSETEAADDSAKMPFAQSVRRHFHPIGSGRPTIIQHGHNNFRDETVE

SEQ ID NO: 148909 - protein, 21 aa, Heterodera glycines
  Coding regions on vcDNA: vcDNA=SeqID_75332; Strand=+; Position=1-64
CSKLCRPIIERHMRRSLRMRG

SEQ ID NO: 148910 - protein, 210 aa, Heterodera glycines
  Coding regions on vcDNA: vcDNA=SeqID_75333; Strand=-; Position=1 -416,485-701
MLPKSSHFASLSYCTNDVEILMPALVAFRREFFDISRRQEYVDGIDDKENHDGIDVLRECMTIAGACMRHFRTNQMPDAHLAIVPERGYDNAQNQSLLALRFFHWYAEQHGVEVQTAHSAGGEKRIGAYSLDGWIEAEGLHLARVQKVLSQRQHAAPQWEDRGGGARAGRQTPGLPAAASEPSGRLLGVRNPSDAGAEQRNAQVVFGLCG

SEQ ID NO: 148911 - protein, 272 aa, Heterodera glycines
  Coding regions on vcDNA: vcDNA=SeqID_75334; Strand=-; Position=1 -161,317-665,712-1019
  Homolog annotation: Hit_ID=NP_507780.1; Match level="QueryCoverage =56%, HitCoverage=10%, E-value=7e-14, Identity=35%"; Hit description =predicted CDS, DNA polymerase type B, organellar and viral family member (5T899) [Caenorhabditis elegans]
MVAKTRGWPRWKFYDYLHSRRGQQGCLQRDALQLMQQIRVRAGLNAYDAEICVPAISALNPSVNCATLFTIPSGGASSNPTWRSRTTAGCRICGPHRTVAFCQRRFVDTHVNHQVVVADNPLVAFVHWLVFELPMSYDTYAYSHFGGRFDMVLVFRELFRIGFNPEMLRRGNKMYEMKVRKQKKRNPNVVFRDSFNLMPCSLAALVPSYGLEVEDKPFFPHMANRPENYGREIHPTPDDYLASGMMPSKRRQFDAWYAENRHHHLQLDEALA

SEQ ID NO: 148912 - protein, 322 aa, Heterodera glycines
  Coding regions on vcDNA: vcDNA=SeqID_75335; Strand=-; Position=1 -97,492-1363
  Homolog annotation: Hit_ID=AAC06264.1; Match level="QueryCoverage =78%, HitCoverage=35%, E-value=5e-49, Identity=39%"; Hit description =pol [Schistosoma mansoni]
MPCVSKNADMTQNELKILYSFRQQAYQANIAAENSVVNGSLTQSAQNKTKLSDIELNAGIIWNILRKLPRRNSTSPDNIPYILLKNCAEPITKILADIFRLALDSGQIPEIWRTSLVVPIFKKGEKTDPLNYRPVSLTSTVYRIFERILSSKILEFLNGIRFFDKEQFGFLKNRSTTTQILKTMDDIYNSLQKDQQIDIIYIDFVKAFDSVPIDLLLQKIKKIGIEGKIQNFLTNFLKNRSFKVKIGEVLSESFSIFSGVPQGSVLGPLLFLIFINDLPSFIANEASSVGIKMYADDVKLYYAHENDDKTEYFINSKMIFRI

SEQ ID NO: 148913 - protein, 24 aa, Heterodera glycines
  Coding regions on vcDNA: vcDNA=SeqID_75336; Strand=-; Position=1 -18,226-282
MLNLSNRNEKKWSTTYFFNIKFEK

SEQ ID NO: 148914 - protein, 122 aa, Heterodera glycines
  Coding regions on vcDNA: vcDNA=SeqID_75337; Strand=-; Position=1 -151,218-393,697-738
MKIFKSYYGMKLNGIFDCALFIFEFIVNYKFSRSVGTESSACYLTDPIIADHSALNRQCAISPIRSKIVAGNFHVFIQIIVHHYVVVRRDVLHHTHFHYLLVKIWKRFPSNHDLTVRWIRTR

SEQ ID NO: 148915 - protein, 135 aa, Heterodera glycines
  Coding regions on vcDNA: vcDNA=SeqID_75338; Strand=-; Position=1 -161,692-938
MAWQTFTDKMKSLEKQSELYRVLLFYSKKNDTGFNVFNEIAPPEAEPIYNYFKKFIKEMKNEEEYQVNRLRPYEIDHTRGFSDRPRLKKYLENDQAIRRLVVAYDAKENKNDEDLISHIHALQYRLGMKGFEEWN

SEQ ID NO: 148916 - protein, 57 aa, Heterodera glycines
  Coding regions on vcDNA: vcDNA=SeqID_75339; Strand=+; Position=1-187
RDVPRFRFSHFAFRIIRIFWRFAFRFLARNATFTPLRIGLNSHKIFQNFTYKLANFQ

SEQ ID NO: 148917 - protein, 108 aa, Heterodera glycines
  Coding regions on vcDNA: vcDNA=SeqID_75340; Strand=-; Position=1-327
MNGAKYHEDPLQGRHEVWAPGSLGAGSSPHQRFGRRLSLRSTRGDCGTGDGDKYIAGNVTHEGRGSIAREEILNFYEDGTSPKEAECRGSWKWYWTSIADDISYLDMG

SEQ ID NO: 148918 - protein, 142 aa, Heterodera glycines
  misc_feature (94)..(94): Xaa can be any naturally occurring amino acid
  Coding regions on vcDNA: vcDNA=SeqID_75341; Strand=+; Position=1 -138,958-1253
  Homolog annotation: Hit_ID=CAE59730.1; Match level="QueryCoverage =96%, HitCoverage=31%, E-value=3e-32, Identity=49%"; Hit description =Hypothetical protein CBG03166 [Caenorhabditis briggsae]
GFTDPTYRARRKYFADIAANYRHGEKIPRVEYTAEEIGTWRTIYNELINLYPIHACREFNYIFPLLQQNCGYAPDRIPQLQVSAIFFWHYLMEXLELILGCDFLKGILAAFFQKSRHRLENLAFFMPTKSVNLKILGIKNFF

SEQ ID NO: 148919 - protein, 25 aa, Heterodera glycines
  Coding regions on vcDNA: vcDNA=SeqID_75342; Strand=+; Position=1-77
CTGFTLRPVAGLLSSRDFLAGLAFR

SEQ ID NO: 148920 - protein, 155 aa, Heterodera glycines
  Coding regions on vcDNA: vcDNA=SeqID_75343; Strand=-; Position=1-468
MARSRQSIICTFYVRNPITNDGRVQWRKTQIGLVRPEGLKNFGRNAAAARRAGGFILERKSIEKPFNFIATKSGQFQSIQSVAITKVKAVEKPKCFPKCFFFFISEWSIENAQTQGNAEKEWQIKQSAEKLWKIKRIFEKWWKIKQSAEKWWKIK

SEQ ID NO: 148921 - protein, 24 aa, Heterodera glycines
  Coding regions on vcDNA: vcDNA=SeqID_75344; Strand=+; Position=1 -33,99-140
MSDGRESAKTLKIQYGLLLNSCEF

SEQ ID NO: 148922 - protein, 86 aa, Heterodera glycines
  Coding regions on vcDNA: vcDNA=SeqID_75345; Strand=+; Position=1 -39,823-896,960-1096,1180-1190
MPFSLKCMSTRKLHFIFLIFGAAITFAISVLFTCILRRRCFLFKAFLRHNKKHHQKRGPSVSEKSHQKHRGAESTSLVQRGTRVKK

SEQ ID NO: 148923 - protein, 59 aa, Heterodera glycines
  Coding regions on vcDNA: vcDNA=SeqID_75346; Strand=+; Position=1 -52,203-330
  Homolog annotation: Hit_ID=CAE59914.1; Match level="QueryCoverage =79%, HitCoverage=4%, E-value=1e-13, Identity=65%"; Hit description =Hypothetical protein CBG03399 [Caenorhabditis briggsae]
MKLCGCKCIASEEQNSTVATQAPLPHTFADFWAMVWQERSSVLVALTNIVESGLKKCDQ

SEQ ID NO: 148924 - protein, 181 aa, Heterodera glycines
  Coding regions on vcDNA: vcDNA=SeqID_75347; Strand=+; Position=1 -128,545-840,1068-1189
MDFILLEFFVWIQNKTVGCTAITLCMKTKQYKKSEKPTHNAFCDGQRVPVMKRTASLNEQNNEICQILPNNYLAAIDKQRNKKAMLNEDKNAFLKAHGVRICSKPIEAEARRLYPPAIACLLAEEDKDQKNREHLEPNQNGDLNFCFTEYYESLQYTKPSNFPEKLKWVIVIIGESQQMCK

SEQ ID NO: 148925 - protein, 19 aa, Heterodera glycines
  Coding regions on vcDNA: vcDNA=SeqID_75348; Strand=+; Position=1-59
MKKVIVQNMAGAQPFRPQL

SEQ ID NO: 148926 - protein, 102 aa, Heterodera glycines
  Coding regions on vcDNA: vcDNA=SeqID_75349; Strand=+; Position=1 -99,162-295,553-629
NFYDLLKDCAKHRGVVFTTPVVQNISHKEANSLELVRKSFEAHKKNNVRFLLLLAPGKDSANSIDVHYFFKLMEQQTVPQFITRNHYFGALPLKKTISEVGH

SEQ ID NO: 148927 - protein, 34 aa, Heterodera glycines
  Coding regions on vcDNA: vcDNA=SeqID_75350; Strand=+; Position=1 -86,379-397
MNLKLGGINYGICASQAFMNARRSTEDIVGPNPI

SEQ ID NO: 148928 - protein, 281 aa, Heterodera glycines
  Coding regions on vcDNA: vcDNA=SeqID_75351; Strand=-; Position=1 -97,262-372,938-1062,1706-1821,2167-2209,2579-2636,3157-3258,3381 -3437,3596-3728
  Homolog annotation: Hit_ID=NP_510083.1; Match level="QueryCoverage =98%, HitCoverage=44%, E-value=1e-121, Identity=73%"; Hit description= abnormal cell LINeage LIN-2, cell junction protein, mediates basolateral localisation of EGF receptor, r
GDDDDLLLCAVSRVRLVQFSKDTEEPMGITLKITEDGRCYVGRIMHGGLIHRQGTLHVDDEILEINGVSVANRNVEQLQRLLRDARGAVTFKIVPSYRSAPPACEIFCKAQFDYDPAQDDLIPCPSAGVPFRTGDILQVISKDDHNWWQARFVCHFPALGGSSNATATGNVNMAGLIPSPELQEWRTACLAMERARENSHCFMFSKKKSGNKYYTTKYLRKHSELFDGMEMISYEEVVRLASFRRKTLVLLGAHGVGRRHIKNTLIKLHPHRFAYPIPRKS

SEQ ID NO: 148929 - protein, 81 aa, Heterodera glycines
  Coding regions on vcDNA: vcDNA=SeqID_75352; Strand=+; Position=1 -3,136-378
MVFRPKFICCRNQAQIVRKDEITYCRNHSFETNHCRKDIAPAGVGSQGFSTPSPVFLYAKNGIAEAANQVKNIFFVRSRPF

SEQ ID NO: 148930 - protein, 153 aa, Heterodera glycines
  Coding regions on vcDNA: vcDNA=SeqID_75353; Strand=+; Position=1 -132,177-463,513-555
MASDGQAMAKWLFTPLQNNVPKMFNCSLHLNDGILPSNIEPFKAAFASASSSVNFIVVICFQLSFADSVVPFDLTNELTREQLALKRINNSHRFLLIRCPIARDESKWTKWEKEAIVWRFCDQWDRISTNTYYENAIGDGLLNATPGPSDQQK

SEQ ID NO: 148931 - protein, 107 aa, Heterodera glycines
  Coding regions on vcDNA: vcDNA=SeqID_75354; Strand=+; Position=1-324
MVFSTLLAFCLVSSFDSASAKAQSVNNSVRNDEIIEKGPTSSKNGLLNMCMDSGLISNGKAGDEAEMDGLVELLTELDEHDSVIQAALANPTKVVSVTRKFVVIAIP

SEQ ID NO: 148932 - protein, 174 aa, Heterodera glycines
  Coding regions on vcDNA: vcDNA=SeqID_75355; Strand=+; Position=1 -330,522-620,978-1070
MSDEIKELKAITLQILKNQTLMIAHLVNQARQNKPQQHVQPPLMLKQVKTEPCEPPSTVSKRKAPSAVEQPLKEISFINKNNGGCATVNKRRRMSAPNTAGMATKQNNTKGAHSEKDDEREGGLVQCVQFRLRRQRMRLPYQQVVLDNRENSEPLFLATLAQCYDRMSDSEKDE

SEQ ID NO: 148933 - protein, 154 aa, Heterodera glycines
  Coding regions on vcDNA: vcDNA=SeqID_75356; Strand=-; Position=1 -159,284-462,574-629,2223-2292
  Homolog annotation: Hit_ID=NP_505960.1; Match level="QueryCoverage =74%, HitCoverage=10%, E-value=5e-35, Identity=60%"; Hit description =guanylyl family member, abnormal DAuer Formation DAF-11 (daf-11) [Caenorhabditis elegans] emb|CAD56284.1|
SGPLSRKHNSFGRIMAWNYRMFFQFLFDYEIPHRPGQHLHCRWGFNSGSVFTGVVGITAPRYCVFGSTVTLAAKMENSGQQDRIQMALKSYQLLSEQFPEFRCIPRGGVRIEGVGTLLTYWLEGIDSGGMIKIRNLFYDLYTFFYLDSKKKPKW

SEQ ID NO: 148934 - protein, 219 aa, Heterodera glycines
  Coding regions on vcDNA: vcDNA=SeqID_75357; Strand=-; Position=1 -268,588-682,1196-1355,1548-1681
MTSDLGTQVNRDLKRRIRVSGDFVPSVATLSAFTSPIDSHRPIASNTLRQAARLVFLLDVREGLYREEAEDGEDEGGRSFDMGEFNGVDDSRPSPVLFADCPFCGLLRCRPLPARGPNAESALYYNNFITDPNRPHSPQLFEQPKTRAESRQLIESGTDSQHVSPHMESTNERIPGVSRPPMNTGGWRRMEPMNETTVRGVNGGGGGGMRDPRAPPSYR

SEQ ID NO: 148935 - protein, 272 aa, Heterodera glycines
  Coding regions on vcDNA: vcDNA=SeqID_75358; Strand=-; Position=1 -230,298-406,455-673,1063-1147,1195-1320,1363-1412
MPPRMAPPDTMMRFNTPRPAPMSLRLEPWQMFPSATPPQRMMAPTVPSHPQIQPMVPATTGGTMSQFSNKELLEDNRVGCSSAGGGRGGGTGRKGGGRGGGAGSKRKAGEFFEELTTSPMPPRMAPPDTMMRFNTPRPAPMSLRMAPRQMFPSATPPQRMMAPTVPSHPQIQPMVLGGGPDSKRFEQMSFRGICQRLGTLSKDAPEMVIDWAKNEICAHFSIPIRIFDNVEFTEKIKILYPMFKDVNTDELSTDCKFVSDICDEIERRKRMA

SEQ ID NO: 148936 - protein, 179 aa, Heterodera glycines
  Coding regions on vcDNA: vcDNA=SeqID_75359; Strand=-; Position=1 -262,738-779,863-972,1526-1621,1690-1718
  Homolog annotation: Hit_ID=NP_495140.3; Match level="QueryCoverage =53%, HitCoverage=12%, E-value=1e-33, Identity=70%"; Hit description =general substrate transporter family member (2G77) [Caenorhabditis elegans]
VLRPGRDAVHHRDGVEFGVRRQLQACPCPPVLLVRLPVRLSAGRLRLRPFRAQADGDRLRHSVLHVRSAAALLHLLPHVPVHPLLRRAADLAAYVLCMEITGTRYRAMVGSLLQAPWAVGYATLALIAYFCNSWQNIQLITAALHTVSICLICVLPESPRWLIVNNRVDEAERYIRKAC

SEQ ID NO: 148937 - protein, 53 aa, Heterodera glycines
  misc_feature (1)..(1): Xaa can be any naturally occurring amino acid
  Coding regions on vcDNA: vcDNA=SeqID_75360; Strand=+; Position=1-220
XVVEKISLSHFAFRIFAYFSFSHFAFFSFRIFSFANFAFRISLFIFQFGPSLV

SEQ ID NO: 148938 - protein, 475 aa, Heterodera glycines
  misc_feature (358)..(358): Xaa can be any naturally occurring amino acid
  misc_feature (363)..(363): Xaa can be any naturally occurring amino acid
  misc_feature (467)..(467): Xaa can be any naturally occurring amino acid
  Coding regions on vcDNA: vcDNA=SeqID_75361; Strand=+; Position=1 -149,197-394,452-616,1592-1711,1764-1814,1857-1925,2105-2519,2915-2971
  Homolog annotation: Hit_ID=CAE70192.1; Match level="QueryCoverage =97%, HitCoverage=35%, E-value=5e-89, Identity=37%"; Hit description =Hypothetical protein CBG16666 [Caenorhabditis briggsae]
AQLLEQIHWSDIDQQYRRNREQLKDLNFQKFCSESGFLRYFPSAPWLWEDRSSELDLFDCRNTEWYVDRSSELDLFDCRNTEWYVNAATASRNLVILLDTSGSMLGQRFEIARQTIEAILGTLSDNDFFNIINFSKQAILLEECDGFSKQAILLEECDGKLVQATLRNKKLLLSRLSNVSSEGKADYEMALHKAFMALMNISKYAGSDQQMGCQDMIMLITDGAPGFFRETFELFNPEKRVRFFSFVVGEEAKDFVRFFSFVVGEEAKDFEQVRWMACANRGFMAHISSMADVQEEQVRWMACANRGFMAHISSMADVQEKVQQYVRILSRTVSRQKAASEDSPFWSGATRERMVSRXRRETXSGGKGREKRVLSSNGLVTLRNNFAKSLQQSDDFIVSVSFPVVLPDGQFMGVSSVTVPLFELSQLAHPSRVGARSHFVLLDGSGYALIHPQLRPMDICAAFKKFXFQLYLIKL

SEQ ID NO: 148939 - protein, 223 aa, Heterodera glycines
  Coding regions on vcDNA: vcDNA=SeqID_75362; Strand=-; Position=1 -82,344-933
  Homolog annotation: Hit_ID=ZP_00151052.2; Match level="QueryCoverage =84%, HitCoverage=40%, E-value=6e-17, Identity=30%"; Hit description =COG0810: Periplasmic protein TonB, links inner and outer membranes [Dechloromonas aromatica RCB]
MDVYVALNSGAIIDCFHDQKNGLASLNGRSGLSASKEPAIRRAKRPPSGEQRARRQASKEPAIRRAKRPTSGEQSARRQASKAPAVRRAKRPPSGEQSARRRASKRPPSGEQSARRQASKAPAVGRASARRQASKAPAVRRAKRPPSGEQAPAVWRAKRPPSGEQSARHQASKAPAVWRAKRPPSGEQSARRQASKAPAVRRAKRPPSGEQSARRQANKRQCP

SEQ ID NO: 148940 - protein, 257 aa, Heterodera glycines
  Coding regions on vcDNA: vcDNA=SeqID_75363; Strand=+; Position=1 -501,826-1098
MDLPSSSGTVELFDRGLAFSVQERYGLQTAATLRQKDNQFLTTSHAFAPTEISADALFKSVVATATVQPQQKSPPSSSLSSASPQQQQQQQSSFLASAPPPPQHRPHQFIDCEGRLTTHLIIDEGEELEEQQHQNQQYSPISDNPFEGVSQSGTEIQIAGLMTSILKRIPSTSGSSTSSKSGHEIRKHVRELYAELGEKNEQQRERAKNAIETKNEGGRKRSTAETDKIKKKVIQHLKYKHSHECSLCNSIHAAYQK

SEQ ID NO: 148941 - protein, 49 aa, Heterodera glycines
  Coding regions on vcDNA: vcDNA=SeqID_75364; Strand=-; Position=1-150
LNFNSFNCIPTAPASNCAQFPSELLYQKHFKIITVPWRVGEAALECRIL

SEQ ID NO: 148942 - protein, 279 aa, Heterodera glycines
  Coding regions on vcDNA: vcDNA=SeqID_75365; Strand=-; Position=1-840
MCAKHQAWLKKNGGKNEKAANNVRVGRVFLVKSENQRKNGIIDVPIDVNGTKVDFIADLGTEGTVLCEDTVRQIGALKLSRCQERAQYHDGTTRPFVGKGKTTFSFGDRSCYGHFFVSKDGSKNLLGLDMMDRLGLSDSIRNGLKDKFRTEASKENGASQKKKKKFFRKDGRGKKKNFFAVGANVIASLGDEPWRAGRVISRKEGTYDVQFLDGTTGEFPAKGVQPYKPDEDENLNFLLDGFGLKRASSGGSIGKHGSDGRRDQTKDDLREASDCGHKA

SEQ ID NO: 148943 - protein, 251 aa, Heterodera glycines
  misc_feature (180)..(180): Xaa can be any naturally occurring amino acid
  Coding regions on vcDNA: vcDNA=SeqID_75366; Strand=+; Position=1-756
  Homolog annotation: Hit_ID=XP_319741.1; Match level="QueryCoverage =91%, HitCoverage=53%, E-value=3e-24, Identity=30%"; Hit description =ENSANGP00000006515 [Anopheles gambiae]
ERFNFALDCAAPQLADEAKVKLLMTKLSEVAFSQYSKSCLPKKVIDFDYSQTEERLKIAFSRPQSIWIDRYECLRASKSEDESFRPFINRHKRLLRDFQFEKLNEEQFSCLMLLTALKSPKDAELRKRILSKLAADGDLVEYDGVVEDLQMYQSTIAEAKVLEQQPMGSRNLMATKLKAXRNERTDLSSNASSISTGTRSSNRSQRVCWRCGLSHSSRNCRHEKTVCRKCKKSGHLERMCAKHQAWLKKNG

SEQ ID NO: 148944 - protein, 236 aa, Heterodera glycines
  Coding regions on vcDNA: vcDNA=SeqID_75367; Strand=-; Position=1-711
  Homolog annotation: Hit_ID=XP_319741.1; Match level="QueryCoverage =73%, HitCoverage=39%, E-value=3e-19, Identity=33%"; Hit description =ENSANGP00000006515 [Anopheles gambiae]
MGDAIQQLTAAIQQLLANQNGAPAANAHALPTLPTIDCFEPSDDRSISDWLERFNFALDCAAPQLADEAKVKLLMTKLSEVAFSQYSKSCLPKKVIDFDYSQTEERLKIAFSRPQSIWIDRYECLRASKSEDESFRPFINRHKRLLRDFQFEKLNEEQFSCLMLLTALKSPKDAELRKRILSKLAADGDLVEYDGVVEDLQMYQSTIAEAKVLEQQPMGSRNLMATKLKAKKKRTN

SEQ ID NO: 148945 - protein, 205 aa, Heterodera glycines
  Coding regions on vcDNA: vcDNA=SeqID_75368; Strand=+; Position=1 -237,756-1133
MADVEMQEQSVPLKNAEQQQPTQQQQMTTEGTETTATTTTVTTTVTAPGTGVAVPQQGEEAPPASKSKEKKGGGWFAKKKTQKSPHDGGDEESEKLVSSDKKAKNLAAAAAGDGGGGDEKEAAAAETNNVKDEAKKMKKDSSNGTKQQQQRAKCPFSLCRGARKVEEVGHAEQHTTASQWGEREPTPTTTFRFDLVQRDSAKLQE

SEQ ID NO: 148946 - protein, 123 aa, Heterodera glycines
  Coding regions on vcDNA: vcDNA=SeqID_75369; Strand=+; Position=1 -44,300-627
MCEHPREGQRQMKRIKLCADVCYDVLAFFGPVMLGLGIALVSGKFNAVADHLLRRKLWTVGHIQIRRAKDGIDWMLDIVKDYQDAQKAVTFPVAVSPLPLGITDFKSIQIKWNILVHSYEKQI

SEQ ID NO: 148947 - protein, 60 aa, Heterodera glycines
  Coding regions on vcDNA: vcDNA=SeqID_75370; Strand=-; Position=1 -38,726-870
MMNRTMFRPGVQELFGHPERSEINANDNDEDAELLSVSEASVASDESEEEFEDDSGGFVV

SEQ ID NO: 148948 - protein, 23 aa, Heterodera glycines
  Coding regions on vcDNA: vcDNA=SeqID_75371; Strand=+; Position=1-71
IGQQQTATVWTGATVDDGTDDAQ

SEQ ID NO: 148949 - protein, 73 aa, Heterodera glycines
  misc_feature (1)..(1): Xaa can be any naturally occurring amino acid
  Coding regions on vcDNA: vcDNA=SeqID_75372; Strand=+; Position=1 -199,1351-1370
  Homolog annotation: Hit_ID=NP_501223.1; Match level="QueryCoverage =97%, HitCoverage=22%, E-value=1e-22, Identity=64%"; Hit description =mitochondrial carrier protein family, embryonic tissue differentiation factor, DIFferentiation abnormal D
XTNVVTNFIAGGVGGSCAVITGHPFDTVKVRLQTMPKPAPGQPPLFAGAMDCVRQTMAREGFFVRFSGGALPP

SEQ ID NO: 148950 - protein, 35 aa, Heterodera glycines
  Coding regions on vcDNA: vcDNA=SeqID_75373; Strand=+; Position=1 -34,169-242
MTKLMQGGAGFELCRSEFASQYGKTIKQQNTKTNA

SEQ ID NO: 148951 - protein, 90 aa, Heterodera glycines
  Coding regions on vcDNA: vcDNA=SeqID_75374; Strand=+; Position=1 -106,760-926
MATSSTGNVKWYEYHMTAMSCRALTSCQKFKMNANGKRYTVRSKYIRDRAGPDPVPDFSGSGNPVRRFWEKSGLTGLPDYERPDPESGHF

SEQ ID NO: 148952 - protein, 25 aa, Heterodera glycines
  Coding regions on vcDNA: vcDNA=SeqID_75375; Strand=-; Position=1 -69,114-122
MDGRKFDQFEQCQHSFEWRKLHLKF

SEQ ID NO: 148953 - protein, 206 aa, Heterodera glycines
  Coding regions on vcDNA: vcDNA=SeqID_75376; Strand=+; Position=1 -144,196-516,927-1034,1121-1168
MSQKSISGFISKITFEQSSSTQNFDEQISSAEEAISDLAVSVSSDEFWIAELKQTLKELEGDWFNRKNVDEKWTAIFKNPNFVLLKSLVSAILSIFPSNAVCESVFSVLKKIKTDERNSIGIPLLNSLISIKFNSKISCLNVHNYFLSLANLLKQTEISKIRRTGTGSIKDRYNSRSRTTLFESNQMPPWTRPRFPNSPDRTGLVF

SEQ ID NO: 148954 - protein, 120 aa, Heterodera glycines
  Coding regions on vcDNA: vcDNA=SeqID_75377; Strand=+; Position=1 -216,376-522
MTKKLRAMEVSWALGAAFHLLNTYHDNMKRERHGRRHSREELEQRRRAVEEREAAADARIAELANSRNLLKSALPAWLLPRQPLTNRYGLFNLLTDHDDDAWNGFFDAYVRQYVGVRRRP

SEQ ID NO: 148955 - protein, 84 aa, Heterodera glycines
  Coding regions on vcDNA: vcDNA=SeqID_75378; Strand=-; Position=1 -14,101-341
MFKKGAAKNMHEKWSKYANKLVKYAPNMHKITKYAPNMHKKHETEGCKFPVKTVKTRDFGVLSCPLPGPGPVALYIIEYSSGTI

SEQ ID NO: 148956 - protein, 341 aa, Heterodera glycines
  Coding regions on vcDNA: vcDNA=SeqID_75379; Strand=+; Position=1-1026
MVPESEYLTLINLLKRGTTTSGPYESERAELDTDIQKNLADHKRGADVQMKRHSWLYKQRRQLKDLAENRPQKVVIENLAAIPPNIAPYMGIQAPSAKAKLETKVKKASDNEQQKTNSFYNRLTAAGDERKRRSRKRKLGKKMVMNTGDESDADNNSGDNADGSFYSSAKDDELEQTSYHKRKRAPSLLTQIDQTDPEHYEELKKIVEARLIKYGIDAKTGAILTNFNKPVAGSHYLNAIKYMTGQLNNKPKGHRFLIQRLNREKEILKFFPHLNQSQQSGEGIKRFRAKKKKFLALVRMQPPIKTPGLHRTAYAEKLHAKFPPKHQQQKFTFKPAIWAKL

SEQ ID NO: 148957 - protein, 179 aa, Heterodera glycines
  Coding regions on vcDNA: vcDNA=SeqID_75380; Strand=+; Position=1 -514,1765-1790
MRALWRLARAFPGTLIRCICFYAAQALEIERLVAQQEIPDILVTTADATQGHESSLAVLVTTCSVFDSGADSQPFWADAARVDVAISRASHGMIIIGDLLLLNRTETWRRYLDQATTETTVVGPEYFDFEQFNNPDNYYDKDGQLISANGGAVRSEHFYSKYGKNVWYNNSVFLNLNLL

SEQ ID NO: 148958 - protein, 114 aa, Heterodera glycines
  Coding regions on vcDNA: vcDNA=SeqID_75381; Strand=+; Position=1 -130,583-785,910-921
MDNLLLFPLQPQCRTRPLLAAIRKAIGAMANQTQCQQKQAELTILGGANSAPVRRLWCHHFHGRPPNARRAARTRRTPCDACALSAFAVGHPLALCRPLRVGSTVWPLGGPEIF

SEQ ID NO: 148959 - protein, 169 aa, Heterodera glycines
  Coding regions on vcDNA: vcDNA=SeqID_75382; Strand=+; Position=1 -442,1798-1865
  Homolog annotation: Hit_ID=EAL47145.1; Match level="QueryCoverage =85%, HitCoverage=68%, E-value=6e-16, Identity=34%"; Hit description =transcription initiation factor TFIID, putative [Entamoeba histolytica HM-1:IMSS]
MQKPIIVNIIALANLGTGIKLNALMITECEFKYNPRKFNAAVIKCISPIKATALLWESGKMICLGTKSLIDCENAIKNFIEIIKGSGCPGASYTGHTVENIVSTFKFGREIELNEFRKNRRAFYEPEIFCGLNFKRGKSMTALIFWTVINYFIFYFLAIIRNTKYKSNW

SEQ ID NO: 148960 - protein, 125 aa, Heterodera glycines
  Coding regions on vcDNA: vcDNA=SeqID_75383; Strand=-; Position=1 -153,315-539
MPPPLSQKNPITVQLKLTNSTDTCSDYSLEFTNTCFKLVDQVKFHVKVPKTSKLANHWGIVPLATDNGTADQQQLFTLPNNVHLYPGKSFASAGISVNGADRPEIVILDVQSVLCTEKHDDAATN

SEQ ID NO: 148961 - protein, 66 aa, Heterodera glycines
  Coding regions on vcDNA: vcDNA=SeqID_75384; Strand=+; Position=1-709
PKMVKKILLIFSNFLFFNFFTFQLIVSPIGSFPKGNKRLRERGVRCSNGRAGGGARGRARIRHKLR

SEQ ID NO: 148962 - protein, 143 aa, Heterodera glycines
  Coding regions on vcDNA: vcDNA=SeqID_75385; Strand=+; Position=1 -264,368-449,886-971
MIGLILNEESCSFLRQSIAPTALLSCLKLHIIEGTELIPEFSRNDIGETTNENEINRWLVKHLTNTSTPKIYKCQTEDIAFNVSAFKTGKIHAPVDLNFIGVQNDEWSRICFLTDAFAFAADLKCLSRKTIFFIMYLFLFQHI

SEQ ID NO: 148963 - protein, 37 aa, Heterodera glycines
  Coding regions on vcDNA: vcDNA=SeqID_75386; Strand=+; Position=1-112
ALFVLYIFPTSFFILFFFFCYFFKLSPFLLLYKFILI

SEQ ID NO: 148964 - protein, 83 aa, Heterodera glycines
  Coding regions on vcDNA: vcDNA=SeqID_75387; Strand=-; Position=1 -156,338-433
MSKQFLLLALLLLLLPLDTLQECVWNDEITLCVGLCSTGCGQLSQANCACAKRRKNKEKQKQQQKNKSVECDEDEKWIIILIK

SEQ ID NO: 148965 - protein, 200 aa, Heterodera glycines
  Coding regions on vcDNA: vcDNA=SeqID_75388; Strand=-; Position=1 -144,288-429,551-672,726-793,860-986
  Homolog annotation: Hit_ID=AAA91356.1; Match level="QueryCoverage =98%, HitCoverage=27%, E-value=3e-61, Identity=59%"; Hit description =Aldehyde dehydrogenase protein 11, isoform a [Caenorhabditis elegans] ref|NP_741082.1| triacylglycerol lip
MAVHGALLANFLSQGQVCSNASKVLVQRKVLEQFTHQIVHQTENMRIGDPLNESTHVGACISEQHMDKVRQFIRTAVDEDGAKLLTGGERVTTIQGLEHGYFLSPCVLTNITPKMTVYQQEIFGPVLLIIPFDDEQEALQMANDTEFGLAGGIFTKSVQDLARAHQFAARMNAGNVYINTYNDTHPNVPFGGFNQSGFSN

SEQ ID NO: 148966 - protein, 28 aa, Heterodera glycines
  Coding regions on vcDNA: vcDNA=SeqID_75389; Strand=-; Position=1-105
KMFKNSQLFFLGLKNALITNLNSDFENH

SEQ ID NO: 148967 - protein, 189 aa, Heterodera glycines
  Coding regions on vcDNA: vcDNA=SeqID_75390; Strand=+; Position=1 -107,161-379,584-801
  Homolog annotation: Hit_ID=AAP30770.1; Match level="QueryCoverage =100%, HitCoverage=68%, E-value=2e-42, Identity=51%"; Hit description= putative gland protein G17G01 [Heterodera glycines]
MEKIVYLKLFQIVLTLTIFWQLISLHQFCGFADPKTFLCHIRAGNTFLCHIRAGNCERYTLIGMDSETGEFGSMYNKLHNQLWMITNGRPIEEQQHQFMDELAAKLPPAGRHCIPITISPFEWIGKDINALNNDTLLYFSTQLFFSLVSLGVLGCIIHKINVKLKTSILQICRVQKCLSFRHTPLSFCW

SEQ ID NO: 148968 - protein, 77 aa, Heterodera glycines
  Coding regions on vcDNA: vcDNA=SeqID_75391; Strand=-; Position=1 -189,964-1008
MATLIVLHKHFGYLGYKANVKFLQQIKFCETQQIRWMLILGPEEIAKNSVKLRYIPAKDKGEEAHKEHLDLSNDIKD

SEQ ID NO: 148969 - protein, 27 aa, Heterodera glycines
  Coding regions on vcDNA: vcDNA=SeqID_75392; Strand=+; Position=1 -57,568-594
MKQMFAKERKYKFIIKRENLKMDKKQF

SEQ ID NO: 148970 - protein, 92 aa, Heterodera glycines
  Coding regions on vcDNA: vcDNA=SeqID_75393; Strand=+; Position=1-279
MIWSIRLPDFWGFATWVPDIWGPDIWGPDIWGPDFWGPDIWGPDFWGSRHLGTRLLVTRHLGNPTFGDPKFGDRMSFGDPTFGDFIKTKKNI

SEQ ID NO: 148971 - protein, 138 aa, Heterodera glycines
  Coding regions on vcDNA: vcDNA=SeqID_75394; Strand=-; Position=1 -160,349-603
  Homolog annotation: Hit_ID=NP_493462.1; Match level="QueryCoverage =99%, HitCoverage=27%, E-value=3e-11, Identity=36%"; Hit description =human TFG related (49.7 kD) (tfg-1) [Caenorhabditis elegans] emb|CAB63398.1| Hypothetical protein Y63D3A.
MNKTTLKARFGSDIRKNWIHHSNDISLNDLVTKMQRYFDIKDANAIKLKYRDQESDWVTLADDDDLAYALASMELLYVDVIVEKYQFKQDEETVEKTAPPAEVVKAVAPPRDATPVDNGDVAQLQKQQRSSTTPVSSI

SEQ ID NO: 148972 - protein, 29 aa, Heterodera glycines
  Coding regions on vcDNA: vcDNA=SeqID_75395; Strand=+; Position=1 -61,135-163
MDQIVTEFLSKLGMAKLYANCQRRNFNGK

SEQ ID NO: 148973 - protein, 443 aa, Heterodera glycines
  Coding regions on vcDNA: vcDNA=SeqID_75396; Strand=-; Position=1 -118,180-212,292-444,499-526,575-690,745-876,935-991,1093-1261,1312 -1346,1391-1676
  Homolog annotation: Hit_ID=CAE69532.1; Match level="QueryCoverage =90%, HitCoverage=64%, E-value=1e-102, Identity=49%"; Hit description= Hypothetical protein CBG15741 [Caenorhabditis briggsae]
RLNSLSLCTEFGFFWGFHTIHHSSEYYNFSTALRQAAIQAGLAAYDILQAFLAFLIPPSIFLVHRYFSEIFQFWMHTSLLGSLGPLGFVFNTPSHHRVHHGRNAYCIDRNFGGAYCIDRNFGGVLIIWDRMVLIIWDRMFRTFEAERKEEPPVYGLIRPERSFDQLWLQFHTLKELLCDKWFHTLKELLCDKWRLKDEKGQKVFPKWTDKVKALFFPPGWFPGTKIRHFFHWTSIRHFFHWTSLDDHSFGVPPVQLPVQKYDPSLSVWLKAYCLAHFLLLLCIFLHFEYDRAQLGYLDFTLKIAFFICTMQSFGAFFDKKWMQSFGAFFDKKWFAPFLEIFRSFGVFSYYFAPFLEIFRSFGVFSYYTTRTIIEHKKPQPNRIFIATLFVASAIVWVVVLLRHSFNLKCIKSIAIPFKVKKEAKAKVTAKDGKENRTIGKELR

SEQ ID NO: 148974 - protein, 545 aa, Heterodera glycines
  Coding regions on vcDNA: vcDNA=SeqID_75397; Strand=+; Position=1-1638
  Homolog annotation: Hit_ID=NP_507780.1; Match level="QueryCoverage =72%, HitCoverage=28%, E-value=1e-33, Identity=28%"; Hit description =predicted CDS, DNA polymerase type B, organellar and viral family member (5T899) [Caenorhabditis elegans]
MVAKTCNWPRWKFFDYVNDRKGQQGQLHHDAVELMQQVNAPMDLVGYDADTFVPHVVDYWNNTQRQHRFAVFIFGSLGQYKPLYKYIDNTYDTPLLLYFNEDHFDGVQKQGGLFGQPYCLECERPYDKMSRHNKSCKAHCVMCSRVGPQFPCQPTDGFVKECSKCYKRFRNYDCYQHHLHSNFCMRSKMCKDCGAVWDVADNKRNGRKGHVCGENYCGLCNNYHNTERGCYIQPIEPKQHTPYRIVAFDVETMQHTFIGESEQRNHLPNFIAAKVICPGCIENGDWQRGTKGCEVCGPNRTVAFCQRRFTETTVDKQVVADNPLEEFVDWLVFQLPLKYDTYVYSHFGGRFDMVLVFRELFRRGFNPSMLRKGNKLYEMKVGKQKKRNPNVVFRDSYNLMPCALAELVPSFGLDVEDKPFFPHMANQPDNYGKQIYPTPEDYLADGMMPDKRQKFNVWYEQHQHKPFLLDEALASYCTNDVEILKAALVAFRMEFFDVSRREEGIVAERAHEGIKRRNFGVHPKRRTSAHRHIQSLNSRPNNKIH

SEQ ID NO: 148975 - protein, 142 aa, Heterodera glycines
  misc_feature (141)..(141): Xaa can be any naturally occurring amino acid
  Coding regions on vcDNA: vcDNA=SeqID_75398; Strand=-; Position=1 -35,85-322,367-446
  Homolog annotation: Hit_ID=CAE67225.1; Match level="QueryCoverage =84%, HitCoverage=26%, E-value=3e-39, Identity=64%"; Hit description =Hypothetical protein CBG12664 [Caenorhabditis briggsae]
KQFGQRIIDFHAVQHQLADLAAVQHQLADLACDIEATRLLVYNAARLKESNLPYIKEAAISKLFSSNVATKVTSKCIELMGGVGFTKEFPIEKYYRDCKIGTIYEGTSNIQLNTIATIYEGTSNIQLNTIAKFIDSEYTQXK

SEQ ID NO: 148976 - protein, 191 aa, Heterodera glycines
  Coding regions on vcDNA: vcDNA=SeqID_75399; Strand=+; Position=1 -99,151-282,352-450,671-772,819-962
  Homolog annotation: Hit_ID=CAE73769.1; Match level="QueryCoverage =100%, HitCoverage=61%, E-value=4e-60, Identity=59%"; Hit description= Hypothetical protein CBG21313 [Caenorhabditis briggsae]
PATIKSNNGKAEMPMSFSSSSTSTLHSQPFKTLALPSDVELLAAKKQATKAHENSYLGAVLRGEKKMKRFVRSCGGQVWEDSSMAEWDPNDFRIFCGDLGNEVSDELLAKAFRKYPSFQKAKVVRDSRTNKSKGFGFVSFKHQDDFIRAMKEMDGKYVGNRPIKLRKSNWKERNLDIVKKKNKAKKKLGLL

SEQ ID NO: 148977 - protein, 144 aa, Heterodera glycines
  Coding regions on vcDNA: vcDNA=SeqID_75400; Strand=+; Position=1 -90,167-283,899-995,1046-1175
  Homolog annotation: Hit_ID=NP_495281.1; Match level="QueryCoverage =46%, HitCoverage=59%, E-value=2e-24, Identity=73%"; Hit description =putative protein of eukaryotic origin (2G650) [Caenorhabditis elegans] gb|AAA68261.1| Hypothetical protei
MVQPVTAEDSIPEYMNVLGMVFSMMGLMMRLKWCSWVALICSCVSFANMRASDDTKQVVSSFMLSISAVPSGLEVLTDVAVISDKEAVPSSFVCLDFTVDTKERALKKKYLCARFTPRTDAIDAVTNLIVLARSRRPPKGYTLA

SEQ ID NO: 148978 - protein, 55 aa, Heterodera glycines
  Coding regions on vcDNA: vcDNA=SeqID_75401; Strand=-; Position=1 -81,135-221
  Homolog annotation: Hit_ID=AAR06638.1; Match level="QueryCoverage =85%, HitCoverage=27%, E-value=4e-09, Identity=61%"; Hit description =superoxide dismutase [Brugia malayi]
MADPKKAVCVLVGDADPSVKGMITFTQDKEGSPVSVQGEISGLEPGLHGFHVHGN

SEQ ID NO: 148979 - protein, 98 aa, Heterodera glycines
  Coding regions on vcDNA: vcDNA=SeqID_75402; Strand=+; Position=1 -208,779-867
MQIILIEERLDSAHKRDKAAEFVMEKAEKEGEKAPIHSFKMSGHCDGEAVEKEEEEYGSKQVEYRSLAISRGCSPTFVTVLALCSSNLMGRAKTVAIR

SEQ ID NO: 148980 - protein, 131 aa, Heterodera glycines
  Coding regions on vcDNA: vcDNA=SeqID_75403; Strand=-; Position=1 -173,335-557
MKILTSLSMLIFIISFGYFFAIVIRIISSLWKIANFAYITFLSSMFSAIAMAANAPVFSDYQNALRQHFPRLFKPQQRQMGGSNAFNNNNNNNNNNWATLSLAAVDRTTRVAPINVRGAAAETKRQGNGQN

SEQ ID NO: 148981 - protein, 60 aa, Heterodera glycines
  Coding regions on vcDNA: vcDNA=SeqID_75404; Strand=-; Position=1-452
NPHDFQKFRWWADPSPHTKFTAVNREKKVSTTLKNFLDFFSHKLKRVIIFNSINAFIKKC

SEQ ID NO: 148982 - protein, 218 aa, Heterodera glycines
  Coding regions on vcDNA: vcDNA=SeqID_75405; Strand=-; Position=1 -66,118-224,299-517,615-737,868-988,1068-1088
AKNQVYITMISDLYLNDSSRNNNYAIFQRDGVPLAFVALIVIRFLIAIIGILFNASLLDLQGSCNFLIAFNAFCLVIFMPFMSISVFNHSLMPVQICFWWELVPMFFGNLFMVSTLAIAFDRLLSVLIPAWHTRHNKEFNYLGSLLTLCILYAGCIVYFCYTALPQLTADSPTVICLNPSDSYQGGIGTILFVVSLVVVTLCILCYAIIWVIGMALSQ

SEQ ID NO: 148983 - protein, 47 aa, Heterodera glycines
  Coding regions on vcDNA: vcDNA=SeqID_75406; Strand=+; Position=1 -77,1271-1337
MTLISKCSLLLLFVAPFSHAFFSGFDDSIEFSISFWKTILFKCLFNE

SEQ ID NO: 148984 - protein, 185 aa, Heterodera glycines
  Coding regions on vcDNA: vcDNA=SeqID_75407; Strand=-; Position=1 -153,298-423,596-874
MSSSSAKLDEFQNALPFGVFLNDFDGAALGIVAFEIHCAIGTNDVNTCKTMATEEKSRKLTTRGIQTSTTTRATPPKTKLKIVTPFKTETPRVPNLFTPRDSTVKHFGTNCVQIDFPAEIAQFSLNVSAALFGIACKQYLRKYKIGQLPKNYDEKMEIKDKMEACGKVPTETNCKKLKKWKLKLN

SEQ ID NO: 148985 - protein, 26 aa, Heterodera glycines
  Coding regions on vcDNA: vcDNA=SeqID_75408; Strand=-; Position=1-78
MIYPVEMDPEFFYSRLRLFWTLTSQR

SEQ ID NO: 148986 - protein, 39 aa, Heterodera glycines; identical to SEQ ID NO: 146413
  Coding regions on vcDNA: vcDNA=SeqID_75409; Strand=+; Position=1 -37,532-614

SEQ ID NO: 148987 - protein, 154 aa, Heterodera glycines
  Coding regions on vcDNA: vcDNA=SeqID_75410; Strand=-; Position=1 -63,518-631,1537-1747,1960-2036
  Homolog annotation: Hit_ID=CAE58761.1; Match level="QueryCoverage =74%, HitCoverage=36%, E-value=9e-31, Identity=54%"; Hit description =Hypothetical protein CBG01953 [Caenorhabditis briggsae]
MAAIRGYRFIAVMSSSYTIERFCNEANPEIHYRTTGPEIWHQTQGKVDICVFGIGTGGTFYAVEPAESAVLSGCRPEGAKHRIQGLGTGTVPAVLDTHMYKNGGGIVQVHSDDAIAMARRMAAEEGLLCDRLNSIRMRTKKRQQCATRKHLRKI

SEQ ID NO: 148988 - protein, 37 aa, Heterodera glycines
  Coding regions on vcDNA: vcDNA=SeqID_75411; Strand=+; Position=1 -48,91-156
MICYNGAMPCVLSLKNVSLGFITNCLSILGPQPKKTN

SEQ ID NO: 148989 - protein, 152 aa, Heterodera glycines
  Coding regions on vcDNA: vcDNA=SeqID_75412; Strand=+; Position=1 -169,370-657
MTVQQQQQPSSTAPHVPSSSASSSVATAPKRQFRPLAEYRKALEEFSAERQQQREVTFLRAFRIFTGRRGIPSLIMSDQGTNFMSGAIVIRDNWTDALVPEYMQQLMAPSGIPLDFQHSPRHLKRRDLGNTCRHHQIRTTKDSQQRTSHIVQ

SEQ ID NO: 148990 - protein, 96 aa, Heterodera glycines
  Coding regions on vcDNA: vcDNA=SeqID_75413; Strand=+; Position=1 -37,96-163,215-300,353-452
VTTVTENGMRITGADEEEEAEKDAPIRVESNFIVSVDEMDEPLALKLERQNRTEKKEAIGENPNKTQRQIDEAHTESSEETEKQTKAKESEAQEKQ

SEQ ID NO: 148991 - protein, 113 aa, Heterodera glycines
  Coding regions on vcDNA: vcDNA=SeqID_75414; Strand=-; Position=1 -67,136-258,498-649
  Homolog annotation: Hit_ID=NP_504823.2; Match level="QueryCoverage =89%, HitCoverage=30%, E-value=2e-14, Identity=29%"; Hit description =phosphate transporter family member (54.8 kD) (5H667) [Caenorhabditis elegans] gb|AAB71321.2| Hypothetica
MPIFYFLCFTFYTFMVVFEGSKVLHLEHIPFWLALLISIGVGFSAMLIYLFILRPKLIRWIKKTPMGLINWFIPRKDRKEDEDTLRLFSIVQVIKKHFVEYVILHLMMFDLIR

SEQ ID NO: 148992 - protein, 173 aa, Heterodera glycines
  misc_feature (8)..(8): Xaa can be any naturally occurring amino acid
  misc_feature (16)..(16): Xaa can be any naturally occurring amino acid
  Coding regions on vcDNA: vcDNA=SeqID_75415; Strand=-; Position=1 -203,250-292,463-564,941-1074
  Homolog annotation: Hit_ID=NP_504823.2; Match level="QueryCoverage =90%, HitCoverage=28%, E-value=2e-42, Identity=54%"; Hit description =phosphate transporter family member (54.8 kD) (5H667) [Caenorhabditis elegans] gb|AAB71321.2| Hypothetica
YRSMIFKXIKINIIFXFNFQKFHQFLWTVIAGFMCSFLLGFGMGANDVANAFGTLVGSKVLTLRKANIMATIMETAGAVLIMATIMETAGAVLVGYNVVDTVRKGIVEIELYRGAPQDLLVGQVAILGGCACWLLLATIFRLPISSTHAIIGSTLGFTLLMKGNAGIHWSMVI

SEQ ID NO: 148993 - protein, 15 aa, Heterodera glycines
  Coding regions on vcDNA: vcDNA=SeqID_75416; Strand=+; Position=1 -6,1143-1184
MTNLALSHTTSPTDQ

SEQ ID NO: 148994 - protein, 31 aa, Heterodera glycines
  Coding regions on vcDNA: vcDNA=SeqID_75417; Strand=-; Position=1 -25,143-213
MDLFLSSAEVEVVRFGGIFSKRLFIIKNYMQ

SEQ ID NO: 148995 - protein, 128 aa, Heterodera glycines
  Coding regions on vcDNA: vcDNA=SeqID_75418; Strand=-; Position=1 -138,751-846,1783-1935
MTFKALRGISPCSNEKLKDEVRRQQKKEEEEEAKKVAKDNDGEGWSGIENRQTKRRMENIDTVVVPIIETEISEFVLCQFWHDSKALDKLSLIIGDEVEPAADHARISSGARSLAPPIGRRSRECAGF

SEQ ID NO: 148996 - protein, 404 aa, Heterodera glycines
  Coding regions on vcDNA: vcDNA=SeqID_75419; Strand=-; Position=1 -871,916-1259
MRDQILELERFPENATAQAMANKILHLKAIAQQLAKFTQAKFARGEAKLIDPLLLEHALKICHFCDNFLIGGESESGERVGKRLRHGIGLVKARVCQVQRLMDANLVEWNDIWQLLRNFSPTEGPMGGVDQLAKSLEQRIGTMIRQSNGSYYGKMPFTKAISQLAEVERDRSEDEAAKLVILFKIVLELIVGATQEMLRNIATDTLEANGATFYGTNFLIVFSNTTNETERQCQGLIGTSEVPNGQLMVRLFDGVRKEANEMFERRKTDICAQFKSIGKMLKTEMAQFRIELDKGLERHISKRHKLFNGKPKLRNTFELLKETQNVFMIVHNALDMVDLQYPKEMVKKKLEQLGRIMQQGIVANNTITSEDYEEHDEITNCLKTEEIEEQIEFEIYSMGFRTIF

SEQ ID NO: 148997 - protein, 92 aa, Heterodera glycines
  Coding regions on vcDNA: vcDNA=SeqID_75420; Strand=-; Position=1 -179,232-331
MRLVQLLHLALLVQLLLAPVLLAVGQTDEKVKRIQKREGPPEANLVDKSAVPAEGNGMKIRRRRGTKLKAMAGGAAAGLGAALLYKAFKGKG

SEQ ID NO: 148998 - protein, 455 aa, Heterodera glycines
  Coding regions on vcDNA: vcDNA=SeqID_75421; Strand=+; Position=1 -66,148-325,378-410,471-669,1012-1124,1178-1413,1487-1595,1893 -2013,2059-2371
  Homolog annotation: Hit_ID=NP_505114.1; Match level="QueryCoverage =87%, HitCoverage=81%, E-value=6e-34, Identity=27%"; Hit description =carboxylesterase precursor family member (64.2 kD) (5I685) [Caenorhabditis elegans] gb|AAA96175.1| Hypoth
MADQQPISEDCLFLNVFAPHRSPSAEQNKTFPVLVVIHGGAYEIGSSARYTKYEVIGQRFVTDANSRGIVFVSIQYRLGVMGFATTGDEELPGNLGIWDQISALQFVKDNIAEFGGDPSRVTVFGYSAGSGSTALLSISPKSRGKEIEKRKAKLKKKGNPHRLDRELFPQDYPEMIATAPPKKMIMGFAELDFLLFSLISSKNNSISMLALTDEQIANYDQKAFEASVSEFVVKEKYFGNQTNEVKAEIVHFYVNEYLPAETVKDQKFFVLLYTTCQLTDQKPTFLISMPSRHSKNRAQQIWASDEIQKKGPAYHGFDHSLIFYDEFTKKSEEDRKMSEYLVTAIKNFVINGDPSTETIRWDQLTDFPSIERVEKVQHMRMEAKKTGMVDGMKAELRRARFWRELAKKYTNFDLVRGTFPEKSGQSAAFVPSAQFAQIFSIFAIVAIISLNNGIY

SEQ ID NO: 148999 - protein, 338 aa, Heterodera glycines
  Coding regions on vcDNA: vcDNA=SeqID_75422; Strand=+; Position=1 -278,375-1113
  Homolog annotation: Hit_ID=NP_491240.1; Match level="QueryCoverage =97%, HitCoverage=28%, E-value=3e-37, Identity=29%"; Hit description =zn-finger, CCHC type and RNA-directed DNA polymerase  and Integrase, catalytic domain containing protein
MKNLAKQFMYWPKIDLDIDRWVRNCEECALAAKAPPKVPLQPWPASTQVYERLHMDFAGPCADGNKYLVVVDSFSKWPEIIKMKSTEHLLIEHSHGIQQTFAPPFHPQSNGRAERFVDTLKRQMKKCARDDPHWVQNSLLAYRTTPNASLNGRTPAELFLGRPVRTVLSLIKPNSQKQKQGPVLNEQNSKMAKQFNKHHGARNRNFSIGDIVHFINYRGPSKMWLRGTIVSGKGVVWRIESPQLHAVVTRHANQIQKFDPIPYKENSDIDNQAQGEQQPETPNRSPRRVRFADEQNEPLEQIQPIEPRRSTRQRKAPQQLDMDVTKPKYDYVKQGKTN

SEQ ID NO: 149000 - protein, 39 aa, Heterodera glycines
  Coding regions on vcDNA: vcDNA=SeqID_75423; Strand=-; Position=1-119
PPIGLGLCGKMSPGGNIKGLRPSHRHGFVRETPVRNRAL

SEQ ID NO: 149001 - protein, 137 aa, Heterodera glycines
  Coding regions on vcDNA: vcDNA=SeqID_75424; Strand=-; Position=1-414
MDLPASVQRVVSRPDWHFLVQQMLPIFVPNIRHLELIGCGSIDMLFHISPTILSDLGIASVETSNLFPYEDWQNAIARKAVTEWLHIPRKDGRPKRLRCICFHHNPPIDIDVDEWINLFKEVWPQLQCHDNAYKGLD

SEQ ID NO: 149002 - protein, 64 aa, Heterodera glycines
  Coding regions on vcDNA: vcDNA=SeqID_75425; Strand=-; Position=1 -23,432-603
MKRTLRKIWICNDVLMDILPFFDHAQLGLKLALISPHFDALVDTHFDGKSDLTIWRRITIWVII

SEQ ID NO: 149003 - protein, 25 aa, Heterodera glycines
  Coding regions on vcDNA: vcDNA=SeqID_75426; Strand=+; Position=1-82
RTLSTAVRQRSSKIYSMPQILWAGY

SEQ ID NO: 149004 - protein, 41 aa, Heterodera glycines
  Coding regions on vcDNA: vcDNA=SeqID_75427; Strand=+; Position=1 -19,567-673
MNDYVEVLLFLMCWFCPICPLAKKLRERKEEEAENSGEMDE

SEQ ID NO: 149005 - protein, 27 aa, Heterodera glycines
  Coding regions on vcDNA: vcDNA=SeqID_75428; Strand=-; Position=1-81
MIINYMGEKEGKQCEGKEFRIKKESAR

SEQ ID NO: 149006 - protein, 161 aa, Heterodera glycines
  Coding regions on vcDNA: vcDNA=SeqID_75429; Strand=+; Position=1 -72,224-460,513-689
  Homolog annotation: Hit_ID=XP_415979.1; Match level="QueryCoverage =68%, HitCoverage=12%, E-value=1e-15, Identity=34%"; Hit description =PREDICTED: similar to Zinc finger BED domain containing protein 4 [Gallus gallus]
MASTKTGFTKSGFWQLQIFLGSTPAFKEVDENGSAILPFLNANCAAHLLNLVVKEGLSADLDIEKLFVKCRKIVGHFKKSNKALGKLHEIQEFLEIPEHCLLQEVSTRWNSGLMMIERLYEQKKAINEYAYQNCDFGLTLTSDEWSILEELIAGILLKQNW

SEQ ID NO: 149007 - protein, 132 aa, Heterodera glycines
  Coding regions on vcDNA: vcDNA=SeqID_75430; Strand=+; Position=1 -76,155-266,310-399,451-571
MDSTKPIVFLKVSLKGKPATVVGRVDTITSVLSEAFASKIGDIDSNLRGHVTLPTADVPVVGWVDDVSVALLNAEPYVFAQRFGVVADNHMIAFCERKVDGVFGADLLKRMGILNEEQIDAIPLASGDVPEE

SEQ ID NO: 149008 - protein, 17 aa, Heterodera glycines
  Coding regions on vcDNA: vcDNA=SeqID_75431; Strand=+; Position=1 -48,849-854
MNSFNPNEKAVLHEVRI

SEQ ID NO: 149009 - protein, 296 aa, Heterodera glycines
  Coding regions on vcDNA: vcDNA=SeqID_75432; Strand=-; Position=1 -94,828-946,1005-1182,1229-1489,1634-1756,1815-1850
  Homolog annotation: Hit_ID=CAE65006.1; Match level="QueryCoverage =92%, HitCoverage=95%, E-value=2e-92, Identity=58%"; Hit description =Hypothetical protein CBG09844 [Caenorhabditis briggsae]
SLITTHCSPLHVGVQSYRTKARYSNQELSKVETGGGEGVQVLRNEPFEGESLFNGQFSSGQYTHKIYHFDSKVPSKVPSLLRAIMPKGSMSVHEHAWNAYPYCKTELTNPDFMKDSFFIRIETIHLNDRGTTENALCLTTDMLSALCLTTDMLSKREVVRIDIANDKEFINAADIREDTKPSTFHSERTGRGPLLQSWQTNCEPVMCAYKLVTINFKWFGFQKLVETFVQKQYPRLFCKFHRELFCWMDRWYGLTLMEIRLIEEETQRELDEMRSTGNPAGMTAMRSTGNPAGMTA

SEQ ID NO: 149010 - protein, 24 aa, Heterodera glycines
  Coding regions on vcDNA: vcDNA=SeqID_75433; Strand=-; Position=1-72
LSPTLVIFGTLASHLSFFGTRGEN

SEQ ID NO: 149011 - protein, 92 aa, Heterodera glycines
  Coding regions on vcDNA: vcDNA=SeqID_75434; Strand=-; Position=1 -32,353-462,586-722
MTFERGKTNFGCTRDNNFDYQLGTSYAATPRVRHRLTGTINSYMANHSWEDEIVRHHIFQFRRHSQIEGYAGKLKDLKILMIQLSMSRNEFY

SEQ ID NO: 149012 - protein, 79 aa, Heterodera glycines
  Coding regions on vcDNA: vcDNA=SeqID_75435; Strand=+; Position=1 -257,369-712
IYAFSFQKFKFLAALGTIISTINSEQAMRLPLEFGTGSPAPSTLKLNKKIHLQHGRTKSFGTTFSNSAGTLKLRDMQEN

SEQ ID NO: 149013 - protein, 98 aa, Heterodera glycines
  Coding regions on vcDNA: vcDNA=SeqID_75436; Strand=+; Position=1 -120,328-436,658-725
MMALIEFAFNSVAKHRQMFIYVSKVLDPHFDKVMPPVLAKGYLPFCCSQQQEVRNRITGNHTGNCDPEIGESVSPYDEALRKKSRLIFLYKILGFLIL

SEQ ID NO: 149014 - protein, 132 aa, Heterodera glycines
  Coding regions on vcDNA: vcDNA=SeqID_75437; Strand=-; Position=1 -156,402-537,613-719
  Homolog annotation: Hit_ID=CAE62785.1; Match level="QueryCoverage =96%, HitCoverage=32%, E-value=1e-38, Identity=60%"; Hit description =Hypothetical protein CBG06958 [Caenorhabditis briggsae]
MSKYGMSMCVLGMHEEFRKDGIAVNALWPRTTIWTAATQMLTSGRGQRNSRKPEIIADAAYVILSKNSRDYTGNFAIDEEVLKEVGVKDFSQYANDPTAELFPDFFVPGVNYEKAIEAAFAAAMGEKKGKKV

SEQ ID NO: 149015 - protein, 112 aa, Heterodera glycines
  Coding regions on vcDNA: vcDNA=SeqID_75438; Strand=-; Position=1-339
MRKYKAEELSNANGNNDEGQSAQNGGEGIDYHSADKRQKIVIDFINQWAKLSIEAESSFFLVAYLRFLVVEVEKISQKGNLSGRDSVVALMANYDGWFGVWGHIFAYFDKNF

SEQ ID NO: 149016 - protein, 62 aa, Heterodera glycines
  Coding regions on vcDNA: vcDNA=SeqID_75439; Strand=-; Position=1 -102,150-321
  Homolog annotation: Hit_ID=NP_740993.1; Match level="QueryCoverage =100%, HitCoverage=14%, E-value=7e-22, Identity=82%"; Hit description= DeHydrogenase, Short chain (dhs-6C) [Caenorhabditis elegans] gb|AAK68187.1| Dehydrogenases, short chain
MLNTGKFLGKTFVITGASRGIGKEIALKLAKDGANIVICAKTTQGNPKLPGTIYSAAEEIEK

SEQ ID NO: 149017 - protein, 56 aa, Heterodera glycines
  Coding regions on vcDNA: vcDNA=SeqID_75440; Strand=+; Position=1 -48,410-529
MGLRKVLTNEKQVLLKLEGYQQELNDIRVKADAVVKEKEVLEYQLTGQKRRGSKQR

SEQ ID NO: 149018 - protein, 171 aa, Heterodera glycines
  Coding regions on vcDNA: vcDNA=SeqID_75441; Strand=-; Position=1 -309,1412-1496,2454-2575
PPEQQDAPPAPNIVLRQQSPPAQQHHRRDDRLNFDTPSPLLRQQRPLVQSPLVGQQPDTPVAPPSPNATLHQHPLGPPQQGHRTPAPKQQQRKHLVIYTPSEATTTAQIQTVLLLRNTSKTEAKRYDTERRSADWLSKLWFGRGEKRQKIDDDDPLRIVQLQILPLNSKGV

SEQ ID NO: 149019 - protein, 66 aa, Heterodera glycines
  Coding regions on vcDNA: vcDNA=SeqID_75442; Strand=+; Position=1-201
MVVQQECLVADPQAATAPTVFADAVAEKVYQSSACRHACGVVVPAVTADAKRCSAPEERLVVPVAL

SEQ ID NO: 149020 - protein, 196 aa, Heterodera glycines
  Coding regions on vcDNA: vcDNA=SeqID_75443; Strand=-; Position=1 -39,165-333,538-785,829-960
MKETKANFVGQRTVEQRRQQLEGEVAALVKACGRLKRNAQKKDIAFKLKSLEMVKWPPAKAFDNPYIKQAYGRGTDHQFQKAATIAGRFRANFLGSSTARLASAAWYATRGVYYPIEDCPPIPADKDGYVPPEQPGLNADDQPVTLAKALQDPLFGPADREAIIGQQPTDEIASAFDAFAQKAGDFADQLRRRIEE

SEQ ID NO: 149021 - protein, 127 aa, Heterodera glycines
  Coding regions on vcDNA: vcDNA=SeqID_75444; Strand=-; Position=1 -118,1332-1408,1464-1598,1779-1832
MPTRGASPANAAAINEAFGLHPFFVAFLMIQNLSDFFYNCLLANIPSLELLDEISKENALAKQHNEPQYELECFVSLGTGKAPTEPVGTTSLEIGIIGAIKNLAGILMDQASHSPGKKYGFPYNWNP

SEQ ID NO: 149022 - protein, 182 aa, Heterodera glycines
  Coding regions on vcDNA: vcDNA=SeqID_75445; Strand=-; Position=1 -317,1319-1550
MTPGTSTPSTMLFIVPSPHKQTLHTKRGLNLTMLHLQMLLSANRDRQMPWPIHLCNFPSTSSADDGTGGADAGAVAEVHALCRMRLNTLDSTRCVTGELHTESYTEYIPKRKRLAPAEKNTVIRLRYDNIHTRNREMARIVEQRIPTTAAAAKVDQQQTTNGGGRSDQKMAVGMRFLSRIFG

SEQ ID NO: 149023 - protein, 87 aa, Heterodera glycines
  Coding regions on vcDNA: vcDNA=SeqID_75446; Strand=-; Position=1-262
MRLKTEQKKAQMQLMRSGGGDGTAMPKMEEEEDELEEELEEEEEEGRRTVEEEEEKEQRDEEEEKKGDEQRTATRKTKAFTIPFIST

SEQ ID NO: 149024 - protein, 49 aa, Heterodera glycines
  Coding regions on vcDNA: vcDNA=SeqID_75447; Strand=+; Position=1 -64,156-241
MQVLYSFVLYYISRPDINEGGQLQGLAESVRCLLEVPIQMNYGIVFVLY

SEQ ID NO: 149025 - protein, 319 aa, Heterodera glycines
  misc_feature (57)..(57): Xaa can be any naturally occurring amino acid
  Coding regions on vcDNA: vcDNA=SeqID_75448; Strand=+; Position=1 -177,292-405,512-686,713-773,822-867,1259-1534
  Homolog annotation: Hit_ID=CAE71149.1; Match level="QueryCoverage =97%, HitCoverage=97%, E-value=4e-68, Identity=44%"; Hit description =Hypothetical protein CBG18005 [Caenorhabditis briggsae]
FDLSYGFSVMQIFGEEELLSVPFKYVVLFAVGCPLVAFLLCLFLSIFLHYEQVTNSXLNVPNWLPSLSAAVSTFAPERYIWRLFIGLHGTPRFQFSPSFRNFLVTSSLWPFPFRPWYRWASKFACSLNLAEILSLILLSSVSSTEDHCEFCFLMTVLHALCFSGFTFFAHFYMFVSTVLHALCFSGFTFFAHFYMFVSIWLFDFSGRRRSSKIWLFDFSGRRRSSKLGELSFQYKVLCCVGSVLSLLFVLYFYYRHNRFCEPGVYTLFALSEYSLILFNILFHSTLYYDFHSRALTLNTAALSSVAGYDLLPLYSEKRT

SEQ ID NO: 149026 - protein, 133 aa, Heterodera glycines
  Coding regions on vcDNA: vcDNA=SeqID_75449; Strand=+; Position=1-399
MDLTRPTDQLANDRSNSSEAPQQQPFVVNVVASRPRSKTDPKNYDPKPLIVPPGAAADQRGPRRLSPVPCLCMARNSSPTGASPSQLVYQPRTVPSPSASLSPTDQKGWGTLKNSSDPSTINVPIKTSVCTAT

SEQ ID NO: 149027 - protein, 109 aa, Heterodera glycines
  Coding regions on vcDNA: vcDNA=SeqID_75450; Strand=-; Position=1-581
FIFRWFSHNSSLFLPKFPRFSSFSSFCCFTSIIIPRKLLGRWRRNARPMGEKKLGEDTAERAGRKRRRGRGSICVSFQRHRQISESALWHSLLNHYPFSHIAFLPPSTD

SEQ ID NO: 149028 - protein, 170 aa, Heterodera glycines
  Coding regions on vcDNA: vcDNA=SeqID_75451; Strand=-; Position=1 -317,516-588,784-906
  Homolog annotation: Hit_ID=NP_500033.1; Match level="QueryCoverage =60%, HitCoverage=15%, E-value=9e-15, Identity=38%"; Hit description =finger protein zinc 2 (4B812) [Caenorhabditis elegans] gb|AAF60789.1| Hypothetical protein Y55F3AM.14 [Ca
MAPLPLPHRPFSQPPRSPRATAQMATESQQQNREEEQQQQRQERHNTVPNSVSQQQQQTIRKLSASATSTIASANDFVCKFCGKRYAYASSLYVHTRLHTGERPFRYKCDGCGKGYAQKVGLNIHQEQCQNWLSRRSSVSTSAEKGEDDGMANEGQQTVPTRRASLQEAF

SEQ ID NO: 149029 - protein, 280 aa, Heterodera glycines
  misc_feature (86)..(86): Xaa can be any naturally occurring amino acid
  Coding regions on vcDNA: vcDNA=SeqID_75452; Strand=-; Position=1 -355,461-554,668-977,1231-1321
  Homolog annotation: Hit_ID=NP_500033.1; Match level="QueryCoverage =92%, HitCoverage=62%, E-value=1e-103, Identity=50%"; Hit description= finger protein zinc 2 (4B812) [Caenorhabditis elegans] gb|AAF60789.1| Hypothetical protein Y55F3AM.14 [C
SCSALFSASSTNSCQNVSAQRDEDEFEGEEEMFEECYEEEEDDELVDVEGHDEETEMRGEMSVGGSDGGRANGHDDAGGDGAAKGXSAVEKRHKCDVCGKAFPYLSILESHKRCHTGEKPFLCHFCDKRFAQKATLQVHERTHTGERPYKCKFCDKTFAQYGTKTVHEKSAHLGIRNYKCPHCDKDLSSPSALYTHKKTHGEKMFKCQHCPKTFTLKNYLKLHVKQVHEQNERKHSCRFCGKSFAYAGSLQVHLRTHTGERPYQCKFCPKAFASQGNQSH

SEQ ID NO: 149030 - protein, 136 aa, Heterodera glycines
  Coding regions on vcDNA: vcDNA=SeqID_75453; Strand=+; Position=1 -134,757-889,1772-1898,2100-2116
  Homolog annotation: Hit_ID=CAE64974.1; Match level="QueryCoverage =86%, HitCoverage=86%, E-value=4e-31, Identity=55%"; Hit description =Hypothetical protein CBG09808 [Caenorhabditis briggsae]
MLTGMVKEHMARQHLRREQQEKLKNEAIVAAHELTEALVDHLNHRVSHAYNLQKRLDVECKKLETQSAALARHADAWVALVGDMNQALKEVGDVDNWARAIEADVTQCAATLERVYRTRGGAGHGPAVGAGVSSNQ

SEQ ID NO: 149031 - protein, 497 aa, Heterodera glycines
  misc_feature (496)..(496): Xaa can be any naturally occurring amino acid
  Coding regions on vcDNA: vcDNA=SeqID_75454; Strand=+; Position=1 -106,1546-1749,1801-1862,1915-1947,1998-2169,2216-2355,2422-2541,2605- 2725,2782-2903,2961-3015
  Homolog annotation: Hit_ID=CAE70363.1; Match level="QueryCoverage =92%, HitCoverage=23%, E-value=8e-72, Identity=36%"; Hit description =Hypothetical protein CBG16921 [Caenorhabditis briggsae]
LFLSSVRRILPNSVQILTLQQKLDAVDREECENKTQMVPDVGSVIAHALAQPSESRHPPGREKEKGSFGSLGAFSATANNGSKFADFVEIVYAEENWQYTVKVYFPEQFERFRSLTFCDGEESVKVYFPEQFERFRSLTFCDGEESFINSISTSSPWFINSISTSSPWYPQGGKSGAVFSRTDYPQGGKSGAVFSRTDDERFVLKTLNRFELDAFKQSALKYIDYISMALMEGKLTALCKIFGAFSVNYKQTGQSVKSDLCKIFGAFSVNYKQTGQSVKSDLIVMEFLFYRKDIKQIWDLKGSLRNRLASTKNDNNGASSLASTKNDNNGASSVLLDENYIQNMWRNQIYITTHSKTALSQAIINDSHFLADQAIINDSHFLADQGIMDYSLLAGICRGEEDEVIVGIVDYMRTFTFDKKVESAIKRTFTFDKKVESAIKAIPLTNSSTVISPEQYCRRFYEAIDGYFAVAPDQWTSESYFAVAPDQWTSESVFTXN

SEQ ID NO: 149032 - protein, 124 aa, Heterodera glycines
  Coding regions on vcDNA: vcDNA=SeqID_75455; Strand=-; Position=1-375
MAEQLLLGMEEGNSSSGIVLFSSSSPPPDEDDGIAAASPPLTNGPTVATAALAKEDEELLRKVPPPPPLATFRVTTSMRVLPCTMRRKWSNIGRSQPLHLKSELKQQLNYWLWLFQSQSVHRFT

SEQ ID NO: 149033 - protein, 41 aa, Heterodera glycines
  Coding regions on vcDNA: vcDNA=SeqID_75456; Strand=+; Position=1 -55,298-368
MMVNGVFCFCLVIVLLQLVTFANRVFFVVFSLGIFRGLREL

SEQ ID NO: 149034 - protein, 118 aa, Heterodera glycines
  Coding regions on vcDNA: vcDNA=SeqID_75457; Strand=+; Position=1 -85,231-307,402-596
MVVVLLKVQLRVMRRTTLAKKQSQLKIFETEHLNPRKRKKPDLQDTVNYVNKIKEHFCDNKNVYKQFLDILKKHKNDHKELLWQVGQLFHGHGDLIDEFIDYLSVMDGNDQIRQKTDD

SEQ ID NO: 149035 - protein, 100 aa, Heterodera glycines
  Coding regions on vcDNA: vcDNA=SeqID_75458; Strand=-; Position=1 -40,148-410
MLITLCLAILFQFVKPMPPMENEAPAEEYDGSLPSSIAISKVYCWLPADKQPKKLVNIKAAPPPPPANYDIKRVASEAAESVYSWLPKEQQPKLMDTSAY

SEQ ID NO: 149036 - protein, 20 aa, Heterodera glycines
  Coding regions on vcDNA: vcDNA=SeqID_75459; Strand=-; Position=1-63
HEDVKLDFNDDIFGQHVSGE

SEQ ID NO: 149037 - protein, 188 aa, Heterodera glycines
  Coding regions on vcDNA: vcDNA=SeqID_75460; Strand=+; Position=1 -15,202-325,371-526,581-852
MENAKPKDGKKVITKLKWLNEKVLSCGNPCGTYRVEIKYRKDKRARGAFVCCSAQIEEDETKNWIEADAPDEDILISAYINPSNFEQLTELFELTYETDGAKILPASDCPDGVNWNRERSPGVVFFCEHQDTGESVECCTKGHKCPLKANSAYGCQLIVVKTSGILNSVPKIGANRRSRKKLKIWPYF

SEQ ID NO: 149038 - protein, 140 aa, Heterodera glycines
  Coding regions on vcDNA: vcDNA=SeqID_75461; Strand=+; Position=1 -86,295-438,493-650
  Homolog annotation: Hit_ID=CAE65108.1; Match level="QueryCoverage =87%, HitCoverage=29%, E-value=3e-36, Identity=63%"; Hit description =Hypothetical protein CBG09971 [Caenorhabditis briggsae]
FKYVEQLNRHQLSYRVLFPMELRLQCKDACAHSDHIYDLVAVVVHCGSTPNRGHYITLVKSHSYWLLFDDDIVDKLDESSIEDFFGLSKLDESSIEDFFGLSDSNAQKNSESAYILFYQQRKYSLNLSHPFQFVANGHFV

SEQ ID NO: 149039 - protein, 350 aa, Heterodera glycines
  misc_feature (24)..(24): Xaa can be any naturally occurring amino acid
  misc_feature (325)..(325): Xaa can be any naturally occurring amino acid
  Coding regions on vcDNA: vcDNA=SeqID_75462; Strand=+; Position=1 -144,231-342,681-746,806-1007,1259-1372,1428-1553,1643-1747,1822-1947
  Homolog annotation: Hit_ID=CAE66445.1; Match level="QueryCoverage =90%, HitCoverage=56%, E-value=6e-78, Identity=44%"; Hit description =Hypothetical protein CBG11720 [Caenorhabditis briggsae]
LLILAYLFHCKSLFYIIFITFLFXELSLGQFISLCPLSAWKMSPLFKGIGVSMVFISCIISIYYNMITSWAFYYMINSLKFPLPCNQVLMLSSGIVDFQTVNWQLAICCLLISWLFVFLCSFKGIKTSGKVVYFIVIFPYIVLVALFIRFITLPGSVDGLFHYMRPDWAILTDLTAWGDAAIQVFYSLSTCTGGFIMLSSYNRFHNNIFSDLWIIGLVDFVTSVLISIIGLVDFVTSVLISSLVFSTIGFICHEMGIPFEQFHLQEGIQVVFVVFVFFVEALSKLPVAQIYSLLFFTMVAFVVFDTELFILFIVETIVSGTSIFXLGLALSKLAFPCQLWNLYLCFQVSS

SEQ ID NO: 149040 - protein, 279 aa, Heterodera glycines
  misc_feature (1)..(1): Xaa can be any naturally occurring amino acid
  Coding regions on vcDNA: vcDNA=SeqID_75463; Strand=+; Position=1 -45,111-181,249-348,408-442,601-672,734-901,982-1183
  Homolog annotation: Hit_ID=NP_497416.2; Match level="QueryCoverage =94%, HitCoverage=37%, E-value=3e-46, Identity=38%"; Hit description =sodium:neurotransmitter symporter family member (snf-6) [Caenorhabditis elegans]
XVSSIDQFPERLRNHRHVLTFTLFAFFLLNHRHVLTFTLFAFFLLGLPLCTAAGIYWIVLFERAGIYWIVLFERFSATWPLIIIGFFEVMTVCWVYGVDNFLDNVKWMVDNFLDNVKWMIGFYPPFYLLWKILWKFLCPILLLALLSLVWLQALLSLVWLQHNPLQYNSFLFPRWSLLLGWAISLSPVFIILFMFFYQFASISGPFSKRLRELLCRLRELLCPTDDWGALAVHRAELYPMQIPEAQKLMAPPSSCVSERNGSFIDHNGITINLLTLPFL

SEQ ID NO: 149041 - protein, 55 aa, Heterodera glycines
  Coding regions on vcDNA: vcDNA=SeqID_75464; Strand=-; Position=1-167
MSSEWAEVYKNWWTNGQNGQNEWMIHHFWHNAKANFCCWAIGADLRLTDELTEGR

SEQ ID NO: 149042 - protein, 29 aa, Heterodera glycines
  Coding regions on vcDNA: vcDNA=SeqID_75465; Strand=+; Position=1 -41,205-253
MMKIIKRNNKIGIEEETKFGIIQEEINKI

SEQ ID NO: 149043 - protein, 15 aa, Heterodera glycines
  Coding regions on vcDNA: vcDNA=SeqID_75466; Strand=-; Position=1 -36,357-368
MKINSHHFRYINQIV

SEQ ID NO: 149044 - protein, 519 aa, Heterodera glycines
  Coding regions on vcDNA: vcDNA=SeqID_75467; Strand=+; Position=1 -42,88-328,373-621,662-781,826-985,1029-1266,1306-1461,1505-1634,2192- 2415
  Homolog annotation: Hit_ID=NP_507780.1; Match level="QueryCoverage =85%, HitCoverage=31%, E-value=3e-45, Identity=29%"; Hit description =predicted CDS, DNA polymerase type B, organellar and viral family member (5T899) [Caenorhabditis elegans]
MTPYRIVAYDLECTTNTVLDEKSLKKETIHKPDFISARFTCSICLGEIKNCEICGDGPRHLKGCSKDGVDPLNCFVKWIISFEKYETYAYAHFSGRYDSHFVLRELANLGYKQPELTIADLKIYELKFKRGEKFPKIHFRDSWLLMQNKLAHLPKTFGLDCESKMYFPHQFNKEENYGIILSTLPPFEDYFPDEMSEEEYEKFKKWYYANYHNGFILEEKLDEYCSNDTDILMNALLKLRKIFIEITKDEETPNGIDVMRLSTTIASSCMNIFRAKFLKNSETLPIIPESGFEPKDSQSNIAIKYFEWIMHRDGVKGRHAANGGEISLLGDKKLKIDCIIGAQKRIIEFQGCAFHGCQNCYKGYMIQANGFTAEQNYERTQNKMERLRSVGKKMGYTVEEVWECDVRKMLNRKSEFYDEQMSKFFNNLPEIGPIIPRNGFAGGRTALEYGAVIDRFYRGYHYENFDGNLFKNYVRKFLKLKVEATGWPQDVKTEEEKIEFVKTYRETYEIELDPKKYEF

SEQ ID NO: 149045 - protein, 40 aa, Heterodera glycines
  Coding regions on vcDNA: vcDNA=SeqID_75468; Strand=+; Position=1 -68,141-197
ISLQGRYVLDEEEAIGLGKRMRKIKFIRKQNKMDQTESNT

SEQ ID NO: 149046 - protein, 115 aa, Heterodera glycines
  Coding regions on vcDNA: vcDNA=SeqID_75469; Strand=+; Position=1 -49,91-268,312-380,424-475
MSKEYEDSEILEVVCAGPKQYALKLQKENGEIWYKTKIRGMTQNKNNKIDYEEFKDMVLNYEEEKKIQFKHPNKFGPTRESYVISRNITKDYRPIQKKGIILNDENLSVLPFGCW

SEQ ID NO: 149047 - protein, 80 aa, Heterodera glycines
  Coding regions on vcDNA: vcDNA=SeqID_75470; Strand=+; Position=1 -210,353-385
MDNQNKPRGRPPKKVEKKETPQNLEKKEIHQKAKIKILRPKIQLKGRKIELDTENGTNSVPTKIKLPPIYIFVVVIVRDQ

SEQ ID NO: 149048 - protein, 64 aa, Heterodera glycines
  Coding regions on vcDNA: vcDNA=SeqID_75471; Strand=-; Position=1-192
VNIDHRPQTQKCLKTVRIDVKRFEMGWKNRIRGALALFQDEKCRKWSAKLSWDSSDRTIKSTQK

SEQ ID NO: 149049 - protein, 81 aa, Heterodera glycines
  Coding regions on vcDNA: vcDNA=SeqID_75472; Strand=+; Position=1 -99,425-571
  Homolog annotation: Hit_ID=NP_501507.1; Match level="QueryCoverage =62%, HitCoverage=10%, E-value=4e-15, Identity=80%"; Hit description =signal recognition particle 54kDa (55.0 kD) (4J508) [Caenorhabditis elegans] emb|CAA92301.1| Hypothetical
MVLADLGRRIRNAIGKLGQATVINEDELNAMLKEVCSALIESDVNVRFVFQNLNCIILLCPCKIMIRTFLPLPKKGKKFDR

SEQ ID NO: 149050 - protein, 194 aa, Heterodera glycines
  Coding regions on vcDNA: vcDNA=SeqID_75473; Strand=+; Position=1 -81,427-576,632-770,1105-1319
  Homolog annotation: Hit_ID=NP_060267.2; Match level="QueryCoverage =67%, HitCoverage=24%, E-value=4e-21, Identity=37%"; Hit description =BTB (POZ) domain containing 2 [Homo sapiens] gb|AAK25826.1| BTBD2 protein [Homo sapiens] sp|Q9BX70|BTB2_H
MPCANFPISKLHNVFLAFNQARHFEEKEFALRCLDHIDQNAYSLLKSDAFLKIGTNYLCEILARDQLQAEEITIWNAALRWADEQCRQMGKECSAENRRAMLGPALFQIRFPLIQLEEFPRNIAVSGVLTSDELLGVLLHLALPSVACSQPPLYPLSFPAKQRNYNGKFSSLKKPSSDRRQAKKFGPEKGLLSR

SEQ ID NO: 149051 - protein, 251 aa, Heterodera glycines
  Coding regions on vcDNA: vcDNA=SeqID_75474; Strand=+; Position=1 -159,288-338,395-468,515-819,1899-2046,2102-2119
  Homolog annotation: Hit_ID=NP_502974.1; Match level="QueryCoverage =34%, HitCoverage=12%, E-value=1e-11, Identity=43%"; Hit description =signal transducer activator of transcription (80.2 kD) (4R613) [Caenorhabditis elegans]
MPNQPVPFPFSKGRFVNDVAELHRVQLAISQLEAEQRHDHLKHLQQQMSLGGSRRAGHLYEQLTECRANLVHRLNDGVKLIAIMQTHLISERLLDSANKFWTKFKASESQEQTKNSLVKNANVFALSKVRSAGGEQLDFARVRMLAIGLVEKVATAERYGCPRLQNPLIIMPIPFADCANAHFQSELHFGNTHQIAAGQLGQVRRVDAVLAHNGQNQQMEIVHFLHFWSPFTGPRTAMLRRSSFGSGRFLP

SEQ ID NO: 149052 - protein, 88 aa, Heterodera glycines
  Coding regions on vcDNA: vcDNA=SeqID_75475; Strand=-; Position=1-264
MAAFLNGNAHSSIECNGVVHDKNGIDQNGTKLADRLQHSVQIGTKKAPVSKGSINVNKYVLEVISDTDQLHTLEQYAIDYAHSIGQCA

SEQ ID NO: 149053 - protein, 140 aa, Heterodera glycines
  Coding regions on vcDNA: vcDNA=SeqID_75476; Strand=-; Position=1 -92,668-998
  Homolog annotation: Hit_ID=NP_508623.1; Match level="QueryCoverage =95%, HitCoverage=36%, E-value=4e-14, Identity=37%"; Hit description =putative protein family member (42.2 kD) (XE247) [Caenorhabditis elegans] gb|AAK39173.2| Hypothetical pro
MTEYEKMLDHSLSNLSFVLTAEDSHFFPQNWLCPFQRINFTLIKYKSLAKTEDEQNFTDQFVAFLANIPSLSHETIEFVRAQAGLKLGHHTSGSAAYKFVKKRIYESPFLMEFLVRMFYWDFKVLGFPLPNLFEMRYGND

SEQ ID NO: 149054 - protein, 119 aa, Heterodera glycines
  Coding regions on vcDNA: vcDNA=SeqID_75477; Strand=-; Position=1 -129,186-305,988-1098
  Homolog annotation: Hit_ID=CAE62859.1; Match level="QueryCoverage =87%, HitCoverage=26%, E-value=7e-14, Identity=35%"; Hit description =Hypothetical protein CBG07042 [Caenorhabditis briggsae]
MTGAAAMTGIVICLSLLHLIFVSTLISDEKIRSELYWVVLMPPVIVVCGFTGMVLPRAALFLYAIALVYYMICIFVLVCFMNTFFAALPYRRLLPTLLVRAKVRRRHLRHSRHGAEHIA

SEQ ID NO: 149055 - protein, 244 aa, Heterodera glycines
  Coding regions on vcDNA: vcDNA=SeqID_75478; Strand=-; Position=1 -177,223-464,1372-1584,1639-1741
  Homolog annotation: Hit_ID=CAE59588.1; Match level="QueryCoverage =84%, HitCoverage=21%, E-value=3e-36, Identity=63%"; Hit description =Hypothetical protein CBG02994 [Caenorhabditis briggsae]
MSNANLYGLNGQLVQHHATTGGTERMSAHLATLMAPIPLAEFATHIDRQKLNSNQGFIQEFESIDTGQHFTWENSATEVNKHKNRCTILSVNINHQKCRLSISYANVVAYDHSRVVLPPEDDAEEELPGTDYINANYIDGAGIGRTGAFIVIDCMLERLRYENTVDIYGCVRSIRAQRSYMVQTDDQYIFIHDAVLDAAQSGSTEIPSSKLHQHVQTLSRPQHMQEYSGIDIEFNVSAEMQKPN

SEQ ID NO: 149056 - protein, 175 aa, Heterodera glycines
  Coding regions on vcDNA: vcDNA=SeqID_75479; Strand=-; Position=1 -136,347-569,2223-2391
MVGLFGNNLNGRSNGSNSQQKSVLTAVIESLLKMEMDNAKEKNQNSAIGPPRNIRVQTISNSSVVVQWDFDDSDSDVGGAPDGFMVKYMQEPSAVREHQMDKWRTQPVMDPKARHLEVHRVPSSDYRPAGDTRGRRHVPVDGVYIAAQIPSNEMQRLYRDELTFTLGDGLVNSRN

SEQ ID NO: 149057 - protein, 180 aa, Heterodera glycines
  Coding regions on vcDNA: vcDNA=SeqID_75480; Strand=-; Position=1-543
MYYMRSTWQCDKIADGFKEYKRTECQKYRKYLDILYEYLLREYVGIPTVKPKFVFKERIEIEGPIIHAVHCLVKISQFYFKPNYSKHIEYKLKKLFIYYFEQKLLNEKSLNYEIKLENEPKVSINEMIFQLAIEAANNYKTNESAEGIIQQKLEQNLEEKFKKAEERAKKDYPREANEIK

SEQ ID NO: 149058 - protein, 24 aa, Heterodera glycines
  Coding regions on vcDNA: vcDNA=SeqID_75481; Strand=+; Position=1-72
MCRARQNPIPIKSPIPIMAKNPIR

SEQ ID NO: 149059 - protein, 228 aa, Heterodera glycines
  Coding regions on vcDNA: vcDNA=SeqID_75482; Strand=+; Position=1-685
  Homolog annotation: Hit_ID=AAG00552.1; Match level="QueryCoverage =84%, HitCoverage=60%, E-value=7e-13, Identity=24%"; Hit description =retinitis pigmentosa GTPase regulator [Mus musculus]
MVAFTIIPHLLLFTVFMSIILVILSQCCGCTPSKKKQTATSTKKKTTTTTSEAMKGKKEEKPAKTSETDKAAQKKPTVTSTKASEEEAEEDHDDYIRSDERKEGREAGQNIRDGQGSAEEDHDDYIRSDERKEGREAGQNIRDGQGSAEEANCDVNKGVGGRGAEEDHDDYIRSDERKEGREAGQNIRDGQGSAEEDHDDYIRSDERKEGREAGQNIRDGQGSAEEAN

SEQ ID NO: 149060 - protein, 21 aa, Heterodera glycines
  Coding regions on vcDNA: vcDNA=SeqID_75483; Strand=+; Position=1-64
GPGSRSRVLKSSGPGPGPGRA

SEQ ID NO: 149061 - protein, 330 aa, Heterodera glycines
  Coding regions on vcDNA: vcDNA=SeqID_75484; Strand=+; Position=1-993
MDINLENAPIPATSHIVSEKIDFSTVPINFATSRNFACKIWRWAAIGLYERDGETALGPRSGPRFIETCWNRPNEWLNDSFIVAYLAYIASISQRKTVVVDSLASRTDVSRFSNVKNYTFGYDPNAVPEVVLMPLHFPNHWTLIVYDVAHGAYFLDSLHMSSLSDERMALIQSIIAEIVPGNASFAVEYVQQLTKQNDGNSCGYFVCLYAESWLMNNRTFVLPDLNINYEKKRILWHINELYGSDIVPFHPREGVSTSFAVVSHHNGDVAQTSSKVIMPMEVDDSPVLPSSEDTAVLAQAPVIGENQADTPTVLLRTQLSSKNQSRRLMM

SEQ ID NO: 149062 - protein, 405 aa, Heterodera glycines
  Coding regions on vcDNA: vcDNA=SeqID_75485; Strand=-; Position=1-1218
MKHTTRMLLVPEELYRSLLARSSAPVADASSARGGLPQHTTPIEHTAKRMARAARSNVTRSTDGVSPSSGQQPKHLLNDDERLIHYQQEFKRFKKFLEDEQERPAPVRLTQLPTDEASKGLLREALSEVARTIQQQPQPKQPALHQQQQQSSQSDSSTMRQPPRRRQRPAKRTHRTTSASTDGAEASRFPSSSSAVSLLTRTDNGGKGGAETTEREDSSNDDRPQNVAAVDPARKGQREEADVQLHPSTSTAPAAAAVLRDTEQRKRQAIDYALRNAGTLGIGDGQQVYRLMQGAYRPIKNSDLDALLTFHFAEPKPEKAPPGYKTFIGNARQDPRMVRILFGNSGAESGKKKKMGGGGCCSTAATLLHAFKKNGKPTAAVAADYAKRSNSTTNNKTFLFKPMLW

SEQ ID NO: 149063 - protein, 450 aa, Heterodera glycines
  Coding regions on vcDNA: vcDNA=SeqID_75486; Strand=+; Position=1 -474,1008-1886
MTKLSSDSNDEHGGGGGGDDGHALPTEDDGVGGAHLPPLLFIDEEEEEESAESRTGDDVGRDGDGQIYTEKVTQEGEEESDDGNADMDSVSNDTYRSSSNSSSSTMSSSLFLLHDCHMRHHYHHDNNNCNSPPRKQAATELLKLPLIDYLCGLNNGCSQACFKMTYLVQNSTSTFSLFKSCGAQAASSPRQQQQLRFTRDQFLALARNGACTEYAPRRFHAIVMRLRTGSTSTISTGAVTITTTTTATTTPTGTTTALIFQSGRVVLTGIGGGGGVAVQQIHALCRHEAHRVCRRVADALRRGGFPTLGRSLRVNGVQLRNLVSTLHMPYRLNIEVMAQHLLRRMTIHGKQRPNDKDNNNSNHNNLAGQIVRVARACLDLCTFPGLRCALRIGGQQKGGTEEGSMGEAEFVVTALFFISGTVIVTGVRDPLLLKRAVDTIQHLCAQYIRA

SEQ ID NO: 149064 - protein, 35 aa, Heterodera glycines
  Coding regions on vcDNA: vcDNA=SeqID_75487; Strand=-; Position=1 -22,433-518
MAIILHETSINLRLQCRNFHDDWHGGGPTVVRAGA

SEQ ID NO: 149065 - protein, 81 aa, Heterodera glycines
  Coding regions on vcDNA: vcDNA=SeqID_75488; Strand=+; Position=1 -11,462-696
MCERLRFERSCGIQCANLEPFGLPLHRELLWSDFRGRLSAAQRTKSHPFGIAAQIAMLMITLIIIPAQLIDRRHFCFRWWC

SEQ ID NO: 149066 - protein, 100 aa, Heterodera glycines
  Coding regions on vcDNA: vcDNA=SeqID_75489; Strand=+; Position=1 -71,241-472
MFLSLCLLSSLSLSLVFSLFIAPLARPGPGSRPGFFLDPVPGPGHFSVTWIFPIPGFFCAFRYPTITAHSPRIAFPAVWEHPELKSTKEFKIISVYTLKA

SEQ ID NO: 149067 - protein, 137 aa, Heterodera glycines
  Coding regions on vcDNA: vcDNA=SeqID_75490; Strand=+; Position=1 -213,842-934,1047-1154
MCDSFKEIDAREEQTTYGFGDTIYRPLIPRLGNHRVLTSFVGEISGAGQYFRYDDDSGRFCVVSINTHEANPWDIAVLKFYAETMGNIWDPLFTYLDEVITSLENGDMPAYIIESSPSNSANSLEDLPSVEAPQSDD

SEQ ID NO: 149068 - protein, 104 aa, Heterodera glycines
  Coding regions on vcDNA: vcDNA=SeqID_75491; Strand=-; Position=1 -128,176-248,299-366
  Homolog annotation: Hit_ID=NP_056573.1; Match level="QueryCoverage =91%, HitCoverage=29%, E-value=1e-28, Identity=66%"; Hit description =forkhead box E3 [Mus musculus] gb|AAF15997.1| forkhead transcription factor FOXE3 [Mus musculus] sp|Q9QY1
YFPNYLIKSRLSPLGWQNSIRHNLSLNDCFRKLPREPGNPGKGNYWYLDPNANYWYLDPNAESMFDNGSFLRRRKRFKRKPFKRKPTPPPQLMPAGVFPPPPAP

SEQ ID NO: 149069 - protein, 129 aa, Heterodera glycines
  Coding regions on vcDNA: vcDNA=SeqID_75492; Strand=+; Position=1 -48,92-433
MSGVQDEHDLSTPSPPGHETVNELPPPPPPPLSLHQLMAPQDNDTPHPSPTSHLGMTAMPMAPVVVGDAQAPSNENEISQMDVTQCLGASPSTFVRPSVSGVQPQVQPTGVIKRLCLIKNLNTNFCLVV

SEQ ID NO: 149070 - protein, 48 aa, Heterodera glycines
  Coding regions on vcDNA: vcDNA=SeqID_75493; Strand=-; Position=1-144
SLKICRKIIPPSPLKALSPIMSPFLKRLKNNPPGALIRENTVIEIGFS

SEQ ID NO: 149071 - protein, 40 aa, Heterodera glycines
  Coding regions on vcDNA: vcDNA=SeqID_75494; Strand=-; Position=1 -78,163-207
MIESQWNSDTLVQRLKSVQNCRRALQTIYSGESMLYIMNL

SEQ ID NO: 149072 - protein, 24 aa, Heterodera glycines
  Coding regions on vcDNA: vcDNA=SeqID_75495; Strand=-; Position=1 -33,80-121
MANLDNFDNDAFYWPSKMPIPAGL

SEQ ID NO: 149073 - protein, 90 aa, Heterodera glycines
  Coding regions on vcDNA: vcDNA=SeqID_75496; Strand=+; Position=1 -3,435-564,920-1059
MGCARVSVLDSRLGKFPGFFASRSRVFSLGNREIFTLLRMTIVGSFRMIQDCWIWSTTLKSYIDSILFGCSWSVPVYQYRWTPKTYTFFV

SEQ ID NO: 149074 - protein, 210 aa, Heterodera glycines
  Coding regions on vcDNA: vcDNA=SeqID_75497; Strand=-; Position=1 -50,96-246,299-395,609-825,882-999
MFFTGIDRLIGIAFSEFHDNLQKRLYLALLTILSGGLWFLLLWFRCTKMQLGDGDQMTTGSYFDFLKSAPIFDKLSFLITSITCIIYLLLGIAVRIKASGFPSADSFNRRTFRAIFCIITVNISGYFFALICYILLIPKISSPITAWFLHAITSIPLNIGAASNGPILYFTSTEYRQAFQTVFPYVFKRISNPNQVIPLQNVPPLGATQW

SEQ ID NO: 149075 - protein, 308 aa, Heterodera glycines
  Coding regions on vcDNA: vcDNA=SeqID_75498; Strand=-; Position=1 -160,742-803,1802-2206,2773-2889,3380-3562
  Homolog annotation: Hit_ID=I51116; Match level="QueryCoverage=80%, HitCoverage=43%, E-value=1e-21, Identity=32%"; Hit description=NF -180 - sea lamprey gb|AAA80106.1| NF-180
MALTNGVAEGEVELEVQKMDDGTGEGAEEEEATLVKKGIKLDEGEAEAEGGGEEAAANESVEKEAAAEDKTEDLQQQKEGEENEAPEKEEDSAAAEIPVDVYDEEAAEAPPAEEAEKAEEAETEQPEAEAAEAQDEEGAVEVPVENVGGGEAAEEEAPPAEEAAEAEPPAVDEEALPAESETEAPEETPAETEGDEPKTEDEQQKFELQHFRRRSVVSQKRQKWKKYQNKIAEKPSDATDAKVTEIAKMEAHDQLGQGRGWDGRGTESVSGGGRNCGRSAGGEIGGRAGREGGGRGEAGRGGGAQIGG

SEQ ID NO: 149076 - protein, 431 aa, Heterodera glycines
  misc_feature (130)..(130): Xaa can be any naturally occurring amino acid
  misc_feature (346)..(346): Xaa can be any naturally occurring amino acid
  Coding regions on vcDNA: vcDNA=SeqID_75499; Strand=+; Position=1 -243,553-734,1111-1236,1433-1855,2844-2962,3438-3648
  Homolog annotation: Hit_ID=AAK31375.1; Match level="QueryCoverage =99%, HitCoverage=39%, E-value=5e-56, Identity=39%"; Hit description =ppg3 [Leishmania major]
SPAASAPSGCSSVRSSGTAPASAATGASSTSDLGSSSPAGFSSSSAFSAGSASDFSSGTSSTVSAATADTFRSASVPSSPFSSSPPFTDHLDSSSSLSRIRASKLSCRCFSSSSFAASPSSSTSTAFLKXFISFSTSFPITVSAICPSHRHSAPSAARNTRPSGTSSACSTSTSTCCTSSNSASTCSSNFCCSSSVFGSSPSVSAGVSSGASVSDSAGSASSSTAGGSASAASSAGGASSSAASPPPTFSTGTSTAPSSSCASAASASGCSVSASSAFSASSAGGASAASSSYTSTGISAAALSSSFSGASFSSPPSVAAERAKSSVLSSAAASFSTLSFAAASEXINHCNSAPSSSLLSLILPFDHPPPPPLSSSPSTFSPSASASPSSSLMPFFTSVASSSSAPSPVPSSIFCTSNSTSPSATPLVSAI

SEQ ID NO: 149077 - protein, 126 aa, Heterodera glycines
  Coding regions on vcDNA: vcDNA=SeqID_75500; Strand=-; Position=1 -97,381-542,631-752
MIKSFPLSVLFLVFGFNRLLLVTSGPCLSCVRMNEDWHDYCNAMAKCCDSLRIKPCGLDDSDVTDDSDSELSPTSCLPIYVFNAPPVDQYWSGICENQPTDKCDSYEVNLCFLDAKKRCLPRMPWP

SEQ ID NO: 149078 - protein, 75 aa, Heterodera glycines
  Coding regions on vcDNA: vcDNA=SeqID_75501; Strand=+; Position=1 -17,738-881,1383-1449
  Homolog annotation: Hit_ID=CAE57967.1; Match level="QueryCoverage =70%, HitCoverage=10%, E-value=2e-10, Identity=49%"; Hit description =Hypothetical protein CBG01028 [Caenorhabditis briggsae]
MPIAEAGETRLCSQTTKLGEFLVEKGTGVAVDVYSFHRNKELWGEDADEFRPERNSQLQLLHYMIRQTKDDFSIL

SEQ ID NO: 149079 - protein, 56 aa, Heterodera glycines
  Coding regions on vcDNA: vcDNA=SeqID_75502; Strand=+; Position=1 -87,167-250
MRFALLEEKMALVRLLRRYSLVKTEQTEVKLLNFNSQVVLNHGAVMVKLSQREENF

SEQ ID NO: 149080 - protein, 83 aa, Heterodera glycines
  Coding regions on vcDNA: vcDNA=SeqID_75503; Strand=-; Position=1 -72,151-330
MFKILSFFLLFIAPFIAAYAPNCICPENEQPGQLSCNRCEPSCYNPRPRICTLMFCTCSCDCVAGLLRDEKTKNCVSKEKCTH

SEQ ID NO: 149081 - protein, 48 aa, Heterodera glycines
  Coding regions on vcDNA: vcDNA=SeqID_75504; Strand=+; Position=1 -24,1946-2068
MYKKWSKYIIKNQPITGGVKKSRYRVSKASKTETENPRPRPKKDVNQN

SEQ ID NO: 149082 - protein, 47 aa, Heterodera glycines
  Coding regions on vcDNA: vcDNA=SeqID_75505; Strand=+; Position=1-143
KKFGTSYLGTQTHFAENKNTFLKNPWVLYPPTKFHSEIPRTPGDLPL

SEQ ID NO: 149083 - protein, 134 aa, Heterodera glycines
  Coding regions on vcDNA: vcDNA=SeqID_75506; Strand=+; Position=1 -189,809-964,1276-1332
MEMPPILTQLMLILFVCSTFIEKTKCGKKEAAATPMEKVSQKSDETAKASKPVENKNEELKKEIENMKKQMDQKLKKILQENIPAFALQLNEIAAQIDNEEKPLEKEFIQKLIDKDAVEDQISANYNCFNRELE

SEQ ID NO: 149084 - protein, 176 aa, Heterodera glycines
  Coding regions on vcDNA: vcDNA=SeqID_75507; Strand=-; Position=1 -415,453-557,1367-1377
MDLFDIFEHINTNEDVQFLRSSGNAGALAPQPLVPNTVYSLSDLCSAFSSAASLSAPPMGMASNSDAFGLRSTILPAAPLSAPPVGISTNSDDFGLRSTIVPAAPLSAPPMGISSNIDNTGATRERNHQYFFGHDFTTESFSSNSGTTRIRKPQPLNFSLKVFLGGIPANMTTSGI

SEQ ID NO: 149085 - protein, 72 aa, Heterodera glycines
  Coding regions on vcDNA: vcDNA=SeqID_75508; Strand=+; Position=1-219
MNPRLDGMCISASRSDASDFLPSYFFKHIFVKCDDSKFVVYKKAWNVSIVKRQLGFCPHFLVTFVSPSSFGC

SEQ ID NO: 149086 - protein, 191 aa, Heterodera glycines
  Coding regions on vcDNA: vcDNA=SeqID_75509; Strand=-; Position=1 -97,175-260,306-461,505-564,608-712,757-859
MSSPSLPAHWPARTAKDIEIILLHEAAQATVCHALGWAVTGMRFTAQGGVVDWHRTTTLNKIETLEDLMKRICIHMSGKIAEEQLLKSNNTGSETDINRISEEMEKIVENGMLPGLPKWNITSGYHGPKLLAEYEKAKRALLQECKKRTERIVIEQKDVIEDLAKKFGASTELNEEQVQNFFAANSPRHSP

SEQ ID NO: 149087 - protein, 298 aa, Heterodera glycines
  Coding regions on vcDNA: vcDNA=SeqID_75510; Strand=+; Position=1 -816,1296-1374
  Homolog annotation: Hit_ID=NP_500013.1; Match level="QueryCoverage =55%, HitCoverage=11%, E-value=2e-45, Identity=51%"; Hit description =predicted CDS, polyprotein family member (4B673) [Caenorhabditis elegans] gb|AAC02594.1| Hypothetical pro
MEPKWIWKGTHLAFANELLCDRNGLLKENSTKEILTLNSERKKMEIDPTFVVDFSKAMVKDKDLEKLKALIEEFSDVFSKFRYDLGLFTAAEHHITTTTEEPITSAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDKVYQMITMPFGLKNATAAFSRAMAIVLSGLEDTSLAYVDDVLIFTKSPNFSEHLTALGHQHRIRTQKTERIERKNGKWRFCV

SEQ ID NO: 149088 - protein, 30 aa, Heterodera glycines
  Coding regions on vcDNA: vcDNA=SeqID_75511; Strand=-; Position=1-91
NFEKFYGNLIQFLGVQKSLFAPKSEMRNAK

SEQ ID NO: 149089 - protein, 69 aa, Heterodera glycines
  Coding regions on vcDNA: vcDNA=SeqID_75512; Strand=-; Position=1 -54,285-422,673-690
MRNFMGISRTGLSKKSWKPPCVLGEFGEQIQSELRDAESVLECPELMLDKIEEHMEDDIQLGDDAKRIS

SEQ ID NO: 149090 - protein, 55 aa, Heterodera glycines
  Coding regions on vcDNA: vcDNA=SeqID_75513; Strand=-; Position=1 -92,141-252
  Homolog annotation: Hit_ID=AAP30754.1; Match level="QueryCoverage =92%, HitCoverage=27%, E-value=3e-18, Identity=82%"; Hit description =putative gland protein G11A06 [Heterodera glycines]
QSDQQISEIDSKCAEFGIGIAKVPFDAPKGDHSQRNVPGTDSVISMPGLPGSHKQ

SEQ ID NO: 149091 - protein, 102 aa, Heterodera glycines
  Coding regions on vcDNA: vcDNA=SeqID_75514; Strand=+; Position=1 -157,832-983
  Homolog annotation: Hit_ID=AAP30754.1; Match level="QueryCoverage =50%, HitCoverage=27%, E-value=8e-18, Identity=82%"; Hit description =putative gland protein G11A06 [Heterodera glycines]
MFVIAASASSHASNNSEWQALSAQFGQQISEIDSKCAEFGIGIAKVPFDGPKAKKRRPSLSECSLRSDNPRGNSTQNGSVCAAYNERRSGEMAKQSKERRRK

SEQ ID NO: 149092 - protein, 20 aa, Heterodera glycines
  Coding regions on vcDNA: vcDNA=SeqID_75515; Strand=-; Position=1 -29,429-462
MVILLVANEIKTTISFNFLT

SEQ ID NO: 149093 - protein, 80 aa, Heterodera glycines
  Coding regions on vcDNA: vcDNA=SeqID_75516; Strand=+; Position=1 -41,710-911
MVPNSKFGTAHKDGICNWMMGVIRWPLNTHQSAKKQIFSFVDINIFFHFVFISKNNLVKDKFIYKFIFEFRITSPSSKRY

SEQ ID NO: 149094 - protein, 106 aa, Heterodera glycines
  Coding regions on vcDNA: vcDNA=SeqID_75517; Strand=-; Position=1 -70,322-514,1168-1225
MSRKSEQIDGENHSEISKRRICKDIELAIRKRNPSLLCQFDRANSFRKIPEEILMEKLESEKRELEKALETEREALGDEKHKRQMGTKGAKEGGTREQKGRKLDNN

SEQ ID NO: 149095 - protein, 30 aa, Heterodera glycines
  Coding regions on vcDNA: vcDNA=SeqID_75518; Strand=-; Position=1 -74,128-146
MWGNCTANAIGGGGGGKRGGGGVNGQIFIH

SEQ ID NO: 149096 - protein, 254 aa, Heterodera glycines
  Coding regions on vcDNA: vcDNA=SeqID_75519; Strand=+; Position=1 -301,661-930,1230-1423
MSLAPSAATSSTVGTSLTPPAAAAQMLFSPFQLMQQISAASSVTAQHIASSMSSSSPPTAATSSTKTEQQTTNTMTMETCDNNYSSLMSNNGMQNHQPIHAAENPLHTLPLSALLQHCEQQKHLTDAINKLQQQQKQQTQNQQNGRTITAQCQSSPNPNSAFSAPNGQQKCCNETALQHDEEEQDEHHNDDENDDSTLTSASVNGSFSTESASCAVAAAASLCSNANTTQSLAEAAGRASAPPLDDEHVKRPMK

SEQ ID NO: 149097 - protein, 196 aa, Heterodera glycines
  Coding regions on vcDNA: vcDNA=SeqID_75520; Strand=-; Position=1 -127,182-247,305-402,505-576,801-901,1288-1320,1363-1454
  Homolog annotation: Hit_ID=NP_508428.2; Match level="QueryCoverage =44%, HitCoverage=17%, E-value=7e-26, Identity=61%"; Hit description =glycine receptor family member (57.0 kD) (XC983) [Caenorhabditis elegans] gb|AAA81448.2| Hypothetical pro
MLEFSLWLLSFNALAAQTAEMTTKTAKTTTTKRETTLVPLTKEFISLLDDERRYNKYATPTQHLGTATNVSMSMFIEGISSFSAQTMDYQLDVYFYQEWKDERLKHNGSGPLLIRDKAVFKDLVRLPHFAGCHLHDGSVEVPIGFPNMRTPYSELNLELSDGSVLRGTGNASPYHPDLCAYFADCHHIMVRKQSSL

SEQ ID NO: 149098 - protein, 469 aa, Heterodera glycines
  misc_feature (11)..(11): Xaa can be any naturally occurring amino acid
  misc_feature (465)..(465): Xaa can be any naturally occurring amino acid
  Coding regions on vcDNA: vcDNA=SeqID_75521; Strand=+; Position=1 -214,479-579,623-670,719-777,898-982,1039-1174,1236-1392,1528 -1767,1909-2100
  Homolog annotation: Hit_ID=CAE59093.1; Match level="QueryCoverage =93%, HitCoverage=31%, E-value=8e-82, Identity=37%"; Hit description =Hypothetical protein CBG02385 [Caenorhabditis briggsae]
FLFKLFLKTYXNLSKSKLKQHKNCRYMATIKFKSAAAAFSFHGQYNDIEFNSIESEKCQLRFVDTIETVRINIGGLLADQMHSEPPICSVCLERMEENNVFTILCNHSFHAECIGQWADNHSFHAECIGQWADTTCPICRYTQTPELVPDQKCFDTTCPICRYTQTPELVPDQKCFDCGRTTDLWMCLICGNVGCGRYEAAHAHQHYEKTSHIFTLQVGSHYEKTSHIFTLQVGSKLVWDYPGDNYVHSLIESATDRKMIEYDGGGDQKDEEISGDQKDEEISAIQLEYTCLLTSQLENQRMHYEEKLRETEQRFSESGRLTQKKLCTVRTERDEARTELATTSTAKQQMEKKCQQMQQKTQNLQRELEEERQLNSLLSKDKELLGKQKEELERVRRQVGGSGETEIAGLEEQLHDLMAHFDTQAKVQRQVETGAVSKEELESSTLGLSKENGSGGKKQRRNKKXRPTE

SEQ ID NO: 149099 - protein, 120 aa, Heterodera glycines
  Coding regions on vcDNA: vcDNA=SeqID_75522; Strand=-; Position=1 -28,448-782
  Homolog annotation: Hit_ID=NP_492659.1; Match level="QueryCoverage =56%, HitCoverage=30%, E-value=2e-13, Identity=50%"; Hit description =putative protein (24.8 kD) (1K653) [Caenorhabditis elegans] emb|CAB05896.1| Hypothetical protein B0379.1
MPVPVASMTFRVPQTSRRPFQVPADATRFENFCMYWGGRARGLDYSEPFLYEPQRDNYSIMEDRRYHRLYWAQHMVELMEKALPFQMFNFLASLDSQPTVGTAWTTNYAECLLKELEGKQ

SEQ ID NO: 149100 - protein, 100 aa, Heterodera glycines
  Coding regions on vcDNA: vcDNA=SeqID_75523; Strand=-; Position=1-303
MASSKINFAERQMGSSKAANLANGKDKLAFEAIQLRDGFYEGKKSLEKERREEGAEEEEEKRRRREKRAGEKEEKKEEKKTGSSSSSAATAALSRRVPSK

SEQ ID NO: 149101 - protein, 107 aa, Heterodera glycines
  Coding regions on vcDNA: vcDNA=SeqID_75524; Strand=+; Position=1 -121,300-500
  Homolog annotation: Hit_ID=NP_501132.1; Match level="QueryCoverage =37%, HitCoverage=15%, E-value=1e-12, Identity=77%"; Hit description =putative secreted or extracellular protein family member precursor (27.9 kD) (4H945) [Caenorhabditis eleg
MYFRADSCPMQAAADMQFCAAQGRDHRECCTRNGVGSTLAAPYEPRTSESEVKRDETKEKRRTIGNGRISPGGEEEINKWPIPPPLPPITLTIFVVRFIFDHYSLAY

SEQ ID NO: 149102 - protein, 441 aa, Heterodera glycines
  Coding regions on vcDNA: vcDNA=SeqID_75525; Strand=+; Position=1 -211,798-1760,2041-2192
  Homolog annotation: Hit_ID=NP_001004509.1; Match level="QueryCoverage= 73%, HitCoverage=21%, E-value=5e-38, Identity=30%"; Hit description =si:busm1-180o5.3 [Danio rerio] emb|CAD60788.1| novel protein similar to DNA polymerases [Danio rerio]
MYEMKVRKQKKRNPNVVFRDSFNLMPCSLAALVPSYGLEVEDKPFFPHMANRPENYGREIHPTPDDYLASGCTWHGCKKCYPNDNMLLPSGKTAGEVRERDAKRLDFLRRQVNRVDVYWECEIHRMLERSREMRKSFADYVDDGPLVIRDAFMGGRTGPLKLLRKAGPGEKISYYDFTSLYPYIKYVWCSSFLNNKILNFSFVTRYPIGRPKVHVLNRQVEWRSAADNPYPLALLKVWVVPPRRVDVPVLPVKVGERLCFPLCITCAKEHPTGGVNSDYHCAHNDRQRGWVSTCTSIELNAALDEGYTVTRVFRVLEYEQSDDQLFRPYIAEFMAQKIQASGFDNNIRGNADKEEQFVRECAEQFGITIDPTKMVLNKGKRSLAKLCLNNLFISLWTTSAARLVLLKAMQKVVRSPGSELLYTGKANSAQKPKMKSDYFRH

SEQ ID NO: 149103 - protein, 115 aa, Heterodera glycines
  Coding regions on vcDNA: vcDNA=SeqID_75526; Strand=+; Position=1 -190,239-297,717-815
MKRRAATLTDATAEQHPEPKPQEETLKNVEPKDESATKKRKVEDRELWKLEKGKFLLTTYLCPDDWNRLFNNQQKVKRVEGDRDAMSVTGTGACHVPNCESGTEKGQGWGCVMGA

SEQ ID NO: 149104 - protein, 19 aa, Heterodera glycines
  Coding regions on vcDNA: vcDNA=SeqID_75527; Strand=-; Position=1-59
MWWWICPTAVRKMESRDES

SEQ ID NO: 149105 - protein, 131 aa, Heterodera glycines
  Coding regions on vcDNA: vcDNA=SeqID_75528; Strand=+; Position=1 -81,444-535,599-650,1337-1507
MKIIRQKRLDVLLMVVKNYCEMFMGQKLIYDHANSIGCAVHFETKRKTELRAKLVCIMSTEHGHKKMLHHHNVFKREWQFDVEIATDRKCRHFFRLDTETFEQYLQFESRSILHSAADLSFRSHLILLYLA

SEQ ID NO: 149106 - protein, 238 aa, Heterodera glycines
  Coding regions on vcDNA: vcDNA=SeqID_75529; Strand=-; Position=1 -45,99-253,303-451,663-886,1061-1141,1544-1606
  Homolog annotation: Hit_ID=NP_727360.1; Match level="QueryCoverage =59%, HitCoverage=29%, E-value=9e-09, Identity=31%"; Hit description =CG1343-PB, isoform B [Drosophila melanogaster] gb|AAN09612.1| CG1343- PB, isoform B [Drosophila melanogast
MSRVSLGAFLFSALIAKKVVMTSMPYHGRVNYHHQQQHHQNQPHHQMGGGGGGTGGGGGRFHQYHHGNRVSTGGSVGGGAGAGNVNNNFVRRSPSIIDRRCEECGSQEHTALFCPNTKKQRALLEIFAHEFQVAAGHPALVQQQQQPQQQHQQPLPQKPYPPYPQQPYSQQPHSHQPHPQRPRNVHHHYSGAVVYSSSHASRGGGGGGGGGASGGGGWGYFEAQSANPASFLTDFQLL

SEQ ID NO: 149107 - protein, 115 aa, Heterodera glycines
  Coding regions on vcDNA: vcDNA=SeqID_75530; Strand=+; Position=1 -46,265-566
MKQNTFENSEGVKAYDERLWRRGEVEDRVPNGAVVQIGHQRLDKHLNANFFKVPLEREQEGHFEQCQSPFRNGGDAVEVVALKNTNQIMFKPVMPRRTGRTPCFRFHGLGVGRSG

SEQ ID NO: 149108 - protein, 106 aa, Heterodera glycines
  Coding regions on vcDNA: vcDNA=SeqID_75531; Strand=+; Position=1 -130,195-314,382-454
  Homolog annotation: Hit_ID=NP_510542.2; Match level="QueryCoverage =94%, HitCoverage=20%, E-value=5e-48, Identity=88%"; Hit description =transcription factor ESE-3A (XP990) [Caenorhabditis elegans] emb|CAB01862.4| Hypothetical protein C33A11.
EKQIKRNKDGRPRKRSQHTKGNKLWEFIRDALKDPRTCPSVVRWEDPTEGVFRIAESERLAFLWGQKKNNQKMTYEKLSRAMRTYYEKQILVPVPKSGLYPKVGEP

SEQ ID NO: 149109 - protein, 313 aa, Heterodera glycines
  Coding regions on vcDNA: vcDNA=SeqID_75532; Strand=-; Position=1 -76,142-292,339-637,700-788,842-983,1789-1839
  Homolog annotation: Hit_ID=NP_510541.1; Match level="QueryCoverage =98%, HitCoverage=97%, E-value=1e-42, Identity=34%"; Hit description =putative protein, with at least 2 transmembrane domains, of bilaterial origin (31.0 kD) (XP987) [Caenorha
TLILCFRLGAGHLPILFAVCFATMLGCTYCTYVFSVWRGDVDPVFPYISASGDLRPESCIFSMLLNICSFFSMLLIILRYSLVVELNRSSDRLRAYSLVVELNRSSDRLRAVNRLAFYVGMLAGLGMFIVANVQETAVFQIHLLGALLCFGSGCVYMLLQSWCTLRMSPLYNDPQIAYIRFVIAIAASLCFVTAFSFGLMASITFHHYYPFSFGLMASITFHHYYPDLPTPRPWNRKHGLQGYNLHCVSLQGYNLHCVSAVAEWTLALLKMTFLLSFQRDFEKIRVQMLSSRWCPIDIISQIPLQKDYSGESI

SEQ ID NO: 149110 - protein, 180 aa, Heterodera glycines
  Coding regions on vcDNA: vcDNA=SeqID_75533; Strand=-; Position=1 -54,192-302,792-1169
MLATLTPFVLHLRDWNAQSMIPKPLRQRRSLGDARLGAGTGGIQALLRSQHERYWAQRKRALSTPPQQQQQNQQLFMRTDEQQIAGKAAATNSLNQQAQAQQQQQQFYAIYNQKQQNGGHKWQQITALASSIKATAATTTALATRPQLLMNGTKQHNEQQQQFDKRVKDVELIIFNWILF

SEQ ID NO: 149111 - protein, 117 aa, Heterodera glycines
  Coding regions on vcDNA: vcDNA=SeqID_75534; Strand=-; Position=1 -169,577-749,844-855
  Homolog annotation: Hit_ID=NP_505362.1; Match level="QueryCoverage =97%, HitCoverage=4%, E-value=4e-09, Identity=30%"; Hit description =titin N2 (5J601) [Caenorhabditis elegans] gb|AAA97973.1| Hypothetical protein F21C10.7 [Caenorhabditis ele
MEANNNTDHHQQRRHTDQRSWGSQSVASSPRGIVYTLSKSDRAESARSSDFEDPGLGYSSLANPPEFIRAFQTEVTINEGELAEVDCLMVGNPRPKIRWFFNDRPVKSSPGFFELKF

SEQ ID NO: 149112 - protein, 33 aa, Heterodera glycines
  Coding regions on vcDNA: vcDNA=SeqID_75535; Strand=-; Position=1 -21,157-237
MYWLDLMKQPQKQHSRQQLQQVQPVDLIRRRQT

SEQ ID NO: 149113 - protein, 53 aa, Heterodera glycines
  Coding regions on vcDNA: vcDNA=SeqID_75536; Strand=-; Position=1-162
VFDYNPIKGITIMPNFDQTPAKMNYKHKIILAMNGDLFLKFSSFILIRQNIRT

SEQ ID NO: 149114 - protein, 240 aa, Heterodera glycines
  Coding regions on vcDNA: vcDNA=SeqID_75537; Strand=+; Position=1-723
MACAVAAERATIHQELQRLTLITELIRVEELQETQVNITFRHQLNSVAEMMDMLQIWEEDTAINCRVDQNDETKPCALGFGTGKTFTAAGIMSAILREDPSARILAMAPPNIAVCKLVLEMEKALRIEGQPEPMIALFSGAGKINYAEELRRISQHLLAAAVDTEEFREHLEIPDTRKVDKYVAACARNPRLAQETTVARILKEHAERRIYFCTLSFAEQTAELFAGITHLLVDEAGQAP

SEQ ID NO: 149115 - protein, 59 aa, Heterodera glycines
  Coding regions on vcDNA: vcDNA=SeqID_75538; Strand=+; Position=1 -111,177-245
MLFDLNINSINSGRLSQMPLITALSSEIIELVNNFKEAFLHAITSASYEIQFTVYAPFQ

SEQ ID NO: 149116 - protein, 412 aa, Heterodera glycines
  Coding regions on vcDNA: vcDNA=SeqID_75539; Strand=-; Position=1 -146,200-475,526-961,1027-1316,1375-1465
MAPVKKKKKLSSANHRLISATEQQKPLGSFVTFGNRRSLRVAMKTKSRRWICNDIWMDILPLFRRRQLGLKMALLSPRFNALVDKHFDGKSELTIWRPIRIDKKGTKAKLFVEKRNGKSVRFSLPDHSLTNKSRFKHLRICHIDHSVITFLRANQQIFDKGINLDLHVPQFSYKAKNFQPIWNAFARGIWPIFAPNIRHLNFAKARHLENLLRYTSPTNLYDLNVKSIDSDDLLPAVVADAKGPNATAGQALSKWLQMPRSDGQPKQLSCSGYMYKTTELVDNFKESFLRATISSASYIIRIKLLESMPLFAPFELTNERTNEMLTLEKENSDENAKKEYGYKWHERWVMKRCQIGETIQWEDEKTDKLNNVDLSLCGTSCIGPLSPPKADKKNAKSPLKMSAGPSGQRKKK

SEQ ID NO: 149117 - protein, 46 aa, Heterodera glycines
  Coding regions on vcDNA: vcDNA=SeqID_75540; Strand=-; Position=1-138
LFAVGVAFWLLEKAAAARLGPIVNGEPPDCVPPCQPKQQKEEEEMP

SEQ ID NO: 149118 - protein, 87 aa, Heterodera glycines
  Coding regions on vcDNA: vcDNA=SeqID_75541; Strand=+; Position=1 -14,191-267,401-573
  Homolog annotation: Hit_ID=NP_495163.1; Match level="QueryCoverage =86%, HitCoverage=24%, E-value=1e-17, Identity=53%"; Hit description =galectin (35.4 kD) (lec-5) [Caenorhabditis elegans] gb|AAC71097.2| Galectin protein 5 [Caenorhabditis ele
MYPKRVVVNFHQGGSDYDDMPLHLSTRWDEGLFSGNVVFNTYSRRNWSEPEERVSSPFPADGEFDIRIRLLPGKFQVQKDLNLKIKI

SEQ ID NO: 149119 - protein, 20 aa, Heterodera glycines
  Coding regions on vcDNA: vcDNA=SeqID_75542; Strand=-; Position=1 -56,105-111
MGDTEEYKEKRQFAEQIVSL

SEQ ID NO: 149120 - protein, 144 aa, Heterodera glycines
  Coding regions on vcDNA: vcDNA=SeqID_75543; Strand=-; Position=1 -43,337-728
MENAKEKTVPKAFESGIQTINDDFDANLAGELKRAGARLFRMSDLSSDGDSFVPEGTKRGGARPFYGGGYIDGAWKRGGTRRTNRTNPLLTAGGRYFLRQFDDVPFGGGWMAKRGGGRSFFEWATFIRFAYCLGELPKMKCQQY

SEQ ID NO: 149121 - protein, 31 aa, Heterodera glycines
  Coding regions on vcDNA: vcDNA=SeqID_75544; Strand=-; Position=1 -82,271-284
MSQFAIFLLPPLFVWSALVDSWADCLHDCSK

SEQ ID NO: 149122 - protein, 126 aa, Heterodera glycines
  Coding regions on vcDNA: vcDNA=SeqID_75545; Strand=-; Position=1 -164,503-718
MSARIYTTFCGVEEADKEDGGTVGRRRRRRHQPQKEQRWTIVGGGAETVGEKCGHNATAADHLPNQVVLQCRDQMMDNSLGQTDETKSSADDNNTKNSDIAGGPSLEKVLKPLNKSPAKEDTKRSS

SEQ ID NO: 149123 - protein, 95 aa, Heterodera glycines
  Coding regions on vcDNA: vcDNA=SeqID_75546; Strand=-; Position=1 -172,253-368
KNDKNYYEKKKQEFIERIDEIYRRLRKGKQKQFAKELDIDQKTFIKWKKEFGIEIDKNGIRYSNEEKISKMNIYYKMKKGTPSPSDREIAGLLEI

SEQ ID NO: 149124 - protein, 212 aa, Heterodera glycines
  Coding regions on vcDNA: vcDNA=SeqID_75547; Strand=-; Position=1 -496,735-877
MLRTAYRGMVLFEGELALKMALLNKHYLLLAVLCGKIINYFEQQLTDDKNEDKMAKLGKYWKLFKRNLESFKANKELDSMKGLLIKLRQLLDYLRDQFGEQKLSSKWQMIVQRMEMIFFEEFYEESDEFRKHFQRNKNTAMPMLTKVFAFAEEKWGIISPHFWALEKLTNEMDEMSMTQNEQKASLLIKCPSKIIPLEMLQELDLKETDEGK

SEQ ID NO: 149125 - protein, 220 aa, Heterodera glycines
  Coding regions on vcDNA: vcDNA=SeqID_75548; Strand=-; Position=1 -154,296-406,482-624,821-985,1285-1367,1412-1418
  Homolog annotation: Hit_ID=CAE72225.1; Match level="QueryCoverage =81%, HitCoverage=30%, E-value=8e-38, Identity=43%"; Hit description =Hypothetical protein CBG19337 [Caenorhabditis briggsae]
MLTTKIRATSPKKVVTKLFPIVGWLPKYNLRSNLHSDLVTGVTIGIMVVPQAMAYTTLAGVPPAVGLYTCFFAALFYLFLGTSFHVSIGTFAVASMMVGNTLAKLHLNGADNKSNLTTNGTENTTALSGADLNPLVLTMAVFRLSFLTVYISDPLVSGFTTAAAFHVLVAQVPKLIGVASKPYGGPGMVIFVIFSIGFSVLFKIEEKHSVKIIKHVPNGQ

SEQ ID NO: 149126 - protein, 234 aa, Heterodera glycines
  Coding regions on vcDNA: vcDNA=SeqID_75549; Strand=-; Position=1 -43,90-262,474-734,1225-1449
  Homolog annotation: Hit_ID=NP_493252.2; Match level="QueryCoverage =86%, HitCoverage=7%, E-value=3e-64, Identity=63%"; Hit description =PAtterning Defective PAD-1, dopey, N-terminal (266.8 kD) (pad-1) [Caenorhabditis elegans]
ESPFVRHYSMSSFGSHNSEASTSTNFLLGTFSSHQNSSKYRAYASAVDKALKSFESTTEWADLIAALGKLGKVFASNSKSFNDIPNPLTVAKRLSQCLHPALPSGTNICHNFSVFNILSTGVHLKALETYRQVFNILGHSGHNQNLARSLFLYAIGLFPLIDHCGIKVKSELLSIFEQYLLPLGTHLRPALPGFITAVLLALEEGTEFYGRAFQLLDQLLDKVGTAAFYTCFWQ

SEQ ID NO: 149127 - protein, 161 aa, Heterodera glycines
  Coding regions on vcDNA: vcDNA=SeqID_75550; Strand=+; Position=1 -159,924-1058,1089-1122,1467-1506,1787-1854
  Homolog annotation: Hit_ID=CAE69614.1; Match level="QueryCoverage =99%, HitCoverage=18%, E-value=1e-38, Identity=52%"; Hit description =Hypothetical protein CBG15846 [Caenorhabditis briggsae]
SALALLLSLSAHGAGAEHSAFYDLLGVPTDADLRSIRRAFKRLALEKHPDKNQNDPEAHDNFVRINRAYEVLKDEELRKRYDQFGEKGLEEGNNAAGGWESWEFYNDKFGAAGGWESWEFYNDKFGIYDDDQEIVTLSREVFESGEVDSNKKHFASLPSLF

SEQ ID NO: 149128 - protein, 28 aa, Heterodera glycines
  Coding regions on vcDNA: vcDNA=SeqID_75551; Strand=-; Position=1-84
LETGNFKFADPVAQDWNSKFFTGHAGSG

SEQ ID NO: 149129 - protein, 951 aa, Heterodera glycines
  misc_feature (608)..(608): Xaa can be any naturally occurring amino acid
  misc_feature (654)..(654): Xaa can be any naturally occurring amino acid
  Coding regions on vcDNA: vcDNA=SeqID_75552; Strand=-; Position=1 -1292,1354-2757,2809-2980
  Homolog annotation: Hit_ID=XP_318550.1; Match level="QueryCoverage =99%, HitCoverage=99%, E-value=0.0, Identity=42%"; Hit description =ENSANGP00000020240 [Anopheles gambiae]
MDIYIIMQKILKILMSFKKVSVKIVEPTAFERLGEPRLEKVGKLVGSFSGHKLKLLGSFKCDVLFRGVTMRLELSVADTEAPIIMGLDWIIPFDATQQPIATTCRSLSTVCNQQMIRSNWKQIKASFPKVFQPGLGHCVKTKATLHLKQNVKPVFCRARPVPHGVQAAVDEELDRLLDSGVLKPIDFSRWAAPVLAVRKKSGNVRICIDFSTRLNDALELNRHPLPRTEDIFHALRGAKVFSQLDLRDAYLQVELDESSKQLVGMNTHRGLFQYQRLPFGIKLAPSIFQKAMDQLTSGIPGVFAYLDDIIIASADHSQHVAALIELFSRIQDYGFRVQLDKCHFLKAELKFLGHVVSSDGLKPDPARSDAIRNMPSPHDIGTLRSFLGALNYYGRVKEMRDLRAPLSALEEGHSLVLGSSAEGPIIVAADASQSGIGATISHVFPNGVERVIDHASRTLTPAERNYAQIEREALSLIFAVQKFHRMIYGRNFTLLTDHKPLLAIFGNKNGIPIYTASRLQRWALILSNYDFTIKYVKSANFGQADVLSRLISEHRTDEEVIVAHTSDDVDSTEEVEYALLVNLEQLPVDAKEVSELTTSDDLLQEVAXFVRSGWPNKCPANELMPFYSRRDTLTLVGGSILTGNRVIVPAPLRXRVLKTLHFAHPGIVRMKALARNHVFWPGLDSDIEAMVKHCAECQFAVKMPPKAPLRPWPIPGEVFGRVHIDFAGPCAGGNIYLILVDALSKWPEVMQMRTTTAKGTIEALNLVFHRYGAPKEIVSDNGPPFTSHEFKDFCRLKGIKHKFSPPYQPHCNDQAERMVDTFKRQAKKRKIQKSTMDFGFLFAYRSSPSPSFSPAELFLERTLRTPLSMLEPRQHTPNENNNQRGHRSFNSGDSVRSFNSGDSVFLNYGRSGKPSWLEGKIVSGSGLIWKIEIPILGITVTRHVNQMRSFS

SEQ ID NO: 149130 - protein, 405 aa, Heterodera glycines
  Coding regions on vcDNA: vcDNA=SeqID_75553; Strand=+; Position=1 -102,400-659,764-856,900-1076,1158-1296,1354-1482,1533-1847
  Homolog annotation: Hit_ID=NP_508085.2; Match level="QueryCoverage =88%, HitCoverage=47%, E-value=3e-87, Identity=45%"; Hit description =glutamate carboxypeptidase ii homolog family member (85.5 kD) (XA925) [Caenorhabditis elegans] gb|AAU0554
MAGGAELHLPSGTRPKKRTRPNGESGGAFQVGSEMPFPHFPCRPIQNVIGYIWGSERPDEWVMLGNHFDAWVFGAIDPNSGTAVLAEVAKGLAQTVRTTGWRPKRTIVFCAWDAEEPGLIGSTEFVEEFADVLRERAVVYLNVDNISSNVTLNIHAVPSLYQAAVDASKSVQNPNGQGSVFGPWIENYPSRTSWLPDFPHMGIPGGGSDQKSFLDFLGIPVMMITYIDPKRGQYPLYHTRYELPFVNEHIFDNNQLAVHKAVGEYWAELARLFADSPLLPISATTLAHRLLADYLEGIKKPILDLSSQFPSTCGPAKTQLDNLIQNGHQFMAQAEEFERHAQGQSAGANLAQLAWANDRLRKLEQCFVNPAMGLAREEPLKRHVLFATGNDNSYAATTLANVYNK

SEQ ID NO: 149131 - protein, 114 aa, Heterodera glycines
  misc_feature (112)..(112): Xaa can be any naturally occurring amino acid
  Coding regions on vcDNA: vcDNA=SeqID_75554; Strand=+; Position=1 -63,261-344,457-540,654-765
  Homolog annotation: Hit_ID=NP_001007089.1; Match level="QueryCoverage= 91%, HitCoverage=71%, E-value=5e-31, Identity=55%"; Hit description =zinc finger protein 21 isoform 2 [Homo sapiens] emb|CAC41951.1| dJ54B20.4 (novel KRAB box containing C
KRPSTHLKVHLRVHTGEKPFECEFCEWRFAEKGNLIKHRRTHSGEKPYECTECGRTFAQKGALHIHRRTHTGEKPYKCTECGRAFAQISNLHVHLTEKKSAERNDQMEFGIXFH

SEQ ID NO: 149132 - protein, 37 aa, Heterodera glycines; identical to SEQ ID NO: 127185
  Coding regions on vcDNA: vcDNA=SeqID_75555; Strand=-; Position=1-230

SEQ ID NO: 149133 - protein, 24 aa, Heterodera glycines
  Coding regions on vcDNA: vcDNA=SeqID_75556; Strand=+; Position=1-91
HQFDLSNLFSALIILFISPANKLI

SEQ ID NO: 149134 - protein, 24 aa, Heterodera glycines
  Coding regions on vcDNA: vcDNA=SeqID_75557; Strand=-; Position=1-91
HQFDLSNLFSALIILFISPANKLI

SEQ ID NO: 149135 - protein, 203 aa, Heterodera glycines
  Coding regions on vcDNA: vcDNA=SeqID_75558; Strand=+; Position=1 -64,472-541,793-1272
RWPPPRYLRFSPAKTAPTLPTSITSGGGSFLAFAKLLAEWKWIVILLIVLQLVLGVLAADMSTASCNWDVKMLIPFLSILTGLVVIFGFIWAIVHVLVNSKFDVVLAKMEAMKSDQRAELRGEMKGIRGEMNGIRENMNGLRGELNGLRGEFNGFRGEINGKFEIMKIELRGDMKGLSGEMNAMKSELNGRINVLQAEMNGKR

SEQ ID NO: 149136 - protein, 74 aa, Heterodera glycines
  misc_feature (5)..(5): Xaa can be any naturally occurring amino acid
  Coding regions on vcDNA: vcDNA=SeqID_75559; Strand=+; Position=1-305
RTQNXALHKTTDGTEAKGARAARVRSAPVQHGVDLAHDVHLAPVVPPGQVLLQLNERDAKITTDFGIQIKNAIN

SEQ ID NO: 149137 - protein, 141 aa, Heterodera glycines
  Coding regions on vcDNA: vcDNA=SeqID_75560; Strand=-; Position=1 -43,362-471,1287-1559
  Homolog annotation: Hit_ID=NP_507910.1; Match level="QueryCoverage =43%, HitCoverage=21%, E-value=4e-12, Identity=40%"; Hit description =CDK5 regulatory associated protein 3 (55.7 kD) (5U745) [Caenorhabditis elegans] emb|CAB54323.1| Hypotheti
MDHLPIDIHSNKLLDINYFHCKQIVDILRDTEKETKNIFGMYSSQRMKDWKDDEIDFGDDEIDFCLDGNGVVECEIELINDKTGDGVKPKVGGGAVAADDGIARGEEALPLLEHLEVRTEFLDELDQVKNSRREFEQDLSN

SEQ ID NO: 149138 - protein, 311 aa, Heterodera glycines
  Coding regions on vcDNA: vcDNA=SeqID_75561; Strand=-; Position=1 -162,212-308,359-446,509-728,798-949,994-1210
  Homolog annotation: Hit_ID=NP_871679.1; Match level="QueryCoverage =64%, HitCoverage=42%, E-value=6e-29, Identity=37%"; Hit description =putative protein of ancient origin (48.9 kD) (3D473) [Caenorhabditis elegans] gb|AAN63406.1| Hypothetical
MVLQLSMIGTDREAATSAGSITTRLLGKYQHVEHVIIVGVAGGQAHLTDPEMVSHIRLGDVVISQEEMDEHSTDGRIGAYVYAHNIESDPKAKEIRFEVHNLSPKVNALAAAVRNANKPRFLDAWHANSQSLIGRLNDKHRDQQLDFSRPPATSDVILQLTNNGNILVFPHPNESRTNPLYHLGPVGSMVTFYKRPDEDEDSNKKQKPPTPPLKPTNRFSFGKGNQNGPSVDNTNGIGSNGPMLSPGNVGDESNDSEEKAKESAADTSLNSESATDGSRDVRLVNERLREKCGGNTGKLNANKLHNSFQNR

SEQ ID NO: 149139 - protein, 33 aa, Heterodera glycines
  Coding regions on vcDNA: vcDNA=SeqID_75562; Strand=-; Position=1 -88,463-476
MLIKKGSNTKLIRSLLHGDLISPFWLGTRAKMG

SEQ ID NO: 149140 - protein, 17 aa, Heterodera glycines
  Coding regions on vcDNA: vcDNA=SeqID_75563; Strand=+; Position=1-66
HKHLFDLFYHIHNLIKI

SEQ ID NO: 149141 - protein, 47 aa, Heterodera glycines
  Coding regions on vcDNA: vcDNA=SeqID_75564; Strand=-; Position=1-143
VCVLSKKKNREDTTKQIQKNGYKFGLFLSLPSLSSNALTPSAARGES

SEQ ID NO: 149142 - protein, 36 aa, Heterodera glycines
  Coding regions on vcDNA: vcDNA=SeqID_75565; Strand=-; Position=1 -72,496-534
MAEKVQPEAEEPVVIVVGGIAHGKVQNKAMCGTKTE

SEQ ID NO: 149143 - protein, 79 aa, Heterodera glycines
  Coding regions on vcDNA: vcDNA=SeqID_75566; Strand=-; Position=1-238
MTYVSAQAHNVLSDIDKKLHENNAFTNLLGKIETKTGLKRLHVFGGFYQPKFISNNQNFVNLAMVKNWCPDEKNVKNLA

SEQ ID NO: 149144 - protein, 58 aa, Heterodera glycines
  Coding regions on vcDNA: vcDNA=SeqID_75567; Strand=-; Position=1 -141,250-285
MQTTCGYAFQIADIGNASSSNPSPNSEPLAQIVRWNWDQNGTQQIIEGRLSAPPALCF

SEQ ID NO: 149145 - protein, 27 aa, Heterodera glycines
  Coding regions on vcDNA: vcDNA=SeqID_75568; Strand=+; Position=1-83
NSALVLIWQKIKPFFLRTHWCSIHLTK

SEQ ID NO: 149146 - protein, 67 aa, Heterodera glycines
  Coding regions on vcDNA: vcDNA=SeqID_75569; Strand=-; Position=1-204
MAESEEKSRRQCANNNSHNNNDGSSTAANAEAGCAADQHQRQQQFDDFMCLDFGGDQTKTAPERQQR

SEQ ID NO: 149147 - protein, 147 aa, Heterodera glycines
  misc_feature (138)..(138): Xaa can be any naturally occurring amino acid
  misc_feature (141)..(141): Xaa can be any naturally occurring amino acid
  Coding regions on vcDNA: vcDNA=SeqID_75570; Strand=-; Position=1 -138,441-555,678-804,1449-1517
  Homolog annotation: Hit_ID=NP_508145.2; Match level="QueryCoverage =99%, HitCoverage=25%, E-value=4e-44, Identity=58%"; Hit description =suppressor of LIneage defect SLI-1, homolog of mammalian oncogene c -cbl, adaptor-like E3 ubiquitin ligase
KRLFHPWPSLIKNWQLLAVTHPAYMAFMTYEEVKQRLQQFSGKPGSYLFRLSCTRLGQWAIGYVAPDGKIYQTIPQNKSLIQSLVDGSREGFYLYPNGRNKNMDLSYVSQFPQSGKVQVGFMLFSYLSKNNYFICRKXCKXNSPKIK

SEQ ID NO: 149148 - protein, 220 aa, Heterodera glycines
  Coding regions on vcDNA: vcDNA=SeqID_75571; Strand=+; Position=1 -138,181-333,609-772,818-977,1034-1081
  Homolog annotation: Hit_ID=XP_393755.1; Match level="QueryCoverage =92%, HitCoverage=13%, E-value=5e-35, Identity=36%"; Hit description =similar to ENSANGP00000011330 [Apis mellifera]
MDLFKSEEIKKAQKDDENNNRRIFQYEYFANYTDEKAAAAIRRMKQGGKIIWPSEKSPNILMIAWKVTNDIHQVIKVEEKEKRRVFEIGKKLLMNGEVFEDVDEIVTRCIEPMANFAVDILRYRYFMESGYAQEVVDGYLRDQKRAAPQRIPYVITALRERPGRFMLSYLAGSTPRNESMSVTPDGIKFRGHTFASTEDCVNWFKNEFARRQQEILHQQR

SEQ ID NO: 149149 - protein, 28 aa, Heterodera glycines
  Coding regions on vcDNA: vcDNA=SeqID_75572; Strand=+; Position=1-84
MHPKLFLVTFAVLLALLSLANAIGFPPE

SEQ ID NO: 149150 - protein, 167 aa, Heterodera glycines
  Coding regions on vcDNA: vcDNA=SeqID_75573; Strand=+; Position=1 -276,328-555
  Homolog annotation: Hit_ID=NP_506146.1; Match level="QueryCoverage =85%, HitCoverage=32%, E-value=1e-09, Identity=30%"; Hit description =putative protein, with 2 coiled coil-4 domains (5N52) [Caenorhabditis elegans] emb|CAB02877.1| Hypothetic
MTRFTNCLITLAFLLITIVSTIDGFGFPSGGSGCGCGCSGGGGGGGGHGGCCGGSGGGGHGRRKRDTDAVQPHYMADETPCPQAAWKAILEESISPEDAIVSVGAIQTALYRRYTNEQKFLVTCSAADVAKNGTALATNKVHFSSSGNGYCNMVKERIWCQAVALHS

SEQ ID NO: 149151 - protein, 157 aa, Heterodera glycines
  Coding regions on vcDNA: vcDNA=SeqID_75574; Strand=+; Position=1 -261,324-536
MSQLLNCLIALTILSVLVAMTDAIGMPMQQCCCPMQQQSCCGGGGGGGGGCCGRKKREATALEAVQPHFKSDETPCPQTEWRQVIDESIRTDDAIGSVSAIQTALFRRYADQKFLVTCSAADEAKTGTNKVHFSSSGDGYCNLVKERIWCQAVALSA

SEQ ID NO: 149152 - protein, 73 aa, Heterodera glycines
  Coding regions on vcDNA: vcDNA=SeqID_75575; Strand=+; Position=1-219
MFNNEILWSENQAEAGAIREHGQMFVGGFEVTPGTRIGGFEMVPGPLVRGQLMAFINDLNDRFRNATDYVELA

SEQ ID NO: 149153 - protein, 88 aa, Heterodera glycines
  Coding regions on vcDNA: vcDNA=SeqID_75576; Strand=-; Position=1-600
LLQLPKKSVRRQLLHFFSLHFTNKIIHRSIFRIYSLNISTKFTHPQNAPQLAPHSCNKFVRNLLIQPAVRSRENYFLEKMLLSFHKKM

SEQ ID NO: 149154 - protein, 89 aa, Heterodera glycines
  Coding regions on vcDNA: vcDNA=SeqID_75577; Strand=-; Position=1-267
  Homolog annotation: Hit_ID=NP_491198.1; Match level="QueryCoverage =93%, HitCoverage=40%, E-value=3e-19, Identity=61%"; Hit description =ferritin (19.5 kD) (ftn-2) [Caenorhabditis elegans] gb|AAK21364.1| Ferritin protein 2 [Caenorhabditis ele
MAQHQESLIRQNFAAETEAGINKQINIELYASYVYLSMVPLNLLNRSEISFVKSFYFDREDVALHNIAKWFKKQSDEERGHGTTFMKYQ

SEQ ID NO: 149155 - protein, 484 aa, Heterodera glycines
  Coding regions on vcDNA: vcDNA=SeqID_75578; Strand=+; Position=1 -132,401-1723
  Homolog annotation: Hit_ID=AAM51140.1; Match level="QueryCoverage =72%, HitCoverage=33%, E-value=3e-47, Identity=34%"; Hit description =SD27140p [Drosophila melanogaster]
MKGRPSKGEWEHIYGRGKEHEMEQKSIGIMSCHSNYGGSAPNNFINSAIKEKDFCEFEKHFERFSKWDRLKNSIAYALRAFKKENQKKVSQKYGKNFGYQNKKNGKEITKEIIKLIRPLEAKEILKAEKLIFKLIQTNLSPTKSIIRNLDLFKDDDDLWRTKGRILKSGLNYDTINPIFIPNNSYIATLLIRDIHMKTMHGGRELVNSKLRENFWIPKSRRKIYEILKRKNKEKCGICAKFANNKYTYPKNPPLPVFRVKGKGAFEHVGIDYFGPLSVKTLDGNKKCWGAIFTCLIVRAIHLELVSDISAEKFLLAFRRFIKRRRVPKLIISDNGTNFVLANKALKQIVLEENIQNKLWSEIYRDPTVQNFSSNLGIDWQFNSPYASWRGGAYERMIGLVKTHLIRSLGKQLLSFEELMTYLIEVERIVNERPLSYITQDEVIEPLRPIDILNPTDGEPFSLKLDPTFDRKDVNEYFEKKTKRE

SEQ ID NO: 149156 - protein, 123 aa, Heterodera glycines
  Coding regions on vcDNA: vcDNA=SeqID_75579; Strand=-; Position=1-372
MPIPTAHGCHACPFQLLTGATHAHSPSPRVPTVHGCHACHSPSLGFQLFTGATHAHSPSPRVPTVHGCTHAHSNCSRVPRMPIPTEHGCHACPFQLLTGATHAHKPSPRVPTAHVRKNFENFS

SEQ ID NO: 149157 - protein, 17 aa, Heterodera glycines
  Coding regions on vcDNA: vcDNA=SeqID_75580; Strand=+; Position=1-51
IFPPSLLEFFQSKRESH

SEQ ID NO: 149158 - protein, 53 aa, Heterodera glycines
  Coding regions on vcDNA: vcDNA=SeqID_75581; Strand=-; Position=1 -58,191-294
MKFVVQISFFGFVGEMNDFDCDAKIKVCPHSQAINVFSDLSQSTQRWRIFPDI

SEQ ID NO: 149159 - protein, 29 aa, Heterodera glycines
  Coding regions on vcDNA: vcDNA=SeqID_75582; Strand=+; Position=1 -77,395-407
MSMAKIVAKSITAMGTIWDLEHIKRLKNK

SEQ ID NO: 149160 - protein, 47 aa, Heterodera glycines
  Coding regions on vcDNA: vcDNA=SeqID_75583; Strand=-; Position=1 -31,549-661
MNSKICQIIKNTKMYVYRRHSVQIAEVREKILGKCGHHVKREKEQFN

SEQ ID NO: 149161 - protein, 33 aa, Heterodera glycines
  Coding regions on vcDNA: vcDNA=SeqID_75584; Strand=-; Position=1-102
MIGRAVRNRPFIFEGICKFILYPRKMAISFFEK

SEQ ID NO: 149162 - protein, 26 aa, Heterodera glycines
  Coding regions on vcDNA: vcDNA=SeqID_75585; Strand=-; Position=1 -38,245-287
MTVRKKVTDGGGRCANEWWWAGLNGK

SEQ ID NO: 149163 - protein, 34 aa, Heterodera glycines
  Coding regions on vcDNA: vcDNA=SeqID_75586; Strand=+; Position=1 -22,827-909
MDRKGQRVILRQMLDQQKIINVNSLVAMINVPAV

SEQ ID NO: 149164 - protein, 249 aa, Heterodera glycines
  Coding regions on vcDNA: vcDNA=SeqID_75587; Strand=-; Position=1 -144,1098-1203,1738-1919,2237-2358,2562-2755
MYSVFSELVRDAFYNDSRFLTVRDKAFQEMVNNTEVFRLELDPNRTKKTGEFPQSPNATDPLRNRPTTVDPKKASTSRPRVLKSRSRSASVYERSRRVSQTGTRAHVIDFDEPNTSAGANPVRGGGGGRFPIDDAMWLSMFRRLNNLTRTVEAIKICLQSILAAQQLNSWDINHCNEGIYVYDFLDVGVGLAPAHMRMHELVGHFEASIALWSDGSIHSKLPCVPDVLDGFAQFGPGDVVGCGMDANNR

SEQ ID NO: 149165 - protein, 161 aa, Heterodera glycines
  Coding regions on vcDNA: vcDNA=SeqID_75588; Strand=-; Position=1 -181,410-714
MRKVPANEKLNALNLALNKEIINYFNYKKSVEKNKNNIFLLKEFSDSYLKLWEFVKELYFDLSRICAFAREYKKKYVDGLPILKGLWFMKTEAKSAFDFTLAKTIGQGNYHVWEEEFGKMYWDHIMLINAQKMPNFNELKRVPDPCEEAKIKVKTRGTIVG

SEQ ID NO: 149166 - protein, 154 aa, Heterodera glycines
  Coding regions on vcDNA: vcDNA=SeqID_75589; Strand=-; Position=1-463
MCKIPFIKLSLLLIILIEIVNVANGMNYKYEKLNEPLLEKEDDSDQPQFEVIEDGTTEEEDMEKAIKILKRFFWRVIMAMNCKNNTIKKPEEIGFQKSYKELVEICEYWKMLSIAAEAYVKSWERCRKGQKQEKEVEVGTSSTRAQETLKTEEN

SEQ ID NO: 149167 - protein, 124 aa, Heterodera glycines
  Coding regions on vcDNA: vcDNA=SeqID_75590; Strand=-; Position=1 -306,1240-1308
MCESSTKFMEIFGKESNCSPIDAIEQFQEMNSLELMPNKPLQIVLEESVGILIVVANDKVHAMMKKMDKNSDELKQLLVPDPCDEAKLKLKKKEMMNKADQPINVNIIDKNEVVYVFVADVKCL

SEQ ID NO: 149168 - protein, 155 aa, Heterodera glycines
  Coding regions on vcDNA: vcDNA=SeqID_75591; Strand=-; Position=1 -409,488-546
METKQKNIHLLNLTRLAFKGDPYFDGFENSILKKQFSNPPAQNGLNALSDLPDELGVFSDLSDQFKQLSLTLGCFTCFIDEELTCCSNLSCAFKKYQKQQKKLKNENLKDEEKLKILKKVKREGDKLWKNAQQLGLGNFGTPKNTLSFFILLDKL

SEQ ID NO: 149169 - protein, 304 aa, Heterodera glycines
  Coding regions on vcDNA: vcDNA=SeqID_75592; Strand=-; Position=1 -124,176-475,538-1028
MAKKKSLLKLQGKRGAEQLRKRREERKAQTAKARQAYLAKRTAPQPNTDAETPQPSEEEPSTSEAPARDNDGRPPSTPTPMAPLEMDVPSVEMVDTDVQIPSTPADEDQQIQPMPSTSTARCDHMATPSTSKCAGAFGLDDVHMFDELRRRHVWTEEELQRQRRSNAFLRKQLKAQRDRSTSLERSASSCRQRKALSDVTNNQHEDNRLSAANDLLITLDAGISFKAREALKRSFAGQGHDVWAPTRAVKRLKAELCEAVNFHWTGNGETRALVSVDVRAMIEGRLQDLVNSGEREKNNRILKC

SEQ ID NO: 149170 - protein, 309 aa, Heterodera glycines
  Coding regions on vcDNA: vcDNA=SeqID_75593; Strand=+; Position=1 -140,507-613,1058-1118,4055-4171,4491-4587,4881-4971,5023-5066,5374 -5458,5528-5603,5974-6035
  Homolog annotation: Hit_ID=AAA21554.2; Match level="QueryCoverage =99%, HitCoverage=68%, E-value=6e-81, Identity=47%"; Hit description =OvL3-1 [Onchocerca volvulus]
LMETPEATTTTTNIHWQRQRRRTVATARAGGHFARELRDAALTERQRAANLQQKSALKQPFGCQLPSSLHNYAYHQGGQAVDELIRDMEFKMRSANDTCTKCHQQIGGDPPGVTALGNPYHVTCFCCDVCQKQLAGCSFYAVDGKNLCQVDYMNSLEKCDKCKMPITQKILRALSRAFHPECFACPICQKSLDGIPFTVDKENQAYCLECYHEVDKENQAYCLECYHERFSPRCAACLKVIAPNGNETEVARVIAMDKSYHLDDKSYHLDCYKCEDCGLKLNSKIEGQGCYPLESHLFCKNCNLKRLKS

SEQ ID NO: 149171 - protein, 139 aa, Heterodera glycines
  Coding regions on vcDNA: vcDNA=SeqID_75594; Strand=+; Position=1 -108,258-404,631-710,930-1014
MFNNKKYVHNLNYFKIFISSSSVVIYRIACGEGLYQHLLAYEVPLVKHLLAHRWQSQADTDCRQQIAEHPIHTIQHQSANAIKPRGTARVPRHAILMDDNGYPTDKTQQSHPPKKAGTSSTLTSSRLTNEAKAGKASTL

SEQ ID NO: 149172 - protein, 66 aa, Heterodera glycines
  Coding regions on vcDNA: vcDNA=SeqID_75595; Strand=+; Position=1 -12,469-657
MQQRLCAQRPNGGQLPEWPIPASRAWPMCAVECRRDTVHHAKRNHDDDEEEQQQQHYCSLVNDNKQ

SEQ ID NO: 149173 - protein, 401 aa, Heterodera glycines
  misc_feature (5)..(5): Xaa can be any naturally occurring amino acid
  misc_feature (238)..(238): Xaa can be any naturally occurring amino acid
  misc_feature (242)..(242): Xaa can be any naturally occurring amino acid
  misc_feature (250)..(250): Xaa can be any naturally occurring amino acid
  misc_feature (370)..(370): Xaa can be any naturally occurring amino acid
  Coding regions on vcDNA: vcDNA=SeqID_75596; Strand=-; Position=1 -102,183-354,995-1185,1438-1463,1519-1581,2077-2180,2258-2418,2483 -2538,2731-2850,3268-3359
  Homolog annotation: Hit_ID=NP_493010.1; Match level="QueryCoverage =98%, HitCoverage=45%, E-value=3e-80, Identity=37%"; Hit description =DNaJ domain (prokaryotic heat shock protein) (90.8 kD) (dnj-27) [Caenorhabditis elegans] emb|CAA21734.1|
AMLKXHSAIAKFITRSAKSQLIVLNADKYNVFLSAGTLAGTLWLVDHFVPWCPPCLRLLAELRKLPAEIDGRPLRLGTVNCEAEATICRSAGIRSYPHSVLFTPDGARHPIVGSHSADQLLEFVAEALNPSVLALNSTLFMERVVHRPKGHLFFVDFFAPWCGPCQQLAPEFRRLARQFSVVLAPEFRRLARQFSVVAPQADIGSVDCEAFPDICDGEYVHSYPTIRLYRHRHDLQPXNQFXSDYPNQFXSDYPPNWWRNAQSMAHWLSEMMPTLVQRLAGDFHSTVLGSDQPFLVDFYAPWCGHCVQFAPTFPWCGHCVQFAPTFDKLAKLLEGKVRLGKVDCDRFGHICQMAGIQAFPSVMLYPGKTXLFRPDFFLYGCGFIHSSFFYQNKQRKKKINK

SEQ ID NO: 149174 - protein, 84 aa, Heterodera glycines
  Coding regions on vcDNA: vcDNA=SeqID_75597; Strand=+; Position=1-255
MTLWYTVGDLKMPGIYRRNQRETADQSRERWNGNHPPTAGPTSASFRKANGPWIGHFATNLADNHFKIDFNIGAKLSRISERCQ

SEQ ID NO: 149175 - protein, 990 aa, Heterodera glycines
  Coding regions on vcDNA: vcDNA=SeqID_75598; Strand=+; Position=1-2973
  Homolog annotation: Hit_ID=NP_510849.1; Match level="QueryCoverage =93%, HitCoverage=68%, E-value=0.0, Identity=41%"; Hit description =predicted CDS, zn-finger, CCHC type and RNA-directed DNA polymerase and Integrase, catalytic domain contain
MRLELSVADTEAPSIMGLDWIIPFERATQQPIATTLEQQSLIVNSVQPTNDPVKLEGQIKASFPKVFQPGLGHCVKTKATLHLKQNVKPVFCRARPVPHGVQAAVDEELDRLLDSLVLKPIDFSRWAAPVLAVRKKSGNVRICIDFYTGLNDALELNRHPLPRTEDIFHALRGAKVFSQLDLRDAYLQVELDESSKQLVGINTHRGLFQYQRLPFGIKSAPSIFQKAMDQLTSGIPGVFAYLDDIIIASADHSQHVAALIELFSRIQDYGFRVQLDKCHFLKAELKFLGHVVSSDGLKPDPARSDAIRNMPSPHDIGTLRSFLGALNYYGRFVKEMRDLRAPLDLLLKKDTPWFWGPDQQKAFDQAKQVLQSDLLLTQYDPSLPIIVAADASQCGIVATISHVFPNGVERVIEHASRTLTPAERNYAQIEREALSLIFAVQKFHRMIYGRNFTLLTDHKPLLAIFGNKNGIPIYTASRLQRWALILSNYDFTIKYVKSANFGQADVLSRLISEHRTDEEVIVAHTSDNDVDSTEEVEYALLVNLEQLPVDAKEVSELTTSDDLLQQVAQFVRSGWPNKCPANELMPFYSRRDTLTLVGGSILTGNRVIVPAPLRQRVLKTLHFAHPGIVRMKALARNHVFWPGLDSDIEAMVKHCAECQFAAKMPPKAPLRPWPIPGEVFGRVHIDFAGPCADGNIYLILVDALSKWPEVMHMRTTTAKGTIEALNLVFHRYGAPKEIVSDNGPPFTSHEFKDFCRLKGIKHKFSPPYQPHCNGQAERMVDTFKRQAKKNAKSKNQQWISEFLFAYRSSPSPILNGFSPAELFLGRTLRTPLSMLEPRQHTPNENNNQRGQYQSRMSQQYNQHHGTKSRSFNSGDSVLVLNYGRSGKPSWLEGKIVSGSGLIWKIEIPILGITVTRHVNQMRSFSPYISSKIVSDQIQAAPQQPIPPMAPIQIDQTPVRDQTPVRDRTPEPVKSPRPQRQRKKPICYSPG

SEQ ID NO: 149176 - protein, 29 aa, Heterodera glycines
  Coding regions on vcDNA: vcDNA=SeqID_75599; Strand=-; Position=1 -42,598-645
MGKALLLVFIMLRIANRGHLRLSKDTKIV

SEQ ID NO: 149177 - protein, 452 aa, Heterodera glycines
  Coding regions on vcDNA: vcDNA=SeqID_75600; Strand=-; Position=1 -167,212-324,373-584,945-1079,1642-1985,2418-2557,2600-2728,2898-3016
MTIPQIDANGTELVVKERHDALPAIKIEIEKGEKGKERANPTKNNDTSKGAECIGRRRQMELVDFGGECLSLWLSELDPLLKGSKLMCCPTDEAAVAPSNFSNKANFLLISRASALFVASRVSLPYESVVARFRPNFVVDFGPNSKPFEEENIEQLAIGSVEFSLSFGIYLEQKQNDENEGDERKQTKTNPMARKKAKAMAREMRVGCANLHKHLAGLSLENESQQQTQMPSREQFQRLISAFNSMAQKLNYEEIVQGSEVEAIFAQIDAYLVTVHTEQRQKVTELEAYKDKDEKRLDEAMRREKSKEWGELNEVLDQQKDNEAIIHFVSHEMLKNIRTKLEEIALFHFLTNAVVQKKYKEYFKCFSKREEFKKKKANAEKANEKETFGFGDACATSMLACSLCNVCESSHVDAGHDGKRIIKTRVKRDGIPGPTPSGYRSLLTLINAIFSQ

SEQ ID NO: 149178 - protein, 106 aa, Heterodera glycines
  Coding regions on vcDNA: vcDNA=SeqID_75601; Strand=-; Position=1 -8,111-423
MPMLWLPSLPCNFQLHFARFIYDGLLLQSFKRVAQKKNRINFKTNREIRRSDGGAATAETGQTAFAGEWAERAPAGTGTSAERPKGPVTNEESDERRSIWCRIELN

SEQ ID NO: 149179 - protein, 132 aa, Heterodera glycines
  Coding regions on vcDNA: vcDNA=SeqID_75602; Strand=-; Position=1 -151,290-537
MKFFLTFLLLAISFLAIKTAADGSDDRNGDKSLPNPLAVEGKASKRSERRIIAISAIMATVMAVTVAEVGAVMSRRDGAVGTTADLEEEAWAVAWAWAAAWAWAWEWEWAWAWVEGWEEEDGDERAFLFIRN

SEQ ID NO: 149180 - protein, 133 aa, Heterodera glycines
  Coding regions on vcDNA: vcDNA=SeqID_75603; Strand=+; Position=1 -75,238-342,419-640
MSSNSSDHQNEEEEAKGTKSKSGDSYYLPKAASSCLCPAAEFGRLTAQRAYNDSSFGNPKILPDGRIEYELAVVSDLDHDSKMEDRKETWRSFFRRGRLLFRPDIPSVQVQWAKDKQDNTLYSQLSSGGRAME

SEQ ID NO: 149181 - protein, 25 aa, Heterodera glycines
  Coding regions on vcDNA: vcDNA=SeqID_75604; Strand=+; Position=1 -39,83-121
MVRHSQEMVFLAEKSVKRHLFRNGR

SEQ ID NO: 149182 - protein, 180 aa, Heterodera glycines
  Coding regions on vcDNA: vcDNA=SeqID_75605; Strand=-; Position=1 -168,570-944
MDVRVVVPVWLVLSFVIHFGCPSYSDTFLCYSDVPVISPAALKLEAWLKLRKFTVYRVTSGFLFADLFGQQRVPFVELNGKQLTGTTDRIIEELEKSEVAKEKAHLIMDEENLKRHGYNEKAELREFRRKERLIRRTFDEIVTKWVQRRYPACNHTPGTFSNLKKSRLTDVVILAFLDPL

SEQ ID NO: 149183 - protein, 71 aa, Heterodera glycines
  Coding regions on vcDNA: vcDNA=SeqID_75606; Strand=-; Position=1 -85,643-773
MPLVRNLVGAIRKIREDLQNKFLPLLAKIKYGRTLTIFALYNTKIRVFCVNFQIQIKFLVAFSESIIRIIK

SEQ ID NO: 149184 - protein, 83 aa, Heterodera glycines
  Coding regions on vcDNA: vcDNA=SeqID_75607; Strand=+; Position=1 -159,268-360
MALLHPFSPNTFKTTEPIVPIFFVCLNFFLSKHGSPHSTSSMNYLAKVTFAIRLYYRSGLLETEIRVRKTPKFFESRPETETY

SEQ ID NO: 149185 - protein, 113 aa, Heterodera glycines
  Coding regions on vcDNA: vcDNA=SeqID_75608; Strand=-; Position=1-342
MSDAQISAPSVFIISFRSLKMFTETNDPGYVGAHVCEKSPQAHTQGSQRFSAALLCLQYSDCTISPVRESESECKREKRKNLIQKRNEAFSFLLFVLETRKGFCATQDFDFSY

SEQ ID NO: 149186 - protein, 94 aa, Heterodera glycines
  Coding regions on vcDNA: vcDNA=SeqID_75609; Strand=-; Position=1 -121,548-654,897-953
MDFLCNKRGILYACDIAAIEKPKGCRLTHGFYWKILIQGTGYFPAIFHGFYCDERDIKTIIIDDAEFDDELGHCRKHRKSEQPPLPKVWFAFVK

SEQ ID NO: 149187 - protein, 252 aa, Heterodera glycines
  Coding regions on vcDNA: vcDNA=SeqID_75610; Strand=-; Position=1 -101,153-298,406-704,1243-1332,1662-1704,1774-1851
  Homolog annotation: Hit_ID=XP_327724.1; Match level="QueryCoverage =80%, HitCoverage=29%, E-value=2e-13, Identity=32%"; Hit description =hypothetical protein [Neurospora crassa] gb|EAA35389.1| hypothetical protein [Neurospora crassa]
MFDFGEKFGKFYFPDQTNFNPNTPYDPAILAEFTAWRRQFLAQNVVPRPVVPDLPDLPVIKEEPEEEEEESEFGLPPQDDLPDEAAENGIGPHHGHANLAPLEAQNWEALQPQAQQPMAMAFVQPFLPPMGMPPPLGMPLHIRMPPHMEMPPPMGLPPPVPFAPIFANPPPPIVYPPAPIPQPIAIPPARPLYGAFSAPQRPPPLINMPFAPWNYVAPIVKTVDVSFVRLPPPPEPPNLRRWHDHHDEPPPP

SEQ ID NO: 149188 - protein, 98 aa, Heterodera glycines
  Coding regions on vcDNA: vcDNA=SeqID_75611; Strand=-; Position=1 -11,72-357
MNRRWVCNDVWMDILPSFDHAQLGLNLALLSPRFNALVDKHFDGKSELTLWRTIIICKHAVAAVPNFSVFTDNANSVEFPLPDRPLPNKLRFKSLHIK

SEQ ID NO: 149189 - protein, 107 aa, Heterodera glycines
  Coding regions on vcDNA: vcDNA=SeqID_75612; Strand=+; Position=1 -198,639-763
QQKGRLTLKIEKFFCFSRGGESGTERYSDAVNIRGFSFKILANTYTMSADKSKKCLGFFIECNKNATLQIVVQKKYRNSTGGNKQFKDANFSAEKNQLGFRDFVPIE

SEQ ID NO: 149190 - protein, 74 aa, Heterodera glycines
  Coding regions on vcDNA: vcDNA=SeqID_75613; Strand=+; Position=1 -55,715-884
MPFLETIFILGPPIIHFLIKRNLFINICMASNLVDRLKLMLSTANGADIQFLVGQGEEKEASWPTKEFDKITKI

SEQ ID NO: 149191 - protein, 106 aa, Heterodera glycines
  Coding regions on vcDNA: vcDNA=SeqID_75614; Strand=+; Position=1 -67,122-259,307-422
MMTASNVFESMFRFDDKKPKTETPSAKTDSSVEIPDISANAFKVMLSFIYAEDLSELNGENAMAVLYAANKYNVSSLVKACLEFPINELSNVFFAHDQARLLNENV

SEQ ID NO: 149192 - protein, 15 aa, Heterodera glycines
  Coding regions on vcDNA: vcDNA=SeqID_75615; Strand=-; Position=1 -3,104-148
MRFGQCNPSSDERNP

SEQ ID NO: 149193 - protein, 112 aa, Heterodera glycines
  Coding regions on vcDNA: vcDNA=SeqID_75616; Strand=+; Position=1 -73,123-232,563-718
MLSFIYAEDLSELNGQNAMAVLYAANKYNVSLLVKALLDVPINELPNVFLAFVEARLLNEHAIRWADEKCRQNAVECSAENRRSALGPALFRIRFPLITKRDFSLNIGSFLC

SEQ ID NO: 149194 - protein, 81 aa, Heterodera glycines
  Coding regions on vcDNA: vcDNA=SeqID_75617; Strand=+; Position=1 -112,352-485
MMDYEMDNQNEEISKLNSQKDEVKKYQKDEVKKYLIKKKSSKYVYKIMKYVKSPNFCKQEKECFSYYLEYGEARKNMYCIT

SEQ ID NO: 149195 - protein, 75 aa, Heterodera glycines
  Coding regions on vcDNA: vcDNA=SeqID_75618; Strand=-; Position=1-228
MALLRNDLALLRNDHSGTFTKSPKVALLRNDLALLRNDLALLRNDLALLRNDLALLRNDLALLRNAHSGTFYETT

SEQ ID NO: 149196 - protein, 135 aa, Heterodera glycines
  Coding regions on vcDNA: vcDNA=SeqID_75619; Strand=+; Position=1-408
MKSFILLVLILFLIIIFDQDESMKKKLQEKSFDEIFGEKWQEKEEQQRNEEKIREIIRKFYKIKEKIKQKGRKYSTKEWSKIISKIAKKLGTNRSKIYQWISSLSYAGDAGRNWGQIEVKFTSGYPPFPMLGMLG

SEQ ID NO: 149197 - protein, 93 aa, Heterodera glycines
  Coding regions on vcDNA: vcDNA=SeqID_75620; Strand=-; Position=1 -242,346-524
RKRGIEYRKKRGIEYRNDSFIILWKLLLVRGINSNILKSGSNNNNNNGKRRNFWHYVRALNTDVAFNKKFRLMNAKSKFMIQTLPSNPESLLR

SEQ ID NO: 149198 - protein, 192 aa, Heterodera glycines
  Coding regions on vcDNA: vcDNA=SeqID_75621; Strand=-; Position=1 -354,463-687
MFIDIHSLDTDDDDYETDFTTVTITPTTLLEFKEYMRRLASASSSSPTTTSISRSSLSAILGQSTTTVKPTIQLLYSDSLDSTYGGGSSSTWIGEFIISLCSSVAGSEEGGCGGSHVWTKDQVTNSNEARNNKNNNNNNNGNEQHPNREDAFHLSDNERVLQRMFSRGSDPQNDRITTASPTLSRISDHQHG

SEQ ID NO: 149199 - protein, 193 aa, Heterodera glycines
  Coding regions on vcDNA: vcDNA=SeqID_75622; Strand=-; Position=1 -159,210-353,491-769
  Homolog annotation: Hit_ID=NP_611363.2; Match level="QueryCoverage =90%, HitCoverage=24%, E-value=3e-11, Identity=26%"; Hit description =CG15087-PA [Drosophila melanogaster] gb|AAF57649.3| CG15087-PA [Drosophila melanogaster] gb|AAM49863.1| L
MRDLSARMKRVTAISDSLTETFAKNCETVKRLNGAKGSVQRLEFLIKVPQILQNCLRDGEHVKAVETYVTFKPKINKFGYINSLKGIEKDADQTMQDLKLKAVTLLKNLGEPESELEKILLENWESEIDSELDQLAANSSFRNIGRFKDIFEFVDIGCCHFLTNLSLIAYTFLQIFVKPGDRKYRIKFKNLKS

SEQ ID NO: 149200 - protein, 146 aa, Heterodera glycines
  Coding regions on vcDNA: vcDNA=SeqID_75623; Strand=-; Position=1 -150,193-481
NGVSKNRNYAQKASQTILTLPIPSTIAFIHPIMSAKIIRVPKIACDLSLAKNGVSKNRNYAQKAPQTILALPIPSTIAFIHPIMNAKIIRVPKIACDLSLAKNGVSKNRNYAQKASQTILAHPIPSTIAFIHPIMSAKIIRVPKIA

SEQ ID NO: 149201 - protein, 133 aa, Heterodera glycines
  Coding regions on vcDNA: vcDNA=SeqID_75624; Strand=+; Position=1 -299,559-661
  Homolog annotation: Hit_ID=BAC87222.1; Match level="QueryCoverage =74%, HitCoverage=93%, E-value=3e-12, Identity=36%"; Hit description =unnamed protein product [Homo sapiens]
MKKKKGKGKEKEKGKGKGKRKGKRKGNRKGIGKTKREKGKGKRKGKTKREKERKQERNRENEEGKGKREEKRENEKGKGKREGKGKTKREHFLMVHATYRLRSHAIFGTLIILAFIMGCIKAIVEGIGSAKIV

SEQ ID NO: 149202 - protein, 240 aa, Heterodera glycines
  Coding regions on vcDNA: vcDNA=SeqID_75625; Strand=-; Position=1 -27,106-382,1665-1999,2888-2971
MCFSCFSHQVEDALFSEFVKGQTTNLEKFIKLTKGLNNFEKVKEDLMQQYEAHLGFSYFTKNNLQCDKIVGESREMLREECQKHRKYLQILHEYFFRLYVEGKKAEFAKKLPAVKPIFKEGHFNKSLIYALQMLNENSKYFWEKSGKKLEIYLENEEELNYAINEEKIWINENVEMEKQILNSQKGQKSTSEIEIEAFRREFEQKQMEKMSEKSATGPGPGSGQLSTTEYQGPGFDRDRD

SEQ ID NO: 149203 - protein, 99 aa, Heterodera glycines
  Coding regions on vcDNA: vcDNA=SeqID_75626; Strand=+; Position=1 -75,131-193,436-506,671-762
LINDFLKDRKAFEEDFYGFLLKLVKSPILNQIVAFMRNNFKVLAKRIELVFPFFSFFPLQDAKRKGTARVGNVRARKCGGIARLATVGLFERASDGNWG

SEQ ID NO: 149204 - protein, 71 aa, Heterodera glycines
  Coding regions on vcDNA: vcDNA=SeqID_75627; Strand=+; Position=1 -113,333-435
MPTEGIGGKASEKGQLSIESFESSMPKLHILFDRHIHLTNIPKEIMCFFDFRFAVDFACHQCSFDHSFPSH

SEQ ID NO: 149205 - protein, 888 aa, Heterodera glycines
  misc_feature (846)..(846): Xaa can be any naturally occurring amino acid
  misc_feature (882)..(882): Xaa can be any naturally occurring amino acid
  Coding regions on vcDNA: vcDNA=SeqID_75628; Strand=-; Position=1-2728
  Homolog annotation: Hit_ID=NP_502721.1; Match level="QueryCoverage =96%, HitCoverage=64%, E-value=1e-114, Identity=32%"; Hit description= endonuclease/exonuclease/phosphatase family and RNA-directed DNA polymerase (4O953) [Caenorhabditis eleg
LEAKKIQILTLTETWTMENQDIPFCPWIKENFNYIFASRKSKNLLRGGGVVFFLEKKLNLLNFLILNLIVNLVLQLQNTKSIRLILIYRPPRTTFKQTKNLFNFLQTFFCVNSIILGDLNFSKKDLVWKEGKPFSLSNFGEIFCDFFNRFSYVNATNGPSRGNSWLDLVLPANDKIVTQCSIEGGIFSSDHLAQFFILTVPELIPKSKNINIRRFTPSNVSLFNVVIASRLRALSFKLFSVNKYVSFNNALLETLDECIPIKRLPKMIWSINILGIYWHPLKKKQNYINKVKLTQQKKHFMIALLHIKIQTNKFHSQIEKTAISKGKQSIFKYLNKYKDNPFEIPNLVFENKCYYDSAEKCELFANLFANSFSISWADPKAMPKVECFISDIDFNIIETQTLLRKLPNKNGTSPDNISYKILKNCHSSLATVITDLFRLSLDSGSLPDIWKESIVFPLFKKGDKFNPENYRPISLTCSLCRVMERILSKNIYKLKNNKISESQFGFVRNRSTTNQLITVVEDWYEAIINGKNVDCIYIDFQKAFDSVPHNLLLKLKKIGIQGKLLNWIKSFLSNRTFRVKIGDTLSSVKKVGSGVPQGSVLGPLLFLIYINDLPDVIPSGANIKLYADDVKISRADTEIMHKTLHNLFEWANKWQIKVSIQKTFVLYLGSKNPKETYKFDGNTINAVDTIRDLGVNIDNKLQFSDHVNQITRNVYLRMRSLFRIIKSKSSKIWITLYKTYIRPLLEYAPEVWNPSLQKNIKKIEKCQKYFTKRVFKCNLPPIPYQKRLEYLQLPTLENRRKLFDLFMAHKIVYGRRNYFQFLTHQHALTSPFRFNTKYKLGKKFIXKLSKFCHKFNQFKFSLSLSLCEKTLSDRFCTQIKLXKIILSF

SEQ ID NO: 149206 - protein, 108 aa, Heterodera glycines
  Coding regions on vcDNA: vcDNA=SeqID_75629; Strand=-; Position=1 -207,252-371
MLSSQSFPYLKMQLIDQKCAAGLEADDTRGTVSRYYTDDLELDLAEYGELLNSTRHFPRFCSAFLAQQKKDENVFKSLGTEFAAAYGKALSIFEEEVEKKKQMLKMSN

SEQ ID NO: 149207 - protein, 120 aa, Heterodera glycines
  Coding regions on vcDNA: vcDNA=SeqID_75630; Strand=+; Position=1 -130,471-703
MGHLLDETFALNAAATVVDKTTESGQGTRRGGQQRVDGKIEELESLALLMNESPQNRARIVRHKEPHNGTPRHNTNNSANHCGQNLWRKPSTFASSERLSAGDATELNNLLIACNYWTDG

SEQ ID NO: 149208 - protein, 70 aa, Heterodera glycines
  Coding regions on vcDNA: vcDNA=SeqID_75631; Strand=+; Position=1 -3,389-598
MLLNDGTFKVLHANIRKIGNKIYNKCVALKMTKKDLTVSDWQKHVKEWKIQRSFDTFNETKRAHIVKLIA

SEQ ID NO: 149209 - protein, 81 aa, Heterodera glycines
  Coding regions on vcDNA: vcDNA=SeqID_75632; Strand=-; Position=1-622
SSLIHFEVGELSRKLSSQKNELPKSGERLSKKWCQCGRSEIEKMKPMALINFEDKKPIELLYQKKRLGKGSYSEVGKMLKE

SEQ ID NO: 149210 - protein, 381 aa, Heterodera glycines
  Coding regions on vcDNA: vcDNA=SeqID_75633; Strand=+; Position=1 -277,339-487,966-1682
  Homolog annotation: Hit_ID=E86336; Match level="QueryCoverage=41%, HitCoverage=33%, E-value=3e-37, Identity=58%"; Hit description =hypothetical protein F14O10.11 - Arabidopsis thaliana gb|AAF88160.1| Contains weak similarity to an unknown pr
MDKFKAHLEEKRKLFREELAKAEDKSKESVERKIDETERLLWMASLKEWKPSERLWKVPCDTGKAKTKPNRMWTTRIKAEKGEAKKAEGEKNAKSNKMLANLMKSIGLTLSPSIQNANDSIEMKFEGTFENLQDSFYNRSSKQPFDQSNQIVSLLLEIGYRNLLEHLISIIERYESDAEMLKKVVVIVSGRLDSEWKKINELAAKYEEEEAEEEEEEEEEEEEEEEKEEAESETEEEKEESKNESNEEMEEQEAKKEGEEVKKEPEEEKEEGQFVFNEKEEEEEEEEEKKVENETGKKVSQKEGKVEEEEEEEEEEDEEEEEEAEEEEEEEEEEEEEEEEEAVEKCCWYTKTIEQIKAVYLYELIYKHFIAEVENNATNNS

SEQ ID NO: 149211 - protein, 170 aa, Heterodera glycines
  Coding regions on vcDNA: vcDNA=SeqID_75634; Strand=+; Position=1 -114,160-249,1676-1813,2124-2219,2412-2485
  Homolog annotation: Hit_ID=CAE63579.1; Match level="QueryCoverage =60%, HitCoverage=16%, E-value=2e-13, Identity=40%"; Hit description =Hypothetical protein CBG08068 [Caenorhabditis briggsae]
HFVALSEHSLIICLLIIFFGGFALGLIASIFFRCMLGKHGHSPVGTSKSARKGARDRAALHSLSSISVPVSALCSAQAENPRRNWQFAIAGLLIASNLFVGITFACIVPFFPIEAEAKGLSTSQVGLVIGIFQLCSFFVSPVFGKYLVVLRVHRAFIGGLLFTSLCTIAL

SEQ ID NO: 149212 - protein, 78 aa, Heterodera glycines
  Coding regions on vcDNA: vcDNA=SeqID_75635; Strand=+; Position=1-235
LMVTTIAFAMLGIVSGAAYVPVFKWCVDAAKSVPWWMECAIYNAISVNALIKQRGIGRHFACHLRVYLRIHTVGTCSQ

SEQ ID NO: 149213 - protein, 131 aa, Heterodera glycines
  Coding regions on vcDNA: vcDNA=SeqID_75636; Strand=-; Position=1 -19,126-293,361-569
MPALTEVYNCALSLRNKGAACKDINWLIATYKIKATEEDDIIDVVDCPGNVFMGCQTFSCLDEQNNDIFVLNGCAETKSCSSKLEKICKKYDGFASCVICKGPLPVCNKEKIELKEPFPPFNDGHAHRWFV

SEQ ID NO: 149214 - protein, 19 aa, Heterodera glycines
  Coding regions on vcDNA: vcDNA=SeqID_75637; Strand=-; Position=1-57
FSLGDHLTFWQASLSPHNH

SEQ ID NO: 149215 - protein, 56 aa, Heterodera glycines
  Coding regions on vcDNA: vcDNA=SeqID_75638; Strand=-; Position=1-170
EKPLLDFDKEFSDQFPFGPFLDDYAGLWLLGLDILPKFGPKTTNISMEKPKNCQLE

SEQ ID NO: 149216 - protein, 536 aa, Heterodera glycines
  misc_feature (27)..(27): Xaa can be any naturally occurring amino acid
  misc_feature (500)..(500): Xaa can be any naturally occurring amino acid
  Coding regions on vcDNA: vcDNA=SeqID_75639; Strand=+; Position=1 -308,358-450,593-745,879-986,1033-1096,1149-1274,1323-1540,1634 -1681,1745-1934,3047-3135
  Homolog annotation: Hit_ID=CAE63948.1; Match level="QueryCoverage =95%, HitCoverage=11%, E-value=1e-78, Identity=33%"; Hit description =Hypothetical protein CBG08530 [Caenorhabditis briggsae]
MPFQQKCHSNNAILNAILDPPPRSPHXHRQLSLQLSNQLNTSLSRARANRRIRLLILKLSGQIDRLFKLMSVDDCLAHPCLNGATCVDGFGKFQCLCPAHFEGKHCEKRVDECALFANTEGKHCEKRVDECALFANTEVGCQNGAICRNNPAGFTCNCTAGWRGRLCNRKDNKCDHSADLCGEHGHCVNNEQSEVREKEKRVLGYRCFCESGFVLGGDPSNPTCVDNDECSTNSPCHPGVNCINLPGSFKCGVNCINLPGSFKCDSCPSGLIGNGINCYDFDECASNGINCYDFDECASETNDCSKEPRVDCVNTHGAYKCGPCPPDFVGDGFTCQKVSLCAFVGDGFTCQKVSLCADGPNKVCHPEAKCVEEPEFRCECPPGTVGDGLGPDGCEANNRTLCHGDSCLNGGTCQAISVSAISVSVFRCNCPEGYQGARCEHASGARCEHASPCLSRQFCSGHGRCRTSPLGCDCFRGFYGPRCQFEEDGGGRHLPFCANXNNFLILSHSNISPQAFLFSFLSYTLFSCSLFSPISF

SEQ ID NO: 149217 - protein, 178 aa, Heterodera glycines
  Coding regions on vcDNA: vcDNA=SeqID_75640; Strand=+; Position=1 -374,593-755
PTAATVGTVRYAARGGGGTPFRQPSPFAAPAGAAGGELSPATAGRFVGIDQQQQQQQIDALRARLDQLQYELLGQVQYATSAAAGAEPWPPAFFTVDYNNHPKSLLARRHMAWQPMRRGIIENDKLNFVKTVKEQQHGSVSPRHISWQPMKRQQQTEYGITGMYGRGGGDGGGAQKEQ

SEQ ID NO: 149218 - protein, 252 aa, Heterodera glycines
  Coding regions on vcDNA: vcDNA=SeqID_75641; Strand=-; Position=1-757
MACAVAAERATIHQELQRFTLITELIRVEELQETQVNITFRHQLNSVAEMMDMLQIWEEDTAISCRVDQNDETKPCALGFVRRIEKRALDNGFEVRVEVFLAFQDAKGQKAWEQFEFLREGALEAVELRPMVSTRALRERAELLTKNGCSIIAKDHASPANVIMAILLGRRVPRDVALQSVEEKMKKGAVGLLKAGQCDSAERMLDGVPRVVFQQAGPGTGKTFTAAAIMAAILREDPSARILAMAPSKIAV

SEQ ID NO: 149219 - protein, 353 aa, Heterodera glycines
  Coding regions on vcDNA: vcDNA=SeqID_75642; Strand=-; Position=1-1062
MSSEKACGHNTENEMEGEAEEVPAQAPEVVVLDESIEENACGQNTDNENGVVEVMPLVNPSDPLGLATVEPVKEMEVDEQNGDQGGDNFGNGGFSGDESSSRHTFLSKKAKRLDQTNASKCSSSSQACLEDGALIDEFQAVGLRAKDKLTKTRVQGPYPGKKEDEKAPKWYLVAQIAANGVIAARVQLTEQWPALIWVDNDIVQKTRPLEVGDSVKVVSVEWAQTATGWAGAGDWLIMVNKRLNHQAVAKEVSACYQGPFSSALGLVLYVERHAKKNGNKTMKFATIAAPELPTIMRIQRRHMSEAMANELHSQSLVQMQLVTINRPQGVLISQHYVLPMGFPFKKWRRDFGL

SEQ ID NO: 149220 - protein, 107 aa, Heterodera glycines
  Coding regions on vcDNA: vcDNA=SeqID_75643; Strand=+; Position=1 -124,284-408,461-534
MTPSTDETHFGGMDRPFVQAHLDQFNCALGTEDELDETVNKINALCKTHSIGALDFLDGLIAFMKNGKRATVSMQILDNYEHQVLLRMNDSEKRRKATKRTAPLDYR

SEQ ID NO: 149221 - protein, 147 aa, Heterodera glycines
  Coding regions on vcDNA: vcDNA=SeqID_75644; Strand=+; Position=1 -75,130-336,847-1008
MAHSADQFVQLLSLVAASHANALILFGPFVPQGMELMTDSPEAIFSDLLAEIDKNIPANVRVLIVPNSQCDQLNALPSFPTPPLIGPQNDTVPNVVDDCVVLNPGRFDRGKGTGTFSVLDLDLSSAIGATSVSPFCEVSLFSTQQQQ

SEQ ID NO: 149222 - protein, 56 aa, Heterodera glycines
  Coding regions on vcDNA: vcDNA=SeqID_75645; Strand=+; Position=1 -117,1159-1212
MDEQEMNQLLLNHAFGFQQQMQNGRRQGEDVRGVGQQTEFIWPYQVFSTVIDFESS

SEQ ID NO: 149223 - protein, 585 aa, Heterodera glycines
  Coding regions on vcDNA: vcDNA=SeqID_75646; Strand=-; Position=1 -80,134-229,274-594,685-979,1468-2011,2057-2243,2284-2429,2477-2566
NSGTEAKRKQKEWRQEHGRRVGSTPKRLKQTEAVPTADGEGTSTQAAESGPSTSALDLCPHSSPRPLSTTPVRRHARVRPKTTENATQMELTTADKATHMDFTTTDNATNMDLTMMDKATDVDLAYEDAATQTEQLDKQLKEQEQTISFLRLQVRNRDAMIADLRPLTSTRCKKNAATLERTSRRNLAEKIVDVIDRDRSRSVSRCSLQTLHREVRHKFGHYTPMKKEQLRQQQTIHEEDALLLLSQLGTQKAYERMKALASDRFLGGDLSFLWAIIGHCGSAVTTYPSPICECRRDQLLDAEKCKMRTTEETVNQAEQFGRLVQNGEKPTVAARALTMGIVDEPLLQSIEFERIILAPFHVFQGIGNALIKELETSTESAEIANEFFRNIGTRREAFRKKDMTGNSIRKILIHADQLERRYSADWPKIICQTLGHLAKIQTFTKAQPLSPRDLDELETSIDQFRTFLNDQPRMRTLLALKPKVHLLLNHFVPFARQHQFLALLDEQGDEALHSVWRRLEQLWKTMPDEEQIRQLLDHHFVSNWLLNTGKIDEMKRDREEQQEEIGDRRETDEDSNGEEEQFDFE

SEQ ID NO: 149224 - protein, 24 aa, Heterodera glycines
  Coding regions on vcDNA: vcDNA=SeqID_75647; Strand=-; Position=1-90
LTHRPLRRKIQLNCTWSPKLTRRV

SEQ ID NO: 149225 - protein, 50 aa, Heterodera glycines
  Coding regions on vcDNA: vcDNA=SeqID_75648; Strand=+; Position=1 -142,177-187
MAFLETFARFPYYEFIWKVELSDEDAKVFAKYKNVNPVKWMDQKSLLINH

SEQ ID NO: 149226 - protein, 55 aa, Heterodera glycines
  Coding regions on vcDNA: vcDNA=SeqID_75649; Strand=+; Position=1 -64,134-237
MYHRNKGYYSTYCTFCGGLIKAHVLSLKHERHNSVHHKIIHFKKRWQISLLCLMD

SEQ ID NO: 149227 - protein, 122 aa, Heterodera glycines
  Coding regions on vcDNA: vcDNA=SeqID_75650; Strand=-; Position=1 -19,138-487
MTSVLSCFIEMFFKFLFETQLHELPHNSLIFGMSQLKKPIDNFLFINQNWHFTKRGDLARVIMTNSDQINPLPMKNHTVADQHVQCQAFSSQPVHWKSAQNHKCYTNQKICHPKGVAHFRQR

SEQ ID NO: 149228 - protein, 227 aa, Heterodera glycines
  Coding regions on vcDNA: vcDNA=SeqID_75651; Strand=+; Position=1 -167,344-408,458-538,1007-1225,1661-1812
MDFFVPNVVLDFLATIALNCQQYGNVCIRLHYVVMAANRAHAVLFPFNYAQNITKKKVFVQCVIIHLISIISIPFYQYVFFNTSYLFVTCLFYLAIVIRLAWIKAQKRRWNNAATDAATAQNPLDKESARITVVCIAVQIHGICFVLLGNLTITPWYTMLTICTNYDPILQQLYYPITLFVGRLYGHACAIRANDSENVCAVSEAWNLNNDSSNCTGQRMRHNANAN

SEQ ID NO: 149229 - protein, 31 aa, Heterodera glycines
  Coding regions on vcDNA: vcDNA=SeqID_75652; Strand=-; Position=1 -17,77-155
MKNFSDMTLGRCKPISLEAEIETKKKLEGAT

SEQ ID NO: 149230 - protein, 104 aa, Heterodera glycines
  Coding regions on vcDNA: vcDNA=SeqID_75653; Strand=+; Position=1 -219,448-541
MRILVTGYGPFGAFTVNPSAIVVDQLAQLCRDGTLGTDDADAIGIELVTRVVEVDYAGALGCANWARDELNVDFAIHIGVYPGSGFVFLERRAFRDGYVSKDVK

SEQ ID NO: 149231 - protein, 497 aa, Heterodera glycines
  Coding regions on vcDNA: vcDNA=SeqID_75654; Strand=-; Position=1 -144,193-381,426-554,596-859,912-1031,1086-1115,1275-1370,1574 -1871,2158-2276,2342-2446
  Homolog annotation: Hit_ID=NP_001003863.1; Match level="QueryCoverage= 80%, HitCoverage=68%, E-value=4e-15, Identity=22%"; Hit description =kinetochore associated 2-like [Danio rerio] gb|AAT68080.1| NDC80 [Danio rerio]
MGRRSTREFALPSFVGQSSEWIPGCKGRRLVSVPKMQTIPDQRNLRDREVQAAIIRKIVHFLEDRVNPAPPFSFGKPDFLRFPSKIAFQDVFQYLFQCIEPTYQVRKLETDALNFLNQLGYPYVLKQSTMQTITLPTSWGLLLGSLDWFIDIIEIENEMYQNLDKIRDDPQWNLLISCFKKFMSKGHGQPYDREETFKEAFEEYRAQKMAEKGIDCNAYDELVARRVAQEQKIHKLEAAIAEAQCVSEQLEKEAVDCENDIASMDRYIEEIQMVASAKERTLNEITLANKELVREELVLLRENLNKTEARIYERQPIIFKQSAKIRSDYNAFMSRLRVICEPLFSEDQLQQHLAELEQCSVDQAIVEFQRCRNDNKLTRLLNQLKGMMECQIRAVQQAEESMRVTNSKLVDEINELEFSKEQAIFGLQKSFGRTIQRIVDGGAGESHETLRPLSADRGEKGRTDQKKRFAELANEMLTKNKEDLKQLETKKKAETED

SEQ ID NO: 149232 - protein, 66 aa, Heterodera glycines
  Coding regions on vcDNA: vcDNA=SeqID_75655; Strand=-; Position=1 -59,551-692
MKIKWGMENEKWRRRSNHLSFISADCWLCVYDLLPASQLGLGIAMISHRFNFYVDEHFKTRKFIIQ

SEQ ID NO: 149233 - protein, 149 aa, Heterodera glycines
  Coding regions on vcDNA: vcDNA=SeqID_75656; Strand=+; Position=1 -47,108-510
MSDNRNEAEQKMAKAIFISADCWLCVYDLLPASQLGLGIAMISHRFDFYVDEHFKTRRWNLGSMKIKMKFEADGTKEMDVVNANLESFGITQKPLPKRVVGFKAISLKRDFDTFLFCKTIPSFFTGTSTTMSSLFSAVFVQFWPPVPFI

SEQ ID NO: 149234 - protein, 180 aa, Heterodera glycines
  Coding regions on vcDNA: vcDNA=SeqID_75657; Strand=+; Position=1 -288,431-685
MIATNIRGIQLSKQSFRSLRKFVPSILDDCPSLRVAANSNGFFTDFPCDDSAAASNGQAVAKWLFTPRPDNVPKVFKCWLNYGSWHLEPEIEDFKAEFYTASSPVNFIAVIRIDFSYHRPLPFVLTNELTREQLMLKKMNDINRVLLIRCPIVRDESKWAKWEKEAIGWNFMDQWNRIDI

SEQ ID NO: 149235 - protein, 81 aa, Heterodera glycines
  Coding regions on vcDNA: vcDNA=SeqID_75658; Strand=-; Position=1 -118,906-1033
MKLYYIGCIYMYDVTRNKIRRMEKINSSIYWGWTKGIFRLIDGPKAHNEKVPLEMGELLNSLNDAQIEQELECVCSFFTSD

SEQ ID NO: 149236 - protein, 291 aa, Heterodera glycines
  Coding regions on vcDNA: vcDNA=SeqID_75659; Strand=-; Position=1-876
  Homolog annotation: Hit_ID=AAS38609.1; Match level="QueryCoverage =83%, HitCoverage=30%, E-value=1e-13, Identity=28%"; Hit description =hypothetical protein [Dictyostelium discoideum]
MSFINFLFGFFAVIFLNFTTQNDGNGTVLAVTPNKNPQHLNRAPLSSNSSQMPNKMINRFSSLKLVDDLDSKEIELFAEYFKKENIVANEEGSGEAKTQKMSSKKHKGQTVKEKRDTETIEESIEECETEKEKTVRGRKGKEAAKENDRLKEKIKEKTVREKGKSVEESEGRKEKKKGKKFKEMGEKIVEMNREKKNGNEEENETVRETDGKACPVQAFAEQVVREMEKGSEVMKSETVRVRNEIGESSGGTEEEKNRGRRFINRDAKNMDIKSIAKYGHKIWTKNRGIWT

SEQ ID NO: 149237 - protein, 85 aa, Heterodera glycines
  Coding regions on vcDNA: vcDNA=SeqID_75660; Strand=+; Position=1-258
MACTTESNGISYSMFKTAYCLYVFQMTNAQEDSPGFELIKEGCTAVNIRFAEAVPNEGVTLIAYAEADGLILIDRNRSITSDLTV

SEQ ID NO: 149238 - protein, 151 aa, Heterodera glycines; identical to SEQ ID NO: 132093
  Coding regions on vcDNA: vcDNA=SeqID_75661; Strand=-; Position=1 -135,211-531

SEQ ID NO: 149239 - protein, 419 aa, Heterodera glycines
  Coding regions on vcDNA: vcDNA=SeqID_75662; Strand=+; Position=1 -243,577-614,827-1078,1126-1258,2266-2376,2437-2592,2641-2759,2800 -3004
  Homolog annotation: Hit_ID=CAE70241.1; Match level="QueryCoverage =80%, HitCoverage=53%, E-value=2e-90, Identity=46%"; Hit description =Hypothetical protein CBG16730 [Caenorhabditis briggsae]
MIDTKTDGVGNDSVKDFSNMDLEDEVMRQKLGNQQDIRDYLTEIEGELKRAEELTIDDCIGQADRIAELAREIDECDGALEFVDDMVVPHTMIKTIIEREVNSCEFLEQLHELQHKLQFIKTQQFKDAKSVGDVHDVVENLKYKAMEKIREWLLLKISLFRKPLTNYQITQNALLKNRFFYEFLLANDRQVAREVKDEYVDTTSKMFFSYFKAYVSRLFKFQTRSRATVFSLGHRQNLLLDDLLAPLIVPHVAQENNETFQFESLFRSVQYALVDHCSHEFLFICDFFMVNGQSAIDLFTSVMGRSISLLLKTLEEKIAANFDAISLFLCICFCAKFREMMTDRAVVVINGYWDALVGFLWARLDAVMTAHSDSVRAIDVRKVPVDSRPHYVCRRYAELICSLLVCSELAYKVTDPRLQ

SEQ ID NO: 149240 - protein, 142 aa, Heterodera glycines
  Coding regions on vcDNA: vcDNA=SeqID_75663; Strand=+; Position=1 -144,214-498
  Homolog annotation: Hit_ID=NP_509282.2; Match level="QueryCoverage =74%, HitCoverage=15%, E-value=5e-18, Identity=40%"; Hit description =sacm21 (76.4 kD) (XI185) [Caenorhabditis elegans] gb|AAA68727.2| Hypothetical protein F08C6.3 [Caenorhabd
MQTLQKILSRQQAEIEGLLTRLATQLKSKKERLVFQINNYDVVLTVLNERVLADSKERGSFWELQQTKMGTYVEEILSPHFAPLIQFVNECEPLVEQNHTQLLARYTGKWKKGEGKALTFCQGKSSKLCGHSAPSGEDRSTQ

SEQ ID NO: 149241 - protein, 51 aa, Heterodera glycines
  Coding regions on vcDNA: vcDNA=SeqID_75664; Strand=-; Position=1-326
KFSILMSLSVTRNHYFGDFVTKIVKNHYFGVLSLFFHYFDIFGQNSLTKMQ

SEQ ID NO: 149242 - protein, 202 aa, Heterodera glycines
  Coding regions on vcDNA: vcDNA=SeqID_75665; Strand=+; Position=1 -565,2948-2989
  Homolog annotation: Hit_ID=EAK90389.1; Match level="QueryCoverage =94%, HitCoverage=31%, E-value=7e-30, Identity=38%"; Hit description =cryptopsoridial mucin, large thr stretch, signal peptide sequence, transcripts identified by EST [Cryptosp
AAQQQTTTTADAAPNTDATGAATVTTDAATTATTPPTTTTADGATVTNANEPGATTATNTEAPAATTPATTTNADGATVTNANEPGATTTTTAATTNTEATAATTTTAIADGAVATNTDATGAATATTDAATNTEAPAAATAPTTTTTTADGAAATNTNATGAATTPTTNAATNTEAPAATTPATTADTLSKFIFISTFIIY

SEQ ID NO: 149243 - protein, 37 aa, Heterodera glycines
  Coding regions on vcDNA: vcDNA=SeqID_75666; Strand=-; Position=1-112
RGYTFPFLLFALCCAITTQFQFVNSFFFPHRRDDLFK

SEQ ID NO: 149244 - protein, 225 aa, Heterodera glycines
  Coding regions on vcDNA: vcDNA=SeqID_75667; Strand=-; Position=1 -358,827-919,1142-1368
MMQNNAELGKIFYLNTLTAIGSSNPLPQIFDGETASAFYEWQIKFLDYVDVFGSNWSEADKINRLKLHLGAHTRTIFEKLLPTEKDTLSNALKSIKSKLDSPHFRELAYRKLATCYQKDAENHAKNDCASETQQLREMIEDLALEVREMKGLSADHWNASDWQRRTLDRHQDAMKIGEAQAGDNSRGRHSHAANEEEALQSATIVDERDTWHVNAKKDGEMTGVD

SEQ ID NO: 149245 - protein, 106 aa, Heterodera glycines
  misc_feature (6)..(6): Xaa can be any naturally occurring amino acid
  misc_feature (26)..(26): Xaa can be any naturally occurring amino acid
  Coding regions on vcDNA: vcDNA=SeqID_75668; Strand=-; Position=1-433
VSPRGXFIPPKRFSSLSRRLLSLPLXLTSVPLLLCPPRPMKSLQIAEPSGATSSAAVRGGRAGVGSGQFGRADGEHWEGTHKLPKEGPHGMIKPRDSIPPLMDTLG

SEQ ID NO: 149246 - protein, 589 aa, Heterodera glycines
  Coding regions on vcDNA: vcDNA=SeqID_75669; Strand=+; Position=1 -175,213-1806
  Homolog annotation: Hit_ID=CAE56861.1; Match level="QueryCoverage =39%, HitCoverage=16%, E-value=2e-13, Identity=27%"; Hit description =Hypothetical protein CBG24691 [Caenorhabditis briggsae]
MDNDPIHNNHKSSTHNDNNRDYNDYTHNKLANQINHTANRTHNHDNANAMVNGPPNDNRIKLIRWPKSTITTEKGRDVFWCSNHGSTLWELKGPENSPFCRPPPALTAQWTPLTITLYTKIHRPEPIATAWHCSIKTTTENYYTNIVGDKFVEINKEFPLVSKRLCQRMAHQQECPLAKTEMHHDDNNRIWATNDQLQVDFPGPITGLFKGKQTSSATNCFAQPATLFVKWHSLQLLSPIHRADHCNYASEYCQLQDNSSLIWTSACPNDNCFMCDFQEAEEIHGEFTKLNGQTTAFWISEDRQKALTFTETHAVQACDGRQIVLSEQNFGIPKEQYDIIMSNHTRERRNVQPEQLASQLSAAQLATTMALSQLYLKECQRNVRVSNPTLQARKLLKRDNLQARWISETTIEVFPCVPISLSNISYRTTKDCYKFIPVTIHLPNATRDAFLDPEMRILSLISKIASCSPFRYHHLQVQQNPNLWVRIDSRNGNVQRLAQTVIHELYETILNKTDNDLDLHPLIFHQWQLDNDTDFASLPHIDEFEDSEEFKNKLEEQTTQRAEALGALPGGIEGWTVRWLQERLQEAIQ

SEQ ID NO: 149247 - protein, 231 aa, Heterodera glycines
  Coding regions on vcDNA: vcDNA=SeqID_75670; Strand=+; Position=1 -37,291-326,682-827,1187-1663
MASEQIREEMSGSRAIPLSIDHKPTCPEVEINAITAEHEFILLACDGIWDVIGNQEAVNFCRERLYRGVLPEKDYSFDDYLAKLRANGTGFEFEHEEEEEGEGVDRYSDAHPQSDSDEPIEEEVFSTPPSHSPPVLSSDSVSREGMTEQQEDGPVPKLEKQRNGTGQKGERHSILVFYWQIELLPLVGVEDITEDVHVPPSPAGAVEYTQPVDSSPGAQTTSNDSTQQRNM

SEQ ID NO: 149248 - protein, 188 aa, Heterodera glycines
  Coding regions on vcDNA: vcDNA=SeqID_75671; Strand=-; Position=1 -118,183-336,861-1046,1254-1362
KFFAEFDVLESFFDKVELSATESSQKAFDANSLLKVRNRRLTCADWSRVTFNVPAELVREGITHEEFAATKQHLQIFGDFDCPQISTRVELFEGEIRRFGQLRVKNVSNDAASDPLFTIVHLELWLNTDEPKTADYGHANETGTEGIKTKRGKARHSKNPSVIMCADGCGRSGTLALIEVKKTSNTHM

SEQ ID NO: 149249 - protein, 104 aa, Heterodera glycines
  Coding regions on vcDNA: vcDNA=SeqID_75672; Strand=+; Position=1 -62,248-500
MEGSLGLGVMSGLFLSGQLRHFFGYPLVFLLLVLLHLLILAIVFLFFRELASDEMERRRTTDSRRRRQSLLPPADEAQAEDRDAAAAAVAAEGENGEGRQSANN

SEQ ID NO: 149250 - protein, 112 aa, Heterodera glycines
  Coding regions on vcDNA: vcDNA=SeqID_75673; Strand=+; Position=1 -125,350-520,657-831
KMTLHLLLVLPVLAMAFAFGNCQSQTIISGSGCVYHNGWVTESGRSRPLTTNERSQLDNYQRQSQSAAAAFSAAFRPPFPFGGPINPQLNLPQMPCFCSAASCAGGVSWVDN

SEQ ID NO: 149251 - protein, 119 aa, Heterodera glycines
  Coding regions on vcDNA: vcDNA=SeqID_75674; Strand=+; Position=1 -33,344-537,1017-1147
  Homolog annotation: Hit_ID=AAC72366.2; Match level="QueryCoverage =97%, HitCoverage=10%, E-value=1e-55, Identity=91%"; Hit description =guanylyl cyclase [Heterodera glycines]
TMTVNITNRALKFERLYSSEASLWVNWGGFRPMTTPLCGYNGTMCGQNVTVYILVGATLMLLMLVAALLGIGYAIREKMREKQRLTRECLIPFAELRNPKELRSSEELKADTEKSMRSM

SEQ ID NO: 149252 - protein, 114 aa, Heterodera glycines
  Coding regions on vcDNA: vcDNA=SeqID_75675; Strand=-; Position=1 -61,119-226,286-461
MKFVLPFTFFCCLAFPCICYGIHCKVGMYDTSGNAAIVASECAADQQFCSAIGCAIGTEQITVFWACEEQNDTQVLVNRASSFNNNTCLAHIGHKGANMSNEQFDFRELEKLIN

SEQ ID NO: 149253 - protein, 21 aa, Heterodera glycines
  Coding regions on vcDNA: vcDNA=SeqID_75676; Strand=+; Position=1 -43,470-492
MLAFSRMVRPVGIGKSVKKGD

SEQ ID NO: 149254 - protein, 63 aa, Heterodera glycines
  Coding regions on vcDNA: vcDNA=SeqID_75677; Strand=-; Position=1 -82,513-622
MANEQVKLPEKEKPGPIPTISPEALEKTFDNFDQSRSINRSIIDFISIVRLVRPIDKSMRRSD

SEQ ID NO: 149255 - protein, 24 aa, Heterodera glycines
  Coding regions on vcDNA: vcDNA=SeqID_75678; Strand=-; Position=1 -31,296-339
MDVPWAAALAGIVTGKCASDTVSF

SEQ ID NO: 149256 - protein, 39 aa, Heterodera glycines
  Coding regions on vcDNA: vcDNA=SeqID_75679; Strand=+; Position=1 -93,211-237
MRVFNSKALFYGFVPTISVYNDNSCLKLKLILKSQFCCE

SEQ ID NO: 149257 - protein, 64 aa, Heterodera glycines
  Coding regions on vcDNA: vcDNA=SeqID_75680; Strand=-; Position=1 -45,857-888,1799-1916
MSICVDLRLSSADLPGLPSLGTRTKGQEWNRGTELRSAFLLNCTRGVWSTIKWLMMNRKVMMLK

SEQ ID NO: 149258 - protein, 169 aa, Heterodera glycines
  Coding regions on vcDNA: vcDNA=SeqID_75681; Strand=-; Position=1 -183,239-565
MRMNCDDYAHQDSQWRCFVRSATFRIVSQKDGAKDSIGIFCDRAFYNKSTIRGFENFFSFTKLMDPKSGFHNREEDKVTLVIDVIVKNKKTEKFVSDPNKSNWTLSMEIEKLSEFAREVIKSERKSETVRIKGFSWQILAEISEGMESTDNVKCLGIFHSRQFLTNIYN

SEQ ID NO: 149259 - protein, 48 aa, Heterodera glycines
  Coding regions on vcDNA: vcDNA=SeqID_75682; Strand=+; Position=1 -28,296-414
MSKPRNVHKDISNTNEDAVNLGVELCEPNAVIIFYNVEQQTLNEVEVQ

SEQ ID NO: 149260 - protein, 1137 aa, Heterodera glycines
  Coding regions on vcDNA: vcDNA=SeqID_75683; Strand=-; Position=1-3413
  Homolog annotation: Hit_ID=DAA04499.1; Match level="QueryCoverage =70%, HitCoverage=59%, E-value=1e-112, Identity=32%"; Hit description= TPA: pol polyprotein [Schistosoma mansoni]
MSFDHPLRHGHLPIVLVRKPDASYRICVDYRKLNQLTKRSTYYLPRIKSILDEVSGKKYFSVADCSSGFFHIKLAKGHEERSAFICHMGLFEWLRCPFGLAGAPTTFQRAMEEVRQMCSATFLVYLDDCIIGSMTEDEHFRDINTFLRTMTEVGFRLKPEKCRFALGEIRYLGHLISANGVRIDPKDLEPIHKLRKPKNITELRSLIGMLSYFRKFVYGFAEILQPIYELTKNESTTEWGPPHEKALEELKTKLMTAPVLAPPKFGQPFVVETDASIKAIAGCLLQENREGEVHPICYFSRVLTKHEKRYSVVELEALAICASLKNFRPYLEGAGKSTVITDNSALTSLFRRKDLEGRLSRYQLAIMAFDVEIIHRPGKRNQFCDHLSRYLDDNDTQINWLKIEPKISQSEMREAQKQETDTQKRRETLKKDQNSEEPNEFTGKWRITEDLLCAMDRGEWKIYVPSSLRQRVMKEYHSDPFQGGHLGEKRTKDKIRRNLYWEGMEKDIQKFVRTCDACQKRKIIGNQMSSEPICPIVPASQPCERLHLDLMGPLKTAKGGFQYILMIIDSFSKYMTALPLWEQSATTVTTAFVDKFLCQFGIPKIVVTDCGTQFLSSTFESLAKTWGFKHQTTVPYHQSANGQVERFNRTLADMLVTTTGGKDWAAALPMLCFAYNTSINSQINHSPFFVLHGFDPRLPSEMLLEKDGEEYNDMAIYVQELTKRMEEAKSRIRESLKKCANRMIQQQKGTKEVRWTEGMLVLRRRNDKKNKLEPNYEGPFRVIKIEKPNLQIRELDPDGQPFTVHMDQCKPYFTNEEAEQDTESLENEKPKHKNGNKKLGDSKLEESDEEMHDGETIVACISEGNPLGQPKDKEEMETPHQIEIRLDGTNFFAYLSTSNFPATSTISENLIKNDWEIFEDDDKYVIMWIFDENFKLRISNGWDEMFFGTGVRKFLKNSGNLTMEDGKAFYHEQFINEQNQIFAQPIIPDVWITLRDHTPARQTNPFNPFFETIEPQNIQSFSSFNRTFHSISHHTHTINSTNLQQKMSRFDSLLTHSNHSTSKNSSPTPPAILISSDSDSEGESDQQQQQKHNNKFQPRPYAPILTPFSVDQVQVIHPDQVEMYKKDYRLAEEDRQI

SEQ ID NO: 149261 - protein, 112 aa, Heterodera glycines
  Coding regions on vcDNA: vcDNA=SeqID_75684; Strand=-; Position=1 -35,121-199,610-833
VLENQQKEQSKATQKIQNDQKKIVETISALEQNQSRGSWMSFGFAVKQQNKLDGTIRSRKGTYAIDSDGKIWINGKETGINVEYSYGAGDTVGIGVNSVIRQITFTKNGKQL

SEQ ID NO: 149262 - protein, 53 aa, Heterodera glycines
  Coding regions on vcDNA: vcDNA=SeqID_75685; Strand=-; Position=1 -61,155-255
MSISTNSINCGDDFTATENGEVNGAAINLENDGQFDGNNELIADQQQQLKVGE

SEQ ID NO: 149263 - protein, 60 aa, Heterodera glycines
  Coding regions on vcDNA: vcDNA=SeqID_75686; Strand=-; Position=1 -121,522-583
MGDNGDWGLIFNPFLDWGIIGDWGINGDWGIIRANTVIALAYTLTLMLMSSKLLEATHAT

SEQ ID NO: 149264 - protein, 52 aa, Heterodera glycines
  Coding regions on vcDNA: vcDNA=SeqID_75687; Strand=+; Position=1 -25,325-458
MNASVWKIGILSVADKRIISMITCNNLSFGLLSDPTFKAQCKYELKDESDYR

SEQ ID NO: 149265 - protein, 357 aa, Heterodera glycines
  Coding regions on vcDNA: vcDNA=SeqID_75688; Strand=-; Position=1 -11,71-352,405-843,900-1195,1258-1302
  Homolog annotation: Hit_ID=AAL78214.1; Match level="QueryCoverage =50%, HitCoverage=93%, E-value=4e-84, Identity=82%"; Hit description =putative esophageal gland cell protein Hgg-20 [Heterodera glycines]
MGQINLCDDVWLDTLAWINRGEVGMKFALVNARFNTLVDRHFEQRKWCFGEFHICERMTEESGAEIMTSIDGSDFSTLPLPTTPLPDSVVGFQSISIWYINEEVINFLCTIRRLLAEDIALEFSTYFTEYRSWKVMARHIWPLLRDGISTLFLKKCDLAMLRKHVSPTVLFDCAGLHRIHTQMLPECPSADGAVDGENADVDPTCRELYTWVHTQREEGHGPVSLKLNKWKEGKWNDFVNNLFKSFTTAAFPVNYIVISKLPFRFKECGAQMENHQTQERLSMSSRVYKVKNGGGALKTKVAVVRFPMDFGDEQLEAWRRIAKIMDDVPANLVHIGFNDNEIGELPSAAASELRTKS

SEQ ID NO: 149266 - protein, 80 aa, Heterodera glycines
  Coding regions on vcDNA: vcDNA=SeqID_75689; Strand=+; Position=1 -110,254-386
MSGQHQHSLHRQHRQQTDTRAAFACGFGAGRHSRTARAMSSARRRRIVHRKLMTSSLMYLQKGGKCFKVNLESKWPPNGD

SEQ ID NO: 149267 - protein, 238 aa, Heterodera glycines
  Coding regions on vcDNA: vcDNA=SeqID_75690; Strand=+; Position=1 -33,77-204,610-751,793-889,1744-1960,2003-2102
MANLDNYGNDTFYLAFKDVHPSWSLIGFAGIYGIIALIGIIFNFSVIFITIKKNHDKLKKQLYLALLTILCVFYGFCYSASVYQNSKLGDQMTTGSFDFLKNGSLLNTVGFLLVSMTFIIYVCVGIVIRIKASGLPSADSINRRTFRALFFIITVNVGGYWFSAISHLLLIPTISSPITAWFGHAIAAFSGIIGAVSNGPILYFTSTEYRQAFQTEFPFVFRRISNQNQVVPLQNTQL

SEQ ID NO: 149268 - protein, 81 aa, Heterodera glycines
  Coding regions on vcDNA: vcDNA=SeqID_75691; Strand=+; Position=1 -120,164-193,239-314,382-401
SNAIDEIGIDDGLNELEIGESFLLRVPFPLRLPFCHIILTFYAADSQQMMGFCKLGPTGSISRGTIQWRQMIKKLDFLKIG

SEQ ID NO: 149269 - protein, 43 aa, Heterodera glycines
  Coding regions on vcDNA: vcDNA=SeqID_75692; Strand=+; Position=1-129
MSSHLLFSFLVFCSLLISAIFACGGGPALPADPFDPLGPWHQR

SEQ ID NO: 149270 - protein, 67 aa, Heterodera glycines
  Coding regions on vcDNA: vcDNA=SeqID_75693; Strand=+; Position=1 -64,229-368
MPDGLKFVFFKSRSDQCNSGRADHFFCLQLGSNANIQRRLWAGLFEERKWRSGGQNSPRLVQRRTER

SEQ ID NO: 149271 - protein, 424 aa, Heterodera glycines
  Coding regions on vcDNA: vcDNA=SeqID_75694; Strand=+; Position=1-1275
  Homolog annotation: Hit_ID=CAE56511.1; Match level="QueryCoverage =68%, HitCoverage=26%, E-value=7e-13, Identity=25%"; Hit description =Hypothetical protein CBG24231 [Caenorhabditis briggsae]
MAANLLHGEGNITDADVLLVDESTQAQWAVVVHLVARMPKLKALLLTGDRHQLGVHLQELPDIFHSGYGLESVILQAEASIGMNYTFLTKMYRSHPFLAKLISYASYELHNEQLIPARSAEERSLITGSDFLLPVQECPVGLINAFSSFRVDPKSDSLTDDHQTEVASFLVQALLEHFGNDFSSRIIVLCMYTYQTSEIERKLKHCGVRALTVDAYQAQECDVIIIVTTRSKYSEMGSGRTDNMHFFEDDQRATVALSRARHAVFIIGDLVSISAGQVWKRFIEMAITRTSVVRAEYVLALLGRTLVRSSTCLFDSAKRESVEDEGFLESWALKHGLRLDRTNAFGQQQSQQPRAPSFQFQNRHFPALQTTGPSDQAGPSGNGGQQRGAPTLAPQYGRGQGRRGPDNQWMHYGGNPKRQKGGRR

SEQ ID NO: 149272 - protein, 470 aa, Heterodera glycines
  Coding regions on vcDNA: vcDNA=SeqID_75695; Strand=+; Position=1 -1395,1539-1556
  Homolog annotation: Hit_ID=CAE56862.1; Match level="QueryCoverage =39%, HitCoverage=37%, E-value=5e-09, Identity=26%"; Hit description =Hypothetical protein CBG24692 [Caenorhabditis briggsae]
MFPFSGGDPPNRSAAASNNALTDPEGLSNDLPELSVVDKLMFAGKILSTPARLSDVDKLHTDLVRTEDGVNRMTRHLNRKINQTNRDLTELKDDTQTLITQVNTLANSYGTVQVLQNQNQSPLVNNPPVLNWATPSPLRNPNNSFGNANTSVVEAIHSEEEDEEFELNPSGFHHVNMLFAESSPSFTIFSGNSPLEFDRWARKFMDLLDCNGRKWDDSEKVARLKACLDGEPRRIFDNLMPAHKATSSEAIQKIKENLDTPQNKELIYQALSMCKQREGESVDEFSARLIPLIEATTADLTTNASEEVLCRAFLEKLNPNLKFLTRTLSGPVRRDFQILRMNAREAEMMHREIPKSIPAPLFPISEQQNPRFNNTEPPNHPEANFRTWAPTGSNREPISPRQRNRNNWDNNAQASRGSFNRSNNHPQNDRRWNNRTFRNERRWNNQTPQNDRRWNARPVCNYCGKKRPIR

SEQ ID NO: 149273 - protein, 36 aa, Heterodera glycines
  Coding regions on vcDNA: vcDNA=SeqID_75696; Strand=+; Position=1 -82,132-160
MDFIAQNANGFDQKNEYLEIVCFANSFESPNGQYAE

SEQ ID NO: 149274 - protein, 64 aa, Heterodera glycines
  Coding regions on vcDNA: vcDNA=SeqID_75697; Strand=-; Position=1 -39,116-253,541-558
MVFIFFLFIFLAQVCIFWAMFLNMPARGAGIRRRRPRRPDGVNEDNAPRPLQVFSVVREGVEAK

SEQ ID NO: 149275 - protein, 55 aa, Heterodera glycines
  Coding regions on vcDNA: vcDNA=SeqID_75698; Strand=-; Position=1-472
QLFKGSPSLLLFFSISSLNGVITTFVNCFAFNLPIIKIIIGTQIQSYSDYSDFFS

SEQ ID NO: 149276 - protein, 52 aa, Heterodera glycines
  Coding regions on vcDNA: vcDNA=SeqID_75699; Strand=-; Position=1-464
SSSRALQAYCCFFSISSLNGVITTFVNCFAFNLPIIKIIIGTQIQSYSDFFS

SEQ ID NO: 149277 - protein, 38 aa, Heterodera glycines
  Coding regions on vcDNA: vcDNA=SeqID_75700; Strand=-; Position=1 -42,109-184
ALEELHRMQVPPLLNTLSHLTRRQTEWYMFERQVDYRT

SEQ ID NO: 149278 - protein, 68 aa, Heterodera glycines
  Coding regions on vcDNA: vcDNA=SeqID_75701; Strand=+; Position=1 -54,110-262
MPDERVLHLECFKSGDYGMMELYGPDRAKEMLIDLRDYAEAYGMPCQHVKMLLYKMDKGLIKWKGTKP

SEQ ID NO: 149279 - protein, 206 aa, Heterodera glycines
  Coding regions on vcDNA: vcDNA=SeqID_75702; Strand=-; Position=1-620
PPPHPPPPSKRGHRRPPSPPGRAPSPPGSPPPRPQRPPRPTRASRRDGRLEQWEKRRNDIQRRQPVVRDLLAEAAAAPLPESDTDDDYMLESGLALPAPSQYYGDLPVLPYNAQREIEQMDTAQQRIAIRRKLKKDEAYDDDLEHKKYRVHYPPSPPRLPLPPRAKAKIEPPPSRPTAKREPKQQKPTKFELKPSKFDSYLRPKVA

SEQ ID NO: 149280 - protein, 95 aa, Heterodera glycines
  Coding regions on vcDNA: vcDNA=SeqID_75703; Strand=+; Position=1-288
MADAMQDGARWKKAKTAINVLGNLLLAESLDNTSANDTSLKNDTVDIKKEEEANMEEEKVQEEPKEKEENKEDLGDIDKTLDEFFNSIKASTSNM

SEQ ID NO: 149281 - protein, 233 aa, Heterodera glycines
  Coding regions on vcDNA: vcDNA=SeqID_75704; Strand=+; Position=1 -41,2124-2787
  Homolog annotation: Hit_ID=AAS21408.1; Match level="QueryCoverage =95%, HitCoverage=24%, E-value=4e-34, Identity=37%"; Hit description =putative integrase [Oikopleura dioica]
RLIPYVSTVRRMSRVRFPRAKTVAAGFMTDVQVDLADFQALSRHNRGHRYLLVAVDVLSKRLFVVPLKNKRADEMLEAFRQLIDQMQWPHRIFSDKGTEFKNRLLKEFFDEQEIEKHESVHSSVKASVAERAIRNVKQRLYRYFAQKETLNWVDAVQKIVDGINSAPTRVHGMRPIDVDFSNAQKVWKRLYGHPALQKRTPRFRKDEFVRMSREKGQFEKGYLNYGDEILEID

SEQ ID NO: 149282 - protein, 78 aa, Heterodera glycines
  Coding regions on vcDNA: vcDNA=SeqID_75705; Strand=-; Position=1 -51,350-535
MNAQMLAGLKEEFAAYKCKMFLFGGGVAQWAIALENTAGGAQFAARPTANATPTVGERKATNDGGTRGTNASGRDTAD

SEQ ID NO: 149283 - protein, 136 aa, Heterodera glycines
  Coding regions on vcDNA: vcDNA=SeqID_75706; Strand=-; Position=1 -180,401-631
MDINPPKMNGPKDETDNESESRKDGTKEKDGDGPMAKDQPGEVPVQQQHGTGGGGTALAKSEEYAVQMRQLSVKVSSDSNSAPGKGDAMIAMELADYKNALIAARKELADNATKMGEKEAIVEVDKMTNGDGNWWN

SEQ ID NO: 149284 - protein, 133 aa, Heterodera glycines
  misc_feature (3)..(3): Xaa can be any naturally occurring amino acid
  Coding regions on vcDNA: vcDNA=SeqID_75707; Strand=-; Position=1 -111,166-391,484-527
  Homolog annotation: Hit_ID=NP_502791.1; Match level="QueryCoverage =91%, HitCoverage=62%, E-value=2e-46, Identity=77%"; Hit description =ADP-ribosylation factor-like protein (21.3 kD) (4P563) [Caenorhabditis elegans] emb|CAB16514.1| Hypotheti
FIXSLPKFLSSWLTSGQPRFRSMWERYCRGVNAIVFMVDAADKSVDAADKSKLEPAKSELMQLLSKPQLEAIPVLVLGNKKDLPDALDEGQLIDAMNLESIQNREICCYSISCKEKSNIDTLQWLIQHSKTAR

SEQ ID NO: 149285 - protein, 16 aa, Heterodera glycines
  Coding regions on vcDNA: vcDNA=SeqID_75708; Strand=-; Position=1 -6,125-169
MAKTNTPKGDQPTTTQ

SEQ ID NO: 149286 - protein, 287 aa, Heterodera glycines
  Coding regions on vcDNA: vcDNA=SeqID_75709; Strand=+; Position=1-864
MTAVHSFLSSNSPLNVVLGGNRGLENDAVWRHSEILDEREMRRRLFAVSANNNNLLRCMKEENKRREMERPIRSNNFLQNFELRNPNTTAFAQVYPPVHESAPPPNFDRNEGQMQYTQPRVDNNQDPIFVRQIAVHSKLTARHITANPQHHLTMLENEASQGQIWQNDRILAHAIKSLDNFSYSMTLNSLPELKGNSGSDQVRSFFQRFDIATEEWPEAKRLNALRSKSSGRVERALNVAVANNPFQYEFIKRALIHQLESTDARHMSAFDELMNGVFRRNNEAIDD

SEQ ID NO: 149287 - protein, 102 aa, Heterodera glycines
  Coding regions on vcDNA: vcDNA=SeqID_75710; Strand=+; Position=1 -208,1061-1161
MVNRTRISEGGRMEDRCQVREANAIEQNSIQDPTLSHPPISGCFPGQSLHVHSQFRAGSVANRDRGEGPVDLLQSLQLIRLALIRLNFVHVVKNRINIQIMF

SEQ ID NO: 149288 - protein, 55 aa, Heterodera glycines
  Coding regions on vcDNA: vcDNA=SeqID_75711; Strand=+; Position=1 -144,570-593
MTKQRQSHSVRVPMHFAQMFLLFMISTFHAQLVAVDNLNPRLEKLSIKEPEFIPT

SEQ ID NO: 149289 - protein, 33 aa, Heterodera glycines
  Coding regions on vcDNA: vcDNA=SeqID_75712; Strand=+; Position=1 -27,380-454
MLKHLGKMVANSASGGLSNDTKIVGFGWQRKKL

SEQ ID NO: 149290 - protein, 394 aa, Heterodera glycines
  Coding regions on vcDNA: vcDNA=SeqID_75713; Strand=+; Position=1-1183
MPQTETFAILIVGLMQQMRQSLNFLRNLILGWQPWHPGLIPLTNQFRPPSPPRFHNRNWQQTPNQTPSCYYCKKPGHVISECRILAYKNQNRNSQNWTSQPPMFTHSNPNSIPISRPPPYNSGRGNQPHQRGTWRNQQSFHHDQRGAWRNQQPFHHDNRNWNRYPNPNQPYGRGRQINSLNTYDSLPPDSFQNLSMSDNGPHPSFNTLTFSDQVQQPVTASPSQIKEQLVCSGSADKQPNLTDALKSEPKPVSPTPIVTNWEPHPRSSNFSIAPFLTRFNFILCIITLSLSASLVSSSHSQSSLKVLPMVCQTHVEGTIWSLPIWLPCPKLKHTPSDTPIKQPIRLFQPNPFEQKSKAWVCRKVKKSLIEYTNPWNDLIIKQLPSENLPVLLDE

SEQ ID NO: 149291 - protein, 43 aa, Heterodera glycines
  Coding regions on vcDNA: vcDNA=SeqID_75714; Strand=+; Position=1 -45,1121-1204
MQFGRIDNESFTMDVDPFTGHPDETRSRGQQQSSHICSCGAVQ

SEQ ID NO: 149292 - protein, 94 aa, Heterodera glycines
  Coding regions on vcDNA: vcDNA=SeqID_75715; Strand=-; Position=1 -105,167-346
MEIKEKSKNTSTSAVLPLTAEERMKRRQIMRTEVLENVEPFLKMKKKSLEDAQEDERENFRRFKMFETSALQQKAKSEKNGILDAGCYEFMVQD

SEQ ID NO: 149293 - protein, 216 aa, Heterodera glycines
  Coding regions on vcDNA: vcDNA=SeqID_75716; Strand=-; Position=1 -159,203-365,473-801
  Homolog annotation: Hit_ID=XP_312805.1; Match level="QueryCoverage =27%, HitCoverage=51%, E-value=5e-13, Identity=45%"; Hit description =ENSANGP00000016627 [Anopheles gambiae]
MQQNILATRLVQQEREREAVNNFYQQQQQRAVQQNHLVRPLIMVPRLSSQLDLANVLLLHNPESVDDAATLVLNGGSSVTSALAHAANPHHIVANAMATATAPEPQPGPRCAVSPSIIKKNLSTHWLREQERDRCTVCLCDFDTDDELRALNCTHLFHTECIDRWLQYNKKCPVCRVDMDKGGAGSSAMAAEAAVMLNAYAAAAAAASTTSNATSC

SEQ ID NO: 149294 - protein, 120 aa, Heterodera glycines
  Coding regions on vcDNA: vcDNA=SeqID_75717; Strand=-; Position=1 -48,252-412,669-821
MGKNDQTGETEYGLKQIEVNIGQAGGFVNSANITKLHRRTMALAGFDTSKEKMPDNPCDTMLINALIMAWKKFDDKDAIILIVAGKLYRDYEQYQLNYLMENVSKNEIKIVQMSLTEAAE

SEQ ID NO: 149295 - protein, 30 aa, Heterodera glycines
  Coding regions on vcDNA: vcDNA=SeqID_75718; Strand=+; Position=1 -15,59-136
MIHRKFLPYALTALVQKLRVEKPLGTVKMA

SEQ ID NO: 149296 - protein, 187 aa, Heterodera glycines
  Coding regions on vcDNA: vcDNA=SeqID_75719; Strand=-; Position=1 -211,680-938,1273-1366
  Homolog annotation: Hit_ID=NP_949714.1; Match level="QueryCoverage =83%, HitCoverage=82%, E-value=2e-54, Identity=60%"; Hit description =maltose O-acetyltransferase [Rhodopseudomonas palustris CGA009] emb|CAE29819.1| maltose O-acetyltransfera
AWASFFLPTIFVSPPLHIQLDRVGANEFWLARFNAALSLPVTERNKILRERLGHLGEGSSIRPPFFCDHGRNIFLGEDVFLNYNCCVLDVCRVEIGDKSMVGPAVQIYAADHPRDRAVRDQGWEYGRPVSIGRGVWVGGGAVILPGVTVGDGAIIGAYAVVTRDVPEGATVVGNPARQITKKEEQTE

SEQ ID NO: 149297 - protein, 374 aa, Heterodera glycines
  Coding regions on vcDNA: vcDNA=SeqID_75720; Strand=+; Position=1-1125
MTTSSSSSSFYIVLPSNTQVEGNRTNSFRVRLPRKLQFGSQWSVGLAVLLYPHSWPSLGTTEEQFVRVEWQTGEQVRIPVPASNVRNPTQLLNSLHHALGEGSEELASRLRQIQLSYHQLTGEAETSAKKEVERLGSLGLQQQPRNQTKRIDEEKQQQQQKSDEMLNQQQNEQQEEWKRTEFNAHYRRTLDTLVAERMEEAERNLLNKHLPLGLELWVQSYRKARLSCRFSLDVEQQRFRLQIDPVRIKQVELSEQLAYILGFHTRHLSSPMSVARYQPDMKGGVSSFYVYAPGLIEPVIIGDVCVPVLRMVCIRSAQPDDMVEEAYTAVQYHQLITKEIAEIFIEIRTPTGALMPFQYGTCTLTLHFRKTPYF

SEQ ID NO: 149298 - protein, 300 aa, Heterodera glycines
  Coding regions on vcDNA: vcDNA=SeqID_75721; Strand=+; Position=1 -492,1130-1537
MHVDFDPLAVDWSHFAEPPPRMDTMLMSGGGSSMGGGGGGGAAPSYPVFTGLPYQRGAGGIGSMFRSFLRFLVPIGRQAGAAIGRQGLETGSRVLSQMLEGRNVKEAMTEEGRAGLKNLLDKAADNLSRQRSVAAAAATNHGGAGRSGRGGGGGLFDFKRYRKIVEVQNTELYDSGTLYPYKAYLTNELSFPNSAKGHFMASAGYHPSLKHDNPTDAGFLARCARFEGGRKARFLSRLDFDLGNQELYLLNNMDVLFTIYRAKNTFLLQNLAPAPAAGVAARQQYALYLHDIKLYMKVVE

SEQ ID NO: 149299 - protein, 246 aa, Heterodera glycines
  Coding regions on vcDNA: vcDNA=SeqID_75722; Strand=+; Position=1 -79,222-883
MSNLSWMILYEPREGGRMVPHPLFDPATQHANESDDSVADAVISGGGSGVAYTVTEAALLNNTTSTLIGTTSAAAVTSTTAMTAAGARVDGAVQIWSTLFLFANYAIVLPMFLLCWMMVVHWLRRSGLMPPPHQSPSTPQHPHRYGGLHTIFEDTVEQKAGHEKDVRQQKEQRSHTSSAATVNTEAMVREAHRVTSQLAAAIPEPMRSAVTSSVAIPILVSAAQSGGGRKEATQHNSEEEEEKERN

SEQ ID NO: 149300 - protein, 126 aa, Heterodera glycines
  Coding regions on vcDNA: vcDNA=SeqID_75723; Strand=-; Position=1 -132,187-435
MAKKHNKDGNKQNSGSNDDESKGSDSSSESRYDDAMSDTKSHFSRMDKNNPRVCRLLKKNRTASEKEEEERNVREYDQLMGYAYDDLISSLNKEWVRSKVVTTQSTLRNTTTTRMGFSVSQHVSRT

SEQ ID NO: 149301 - protein, 75 aa, Heterodera glycines
  Coding regions on vcDNA: vcDNA=SeqID_75724; Strand=+; Position=1 -122,325-430
MKVHVMIDQILIILVFIGTICDNKPSYCLIINRRILSEKNSFLLVCILNHFFISLMNLFNVKLLMVKKLNVNLCD

SEQ ID NO: 149302 - protein, 62 aa, Heterodera glycines
  Coding regions on vcDNA: vcDNA=SeqID_75725; Strand=-; Position=1-186
MKDYCRERARPDPGKNSPDRTGLALSKDRILDPVSHNPVNPVNPGFSRRTGLPDPENPIPDP

SEQ ID NO: 149303 - protein, 102 aa, Heterodera glycines
  Coding regions on vcDNA: vcDNA=SeqID_75726; Strand=-; Position=1 -174,640-773
MDLNGPTISGPPDDHPHASDGQALAKWLHTPRADGRPKLLNVEAMTGQFHEQIERLKEAFLFASSPVSFAIRLSMHLPGAYVPFAVDNGQTQERLTFCCIDK

SEQ ID NO: 149304 - protein, 19 aa, Heterodera glycines
  Coding regions on vcDNA: vcDNA=SeqID_75727; Strand=-; Position=1-59
MAQQIWPLAASNVCQLSVD

SEQ ID NO: 149305 - protein, 219 aa, Heterodera glycines
  Coding regions on vcDNA: vcDNA=SeqID_75728; Strand=+; Position=1 -54,365-568,617-769,1092-1233,1280-1346
  Homolog annotation: Hit_ID=CAE60244.1; Match level="QueryCoverage =99%, HitCoverage=46%, E-value=1e-52, Identity=48%"; Hit description =Hypothetical protein CBG03817 [Caenorhabditis briggsae]
SDFDKARAYQLDNMQLPFAHKWPHGLGQVAPRSPRIYEFSQIFFNFQIWHSIVFIWVSSVVETLISLPFSYYHTFFIEQKHGFNNETVPFFFKTVPFFFKDRAMKLGVSLALSSPVVALLVWIIRNGGPNFPIYAWLALSLIIFVMMFVYPEFIAPLFDKYSPLPDSELKRKIEALADRVGFPLAKLYVVENSKRSSSKRSSHSNAYMYGFWNNKRIVL

SEQ ID NO: 149306 - protein, 78 aa, Heterodera glycines
  Coding regions on vcDNA: vcDNA=SeqID_75729; Strand=-; Position=1 -60,125-301
NTSSANDNAQSNQQKEQVQKWKVGDQCMALYEVDGQWHSAKIEQISPEENTCTVSYIGSDRKAILKLESIVYVFFYKS

SEQ ID NO: 149307 - protein, 155 aa, Heterodera glycines
  Coding regions on vcDNA: vcDNA=SeqID_75730; Strand=-; Position=1 -191,373-437,487-546,611-762
VVKDAAKEAGKRPKCLDGTNETTTAPATTTATNWLLFGIVAAVVVVVIVAVFVIIWLCRRRKRGSQVLDDTEFGKMYDRSTSKTLNTSSANDNAQSNQQKEQVQKWKVGDQCMALYEVDGQWHSAKIEQISPEENTCTVSYIGSDRKAILKLESI

SEQ ID NO: 149308 - protein, 16 aa, Heterodera glycines
  Coding regions on vcDNA: vcDNA=SeqID_75731; Strand=+; Position=1 -15,306-341
MVNAEVNLSIENINYK

SEQ ID NO: 149309 - protein, 162 aa, Heterodera glycines
  Coding regions on vcDNA: vcDNA=SeqID_75732; Strand=-; Position=1-489
MNLCYLIFLIIFIAFKIESGKIRPNFDEIFGEEWNKNEREEKAIKIEQNETNEKSQAAVDQMGEEMATYPNDQQKREIIRKFETIKEKLRERGKYQRKDRHKIDVKIGRILGAKYYKIKKWKKELNLNKKKMKKSFMRRKSANSLDDLMNLKVYIKANRKNL

SEQ ID NO: 149310 - protein, 172 aa, Heterodera glycines
  Coding regions on vcDNA: vcDNA=SeqID_75733; Strand=+; Position=1 -72,182-398,463-517,609-726,770-826
MLNQRLYSLCRIDSSPKDLKEAERIARLLVCLIVDNDIDDLTTLGKAAQRLVQLRLSVPLLELLKYLRNIKGKDIRTIPNISAFFAKTFEALFDKIDAPATDRKELASLVFFLISCPVEGDGHFARSVSLLASSGANFASSLVAISDNSTGVPFEVNLANESGKMTDLCGGN

SEQ ID NO: 149311 - protein, 60 aa, Heterodera glycines
  Coding regions on vcDNA: vcDNA=SeqID_75734; Strand=+; Position=1 -19,273-436
MAPFGKEAFFAQNSTATANNEKEKSGENCADGPKVATTIEREEAETPKSDDEKETKYLTK

SEQ ID NO: 149312 - protein, 190 aa, Heterodera glycines
  Coding regions on vcDNA: vcDNA=SeqID_75735; Strand=+; Position=1 -500,614-686
MELLLLTNTAVLREIVQCNFYFVGIPSVDESDAIKSAKILSEKIDQFAEKSTEHLVMKRIRLNLAFITMSLEKYFQNYSTFFEALKEKTTKEIDELFRDFGKMAQKFNADGTANILNLESVKPKLLYYFFFSCFYRNLMLRTNLVIVSRARTGLGPDEIGINPRVGRYNGQQTIAELAVLNGKGNGRSNE

SEQ ID NO: 149313 - protein, 269 aa, Heterodera glycines
  Coding regions on vcDNA: vcDNA=SeqID_75736; Strand=+; Position=1 -83,155-370,994-1506
GSGQRGNEQSDEERGADFIGYSPIIPGQRIVDVKMAVDFRRQITKYAFTYKMVMELFEFEYVSKNELENADECAVCLNEFEEEEKFVMIHKNERQQTKPQITLLPLLQAEDEQQYQTECENAFACLIEMAEGNDQNENSFKRSQAKIALDEMTKFVDNMNREAIILFGMEREEISYGERMIGMENGQIVLISRQIPIKESLEIIVRNAPLQALMEMKKESAIKLLNEINCADLKFRNLALQTMQTIEIMTENETEAEEEIMAKRLRLIY

SEQ ID NO: 149314 - protein, 366 aa, Heterodera glycines
  Coding regions on vcDNA: vcDNA=SeqID_75737; Strand=+; Position=1 -44,804-1095,1187-1281,1424-1538,1665-1776,1823-1939,1986-2023,2199 -2368,2418-2452
  Homolog annotation: Hit_ID=CAE60622.1; Match level="QueryCoverage =95%, HitCoverage=20%, E-value=4e-74, Identity=40%"; Hit description =Hypothetical protein CBG04265 [Caenorhabditis briggsae]
SNFQIFPRRRLSAPPLANGTSAESEVQSNNGTKRTECSANEHFDVCPETGRECEPSCDWTAFPDSIPSCAPRGEQCGLPRCVCAEGFVRLSNQHDECKPFSFCQAPEVDAATCCAANEVEKCGRACEPSCHMYSEEPCGEACEAPGCTCDDNFVRLSARGGPCVAWTDCPSECRFPTLSPRYSSTLTTEEETTELELFTATENAAEPPEVGQCDSNETVNECGRVCVNECGRVCETDCVSIFEREECHGCAAPACSCRQGETRENNGKCVYWGDCPTENGKCVYWGDCPTERALSSPTKGTANGAKSVETSAEETPLDLCGGEWAWPIGCAECAYRLRWDYDEKMNSVVFLLDTRNSVVFLLDTRP

SEQ ID NO: 149315 - protein, 43 aa, Heterodera glycines
  Coding regions on vcDNA: vcDNA=SeqID_75738; Strand=-; Position=1 -58,204-277
MSVRKCPSANVRPQMSVRKCNREPLGLSNDIKNEKFGCFRAKL

SEQ ID NO: 149316 - protein, 105 aa, Heterodera glycines
  Coding regions on vcDNA: vcDNA=SeqID_75739; Strand=+; Position=1 -193,415-503,553-586
  Homolog annotation: Hit_ID=NP_502865.1; Match level="QueryCoverage =100%, HitCoverage=16%, E-value=5e-33, Identity=62%"; Hit description= receptor nicotinic family member (4Q273) [Caenorhabditis elegans] emb|CAB60559.1| Hypothetical protein Y
MNHSMPTRVNFTMRRAIGEQSEINANLSLYQVLAINEKVQSVDLNLWIIQKWKDEFLGWDPHKYGGINATILPYHRIWLPDTYLYNSMVMNRDESERYINVIVST

SEQ ID NO: 149317 - protein, 231 aa, Heterodera glycines
  Coding regions on vcDNA: vcDNA=SeqID_75740; Strand=+; Position=1 -44,113-421,643-982
MAKGQIGIDQSSDEKKMVPKRNLTAGNLLQKRRISSGGGGNSKKWKKPWTAKGIDEEMAEPNLGESAGEWAMLERSIEEEDEESEAATEWRSANPNSGLNEERAANARQNWRRIAQKADRRTDWLMKCFPRDSDRDALERAQPTNSAGGRIPERESEEIPFADLSPGRLSLASPARHFSPSSPHGISSSVLSPRLLPSLPNASSSLTAAASATDRPRHPPNASSSSVPKAP

SEQ ID NO: 149318 - protein, 360 aa, Heterodera glycines
  Coding regions on vcDNA: vcDNA=SeqID_75741; Strand=+; Position=1 -448,979-1247,1885-2113,2335-2471
MNSNKSEKANTVLVEAAKKETERAWRDVEALAEEVGDFAKSSRETLNRAIKSREKAPNANGVRELYLKMSDSIWEIFTILDQINLESEKAESTWRDFERCKTFDQATKLEEQSQNSLIEARRLHFESRRVQSQMLNYENRLQTIVWEHMAFSAAEIENLYFSFLEMLDKIQKLPNFILHEYRNQALAMQKLEIGLREINIFKCQEAENLSDLSFSKIDEFRKRVQNYRFDTRMLYNKIRTFAQKHSGQLSKIINSQLSNTSKRNSSATGDYFCFNHLSFNISTYGIGFASREYASNEFIGWSHDSIGWDSMGDIQGIDEVCVEPGRFAAFPTVSMIGEGSSAGVNMGPIFMFNLKKLFMP

SEQ ID NO: 149319 - protein, 316 aa, Heterodera glycines
  Coding regions on vcDNA: vcDNA=SeqID_75742; Strand=-; Position=1 -81,335-1204
  Homolog annotation: Hit_ID=AAC95573.1; Match level="QueryCoverage =92%, HitCoverage=45%, E-value=7e-41, Identity=29%"; Hit description =orf 48 [Ateline herpesvirus 3] pir||T42963 hypothetical protein 48 - ateline herpesvirus 3 (strain 73) ref
MKSWVLWIFVSWYKARKQGMVPGFWKGSKSAIYSYDRAWCESLGKKKEQDRQEEEAEEQGEEEEEEEHRPEQERQEQERPEEERPEQERQEQERPEEERPEQERQEQERPEEERPEQERQEQERPEEERPEQERPEGERPEQERQEQERPEEERPEQERPEGERPEGERPEQERPEGERPEEEDRPEGELPEGERPEGERQEKQRQEDGEEEDGDDDDDDDDDNEDGAVQCKVILRRGGEGDDDDSAGGNSGGNGAKDGGGGDGEKKGNDGKKQEERGGGGEKANEQYKNGSTETAGKASEPYEEAKVQTILSDKK

SEQ ID NO: 149320 - protein, 87 aa, Heterodera glycines
  Coding regions on vcDNA: vcDNA=SeqID_75743; Strand=+; Position=1 -86,443-612,1182-1189
MHQLLTIPMPFIEHFLHRLGTFVERSPVGNLDESVKTADWDFIKTIQLVVSMENDGQKLVAQKRQKAIGPDVSIDCFKLLYSLAIPN

SEQ ID NO: 149321 - protein, 83 aa, Heterodera glycines
  Coding regions on vcDNA: vcDNA=SeqID_75744; Strand=-; Position=1 -10,57-200,519-616
MSKVPTLTLIKILNFRIRAEKEDGKANFRAQQMSIQRGNFDGGGTETDGGKGSPKGAPTFAAQTFVPMSKIGLKVEFFQALSD

SEQ ID NO: 149322 - protein, 59 aa, Heterodera glycines
  Coding regions on vcDNA: vcDNA=SeqID_75745; Strand=-; Position=1-177
MPQNVMAVDTLYDAASDSSAALQKAAQCQKSGTVVVVASTKPVEESEEANANEMDMATT

SEQ ID NO: 149323 - protein, 95 aa, Heterodera glycines
  Coding regions on vcDNA: vcDNA=SeqID_75746; Strand=-; Position=1 -203,934-1018
MLTAFMKGHQETQLSEYSKQKCEAHLGILYYMKNNWQCDKIDQKFVESERTECQNIASLETETLEQHYRLIEPVKSFRMISRLFDSVNNFKSYID

SEQ ID NO: 149324 - protein, 398 aa, Heterodera glycines
  Coding regions on vcDNA: vcDNA=SeqID_75747; Strand=+; Position=1-1223
  Homolog annotation: Hit_ID=NP_498506.1; Match level="QueryCoverage =96%, HitCoverage=64%, E-value=7e-55, Identity=34%"; Hit description =RNA-directed DNA polymerase family member (3I9) [Caenorhabditis elegans] gb|AAA21080.1| Hypothetical prot
NLLPNCQHGFRKAHSVTTQLFEVVVDEFSFALENRKSIDVIYFDLAKAFDTVPHNRLISKLKSIGINNSLLKWIQNYLENRKFFVKSGSDFSDEYPCLSGVPQGSILGPLLFLIYIYDLPKFCETDVKIKLFADDLKAYHVLSNISFSPLQNFINKFNQYCKFNGLKIASNKCLTLHLGHKNQKINYFIDDFQIPKNRKRTSQRDLGIYFTNDLKWAQHIDIISKKALRSAFAILKSIKTRDTKILVNLFNIYCRPILEFGSPIFNPYLKKDIEKSENVQKLFRVIFRRNNYTVANYAELLNIYDQKSLESRRLKIDLKLFHETIFGKINLQNNESFSFSKNPVKNEFIIRTAYCSTKLVLYSNLSSRLLPKETRLLNPNEFAKLLERSDLNLLISLP

SEQ ID NO: 149325 - protein, 147 aa, Heterodera glycines
  Coding regions on vcDNA: vcDNA=SeqID_75748; Strand=-; Position=1 -282,500-658
MGRTKCVESSLVLRGSGKGGRGTKDARGVQQTQQTKTGFDGRSEAPMRKTATAFRQPVTLVHTTSRRSHKAPERKQTNNTAKEESIEKAEKGRQVPSMSEDAAAATFCSSLHTFELNGSEIVGQQATRKQIEENPFDTLKFVQPFVQ

SEQ ID NO: 149326 - protein, 60 aa, Heterodera glycines
  Coding regions on vcDNA: vcDNA=SeqID_75749; Strand=-; Position=1 -31,700-851
MEERIKTELRVEAEISDEEEEEGAEDALEDEDDSEEEEEGVDTDDEAALAYLNSSKALNV

SEQ ID NO: 149327 - protein, 267 aa, Heterodera glycines
  Coding regions on vcDNA: vcDNA=SeqID_75750; Strand=+; Position=1 -144,298-555,644-853,1072-1263
  Homolog annotation: Hit_ID=NP_492677.1; Match level="QueryCoverage =99%, HitCoverage=49%, E-value=9e-43, Identity=40%"; Hit description =ribonucleoprotein (49.3 kD) (1K746) [Caenorhabditis elegans] emb|CAB02757.1| Hypothetical protein C25A1.4
MAVCEYSHPMQAVQAVSMLNNQRLFDRTISVRMDRYPKEVERREGGLPFGLRAVGMGLGANGAPLTDVASVISSISPSQTQPGMNGTAGAPITPFQSPPNVAQFGPVAAQPVAAGPPSGFQQGLPDHGISGHFQSPQPTYQPQATSGFFNPPQPSPQNRPSGGMAFGGGGATPQYAPTKQMGVVGGGTASAAVYGHPPQQQTQKLPVDYTWQIVSDRVQQFGDLESVEMITPGVAKVRFVKLRDAEHAKAALQGTTVEGRAIGIEYL

SEQ ID NO: 149328 - protein, 193 aa, Heterodera glycines
  Coding regions on vcDNA: vcDNA=SeqID_75751; Strand=-; Position=1 -97,188-270,319-435,878-1009,1075-1227
  Homolog annotation: Hit_ID=NP_497062.1; Match level="QueryCoverage =92%, HitCoverage=11%, E-value=5e-40, Identity=43%"; Hit description =DEAD/DEAH box helicase and Sec63 domain and helicase, C-terminal (2P63) [Caenorhabditis elegans] emb|CAA2
MAQYVEMFHRQAPIESQFQRRILNNLNAEIARGAISNIKEAVEWIRFSYFYIRLRKNPLMYGVEWRELRREPTLVSFLNDFCHSAARRLDLNRMIRYDPHFYITFETVELINAESGPVRFTELMTDEMIISLIAASSEFAQIKNRDSEMTDLDELASFGAALKIRGGLATTAGKVNCLLQVCATNAISEAFVN

SEQ ID NO: 149329 - protein, 153 aa, Heterodera glycines
  Coding regions on vcDNA: vcDNA=SeqID_75752; Strand=-; Position=1 -123,607-768,891-1067
  Homolog annotation: Hit_ID=NP_497062.1; Match level="QueryCoverage =95%, HitCoverage=55%, E-value=7e-54, Identity=53%"; Hit description =DEAD/DEAH box helicase and Sec63 domain and helicase, C-terminal (2P63) [Caenorhabditis elegans] emb|CAA2
MKALASEMTTNFANRLAKLGLKVRELTGDSQLSRREISETQMLVLTPEKWDVITRKADDEELSQLVRLMIIDEVHLLHDERGPVIESIVARTLRQVELYHQNLRIVGLSATLPNYEDVAQFLRVDPTRGLFHFDARFRPRPLAQRWRPAPQKN

SEQ ID NO: 149330 - protein, 187 aa, Heterodera glycines
  Coding regions on vcDNA: vcDNA=SeqID_75753; Strand=+; Position=1-564
MPSLNKLTFYESEMVLVNVFCAQLLDCPVKSLRDRLNHPEDRVNAMNGLMGKKVRTTYKDRNGMHKTYFVGGITERGAAFVPAYGNLRAPYNVNVAAYFYARHRIKLHFPYVPCVIERFSGRAEDRFYPMELLGIVDDENKGRLFGRMFMEIGEEADDDDNDEDVSTSFDSTLRFDMGRDECSQLWR

SEQ ID NO: 149331 - protein, 374 aa, Heterodera glycines
  Coding regions on vcDNA: vcDNA=SeqID_75754; Strand=-; Position=1 -299,344-744,791-890,1176-1497
  Homolog annotation: Hit_ID=NP_507780.1; Match level="QueryCoverage =63%, HitCoverage=15%, E-value=1e-21, Identity=31%"; Hit description =predicted CDS, DNA polymerase type B, organellar and viral family member (5T899) [Caenorhabditis elegans]
MYEMKVKKQKNRNPNIVFHDSFNLMPCALAQLVPSYGLDVEDKPFFPHLANRPENYGKHIYPTPDDYLANGMMPEKRRQFDHWYEQHREEPFQLDEALASYCTNDVEILMAALVAFRREFFDVSKRNEYVDGIDHRENHDGIDVLRECMTVAGACMKHFRLNHLPAEHLAIVPEKGYDNTQNQSKLALRFLFWYAEENNVQVQTAYSPDGEKKIANYTVNGWIEAEGRVIEINGCVWHGCRKCSPSDNMMLPNGKTAGEQRERDAKRFTTRYPVGHPKVHVLNEDVNWTSPADNNFPLALIKCWVIPPRKCTIPVLPVKVGERLCFPLCMKCAKDYPTGGVDDEYHCRHNDQQRGWVSTSTSIELNAALEEGYR

SEQ ID NO: 149332 - protein, 108 aa, Heterodera glycines
  Coding regions on vcDNA: vcDNA=SeqID_75755; Strand=+; Position=1 -45,99-266,636-732
  Homolog annotation: Hit_ID=CAE59379.1; Match level="QueryCoverage =90%, HitCoverage=61%, E-value=5e-29, Identity=57%"; Hit description =Hypothetical protein CBG02732 [Caenorhabditis briggsae]
CGIGGSGTPIDGIDMCCKLHCCKLHDQCYDLAVDRGLCYDTYVEYADPYSWTCQQGEPNCSQKQFGCKAALCECDKNVVNCWSKFKVPSKREKCTKTKVNRTYETVSY

SEQ ID NO: 149333 - protein, 41 aa, Heterodera glycines
  Coding regions on vcDNA: vcDNA=SeqID_75756; Strand=+; Position=1 -27,145-243
MPAVVMREKVIFGISSADESRNSKEEIQLINNWGRRLGDDQ

SEQ ID NO: 149334 - protein, 108 aa, Heterodera glycines
  Coding regions on vcDNA: vcDNA=SeqID_75757; Strand=+; Position=1 -63,1227-1490
MSSRHHWRAAAFHPFTAQLERCHCCNGWLPLNAVVPASDQLHCMSLASDLPVSPFSSATDQPFFIHPTKGAYGTSILFNNHSDQMAPIPDHSTMLDPSEATSFINQPL

SEQ ID NO: 149335 - protein, 15 aa, Heterodera glycines
  Coding regions on vcDNA: vcDNA=SeqID_75758; Strand=+; Position=1 -22,248-273
MNTFGKGFRNQMRIS

SEQ ID NO: 149336 - protein, 26 aa, Heterodera glycines
  Coding regions on vcDNA: vcDNA=SeqID_75759; Strand=-; Position=1 -12,552-620
MTAMPYYEEMAKVCRKRCHLCDKAIP

SEQ ID NO: 149337 - protein, 197 aa, Heterodera glycines
  Coding regions on vcDNA: vcDNA=SeqID_75760; Strand=-; Position=1-591
  Homolog annotation: Hit_ID=DAA01153.1; Match level="QueryCoverage =85%, HitCoverage=9%, E-value=2e-30, Identity=45%"; Hit description =TPA: RTl1 [Mus musculus] ref|NP_908998.1| retrotransposon-like 1 [Mus musculus]
MLRVKLWQIIALSLALFLAGIQKRWAVQAQDDQQDEEETDPGGEDTDGNENGDDQQGEEGDGATEDDGGGDEDDQATDDEGTEAEGDEDEGADEETETEGEEENDQVEEDEGGDETEDGNNAEDEEEGEEERKDEEEGEDEGEEEEEEEEGKGQRKRKRKEEGEEEDEEEEGEEEEGEGQRKRQRGNESTLELLRCQ

SEQ ID NO: 149338 - protein, 1219 aa, Heterodera glycines
  Coding regions on vcDNA: vcDNA=SeqID_75761; Strand=-; Position=1-3660
  Homolog annotation: Hit_ID=AAA59875.1; Match level="QueryCoverage =23%, HitCoverage=67%, E-value=2e-29, Identity=36%"; Hit description =mucin
MNRVSETRWESLAPIRKEYGWYGVNCFNNVQTVIEEGKAGILDGKRLITSWGDSLKVDKSLGEDGSWIRLPGAVELLMWKIPSDEFWHSHFVIGPVITEIWPKKAVIVDELQYTFPISRNQERKFPVFGVPDDALKTDNNVFVHVIGKVNSTKRARQRRETVSLKPGQRKPNVPRIEPTRRPNLRRGQIAEIAMTTRPTITTTNIPPTIRPVSTTHIPSIIPTIATHTPPTTRPITTTHIPPTIRPIATTNIPPTIRPITTTNIPPTIRPIATTNIPPTIRPITTTNIPPTIRPIATTNIPPTIRPITTTHIPPTTRPIATTHIPPTIRPITTTNIPTTIRPTSTIHSPIIIKPTTTIPTTTIQTPTKLISTTATPNTVSPHTTKSADDTAPTTASYHSILDELRGLAEEADEEGILISPTIKVTPTPFVLPNEPNEESPTTVVTKREIPDDDESEKLWKEENLDHENSRLNYLGWKTHRTNIQNAREKWMSDCHERNNALSIAKALARQMPEDAARSLYKRDDITAFWTRSSQLDQKWSIALCKQLKAEDVLWDQKIGKKCFRELPVLVARRTLFVKPGTRDLSYNGTETHCDEQGNNPWAADFNNNDTELQQANSKHRFVSKQQTNFQNPLIFFTRGSIFESEQARLEQNLKELTRRITRPELNFPDIGTVDINQTEIHGSTVTDIFSIGEILVEKMQKEGESFRKKAEETIEKGKAWMEDPIGIIKYIKWILITIAIILIVIGCTVLLWKIKIYSTLFLAPIHLLQSLLNTIMNCFNSGRRLAEQVRYPIVMEVELQDRAKPSAPPEEPLLDQKAYVLNYLPNICQIEQTRRKKKRCYVNFFMNGVKTKALFDTGADITYIGHSTAQRCFMMVRKGDYPQARAANSTPIRFIGSALANIKLGDFEGKFPILVSEDDSCPCTAIIGTDLMDFISEQGEEEIGLNFKRGLVRVGNTQLPMIAAVSIEKQPIEVQLIETQTLPPLSDSLVWGKINRSLGPDEVFITVEREHDYFPLRVGKCLTSPGSTRIVPLRLLNFGNSVIKVYEGSRLAWLETIADGTEINALKEDEKENPEMIMTDEEWMKFKLESDKISPEADWTDQTLEFPKKEEAVAPILERIRLNDTILSRDGIEKLKNIIRQNENAFVKPGEVGLFKGQTIHRIDLIDGARPVQQRPYRYPVALQPEIERQVKELLRQNVIRPSTSAWSSPQSCTAVNPR

SEQ ID NO: 149339 - protein, 393 aa, Heterodera glycines
  Coding regions on vcDNA: vcDNA=SeqID_75762; Strand=-; Position=1 -82,1133-1926,1982-2285
MDKDKDNKDKIEPKGRSDHPNRPCHSAEEEGLNEGQTERDKRLWLIHQKRQLRNMDLDALRRRIVTLEQEMRENGGTRSGLPMPTTFDGTTDLQDYLKSFNLIATAHNWTPARCVQVLPLFLRGSARAIYESIEPDIKDNWRSLIDAMADKLKQMSPSLTARQKLAQRKQQTGESLEEFAQAIRNLVLRAYPDNSLEMDFGNLVLGALENDVKHANEARLRQFRSEIARDFFRANMAPRLKERVMYMEEPQTLEEAVAQARRVEQVQGNLADDMWKNTQDAKAEVALAEVNADEINENGKIKAILGEETTPKDKINLIFGEAIPNFGQFAEGISRQGDSQDTPGDSTHTEEDLIRAALTSHRLATTSKEQTTMAIFNRTSTKIKIGHEGRGPT

SEQ ID NO: 149340 - protein, 103 aa, Heterodera glycines
  Coding regions on vcDNA: vcDNA=SeqID_75763; Strand=+; Position=1-350
IESLELWRVSCAGRNCSRRCFGFEEWENPVFCADSIPFCTSGVAWPIWMIASSFGLNFVLIVLVLVHLAVVRVRRVFPFASFGVCDQCQRRVSVLSSRIVSSM

SEQ ID NO: 149341 - protein, 760 aa, Heterodera glycines
  Coding regions on vcDNA: vcDNA=SeqID_75764; Strand=-; Position=1-2282
  Homolog annotation: Hit_ID=EAL50634.1; Match level="QueryCoverage =65%, HitCoverage=79%, E-value=4e-41, Identity=34%"; Hit description =hypothetical protein 19.t00007 [Entamoeba histolytica HM-1:IMSS]
MDQCKPYFTNEEAEQDTEALENEKPKHKNENKKLGDSKLEESDEVMHDGETIVACISEGNPLDQPKDKEEMETPHQIEIRLDGTNFFAYLSTSNFPETSTISENLIKNDWEIFEDDDKYVIMWIFDENFKLRISNGWDEMFFGTGVREFLKNSGNLTMEDGKAFYHEQFIDEQNQIFAQPIIPDVWITLRDHTPARQTNPFNPFFETIEPQNIQSFSSFNRIFHSISHHTHTINSTNLQQKMSRFDSLLTHSNHSTSKNSSPTPPAILISSDSDSEGESDEQQQQQQKRDNKSEPRPYAPILTPFSVDQVQVIHPDQVEMYKKDYRLAEIDRQIQLMMDAKAKIQAEEEEEEQIKERRARSEKAKQERKKEEKEQMKAKSEAKRKEAEEKAKAKAKAEKEEWKRALRRPAATPEEKARKEAENEARKEAEEAARKELEEEARKEAEEKARKEAEEKAAKEADEKAQKEAEEKAKKDEEEKKKSEKQQQNVEKRAEEKGEKTMIARGIKKRRLTEEEKEKKQNMEKMEEVHREIREIVKQAEEDAKKREIREKIEKLTAKLNREEDGKRGEKDIAALEREREAFENPPAPPKDRMPFYSSTVARFECQSDLDSAPKPREEKSDRERSSLGTSGKRLFRNTLKSAVQAVHEKPCIPPEGLGLRRRESATEEAPRGRRPTPTPGQRQLERSPIRKNNSYLKRALALEKPEETIYKIRKLLLEAADRLSELADLLYPYEGGQKTKKDEKETVEENLGMGCSSSF

SEQ ID NO: 149342 - protein, 103 aa, Heterodera glycines
  Coding regions on vcDNA: vcDNA=SeqID_75765; Strand=+; Position=1 -87,156-249,297-425
MSSSSKPRNSMGRMKHLLSSAEDADVHFLLLHAHKLILKHASEVFEAMFRFDAQKVKTENASAEGVVEVPDVEAAAFRVMLAFIYADDLSELNGENAMAVLYA

SEQ ID NO: 149343 - protein, 43 aa, Heterodera glycines
  Coding regions on vcDNA: vcDNA=SeqID_75766; Strand=+; Position=1 -75,855-911
MEMQQNESLVIVNSDGEEEEEFTDVTNRASEGLSNDIKILGFG

SEQ ID NO: 149344 - protein, 174 aa, Heterodera glycines
  Coding regions on vcDNA: vcDNA=SeqID_75767; Strand=-; Position=1 -7,822-1158,1471-1651
MLIFSPDSSDESEDDEHHNHHHDNHHLLRTKTNLSNYNFLQSCEDNFFRSFDATKIADNFCHDSDSSLSLSSAATEEEDSEEYNSQQSDSEEDSSKTTSSSIDGSTTTFKLKSILSTSAKRSPTAEKHAYERRVSFADRWGMQLTSFRTIPNRFADRFYDELELDFNEGGSINY

SEQ ID NO: 149345 - protein, 141 aa, Heterodera glycines
  Coding regions on vcDNA: vcDNA=SeqID_75768; Strand=+; Position=1 -146,792-1073
EKDIKATEVALVTLMANIHKQICIQFDKNAFPVEEIAKITVEKVNDMLEKCHQIVNIRREKAENTQAQAQNTSKKSKMSGISKIFGGNSKIKKKLANLTDELKSLEQKEQQLFREIKSAAETTQFDWRHLELPCTKVTTKI

SEQ ID NO: 149346 - protein, 42 aa, Heterodera glycines
  Coding regions on vcDNA: vcDNA=SeqID_75769; Strand=+; Position=1 -54,323-397
MSFKKDIYKLPTCFSIPNKLFDQIKTLSITITLKKNASTRKY

SEQ ID NO: 149347 - protein, 102 aa, Heterodera glycines
  Coding regions on vcDNA: vcDNA=SeqID_75770; Strand=+; Position=1 -148,245-405
MKIGILLLPCLLMIKNTVDQTVSVKIKQSKGFDQIFGEGWEKNVEVNGMGQFDQNLEVKEESASECDQMEQMSEDSGQISDHFSSEIEQIKRKFTNGRENFD

SEQ ID NO: 149348 - protein, 153 aa, Heterodera glycines
  Coding regions on vcDNA: vcDNA=SeqID_75771; Strand=+; Position=1 -289,359-531
MPKIIAKNLGINIRSIYNWKKEIKSGTFIKFQKIDDEKREIVEKYLKIKKEFMQNGKHSQKEWEEFNAKIKQMFGVILQTIEKWAKKLGNKQNAKKEQKILTIAEKREMMKQYHQMKKQNPKLTERQIVANLEISPSSFYKYKSELMGEAKKF

SEQ ID NO: 149349 - protein, 218 aa, Heterodera glycines
  Coding regions on vcDNA: vcDNA=SeqID_75772; Strand=-; Position=1 -171,742-902,1101-1259,1334-1499
MLLLYFRISSDYAFLKDAHREVLNSERKSIIQSLIRRLDDLYNNGFQQPVTMFCQRAVEVNTGAVGSFATSPRFSQLHRRMIANAGLDASETVTPVDQSDKMYAETLYYSWQQFGNDQAVILFVHGSLYSHLMLESRQIVNTLEEITSRKIKNRFITLKEAFSRLKIDPVDKSLIFDDKYVVAVLVDRIGREISDAELALCVEFERSTAIVKMGIYIF

SEQ ID NO: 149350 - protein, 45 aa, Heterodera glycines
  Coding regions on vcDNA: vcDNA=SeqID_75773; Strand=-; Position=1 -40,108-205
MHIKFGKGLNGGGDSFFRRDFSKNFWELMGGGGSGGADRRRREKF

SEQ ID NO: 149351 - protein, 50 aa, Heterodera glycines
  Coding regions on vcDNA: vcDNA=SeqID_75774; Strand=+; Position=1-153
RNYKAESHVWYSITCRDGADSDFRFMGLEFRFSKDWGLGTPSLLTCIGQN

SEQ ID NO: 149352 - protein, 142 aa, Heterodera glycines
  Coding regions on vcDNA: vcDNA=SeqID_75775; Strand=-; Position=1 -73,124-336,1266-1408
  Homolog annotation: Hit_ID=AAK13420.1; Match level="QueryCoverage =81%, HitCoverage=13%, E-value=5e-22, Identity=43%"; Hit description =metabotropic GABA-B receptor subtype 1 [Drosophila melanogaster]
MRLEDVMLMPILELCQSNRHEMWTVIVLGHKGLLLLLGLFLAYETRQLKPRYLSDLRSTILSVCNVGVLCLLTGPIIAFFLRNQQNPFFGFVSVTVLTCLFASLGLVIVPKLLFIYHWPPIYQGGATAKHAAPIVGGVSAEP

SEQ ID NO: 149353 - protein, 29 aa, Heterodera glycines
  Coding regions on vcDNA: vcDNA=SeqID_75776; Strand=-; Position=1-91
SIVKSIQGSKFGYKNQLTQNPLINAKKNP

SEQ ID NO: 149354 - protein, 254 aa, Heterodera glycines
  Coding regions on vcDNA: vcDNA=SeqID_75777; Strand=+; Position=1 -20,147-254,685-794,1034-1119,1165-1300,1591-1822
  Homolog annotation: Hit_ID=CAE59896.1; Match level="QueryCoverage =95%, HitCoverage=34%, E-value=2e-63, Identity=53%"; Hit description =Hypothetical protein CBG03380 [Caenorhabditis briggsae]
VACEQIGIRVLDTRHEATAVFAADAAARLRQDIGVAAVTAGPGITNTVTALKNAQMAESPVLLLGGASPSLLKGRGALQDIDQQTLVRSLCKFSARVTCVRNIVPTIRNAIATAKSGTPGPVFVELPIDPTIRNAIATAKSGTPGPVFVELPIDVLYPYKSVEREAGLSNAPKKGLVKLLDAYVRTHIANTFSDAWQPEQPLLPLPVRVPRPTTAQIEQLANLVSSARAGMRRMIIPFFPSDFEFREFLEAYMK

SEQ ID NO: 149355 - protein, 95 aa, Heterodera glycines
  Coding regions on vcDNA: vcDNA=SeqID_75778; Strand=-; Position=1-290
  Homolog annotation: Hit_ID=CAE71944.1; Match level="QueryCoverage =98%, HitCoverage=20%, E-value=5e-23, Identity=52%"; Hit description =Hypothetical protein CBG19011 [Caenorhabditis briggsae]
GYEAYQCRGRCAHPLPAKLNTTNHAIVQSLIHSIDPHSVSAPSCVPVQVIPAQNMLEVLPFSLQMSAISILYKDINNVIVVKTYADMRVDSCGCH

SEQ ID NO: 149356 - protein, 122 aa, Heterodera glycines
  Coding regions on vcDNA: vcDNA=SeqID_75779; Strand=+; Position=1 -123,233-331,383-489,541-725
TEIRIPSTAMSSFSFPWATFLFFSLISCLISLTEANPKFLLSCKVIDGICQNDELCLEEMGIRFPDCYLERKIDFLQPQKSALKSTPFTEGANGPQRFLKRTPAMKLMKVLMMKDRIPVGRR

SEQ ID NO: 149357 - protein, 92 aa, Heterodera glycines
  Coding regions on vcDNA: vcDNA=SeqID_75780; Strand=-; Position=1-279
MHAFEIDERTFQDLKLDDEAEDDAATGGAQNVQSSSATTTTTGKVVVFDAELFQDEAGMVDDDDDDLLQSNSSTDDDGGDQHDDDQGGDGQK

SEQ ID NO: 149358 - protein, 199 aa, Heterodera glycines
  Coding regions on vcDNA: vcDNA=SeqID_75781; Strand=-; Position=1 -98,265-362,512-631,962-1022,1073-1175,1334-1453
  Homolog annotation: Hit_ID=CAG00335.1; Match level="QueryCoverage =73%, HitCoverage=40%, E-value=1e-50, Identity=62%"; Hit description =unnamed protein product [Tetraodon nigroviridis]
MYRLVHFIWFLLLDVDPKSVLCVFFKQGLCTKGNKCKFSHDLSIQQKTMKKNLYVDSRDLGDKKDETNENWDEKTLQDVAEKKHGEKDRKRPNQTDILCKYFLEAVENSKYGWFWECPNGDTCIYRHALPPGYILKKDKKKMEEQNRLTRITLEEFIETEKKTGVARSPDICGPTFAVQTFAAMSKIGFKVVFFQALIA

SEQ ID NO: 149359 - protein, 225 aa, Heterodera glycines
  Coding regions on vcDNA: vcDNA=SeqID_75782; Strand=+; Position=1 -84,159-249,726-805,1170-1253,1296-1371,1669-1851,1896-1976
  Homolog annotation: Hit_ID=CAC80545.1; Match level="QueryCoverage =99%, HitCoverage=22%, E-value=4e-71, Identity=60%"; Hit description =putative Na-K-Cl cotransporter [Meloidogyne incognita]
WIVQDGGILMLIAYLLQQHKVWKGCKLRIYVIAQEGEQNEEMKHRLQRHIYMLRIDATKNLSALSNGGLSNGGFTPDERFRSGTNSPNGNTLAVPNTVCRPPRDSVIETSFIQKTFQEENNDTVSSNEISIKDIDDTKVQKMNAAVRLNQVNFLIIFFHISTNFAQVILEYSSESQLVLLSLPKPPKSIQALVENYLSYVEALTEGLPRVLLIGGSGKEVITADS

SEQ ID NO: 149360 - protein, 125 aa, Heterodera glycines
  Coding regions on vcDNA: vcDNA=SeqID_75783; Strand=-; Position=1 -119,482-578,627-674,1061-1126,1321-1368
  Homolog annotation: Hit_ID=AAR11446.1; Match level="QueryCoverage =100%, HitCoverage=28%, E-value=7e-51, Identity=65%"; Hit description= matrix metalloproteinase [Heterodera glycines] gb|AAR11445.1| matrix metalloproteinase [Heterodera glycin
FFPDGPEKVDVAFSSGRLTVLVKSRMLFGYEFDQKTAQFTRDHRYPRELHSRILFYPEGAFPIVNGSVILFKDDVFATYNVESNTPHLHFCTMFAWHEQSAHKALANLLAPPGPPMPHLFFPYQP

SEQ ID NO: 149361 - protein, 187 aa, Heterodera glycines
  Coding regions on vcDNA: vcDNA=SeqID_75784; Strand=-; Position=1 -384,444-623
MHVAFSFVFRCRQEHHPKCNIFGRNCVGCVYLYTSQKCDVVEVRCSCYYCCDPQYAATCPDGCKNCIKDGEGGCSQKSADHFKTLQYLAMRIRFNDLIIILIRIPISRNELSLSSLEPMEKVNAHFEMIDADKNAGISPEEAIAFLVKTKNGTSADDLAKNMAWFSQMDSNGNNRIEPGEFDRSLTE

SEQ ID NO: 149362 - protein, 131 aa, Heterodera glycines
  Coding regions on vcDNA: vcDNA=SeqID_75785; Strand=-; Position=1 -60,114-248,296-388,916-981
  Homolog annotation: Hit_ID=CAE71479.1; Match level="QueryCoverage =84%, HitCoverage=25%, E-value=8e-37, Identity=63%"; Hit description =Hypothetical protein CBG18398 [Caenorhabditis briggsae]
RNHLWGKTKAAFKYAYDHYLNDFDWFLNDFDWFLKTDDDTFVIVENLRFLLMAHSPEEPIYYGCKFKPFVEQGYMSGGGYMSGGAGYVLSRMALKKFVEEGLPDEKKCRENTSLKSTYFFSKYNPKNGPKI

SEQ ID NO: 149363 - protein, 302 aa, Heterodera glycines
  Coding regions on vcDNA: vcDNA=SeqID_75786; Strand=+; Position=1 -216,497-652,1378-1520,1574-1683,1991-2166,2215-2322
  Homolog annotation: Hit_ID=NP_500162.1; Match level="QueryCoverage =93%, HitCoverage=56%, E-value=2e-38, Identity=31%"; Hit description =mp-gated cation channel alpha 1 (4C868) [Caenorhabditis elegans] gb|AAC17534.1| Hypothetical protein C23H
MIRDGLAHRSTKVPFSNFSKQYSLSFYWSSLTLTTSGQQPYPTAAMHNFLEIFDTIIGVLVFAVIVGSVGNAVSTMNLTRSELQQLNDGIKFYMNYRNVKDAMQKRVLDCIHYIRRHAQMHDEREMFVLKRGVLEIIDENERVEHLESGATFGEMSILKPIGPLGKLLARRSHSLRSLGYSEVYLLSQEDALEVFADYPEQRQMLIHHATQLLMERGEVCGAELVEPGPLDPLELCGTENSAELLQLLGNTLCGLDATLDALYDKFMVNSSELKQQLTVLEGTYQRNRQKLRKKWHKKLCQK

SEQ ID NO: 149364 - protein, 90 aa, Heterodera glycines
  Coding regions on vcDNA: vcDNA=SeqID_75787; Strand=-; Position=1 -169,429-532
MRYGRNRTTNEILWHFHFVYLAQQAIECAKAEKTKEKQKKNAKTEKAEKLPIKFEERKLMLKMKKTKVWDYWRRQRRQRILMVLERGLFP

SEQ ID NO: 149365 - protein, 53 aa, Heterodera glycines
  Coding regions on vcDNA: vcDNA=SeqID_75788; Strand=+; Position=1 -61,363-463
MAMNGATFTGRRALLPLGRPSNPNSPFGAGRPLPVVGPYGQFPVARRQMPFRL

SEQ ID NO: 149366 - protein, 54 aa, Heterodera glycines
  Coding regions on vcDNA: vcDNA=SeqID_75789; Strand=-; Position=1 -57,122-224,408-412
MRFIHCFVSMLIIWAGAQLTFGTDYSPYSPSGAYSEKAGDYEYAYGSPHRLVDE

SEQ ID NO: 149367 - protein, 174 aa, Heterodera glycines
  Coding regions on vcDNA: vcDNA=SeqID_75790; Strand=+; Position=1 -93,144-575
  Homolog annotation: Hit_ID=E86336; Match level="QueryCoverage=89%, HitCoverage=43%, E-value=8e-27, Identity=47%"; Hit description =hypothetical protein F14O10.11 - Arabidopsis thaliana gb|AAF88160.1| Contains weak similarity to an unknown pr
MRLLLFPNFGLFLCLLAAVTVFGIEVKRTTEQTNSTNPNSVDKIKTEEAPPSTVTNSKNETSTKEAEKTEHKEETLKKEEEEEGKEKEEQKEEEEEEEGEEEAGEEEEGEEFGEEEGEVTEDEEEEEGEVREDEEGEVTEDEEQEEGEGKEEEDQKRGESEEAKKEEKGREEEL

SEQ ID NO: 149368 - protein, 195 aa, Heterodera glycines
  Coding regions on vcDNA: vcDNA=SeqID_75791; Strand=-; Position=1-588
MKLFPLLLLIILFLIDKIGSEKKKLQQKSFGEIFGEKWQEKEEEKRNELKKREIIGKFYKIKEKIKQKGRKYSAKEWGKINSKIAKKLGTNRNYIQKWIKEFGLQKKKSYKSKTDEEKLIIVQKFVEISNKYKQKRKYSPKEWKQNYAEICKKIGVNYGTIENWKKQFGINCKRITEEQKIEHLLGNKKKKSKNE

SEQ ID NO: 149369 - protein, 102 aa, Heterodera glycines
  Coding regions on vcDNA: vcDNA=SeqID_75792; Strand=+; Position=1 -33,398-460,785-934,1334-1396
  Homolog annotation: Hit_ID=CAE59078.1; Match level="QueryCoverage =71%, HitCoverage=5%, E-value=1e-20, Identity=68%"; Hit description =Hypothetical protein CBG02368 [Caenorhabditis briggsae]
MRGVHANSRLLDEKRRKDLLLQRMLPISVAQQLLEEREVVPESFGSVTIYFSDIVGFTSICSESTPHQVIAMLNKLYTLFDGNKFYNANFNVKCFSFQMLIE

SEQ ID NO: 149370 - protein, 56 aa, Heterodera glycines
  Coding regions on vcDNA: vcDNA=SeqID_75793; Strand=+; Position=1-169
MFDKETEEYKWEMLNARSREERKKAKECVRGSVLLKMAQDRAFSDERTTEQLAKSM

SEQ ID NO: 149371 - protein, 178 aa, Heterodera glycines
  Coding regions on vcDNA: vcDNA=SeqID_75794; Strand=+; Position=1 -436,673-773
MKSSPKAIGGGGISLHPSTFSAAGTSTGGPFDVAENVHGIDHVTHKPFNFLRTNSEREAEEKRQQQRQQREAIVRHNEFIMMGGNGFDDEDESDVDSDMDSPRNVQQQSYNDGGHRRLGKSESKKRLAEKKQQLAEAKAELKMQLRVLGVIGHEYDIHFGQFRTPDPISNKKSKIQIF

SEQ ID NO: 149372 - protein, 149 aa, Heterodera glycines
  Coding regions on vcDNA: vcDNA=SeqID_75795; Strand=+; Position=1 -23,877-1169,1221-1354
  Homolog annotation: Hit_ID=AAV34698.1; Match level="QueryCoverage =95%, HitCoverage=46%, E-value=4e-15, Identity=36%"; Hit description =IC5 [Globodera pallida]
MKAINLESFAAIGFATKEVPLDGSIGQILNSYGYRSDGSFGCNGINRPCKMPFGQVPMSLFDVSMQSADVAMAYKSSEFSTGDVVGCGLFLDTQLIFLTKNGQRMDDSSFFISSPANSLNSLFPCVSLWAGDKTEANFGPNFKFNLATL

SEQ ID NO: 149373 - protein, 143 aa, Heterodera glycines
  Coding regions on vcDNA: vcDNA=SeqID_75796; Strand=+; Position=1 -72,589-742,821-1005
  Homolog annotation: Hit_ID=NP_492108.1; Match level="QueryCoverage =100%, HitCoverage=38%, E-value=5e-71, Identity=90%"; Hit description= G protein, class O, Alpha subunit (40.5 kD) (goa-1) [Caenorhabditis elegans] emb|CAA96595.1| Hypothetica
VTAIIFCVAMSEYDQVLHEDETTNRMHESLKLFDSICNNKWFTDTSIILFLNKKDLFEEKIKKSPLTVCFPEYNGRSDYHEARSDYHEASAYIQAQFEAKNRSTKKEIYCHMTCATDTTNIQFVFDAVTDVIIANNLRGCGLY

SEQ ID NO: 149374 - protein, 68 aa, Heterodera glycines
  Coding regions on vcDNA: vcDNA=SeqID_75797; Strand=-; Position=1 -52,625-777
  Homolog annotation: Hit_ID=AAK60209.1; Match level="QueryCoverage =100%, HitCoverage=31%, E-value=3e-32, Identity=100%"; Hit description=vap-1 [Heterodera glycines]
MEHFPSKFVLCLLIAFIAVPCSVLALSAGSRVSMLACHNNYRSQLAKGTADNKSGKMPAGSNLIQQKY

SEQ ID NO: 149375 - protein, 29 aa, Heterodera glycines
  Coding regions on vcDNA: vcDNA=SeqID_75798; Strand=+; Position=1 -57,454-486
METHETENSHLQYMKYRKMVWFLVFPLLQ

SEQ ID NO: 149376 - protein, 179 aa, Heterodera glycines
  Coding regions on vcDNA: vcDNA=SeqID_75799; Strand=-; Position=1 -120,276-396,503-659,970-1070,1149-1189
MVLDLVRYENKLSHYNNVLVNIVIQLKQKLEFLKNSCKENSINIYGDHEYILDLIELNLSKVKVKYMESDITNAAQLWTLDKRPTVIQSLWVIRHGHRQDNIDKKLCTEDELARDDIPLSPLGIQQSQELGKRTVSALESVKQVEEDDCKWVIKKTIGQILADNKNDQISLIMQISRFI

SEQ ID NO: 149377 - protein, 23 aa, Heterodera glycines
  Coding regions on vcDNA: vcDNA=SeqID_75800; Strand=+; Position=1 -55,1179-1195
MKNILSKWGIEPRRKIMKDQEES

SEQ ID NO: 149378 - protein, 20 aa, Heterodera glycines
  Coding regions on vcDNA: vcDNA=SeqID_75801; Strand=-; Position=1-65
PGPESRSRRAWVFPGPGFFS

SEQ ID NO: 149379 - protein, 181 aa, Heterodera glycines
  Coding regions on vcDNA: vcDNA=SeqID_75802; Strand=-; Position=1 -6,423-666,755-1050
  Homolog annotation: Hit_ID=AAC47437.1; Match level="QueryCoverage =82%, HitCoverage=70%, E-value=8e-42, Identity=47%"; Hit description =COL-1
MHAPCRPCPGGAPGEPGPSGPPGVPGQPGLPGRSSGEALPGYPGPPGEPGAPGQDGPPGPPGPPGFSPPEIPDGASGYEPGPPGDAGLPGPPGQPGLPGPQGLDGQAGARGQRGMDGPPGEPGKIGLPGSQGAQGQGQAVKCPKQCGPSGAVYEQPTAAMEYYRRRMRKMMKSRMMTKKRV

SEQ ID NO: 149380 - protein, 91 aa, Heterodera glycines
  Coding regions on vcDNA: vcDNA=SeqID_75803; Strand=-; Position=1 -62,526-739
MGRALDQIAFSYFVVFFIFVQFTIAFWPSNNGFSTENQGLQICLPHFAAFCTCFTAVPFCNAADDEKLYCQFENGNVQRDWPMPSQFSFKH

SEQ ID NO: 149381 - protein, 95 aa, Heterodera glycines
  Coding regions on vcDNA: vcDNA=SeqID_75804; Strand=+; Position=1 -138,187-336
MFSSVAEEFLGMKAAELLAKEKEPESLAKHLDDLIAVKIIAKVNIKANSQTYTGFDWIVNLFKKCPGKNDSDVPKEKDDDDGDVDEIATKKTKKN

SEQ ID NO: 149382 - protein, 692 aa, Heterodera glycines
  Coding regions on vcDNA: vcDNA=SeqID_75805; Strand=-; Position=1 -432,796-1422,1472-2488
MIIRSPPLTRQRALNLRTFAQNQNAAVEEQQQQQQVEGVHAENEPLVNAPISPGLNRNLSLSAEENEHHFSEMAAAAANDDEIRRRLLHVSIQSNLPPRANGGGNNGAEQQQIRNENVGHEDFVEGLREVLRPNFGSFLVREEGDGRQMMHPTEIPRQMHQQPPREERGWQQQNSVLYRPVARQQQNFPVYENQMMPPQSQKFDAYTDSWPDEKRIKGLESKAYGRAERALEAAKAVIPIKYELLRGEMMRQLEETDSKNLNAFDELMLEVRRKPNESIDDLAGRISGLVKRAYHGLSFQLSDEFSIKYLIRSIGDPTLSLNLELIRTPRMSLDHFVSLAARAESTQRATQRFNPNFNREYQRQHEFQPIFRDRQPGFQPNNGPIRQNNPSFEQKLWKCYNCNEVGHISRNCPRPKQFEANAQNKAQTQPVNVSNKTFENSNRNFGSTKPNSSNFLRQNCIVEQQESVTTDLCLGKIEIAPEVDDFLEILVVGRENEAVPPIGKVMVVKTSTFGVETDSMLDGGAQISLISANFLYQLVKEKNLDFDSLEPSQTNVRVLYVNGKMVPCLFKVNLPIHSRGLKSEVKIAVHVTKASIGFDMLIGTNGLGKLGFKLYDEANDSMVEFENSVLNSKNLLTVIYGTTIEPRSTKILEMGVNENYEASELLISSDNSNDLHVEPTVAIANEGKMIVP

SEQ ID NO: 149383 - protein, 29 aa, Heterodera glycines
  Coding regions on vcDNA: vcDNA=SeqID_75806; Strand=+; Position=1 -81,810-818
MAFSLSFKVIGAPAQFLLGAGPTSAATRF

SEQ ID NO: 149384 - protein, 23 aa, Heterodera glycines
  Coding regions on vcDNA: vcDNA=SeqID_75807; Strand=+; Position=1 -10,128-189
MAIGFKQKVNEQRMYFIRKLFIV

SEQ ID NO: 149385 - protein, 46 aa, Heterodera glycines
  Coding regions on vcDNA: vcDNA=SeqID_75808; Strand=-; Position=1 -52,159-247
MSISTNSTNGDFTPTDGEVNCESISLDNDGQSDGKVFVEEEGKVRN

SEQ ID NO: 149386 - protein, 61 aa, Heterodera glycines
  Coding regions on vcDNA: vcDNA=SeqID_75809; Strand=-; Position=1 -30,159-314
MAIEQTQAYYGWGGYGYGYPYGFYGKRQAGFGPSANVGTFGRNEGENANGGGGGPFSLNNF

SEQ ID NO: 149387 - protein, 99 aa, Heterodera glycines
  Coding regions on vcDNA: vcDNA=SeqID_75810; Strand=-; Position=1 -87,827-1036
MWEKLEFALVKFREKIDELNEQLTRKQEELKHQISDWEDRAVDYERVIVKFRQKTAELNERVQNLHDELATMHARDEEKSRNAGAEMSLLANVNRTFSE

SEQ ID NO: 149388 - protein, 66 aa, Heterodera glycines
  Coding regions on vcDNA: vcDNA=SeqID_75811; Strand=-; Position=1-201
MSNQQTATASKDEGIGSTDKKQLDTAHCQQQLQQALEQITQLGVRKWRDCEERFKKKVSKVLLELR

SEQ ID NO: 149389 - protein, 64 aa, Heterodera glycines
  Coding regions on vcDNA: vcDNA=SeqID_75812; Strand=+; Position=1 -16,575-753
MTSFTVAPIKPFIAKKIDKNFWDGKAGQVKSIGRKNEEEGKEDGEEKKEEKVTGEYAQFHRKMN

SEQ ID NO: 149390 - protein, 38 aa, Heterodera glycines
  Coding regions on vcDNA: vcDNA=SeqID_75813; Strand=-; Position=1-115
SFFSSPSSFPSSSFFRPMLFTWPALPSQKFLSIFLAMK

SEQ ID NO: 149391 - protein, 132 aa, Heterodera glycines
  Coding regions on vcDNA: vcDNA=SeqID_75814; Strand=+; Position=1 -180,739-831,881-1006
  Homolog annotation: Hit_ID=CAE64954.1; Match level="QueryCoverage =88%, HitCoverage=30%, E-value=2e-09, Identity=27%"; Hit description =Hypothetical protein CBG09785 [Caenorhabditis briggsae]
MRPGEYLSAFFGFLELMLQHVLEQEKLTNRRSWAVCIFDMQNVSILQWVNPLGPMTRCFEARVALAMAYYAEMLSKVVIVNPPHLLNVLFKIMSFLLPKSISNRFHVATNFAEIQNGFPQTLSRLDMVDTNN

SEQ ID NO: 149392 - protein, 150 aa, Heterodera glycines
  Coding regions on vcDNA: vcDNA=SeqID_75815; Strand=-; Position=1 -92,202-316,542-571,723-823,1016-1115,1418-1432
MERNNLIRNFFTFFSIILGCVSSFVNEPRRGSGWERLETFKKELAKSDFSIDHPFKFDGQSYFWDGFSKPNFIGKRPEKITWECATNEKCCGIDCCPKNSSADNIGIIIMIIILFMYISFLCAILCTCTKSDVQQTKWSYCCDVGMSEKD

SEQ ID NO: 149393 - protein, 303 aa, Heterodera glycines
  misc_feature (9)..(9): Xaa can be any naturally occurring amino acid
  Coding regions on vcDNA: vcDNA=SeqID_75816; Strand=-; Position=1 -81,229-311,356-441,607-697,1029-1081,1136-1267,1352-1552,2000-2023
  Homolog annotation: Hit_ID=CAE66475.1; Match level="QueryCoverage =96%, HitCoverage=21%, E-value=3e-55, Identity=44%"; Hit description =Hypothetical protein CBG11754 [Caenorhabditis briggsae]
LNFNSKNEXGNPLLRAICLMSWIVQAFSSGHYTTAVPFLFILSGSALKEIFEDIKRRRMDSEVNNYEVELLDSFGIFEDIKRRRMDSEVNNYEVELLDSFGSVRRWPNLRVGQIIRVSEGQFFPADIVLLSSSEALGMAYIETAQLDGETNLKIRQAVPLTAQLTDIAQLSALRAHAVPLTAQLTDIAQLSALRAHIECEPPNRRVHEFSGTMCAGDDEKPAAIDQFLPAAIDQFLLRGAKLKNCRWVFGVVVYTGHDSRLLMNSTSAPLKTSRIDVMTNQRSVILFLMLVLVTIISYIFNEI

SEQ ID NO: 149394 - protein, 335 aa, Heterodera glycines
  Coding regions on vcDNA: vcDNA=SeqID_75817; Strand=-; Position=1 -41,2553-2688,3079-3941
  Homolog annotation: Hit_ID=AAO53177.1; Match level="QueryCoverage =98%, HitCoverage=25%, E-value=5e-42, Identity=30%"; Hit description =similar to Dictyostelium discoideum (Slime mold). Adenylyl cyclase
MITLPNDQIGHSQSGGGKEKEQEKREEDEDKEEREKGAESGERNEVVETEQNHPMQHQQKKQQKEQEKERTSPRGKQSQEEVEENGAKSGEEMQNRETEGPEEQAVQQGQGEEGQHVPNQQGHEAVQQGHQQQQEQQHQAVHLGHKQHQAGQQEQAVLQQGHQQHQAVQQRQQQIRHGQQGLQGQLQLGLKNEKQGQHQAVLVQQQVVQEMQNQAVQRQQRVGQNHQHQTVPVQQVEQGQLPLTNFLQGQQQPQQSMQEQQHKIVQGRQDVQGQQIVQTQEQQPQAINGRQFAQPTQVQVQSSQHQNQVQGHQQGPLQKPRHVKQHVGQNQKHQI

SEQ ID NO: 149395 - protein, 206 aa, Heterodera glycines
  Coding regions on vcDNA: vcDNA=SeqID_75818; Strand=-; Position=1 -66,519-623,786-923,972-1030,1213-1465
  Homolog annotation: Hit_ID=CAE68856.1; Match level="QueryCoverage =87%, HitCoverage=32%, E-value=2e-50, Identity=56%"; Hit description =Hypothetical protein CBG14818 [Caenorhabditis briggsae]
MEASRREFGDDCDDLVRSSLPPEYAPPQLPSKDDDDGEEGEGEAPPIPERPKKTLSIYTKPIEHEETSKIVPDYLLKNGNFGGRANGRRRRLTDSEVLARLRTIVSIGNPDRKYRKVEKIGSGQQPKKELIINEILVMRENKCPLSFPFSFIPISLRHRNIVNYLDSYLVGEDLWVVMEYLAGGSLTDVVTECQMEEAFAIYALFR

SEQ ID NO: 149396 - protein, 82 aa, Heterodera glycines
  Coding regions on vcDNA: vcDNA=SeqID_75819; Strand=-; Position=1 -111,274-411
MTPRSETQKPKKFHESKIENRESRTSLLPNEKEKEFKENRRHLGLSNDTRMMLLGKSYGALNLSNYYMVVSFLWHINLNRAK

SEQ ID NO: 149397 - protein, 592 aa, Heterodera glycines
  Coding regions on vcDNA: vcDNA=SeqID_75820; Strand=-; Position=1 -273,324-571,618-713,755-922,964-1956
  Homolog annotation: Hit_ID=NP_001004509.1; Match level="QueryCoverage= 93%, HitCoverage=36%, E-value=1e-65, Identity=30%"; Hit description =si:busm1-180o5.3 [Danio rerio] emb|CAD60788.1| novel protein similar to DNA polymerases [Danio rerio]
MVCWDTETRLEQLQQAGQQRHKVNYLSARITCTECCDSENGLRLNCKICLTTYGAMERTKDWSESEGHEPISAFVEWILKAWDNKYQTFIWAHNASRFDGHFVLKYLGQTKRRPEVIMNGLKIFEFRLQHSRRHSKLTWRDSCLLMPIRLEEMPKTFNLNCADKPFFPYAFNRRENYNVHLQHLPDKEDYCPGSMKQDKYEKFIKWYDVNKNTPFYLPDELKTYCRNDTEILLAAVVQFRQILMRDITEGFDVLPLSATIASVCMTIFKGKFLNEKELAIVPEGGYERNDRASVFAIKYLDWRSKRDGVRIQHAGNGLEKRWRQFKLDGWIAEQNKCIEVLGCYWHGCESCFKPDDELVDGKTCRELNDATKLRLLKLQEPVPAEDAYGGEDEQGLDVEEIWECQIREQLKRDDEMRAFFDDLGTDRGPIDPRQTFYGGRTGPLQLIAEPKEDEKISVFDIVSLYPWVNYATDYPIGIPAVIHPTVEEMIVDWTRPEHLQYQGIYRVRVIPPKGLRIPVLPLKIDERLLFCCCHRCAAKFRKLNTRRVHKCPHTDEQRAFTGNFTHIELARALETGYRVDRFWRAWHYDEWY

SEQ ID NO: 149398 - protein, 394 aa, Heterodera glycines
  Coding regions on vcDNA: vcDNA=SeqID_75821; Strand=-; Position=1 -589,636-1231
MKRTGDEPSTSSSATLEDYTTAAAAAAAAAVAAASFSPTISNSDGVAKRQRRQSWDFKTMAHFEEHHLRQQQQKQESHAIPMDGEGRLHQRGIDGAQTVVAAADNAEDHNEQTEKPLFEQLQYYVHRVERFALHRHVTEFVLNGQHDEPEEALLNAFEHIIGQAIRNAEENTDQDGGGTAGHRRRVLKLGVLLNGKGLTDPIVLPVRPPEQNTAEVLMAELDKLGQSDGDEDVHGGGISKRSLLLSEPIEIIVTCIAPPVGAAPRFHPYQHWGYDERHMIRIFNTGNNFCLFYALIATRAYTDAEFLKSTVHLQTAEGGQSSNSNHVSSEVIQRVKRRADFCSDHKALNRFVSNRDRLRIAVQELMRAAEIAPDQDAYGMEHLILIQQLWVQII

SEQ ID NO: 149399 - protein, 202 aa, Heterodera glycines
  Coding regions on vcDNA: vcDNA=SeqID_75822; Strand=-; Position=1 -165,209-514,582-719
MSGLKRFQLTSSSNKRPADEFPSHPKQLSEVAKFNAPGIFFVRAKVADLQFSLYKACPLKSSGSVPCKKKLDDEMFCRGCDHRANSPLQCLFLRLDLQDCEDLEISQKVTVFSNVAEDYLAMRVNQFADMVEKCSEKLEALLQSKLGQTLTFKLNLKAKGGGEFTTMDWIAAAILVDKKNEADNEDGEIIELDIGKKRAKKN

SEQ ID NO: 149400 - protein, 202 aa, Heterodera glycines
  Coding regions on vcDNA: vcDNA=SeqID_75823; Strand=-; Position=1 -165,209-514,576-713
MSGLKRFQLSSTSNKRPAEEFPAHPKKLSEVVKFNSSGTFFVRAKVADLQFSLYKACPLKSSGSVPCKKKLDDEMFCRGCDHRANSPLQCLFLRLDLQDCEDLEISQKVTVFSNVAEDYLAMRVNQFADMVEKCSEKLEALLQSKLGQTLTFKLNLKAKGGGEFTTMDWIAAAILVDKKNEADNEDGEIIELDIGKKRAKKN

SEQ ID NO: 149401 - protein, 27 aa, Heterodera glycines
  Coding regions on vcDNA: vcDNA=SeqID_75824; Strand=+; Position=1-83
NSALVLIWQKIKPFFLRTHWCSIHLTK

SEQ ID NO: 149402 - protein, 114 aa, Heterodera glycines
  misc_feature (7)..(7): Xaa can be any naturally occurring amino acid
  Coding regions on vcDNA: vcDNA=SeqID_75825; Strand=-; Position=1 -100,160-332,2109-2147
  Homolog annotation: Hit_ID=AAQ16111.1; Match level="QueryCoverage =91%, HitCoverage=21%, E-value=2e-23, Identity=53%"; Hit description =ornithine aminotransferase [Schistosoma japonicum]
HTVFLLXNKVFCNHLGVEACDTAVKLARRWAYDVKMVPKNEAKVVVKMVPKNEAKVVFAENNFHGRSLAACSASTDPDCYGGFGPFVPNFVKVPFDDLTALEVEIVDNQCSIGN

SEQ ID NO: 149403 - protein, 60 aa, Heterodera glycines
  Coding regions on vcDNA: vcDNA=SeqID_75826; Strand=+; Position=1 -11,79-135,189-303
MNRRWISDRPLPSKIRFDSIQISYIEAKFNNFGWPSVVQMVALSEKRWPTQAIALFPMEH

SEQ ID NO: 149404 - protein, 86 aa, Heterodera glycines
  Coding regions on vcDNA: vcDNA=SeqID_75827; Strand=+; Position=1 -185,247-322
MVPFELVNEWTKEKLTLAKANENELDNWIMKRCKIIGEKEENWDNNCNNVFFWLVGGIDCIGPLSPPPAEETGQGITKVASSADDE

SEQ ID NO: 149405 - protein, 44 aa, Heterodera glycines
  Coding regions on vcDNA: vcDNA=SeqID_75828; Strand=+; Position=1-179
HFTRPMTFYASQQHFTRPMTFYASHDILRVPTTLYASHDILRVP

SEQ ID NO: 149406 - protein, 80 aa, Heterodera glycines; identical to SEQ ID NO: 146657
  Coding regions on vcDNA: vcDNA=SeqID_75829; Strand=-; Position=1 -146,194-290

SEQ ID NO: 149407 - protein, 82 aa, Heterodera glycines
  Coding regions on vcDNA: vcDNA=SeqID_75830; Strand=+; Position=1 -54,354-474,535-608
  Homolog annotation: Hit_ID=CAA74206.1; Match level="QueryCoverage =98%, HitCoverage=23%, E-value=2e-17, Identity=49%"; Hit description =serine proteinase [Heterodera glycines]
MNLLDKICLVAEPSVTEPGDSGSPLLSKIGDKNWVQVGVLFGGSGCSEKHPFSTTRRRSLYTPIDCDWISRVTNDEVKCKGW

SEQ ID NO: 149408 - protein, 25 aa, Heterodera glycines
  Coding regions on vcDNA: vcDNA=SeqID_75831; Strand=-; Position=1-82
YQICITLNKCWTCQQNDFLCYVFSS

SEQ ID NO: 149409 - protein, 43 aa, Heterodera glycines
  Coding regions on vcDNA: vcDNA=SeqID_75832; Strand=-; Position=1 -14,637-737,814-830
MGLPLTEYRQAFQTVFPFVFKRFSNANQVIPLQNGHPLETNLL

SEQ ID NO: 149410 - protein, 86 aa, Heterodera glycines
  Coding regions on vcDNA: vcDNA=SeqID_75833; Strand=-; Position=1 -40,315-535
MIFWKIFKFLGQKVALGSAARQILSNTFISFNSFAMETIGSTTGDEPELALKHFEESLDLDSFVGPWTGNLTDKKNPEKPRKKLEH

SEQ ID NO: 149411 - protein, 39 aa, Heterodera glycines
  Coding regions on vcDNA: vcDNA=SeqID_75834; Strand=+; Position=1 -112,414-421
MDGPPLPDSQSGQRLIVGRSGEGEKSWIKGTAPKATIEF

SEQ ID NO: 149412 - protein, 131 aa, Heterodera glycines
  Coding regions on vcDNA: vcDNA=SeqID_75835; Strand=+; Position=1 -94,138-439
MSPQPENPPAKRRMSFFERLKHITGANTSEQGFQTSQDDDIEKEIKEFLALEIANPEADPLDEWKKIAPRFSILAKFAEKYLSAPATSVPSEQTFKVARDVFDYRRSKLSPETAEQLIFLNKSLPQMNYNY

SEQ ID NO: 149413 - protein, 191 aa, Heterodera glycines
  Coding regions on vcDNA: vcDNA=SeqID_75836; Strand=-; Position=1 -110,393-783,970-1044
  Homolog annotation: Hit_ID=NP_502721.1; Match level="QueryCoverage =64%, HitCoverage=8%, E-value=2e-14, Identity=41%"; Hit description =endonuclease/exonuclease/phosphatase family and RNA-directed DNA polymerase (4O953) [Caenorhabditis elegan
MKGFKEWNYECGFCFYGADGEMKRVHKNKKNLPLLLIAEKCELFATLFANSFNNSETDPSNPCLGNIIEIDQCFISDINFNIIETQNLLKKLPNKNGTSPDNISYKILKICHSSLSTVITDLLRISLDTGSHPDICKESIVFPLFKKGDKNNLENYRPISLTCSLCRKAFDSVPHELLLYKLEKIGIRSKL

SEQ ID NO: 149414 - protein, 83 aa, Heterodera glycines
  Coding regions on vcDNA: vcDNA=SeqID_75837; Strand=+; Position=1 -75,217-393
MPVNVNSKEWSGQQKMAREHRDLCSFPIVDEAHLKQFSKKDKVQSIELIKGDCGFIYFIIIVWRIKNYFNVLKSQLKLQNKIY

SEQ ID NO: 149415 - protein, 144 aa, Heterodera glycines
  Coding regions on vcDNA: vcDNA=SeqID_75838; Strand=-; Position=1-435
MKTFVEEKVAEAKELAEFAIADAERKMKQSLNNAIHAERERGQQQLRSVVEEQHMRCRHLALQIYRSATMTKPTSVRTSDVSPKWEPHCMFCLIDEPMFGSEWCAHVNVCAECSIVWSGDDQFKCLTCQTTCNKFVYFGPNPSP

SEQ ID NO: 149416 - protein, 158 aa, Heterodera glycines
  Coding regions on vcDNA: vcDNA=SeqID_75839; Strand=+; Position=1 -347,919-1048
MMNLRIGVLKRFPLLGRRRRFSRRRKRKVGPFTQSLSVLVMPLGEQKGGLIFVIKHGRTGQYPLYSTCSESWQAQGFLLKQELSACLVHAVLVHLGNPGPLVRIFFFKLRALLLQNISIFRDPVRDCELFKNRIFSLSPIRRQCQEVWLVTMYGWDGT

SEQ ID NO: 149417 - protein, 91 aa, Heterodera glycines
  Coding regions on vcDNA: vcDNA=SeqID_75840; Strand=+; Position=1 -140,731-865
IKSVRSSTSDGDYVLNNGDQQHCSINEELRNLTLSHNLLRQQQSSALSDYMERMVTFPSSCVAAYRPEERPMRLVRNCNLLDQKIRLYRDQ

SEQ ID NO: 149418 - protein, 54 aa, Heterodera glycines
  Coding regions on vcDNA: vcDNA=SeqID_75841; Strand=-; Position=1 -60,103-130,666-742
MRLIQTCNLMEQKMRLYRDQVVFVQPNSLEIPKSMGDDAFGLLMYTLTQTYDAN

SEQ ID NO: 149419 - protein, 51 aa, Heterodera glycines
  Coding regions on vcDNA: vcDNA=SeqID_75842; Strand=-; Position=1 -69,129-215
  Homolog annotation: Hit_ID=AAH72894.1; Match level="QueryCoverage =82%, HitCoverage=14%, E-value=2e-11, Identity=78%"; Hit description =Cdk5 protein [Xenopus laevis] sp|P51166|CDK5_XENLA Cell division protein kinase 5 (Neuronal cyclin-depende
MSNSNDMSGYEKLGKIGEGTYGTVFKARNKDTEQIVALKIVRLDDEDEVNY

SEQ ID NO: 149420 - protein, 153 aa, Heterodera glycines
  Coding regions on vcDNA: vcDNA=SeqID_75843; Strand=+; Position=1 -95,147-239,870-933,1292-1403,1698-1795
  Homolog annotation: Hit_ID=EAL32302.1; Match level="QueryCoverage =57%, HitCoverage=18%, E-value=7e-39, Identity=85%"; Hit description =GA13260-PA [Drosophila pseudoobscura]
MTFCICPKNWHGLVNCYKIPNFHSILPMSASRTKVIWVPMLNCAIFFASLFFVVLPTLCKNWRYHLKDVIVGKIYFLLVRIKIKHMEIAILKRESVGNGPNLFNENETIAKYEIMDGAPVKGESIPIRLFLAGYDLTPTMRDVGKRFSVKVRC

SEQ ID NO: 149421 - protein, 84 aa, Heterodera glycines
  Coding regions on vcDNA: vcDNA=SeqID_75844; Strand=-; Position=1 -115,554-615,662-741,797-919
  Homolog annotation: Hit_ID=NP_499892.1; Match level="QueryCoverage =96%, HitCoverage=43%, E-value=6e-21, Identity=50%"; Hit description =pancreatic trypsin inhibitor precursor family member (20.1 kD) (4B21) [Caenorhabditis elegans] gb|AAC4809
SAGTDKCPDGFTCVANKNCCPGSKEIVCGIEYDTGRYAFQGSHTPRYFYKKDIDNCLLFTYYGALGNGNNFETYNECIKYCKKT

SEQ ID NO: 149422 - protein, 29 aa, Heterodera glycines
  Coding regions on vcDNA: vcDNA=SeqID_75845; Strand=+; Position=1-89
SPIFVLAFLIELNRFISPKSVQFIHIKFA

SEQ ID NO: 149423 - protein, 166 aa, Heterodera glycines
  Coding regions on vcDNA: vcDNA=SeqID_75846; Strand=+; Position=1 -13,233-355,721-1073,1225-1236
MAFFSRINGVAKRAAISNAADTPSAPRRSMVARHHRISLKPSPAEGTVDIQFDDNQQQMPTATIGGAAGGDQNKQSCANGSSNTSPPARHGHQTQSQQQKMTTTSRSSTTPTPPSTAPSLCPLNGVGCDGEAAQQKQDTIQPANCVAGASSSSSSSSFSVPNEHFA

SEQ ID NO: 149424 - protein, 71 aa, Heterodera glycines
  Coding regions on vcDNA: vcDNA=SeqID_75847; Strand=+; Position=1 -39,657-833
  Homolog annotation: Hit_ID=AAH80328.1; Match level="QueryCoverage =81%, HitCoverage=12%, E-value=1e-18, Identity=74%"; Hit description =MGC79498 protein [Xenopus tropicalis] ref|NP_001008438.1| MGC79498 protein [Xenopus tropicalis]
MQFEVEFQETVYQNLLDPGKRFIRHRLFREHCVFVYGNYIKDLNILGRDLSRTVIIDNCLQSFAYQANTNI

SEQ ID NO: 149425 - protein, 65 aa, Heterodera glycines
  Coding regions on vcDNA: vcDNA=SeqID_75848; Strand=-; Position=1 -80,608-720,1290-1294
MAFSIIFVTVFRAFFQQSAIFRPYKIPGLKWQLNSCVLIDHMVKDGEKLISFRFDIDCDTDSKIF

SEQ ID NO: 149426 - protein, 125 aa, Heterodera glycines
  Coding regions on vcDNA: vcDNA=SeqID_75849; Strand=-; Position=1 -73,137-246,834-1028
MLRFIYSADLSQLNGQNAIAVLYAAKKYNVIGLIRACLDFPIGQLQNVFFAFAETHFLGENALRWADEKCRQNDTECSAQNRRAMLGPALYKIRFPCIFETDFSTQIGQYCSQHFKIILKYRTPS

SEQ ID NO: 149427 - protein, 37 aa, Heterodera glycines
  Coding regions on vcDNA: vcDNA=SeqID_75850; Strand=-; Position=1-113
MLQTVSGVLLRSKMFYVPFLICKQPEPIVDEKSQQIG

SEQ ID NO: 149428 - protein, 148 aa, Heterodera glycines
  Coding regions on vcDNA: vcDNA=SeqID_75851; Strand=-; Position=1 -122,191-308,366-572
MANSAMEQQLGMLCPITALTLPQKRLILARWRQLSAADILRLSENIFERTFRRNESFARTVLRQNDRNWKNLPQFRVLTMRFSYALSALCASLADDAAPGAELLAEFGAQHAIGLDNGQVVPPSYWDVLLLAICEAAGAGEGQQQIEV

SEQ ID NO: 149429 - protein, 105 aa, Heterodera glycines
  Coding regions on vcDNA: vcDNA=SeqID_75852; Strand=+; Position=1-318
MEKLINGPSAVYVLESEGFCATSVEGTPRGALAANAIAQTAASGCDGTTAEGTTACQICLVKRSVVAHGIGQNYRYRVGTVRGTAKSDGWTPIRPSGTERGQTNG

SEQ ID NO: 149430 - protein, 44 aa, Heterodera glycines
  Coding regions on vcDNA: vcDNA=SeqID_75853; Strand=+; Position=1-184
CNFIKNGKNLNLIRNVPPLRRSIQKIFVCLQSILIHFSHKNVLI

SEQ ID NO: 149431 - protein, 122 aa, Heterodera glycines
  Coding regions on vcDNA: vcDNA=SeqID_75854; Strand=-; Position=1 -204,585-748
MGNAESNAAGRHVGSGKLRQSKKAKKEKRSCSEHLEQLQIKQRNTSMEQEKQKMKQKQEKGDKKEKEESISAKFIRMPRRLTQKSSEGTAASACCCTRLAAQRMPRMAEETVAMSRTTVLPH

SEQ ID NO: 149432 - protein, 37 aa, Heterodera glycines
  Coding regions on vcDNA: vcDNA=SeqID_75855; Strand=-; Position=1 -84,413-442
MAKYAKNRKIFEEKCQNMQKIGKYAQKMVFGIIKLNW

SEQ ID NO: 149433 - protein, 249 aa, Heterodera glycines
  misc_feature (1)..(1): Xaa can be any naturally occurring amino acid
  misc_feature (227)..(227): Xaa can be any naturally occurring amino acid
  misc_feature (232)..(232): Xaa can be any naturally occurring amino acid
  Coding regions on vcDNA: vcDNA=SeqID_75856; Strand=+; Position=1 -41,1286-1484,1701-1794,2563-2624,2708-2818,3187-3419
  Homolog annotation: Hit_ID=CAE66567.1; Match level="QueryCoverage =89%, HitCoverage=4%, E-value=6e-68, Identity=52%"; Hit description =Hypothetical protein CBG11882 [Caenorhabditis briggsae]
XLSLLLSPGSIPLHNFQMYWTDRRLEKVFAGSSKPNQSSMILSPVTVVGDLQDLTDLAAFDALAQPKATSPCHISESLRKPCQQLCLAIPGSSSPNCACAKGVPKGRICDEPDTFMMFIDGDRIVDATIVPDIKASSPLREQPLREQFPPFPSIQIFDVDVNLRRIYVATDAPNGANISWFPMSQPKQIRQLINPRLHSLEIRHVSDMRYDWVTQKLYWTTGRSGQXFFVKXIIKFYTKLHSSDQNFKK

SEQ ID NO: 149434 - protein, 751 aa, Heterodera glycines
  Coding regions on vcDNA: vcDNA=SeqID_75857; Strand=-; Position=1 -762,885-1445,1794-2726
  Homolog annotation: Hit_ID=NP_502797.1; Match level="QueryCoverage =40%, HitCoverage=85%, E-value=2e-48, Identity=36%"; Hit description =HASI (4P602) [Caenorhabditis elegans] emb|CAB16520.1| Hypothetical protein Y57G11C.19 [Caenorhabditis ele
MANKFVLVPQEIYRGLTSATDTGDINLDAVRHDLTRARAERTNPSAKNVSYNQQLRRYLQMRREVADKPARVELVKGLSVLMRRGGADDEAEVVDTPPRPPPPPPPPPGQHPPRRPPSPPGPGPSPPGSPPPRPQRPPRPPRAAAPPSRRDGRVEEWRKKRNDIQQRQPVVRDLLAEAAAAPLPESDEEDDYMLESGFALPAPSQYYGELPVLPDNADAIEEMDTAQHRIAARRKLKKADDDDGNDDLHRKKYRPSTSQQVERKPKREPKFDLDPRPSTSRQAGYNPPAEPKHEQKPSKKPPPRATPYHIPKREPKIEETLPRQQPPPAAPQVPPVPPPRRGTKRRHPPENGDESGELRIRKRVRQARRVRVYYSPEPGPSTSAQSDEQQQQQQRELFAIPSNQLTMAQRIELIYIKCNRYADRMGVRGNAIINTQNAQPLGHRTYTLMRPRRVRFPRAKTVAAGFMTDVQVDLADFQALSRHNRGHRYLLVAVDVLSKRLFVVPLKNKKAEEMLDAFKELVKQMPMVPHRIFSDKGTEFKNKLLKEFFEEQEIEKHEPVHSSVKASVAERAIRNVKQRLYRYFAERETLNWVDVVQQIVDGINSTPSRVHGMRPIDVNFENAQKVWKRIYESPQKRKKPRFRKDEFVRMSREKGQFEKGYLPNYGDEILEIDEVLKAVRPIRYKLRDDRGEKFRGTFYEQELARVRKDAGTSYRIEKVYRKRRKPDGTTEMLVKFIGYPEREWIDESQIV

SEQ ID NO: 149435 - protein, 107 aa, Heterodera glycines
  Coding regions on vcDNA: vcDNA=SeqID_75858; Strand=-; Position=1 -93,150-290,343-432
MCVICEYLRGTDGLAGFISSQQSLPTLNTLKKMPPREGQSNNAGNDAPGHRQPPFAEQLVNDAQLRDIMNVLQQHGVLVGLNGTPQQIVEALRQLAQGQLDDRRRQT

SEQ ID NO: 149436 - protein, 111 aa, Heterodera glycines
  Coding regions on vcDNA: vcDNA=SeqID_75859; Strand=+; Position=1 -137,290-488
  Homolog annotation: Hit_ID=XP_477841.1; Match level="QueryCoverage =90%, HitCoverage=83%, E-value=7e-12, Identity=51%"; Hit description =putative glycin-rich protein [Oryza sativa (japonica cultivar -group)] dbj|BAC84308.1| putative glycin-ric
MKFFLTFLLLAISFLAIKTAADGSDDRNGDKSLPNPLAVEGKASKSNRHKRHYGYGYGGYGGGSWGGYESSRWGGWNNGGFGGGGMGGGMGGGMGMGMGMGMGGGMGGGGW

SEQ ID NO: 149437 - protein, 290 aa, Heterodera glycines
  Coding regions on vcDNA: vcDNA=SeqID_75860; Strand=-; Position=1 -69,144-260,619-749,862-1046,1239-1315,1889-2080,2508-2606
  Homolog annotation: Hit_ID=CAE62010.1; Match level="QueryCoverage =87%, HitCoverage=21%, E-value=5e-22, Identity=26%"; Hit description =Hypothetical protein CBG06018 [Caenorhabditis briggsae]
MLWQVVVHYAPLSIVGRLAVVLKARFTDTGGHFLLTLFVPNSGDKFSEFGQRHKAYDALSEEDKKWHRNGLLLSHAALHGPEGVVPAHAFAREAPFTILEDVGLDSLTAVCRRSIAKLSVDTVLEEHRRISGPYRAQSPDRAVRRLLVELETLSDRFEQQQQQLKRRDMSELVYVLGQDTDRRDVDLVDRLRELRLMAHRCKLEEQKRRLAFETSSNNLQFSKEYVDRLKVLQALHYIDRHNMVGLKGKVACEISNQELLITELILDNKFEQRTAAQIAAILSSITCQFE

SEQ ID NO: 149438 - protein, 155 aa, Heterodera glycines
  Coding regions on vcDNA: vcDNA=SeqID_75861; Strand=-; Position=1 -35,266-424,1048-1194,1470-1599
  Homolog annotation: Hit_ID=CAE62010.1; Match level="QueryCoverage =84%, HitCoverage=10%, E-value=3e-50, Identity=72%"; Hit description =Hypothetical protein CBG06018 [Caenorhabditis briggsae]
IRKFPQCAAPHKVVFVFSRQRCDDTAQLLQSVDLTTEKEKSAIHRFFTKCIDRLKGTDKMLPQVLLMQELCKRGFAVHHSGILPIVKEVVELLFQRGYVKILFATETFAMGVNMPARTVAFETIEKFDGNQKRFLNPTEYVQVEKHHQMLENFKK

SEQ ID NO: 149439 - protein, 341 aa, Heterodera glycines
  Coding regions on vcDNA: vcDNA=SeqID_75862; Strand=+; Position=1 -245,529-1258,1454-1504
  Homolog annotation: Hit_ID=XP_309595.1; Match level="QueryCoverage =46%, HitCoverage=32%, E-value=4e-11, Identity=34%"; Hit description =ENSANGP00000010937 [Anopheles gambiae]
MTGLPPNAKSKCKNRMSNSSASTTWMPTASGGGGGTQFGGPIAMPTTTTMTVGDGAPPPTKIRRKENDGGATAAATETENIFGTQQHAQPSAAKNVIITLNDDDIFPINRSHFTKQHFSNAQKTLASPRQKAPQKHTHTPQTTTNTAAGTGCQPSSDTSPMPPRPPPPSFTGTSSSSLSASVAAAVHHDPCAGLPRSALSTMIAALSSQLSHHYPHQPQQPSLAVINSHQLHKQQQQHQQSSSMTRMTTAVTQPTCSSPSIASSTLFRQQAQQQQQQHHQQQQHGIPPLQGQQQHVVNPQILSSQRNNAEQQQQQQQPDLLLSHLVEQTLFFFVFDTASGN

SEQ ID NO: 149440 - protein, 38 aa, Heterodera glycines
  Coding regions on vcDNA: vcDNA=SeqID_75863; Strand=+; Position=1-119
TFFIYAGVTAVAFAIFYFVVPETKGLNLDEVNFYLIFL

SEQ ID NO: 149441 - protein, 88 aa, Heterodera glycines
  Coding regions on vcDNA: vcDNA=SeqID_75864; Strand=-; Position=1 -122,355-499
MISNFGCFFLQFLPNFGLFSSGWIVFFVGVDRLISVLLPLRPVLCTNSDMFSFGMTTMLLRNGLVINGMSIICYLFVGLSLFWSWQKS

SEQ ID NO: 149442 - protein, 54 aa, Heterodera glycines
  Coding regions on vcDNA: vcDNA=SeqID_75865; Strand=-; Position=1 -33,116-247
MAFQNYSMVNLAFNRFGVDTFSMELVLSNSCRWLITLPGLVFNSALLYTIISEK

SEQ ID NO: 149443 - protein, 143 aa, Heterodera glycines
  Coding regions on vcDNA: vcDNA=SeqID_75866; Strand=-; Position=1 -107,442-766
MVTSCKARSKLFYNQLQVIILIKVASSIWTSHTKSGLLIRAEIEPLCPNCSNGTVGQRMAMQMRPMPMCLFGLRKICWNFADILIGQWPNGGTLTTKSATDSQLCSKRRQEEADPIIGLCTFFCPSPMKVSDSFIVIKILKIV

SEQ ID NO: 149444 - protein, 26 aa, Heterodera glycines
  Coding regions on vcDNA: vcDNA=SeqID_75867; Strand=+; Position=1 -55,266-291
MCSNRCALITKSTESFANGGKDTFEK

SEQ ID NO: 149445 - protein, 202 aa, Heterodera glycines
  Coding regions on vcDNA: vcDNA=SeqID_75868; Strand=+; Position=1 -28,1315-1419,1599-1678,2017-2222,2805-2992
  Homolog annotation: Hit_ID=NP_493982.1; Match level="QueryCoverage =97%, HitCoverage=38%, E-value=2e-60, Identity=57%"; Hit description =solute carrier family 2 member 3 (2B799) [Caenorhabditis elegans] gb|AAK31540.1| Hypothetical protein H17
NKSPKILFLDGRLTGILAFSVFMAAFGSSFQMGYHIGCINIPGSLIKEWFTESYKHMKGVPISVEEMESTWAFAVGIFAIGGMFGGIMVGTVADRLGRRKSLLYNNILAIIAAALMTLAKYMNVYYLIIIGRFIIGLNVGLNSGLSPMYLIEISPNNLRGSIGSLHQLFITISILASQIIGLPQIFGTTNRWPLIFAFTLVN

SEQ ID NO: 149446 - protein, 85 aa, Heterodera glycines
  Coding regions on vcDNA: vcDNA=SeqID_75869; Strand=+; Position=1-258
MRNEKNAKMGPSPGKISQNWEKHSIEGQNQEKMDQKYHIKWARNLPGPGQFSQKKWKMKGRSQITDHIWGKGSGQESSQKLGKYI

SEQ ID NO: 149447 - protein, 76 aa, Heterodera glycines
  Coding regions on vcDNA: vcDNA=SeqID_75870; Strand=-; Position=1-231
MKRENYWEFKPESENFYALGRQIPRAADTIEGALELSNLGKQSFNRTRPASTSCAYASFTTRVLTPEGQTVSCLVV

SEQ ID NO: 149448 - protein, 23 aa, Heterodera glycines
  Coding regions on vcDNA: vcDNA=SeqID_75871; Strand=+; Position=1 -57,321-335
MACHFSGKCLGITIDAMECNSKN

SEQ ID NO: 149449 - protein, 286 aa, Heterodera glycines
  Coding regions on vcDNA: vcDNA=SeqID_75872; Strand=+; Position=1 -369,469-835,1133-1257
  Homolog annotation: Hit_ID=NP_701435.1; Match level="QueryCoverage =84%, HitCoverage=9%, E-value=2e-09, Identity=27%"; Hit description =hypothetical protein PFL0350c [Plasmodium falciparum 3D7] gb|AAN36159.1| hypothetical protein PFL0350c [Pl
MLKINFIIIFFLFLFVIIDGTDEDLIDDLWKNLKSPTPKNFKNQKFGENNTIKQEIVEKNDEQENANKIEMEDIKPIKIKEPKIELGQLNEESFGNQFDQQADQNVSFADLSNSANDKDYNNMNTEEINEMEILNKFNLMKKELRKENAYKNLTNVQFECEIAKKLGTNRNKIYEMKKKLGQKREKRTEENEETKRKLIRKFDQLRKEKICGYKYDRLKRNKIEHEIANELGVTFNKFYQWKRELGERKIYSVNEKLEYVKKSEEMAERNLTICEKQNCRNFGHSK

SEQ ID NO: 149450 - protein, 130 aa, Heterodera glycines
  Coding regions on vcDNA: vcDNA=SeqID_75873; Strand=+; Position=1 -68,666-775,830-1044
MANCALDCTVCMTRLRWNPINAMCMCWSSSTLATQNSTHLAVKRGALGVAQALAPIVCSLSSLTLWNFPLFSYRAFSVSRTSLEFIRAVSDLKIFNTREPGSRIDSQGVETESRKPWEFLTQEPRLSDIP

SEQ ID NO: 149451 - protein, 80 aa, Heterodera glycines
  Coding regions on vcDNA: vcDNA=SeqID_75874; Strand=-; Position=1 -17,333-558
MSFKIRSLTARMNSRDVRETENARYEKSGKFHRVRELTGKSTYIPNAFYHFVRQLREQTIGANACATPSAPRFTAKCVEF

SEQ ID NO: 149452 - protein, 128 aa, Heterodera glycines
  Coding regions on vcDNA: vcDNA=SeqID_75875; Strand=+; Position=1 -30,64-156,207-295,346-361,440-500,721-786,860-891
MCISAICIKIYLYYNCKKLKMCIFRYLYYNCKTQTKNMHFQYLYYNCKKLKMCIFQYLYYNCKKLKICIFSICITIYLYYNCKKLKMCIFRYLYYNCICIKIVKHKLKLCIFQYLYYNCICIKIVKQD

SEQ ID NO: 149453 - protein, 421 aa, Heterodera glycines
  Coding regions on vcDNA: vcDNA=SeqID_75876; Strand=+; Position=1-1263
  Homolog annotation: Hit_ID=XP_550305.1; Match level="QueryCoverage =60%, HitCoverage=16%, E-value=8e-14, Identity=24%"; Hit description =helicase-like protein [Oryza sativa (japonica cultivar-group)] dbj|BAD68127.1| helicase-like protein [Ory
MLNPHPDELKQLIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQNQEELRFFRMTLLDSRRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDSEAESDNESCETQSIASSDAGSVADSDAESVASVSSQHRRIDKSKQFISLRDYCKYYLAIRDENVELQYHHILSCGGGLGQRWILDQAAKIDWQIATFLRRPDMDLRISTPKNLLQYLVNQYNRQQARQNPNAQQKTVDDIGSVVRLSEHN

SEQ ID NO: 149454 - protein, 27 aa, Heterodera glycines
  Coding regions on vcDNA: vcDNA=SeqID_75877; Strand=-; Position=1-82
RPTKFEKRARSARLEPRCGLKTPNNFL

SEQ ID NO: 149455 - protein, 133 aa, Heterodera glycines
  Coding regions on vcDNA: vcDNA=SeqID_75878; Strand=+; Position=1 -186,2007-2105,2165-2278
MIGRSVAEFGADAHSGQLRRVGGRLPISSDSSAANTQVIVTPSSRSAKGIPLKLLESLEHSEGNDTVFSCLFGTEGGNRAEISYNQWTDNIPLVEASKQMISEQTFSTGKETNGCAISINYAYKLTSKDEQKM

SEQ ID NO: 149456 - protein, 138 aa, Heterodera glycines
  Coding regions on vcDNA: vcDNA=SeqID_75879; Strand=+; Position=1-415
  Homolog annotation: Hit_ID=NP_491194.1; Match level="QueryCoverage =94%, HitCoverage=30%, E-value=2e-12, Identity=32%"; Hit description =COLlagen structural gene (col-50) [Caenorhabditis elegans] gb|AAB53052.1| Collagen protein 50 [Caenorhabd
MSANCYMGSRVLISVSIGGTALITFVTLITLVTLCRDINSLYDEIISDLDEFKDIANHAWKTMMDERLVKGGVAEQFGSGDAEFVRRQPRQSYADGDAAATATGGSAARVSSASAGICKCARQPNNCPKGPQGPKGQP

SEQ ID NO: 149457 - protein, 237 aa, Heterodera glycines
  Coding regions on vcDNA: vcDNA=SeqID_75880; Strand=+; Position=1 -224,832-1213,1366-1472
  Homolog annotation: Hit_ID=NP_506053.1; Match level="QueryCoverage =27%, HitCoverage=17%, E-value=3e-10, Identity=48%"; Hit description =COLlagen structural gene (col-37) [Caenorhabditis elegans] emb|CAB09131.1| Hypothetical protein ZK863.2 [
SSPGPPGSQDPPGPPGLLANPATEGSPGRLAKRDPPGPDAAYCPCPPRTGEVAGKQQQSAGAGGYRRFFRAFHSRIRPSNLEHHYEQLLFNAELSSSDRELLARRIIAVHFHLSIMAKLALPNESSSSSSSKMKNKKSRKPEKSDGGPVDYAHAYQTIRQTIELVSAKDFVPMEHLCHLWQLERLFNRRSDTEDKARDELIKACNFVKVVLLIGESGQDRITGIKTPVLTGFIPRHR

SEQ ID NO: 149458 - protein, 46 aa, Heterodera glycines
  Coding regions on vcDNA: vcDNA=SeqID_75881; Strand=+; Position=1-138
SPFQNLFLDNKMFGLVGNAGELWRLEINHTKKPFTCVIFEIARKIT

SEQ ID NO: 149459 - protein, 150 aa, Heterodera glycines
  Coding regions on vcDNA: vcDNA=SeqID_75882; Strand=+; Position=1-453
  Homolog annotation: Hit_ID=AAB71889.1; Match level="QueryCoverage =72%, HitCoverage=5%, E-value=5e-09, Identity=30%"; Hit description =hybrid histidine kinase DHKB [Dictyostelium discoideum] pir||T08875 histidine kinase homolog DHKB - slime m
MQNSQEQQQRHQQQQQQQHSQKEQPKQQQQKQQRKRKCEDGEEHSARADSVATTNKIVAVEQPTKPVAAAAAVAVPSTRTTRSSNRIAKQYTQNTSKTSQSPHQQSANSTDCQYDNFHHQQRGGGGTQRRSGGKSQQQVKGERKSWDGKK

SEQ ID NO: 149460 - protein, 69 aa, Heterodera glycines
  Coding regions on vcDNA: vcDNA=SeqID_75883; Strand=+; Position=1 -143,195-260
IINMDTTMEQPAEDVEDVQLDLGKKKKKKKAKTTELKLSEDEHEEEKEVTALAEGVGRTNLLDAKNPRR

SEQ ID NO: 149461 - protein, 81 aa, Heterodera glycines
  Coding regions on vcDNA: vcDNA=SeqID_75884; Strand=+; Position=1-243
MVFSHDEWFVQCVPALCEQLDKLLLLSQHQREEEGNSCLQQRRNTDDDGECHVRRVLRHLLALTTRIPMRTRPRTEMGLFI

SEQ ID NO: 149462 - protein, 83 aa, Heterodera glycines
  Coding regions on vcDNA: vcDNA=SeqID_75885; Strand=-; Position=1 -213,381-419
MANRNASAVSKMLCCKSWANSLSSPLIVKATFESSINCNALTAHSVAASCKCCEVLGWLSTERTERKKGERTKKYPKSTNETK

SEQ ID NO: 149463 - protein, 325 aa, Heterodera glycines
  Coding regions on vcDNA: vcDNA=SeqID_75886; Strand=+; Position=1 -370,638-876,920-1058,1111-1220,1271-1388
  Homolog annotation: Hit_ID=NP_957381.1; Match level="QueryCoverage =97%, HitCoverage=33%, E-value=2e-46, Identity=32%"; Hit description =similar to transportin-SR [Danio rerio] gb|AAH45332.1| Similar to transportin-SR [Danio rerio]
SIEAGLGRNSTAIITQLSAALCDLYIHVVHWKGLVAQILVQFDSPTSSSNSTVLVALFKALPEELYSHKLKIGENRRTEIEEELARHMETLLSKLVIILRLYKNVSSLLLWRNRLARSAVNRKLTRSPFFRSVLSVLSQPNTSQHLHDAATECAVNALQLIDDSKVALTMSGELSEFAQLLQQSIFETADAFRLAMREEDSEKLQNFTRLYAEQSNAFLSAMANNPRKGFGDLRMLDMLLMANDYHDYTLCEMSFNVWYQLSEHLYQCNEAEFDELQGIFTPYVEKHILSLCKHCRVEPDSQDLLDKNSEHADFRSKAQESVKDV

SEQ ID NO: 149464 - protein, 54 aa, Heterodera glycines
  Coding regions on vcDNA: vcDNA=SeqID_75887; Strand=+; Position=1 -130,502-536
MSPLRFFVALFLITLAILAGTHGTVENSVDGGPNMASPIIRERPKSLLLVLIML

SEQ ID NO: 149465 - protein, 202 aa, Heterodera glycines
  Coding regions on vcDNA: vcDNA=SeqID_75888; Strand=-; Position=1 -89,593-715,886-964,1135-1422,1500-1529
  Homolog annotation: Hit_ID=CAE60853.1; Match level="QueryCoverage =59%, HitCoverage=37%, E-value=7e-22, Identity=41%"; Hit description =Hypothetical protein CBG04562 [Caenorhabditis briggsae]
MFASVFMILLATSERLLQTFSGRKIVKTRRILQRHRPQVTLLVMCVSFAYKMSIYFEIEVIEIANCTDFERFEVRSAVEGEEWKFYRFWWMFVFRNVIDHIVPFFLLIILNFFIIRALNREHIRATHSFATAAASASALTLRGSSASSDDGRASAAAAAATRRESLCQKGSGRRLQRHALTLAEDNAQKKNLRRFFGKFEKT

SEQ ID NO: 149466 - protein, 57 aa, Heterodera glycines
  Coding regions on vcDNA: vcDNA=SeqID_75889; Strand=+; Position=1 -72,329-430
MFTFICFFMLLISPIISAQNSKCQCPKNEQPGQLKCTGCEPSCDNRNPDGAILQLLM

SEQ ID NO: 149467 - protein, 228 aa, Heterodera glycines
  Coding regions on vcDNA: vcDNA=SeqID_75890; Strand=-; Position=1 -148,532-588,684-807,1404-1762
  Homolog annotation: Hit_ID=CAA48260.1; Match level="QueryCoverage =82%, HitCoverage=47%, E-value=8e-33, Identity=42%"; Hit description =nuclear factor I-C4 [Gallus gallus]
KDIQPQCRDTFVQSIADPCPQRRALCCVLSNPDQKGKMRRIDCLRQADKGIPLESTDGERLEKCGTCNFPTLCVNPYHISIAIRELDLWLANYIFTTDPDKPETRRRPRDKDDDNDDIDDGTVSDDSSEGIWGTGVFSAYELKKLHKPSIMCSSSGRGAKTAVPLLPNAVATTTTASSSSMTAPSVGATVFVGGGRKASLTAAGGTTVATTIVPLGSIWGKTQPQKWV

SEQ ID NO: 149468 - protein, 97 aa, Heterodera glycines
  Coding regions on vcDNA: vcDNA=SeqID_75891; Strand=-; Position=1-294
MGKAVAEVAEPIDALSGGKQSEEKADKRQPMLLPLDALFGVLSALDPQMIGRHCAILDRLESVIGRQTLTSVANLQKRIGTSDHLAVTWQCETLGNE

SEQ ID NO: 149469 - protein, 39 aa, Heterodera glycines
  Coding regions on vcDNA: vcDNA=SeqID_75892; Strand=+; Position=1 -84,1014-1049
MPNHRTVEDGTGVFASSLALLALALRRKIEKKKLPREED

SEQ ID NO: 149470 - protein, 47 aa, Heterodera glycines
  Coding regions on vcDNA: vcDNA=SeqID_75893; Strand=-; Position=1 -20,569-692
MRPKMRSFGAPQFRFVRTCENYFVEKIVQILFLFFLSTTDENDELHL

SEQ ID NO: 149471 - protein, 44 aa, Heterodera glycines
  Coding regions on vcDNA: vcDNA=SeqID_75894; Strand=-; Position=1-237
MSRRKGKHLINQKQLFIYLFIFVNGLAIAIGQSEKHLNSSRRKG

SEQ ID NO: 149472 - protein, 87 aa, Heterodera glycines
  Coding regions on vcDNA: vcDNA=SeqID_75895; Strand=+; Position=1 -102,540-698
  Homolog annotation: Hit_ID=NP_491691.1; Match level="QueryCoverage =100%, HitCoverage=13%, E-value=2e-11, Identity=43%"; Hit description= oxysterol-binding protein-like protein 9 (76.7 kD) (1G409) [Caenorhabditis elegans] gb|AAC24270.1| Oxyst
MARGQQRGCIRLRGAALGIDEENNAQFTIAVDGKGKNRAERDTWVRVLERVIHEKCGYYKPPQEDPLEELRKRVIIAENQSQTLMEQ

SEQ ID NO: 149473 - protein, 244 aa, Heterodera glycines
  Coding regions on vcDNA: vcDNA=SeqID_75896; Strand=+; Position=1 -435,1364-1513,1776-1866,1933-1991
  Homolog annotation: Hit_ID=NP_491691.1; Match level="QueryCoverage =98%, HitCoverage=36%, E-value=2e-29, Identity=35%"; Hit description =oxysterol-binding protein-like protein 9 (76.7 kD) (1G409) [Caenorhabditis elegans] gb|AAC24270.1| Oxyste
TRNLEQITARETDKTDQKRKKMLTEIIATAKRLQSSVDHSSVLLRQVQRDIGTSLTMSTDQQQKRRTAADKAIRSPTTMATTTGTAKAAMTEEDNLNGNEDGEGGKMGGGAGGGGPPQLQQHQRERQESEDEEMCPIGGGSNGKEHQQQSELSDWGQFDAKGTDYDAIYNNTHDEQDIGDINKQHGSVLMHLLSQVSVGMDLTKVTLPTFILERRSLLEMYADFFAHPDDFISAVDEDSPEIRR

SEQ ID NO: 149474 - protein, 79 aa, Heterodera glycines
  Coding regions on vcDNA: vcDNA=SeqID_75897; Strand=+; Position=1 -87,206-358
MDKFVIFRRNAAINSCFLVPALKVSKITQMDVALLLARSGASIEKKNRQNKTPIDLVDGKEQKLKLIKASESVKPTAGT

SEQ ID NO: 149475 - protein, 171 aa, Heterodera glycines
  Coding regions on vcDNA: vcDNA=SeqID_75898; Strand=+; Position=1 -64,268-336,384-445,632-754,1004-1153
  Homolog annotation: Hit_ID=CAE58385.1; Match level="QueryCoverage =98%, HitCoverage=98%, E-value=1e-37, Identity=48%"; Hit description =Hypothetical protein CBG01514 [Caenorhabditis briggsae]
SATDIFSLLDAIDKLKHLKRTGWVLVGISEPETVASHMYRMATLAMTLSAHRTDLDVNKCMTLSAHRTDLDVNKCIRMALAVETISNWLPETVGDEWKNLWREYDEGKSAEAKAVKQLDKLDMLAQAFSYEKRLSIDLTEFFDATSNAFSEEPFASWAAQIRLGREQKTMT

SEQ ID NO: 149476 - protein, 330 aa, Heterodera glycines
  Coding regions on vcDNA: vcDNA=SeqID_75899; Strand=-; Position=1 -274,370-439,495-727,982-1290,1411-1485
  Homolog annotation: Hit_ID=NP_508917.1; Match level="QueryCoverage =94%, HitCoverage=64%, E-value=2e-99, Identity=60%"; Hit description =calcium-activated potassium channel family member (XG9) [Caenorhabditis elegans] gb|AAK18882.1| Hypotheti
PPPPPFSLTVTLPPSTSPCIPFIVSHFCPLPGTGTIRWAFFEPSRVWSQADERSVYNVRVPVDVVLSLLMLSRVYLVCRWQVLHSKQFQDASTRTLAALNRIQVNFAFVLKTVLDQRPMFFLSIFLDQRPMFFLSIFLFVFWLITAWSFAQCERFGRDVDDPFILYTNALWFIAITFNGNGYGDIVPKSLAGRLIAILVGISGAVISSILIAVISRKILLSQGQKNVNNFMNDSRLTLAHKHAAARVLQKTWHIYRCLRSSDAADHQLRRHQRKFLNAIHQFRRIKNKIRSFGENGSATVQQLSRLMTEMHSHTQRLALAQEEMRVQIEL

SEQ ID NO: 149477 - protein, 108 aa, Heterodera glycines
  Coding regions on vcDNA: vcDNA=SeqID_75900; Strand=-; Position=1 -158,628-736,996-1039,1331-1353
  Homolog annotation: Hit_ID=CAE62167.1; Match level="QueryCoverage =82%, HitCoverage=9%, E-value=1e-32, Identity=69%"; Hit description =Hypothetical protein CBG06214 [Caenorhabditis briggsae]
KDSLLDARSAMPTGKRPLFYFHVRAEFFSFAGTLSTAHTLSMPFTIATRRNQDCQVQRMMSSYTATCFWLYGTNVLDGLLIQWFDGGQYWKHFKLLYSLYFLKFQIFS

SEQ ID NO: 149478 - protein, 21 aa, Heterodera glycines
  Coding regions on vcDNA: vcDNA=SeqID_75901; Strand=+; Position=1-65
MNSSLIGGSLGSWIDEERSQL

SEQ ID NO: 149479 - protein, 168 aa, Heterodera glycines
  Coding regions on vcDNA: vcDNA=SeqID_75902; Strand=-; Position=1 -31,1535-1803,1898-1971,2394-2533
  Homolog annotation: Hit_ID=CAE59996.1; Match level="QueryCoverage =99%, HitCoverage=16%, E-value=2e-30, Identity=43%"; Hit description =Hypothetical protein CBG03489 [Caenorhabditis briggsae]
FQYPCKFCCASAFSDPEDLYLLLVFSFFPKNFSKCNEANFLNLQINYLFSFPMKTLCRFCFFRDFSLQIVSEEVAQQIQQERHRKTFDPPSPVRKTPTPSAALLAMKPATGVKRNNAKASEVAEGGNTAHKKSDVNSRECISIPPLFDAEHNGWCATYPHLLCTTRQK

SEQ ID NO: 149480 - protein, 156 aa, Heterodera glycines
  Coding regions on vcDNA: vcDNA=SeqID_75903; Strand=-; Position=1 -27,246-350,727-876,929-1117
MAINLLFFKEKIHARLVELVNKAHRMQPPPTVQPNDQQFERFYQAYVTALISLHELYTLCQQKCLTSAEFEAHLANFKKQLVAALALQRDFSNCHGNLLWRKLREHQIHRMTHYGYDNRTFMDSALSFYAHMLYNLGVLAARIQVKKEEGWHANWS

SEQ ID NO: 149481 - protein, 43 aa, Heterodera glycines
  Coding regions on vcDNA: vcDNA=SeqID_75904; Strand=+; Position=1-134
PGLDPGLEEPGFFLDLDFCPGNPGPGPTWNPGPGPGFFQNVDL

SEQ ID NO: 149482 - protein, 62 aa, Heterodera glycines; identical to SEQ ID NO: 125756
  Coding regions on vcDNA: vcDNA=SeqID_75905; Strand=+; Position=1-289

SEQ ID NO: 149483 - protein, 151 aa, Heterodera glycines
  Coding regions on vcDNA: vcDNA=SeqID_75906; Strand=-; Position=1 -138,1903-2025,2088-2282
MASSLIIGQMQQPTNINANANNNNFNNNNSNNNSEFAPLHMEMFDFGHYQFRRMAFFTIAWQMVICDLMTQTVQIIVAVPITFTGEAVYGHPFWYYAVLFFDTVAYNATLHFSALLTSNRLCVFFVPRLNAFLFSYPNIFGYSKTFGIRNQ

SEQ ID NO: 149484 - protein, 18 aa, Heterodera glycines
  Coding regions on vcDNA: vcDNA=SeqID_75907; Strand=+; Position=1 -37,348-367
MIPTIFGYIANDLNLLQN

SEQ ID NO: 149485 - protein, 108 aa, Heterodera glycines
  Coding regions on vcDNA: vcDNA=SeqID_75908; Strand=+; Position=1 -169,223-380
MKKSVTVAVPEQKEINQPNAEVEPPKSDTTKKRKVEDQELWKLAKGKFMLATYLCADDWDRLFHNQQKVARLEDGRFAVCFELCEECVWRNCRANDLIASMKKKQNNA

SEQ ID NO: 149486 - protein, 591 aa, Heterodera glycines
  Coding regions on vcDNA: vcDNA=SeqID_75909; Strand=-; Position=1 -610,640-1512,2197-2489
  Homolog annotation: Hit_ID=CAB62280.1; Match level="QueryCoverage =53%, HitCoverage=88%, E-value=1e-24, Identity=44%"; Hit description =hydroxyproline-rich glycoprotein DZ-HRGP [Volvox carteri f. nagariensis]
MANKFLLVPQEIYRGLTSMSNTGDLNLDAVRHDLDRARAERTHPSTKNVHYNQQLRRYLKMRRELEDRPAKVELTKGISVLLRKGGEDENGEVVDIPPRPPAPPPPPPGRRPRRGPSPPAPPPPPPPAGRRSRPPPIPPAPAPYPPSPPPRPERPPRPSRAAAPSRRGDSRLEQWHKRRSDIQRQRPIVRDLLAEAAAAPLPEKWALPAPSQYYGDLPALPDNADEIEEMDTAQRRIATRRKLKKDETDYADLQGKRQRIYRPSPPRLPLPPRLKTKAGPRPAPPPPSPRRPSVKLEKKEPKLMEVKPSTLKQADHPTPAPRANREPMSGLDPRPSTSREAGYFPPATYKIEPKHEPTKRPMPYRIPKKEPKSKEKPPQTQQQQPPPAAVVEEMPYVPPPRRGTKRHYPVNGDDEVRVRKRVRQPRRVRVQYSPEPGPSTSAQSDEQQQQQQRELFAIPSNQLTMPQRSERLYIKCNRYADRMGVRGNTINTANVPLSTSDKPFGTEDDNNFRLFDGELSGSGDDDDDNDDDDEMVRFNDWRAVSTTASHLYMPWRRIRSAMTSCTFSCCFSKSNHLRRTASEIDEVVSNG

SEQ ID NO: 149487 - protein, 255 aa, Heterodera glycines
  Coding regions on vcDNA: vcDNA=SeqID_75910; Strand=-; Position=1 -58,117-235,710-769,831-881,1041-1519
  Homolog annotation: Hit_ID=E86336; Match level="QueryCoverage=50%, HitCoverage=34%, E-value=8e-30, Identity=56%"; Hit description =hypothetical protein F14O10.11 - Arabidopsis thaliana gb|AAF88160.1| Contains weak similarity to an unknown pr
MPIFHNPEFAQHDMYLDDTLWDEENAADDDHQQKPEKIQHLWLIALVFVCVLAIGLHFLFMSDKMNKFQLAMLDKLEQKLISERQPKVNENFREIEAIISEAIDAKIKTAIYYVIGLAIAAFLLLMRLKANHEEERRREMEENEEEEGTHQMEENEEEEERGEMEANEEEEQGREEMEENEDEEESQEMEENEEEEERGEMEANEEEEQGREEMEENEEEEETQEMEENEEEEERGETEANEEEEQGREEMKRRG

SEQ ID NO: 149488 - protein, 79 aa, Heterodera glycines
  Coding regions on vcDNA: vcDNA=SeqID_75911; Strand=+; Position=1 -112,204-331
MHYFFTFYFMVVLFQRIDAIARPATFNRNILKNNSFEAKLSSILHNHPDKEGTLSKKEVFSNGVIRKCLNIFPIFLFIF

SEQ ID NO: 149489 - protein, 428 aa, Heterodera glycines
  Coding regions on vcDNA: vcDNA=SeqID_75912; Strand=+; Position=1 -183,301-379,453-508,1010-1086,1308-1348,1847-1953,2054-2108,2451 -2576,3120-3335,3970-4062,4131-4203,4301-4405,5179-5198
  Homolog annotation: Hit_ID=NP_510435.1; Match level="QueryCoverage =99%, HitCoverage=34%, E-value=9e-90, Identity=38%"; Hit description =nephrin (142.0 kD) (XP281) [Caenorhabditis elegans] emb|CAB63432.1| Hypothetical protein C26G2.1 [Caenorh
PPRIAVEGPMSIVIGEGQSFEENVTIYANPRVNAFAWRKNGITIDRTVGTIFVRQSVIGGDGVTKDDSGIYTLFVSNGVGTANATIKVVVVVEYAARITYITTPVIASVGEDVVLECEADGMPMKAGMIKWFRGGAYTCTVDNGIGQPNHTTAYLLVRRAPVIVKNAAFSRAAGPIGGKAVLRCRATAVPNAEFTWGIEGELVHYNTTKYRFFDTQLDYTTFQSTLTILNLEEHDYARRYRCRAQNRLGLVQSFISVGPPAPPELPTELEIVNVTNSTASISWTAGFDGGAEQMFELLYQDMDSNEIRSLNTSETQVLLKGLDADHGYQLQIRSINARGDISDLTRPLLFRTMDENSQSAGVPLLFRTMDENSQSAGVGFSIITKVNSAIVALCVALLALLLLNCLLICYLNRRNKRRKMREPTEGKQ

SEQ ID NO: 149490 - protein, 37 aa, Heterodera glycines
  Coding regions on vcDNA: vcDNA=SeqID_75913; Strand=-; Position=1 -47,127-193
MADLKKMKRDTEAEKKAESKNGLQKRHFSRPSNNKMF

SEQ ID NO: 149491 - protein, 308 aa, Heterodera glycines
  misc_feature (167)..(167): Xaa can be any naturally occurring amino acid
  Coding regions on vcDNA: vcDNA=SeqID_75914; Strand=+; Position=1 -29,756-1679
  Homolog annotation: Hit_ID=NP_508294.1; Match level="QueryCoverage =98%, HitCoverage=26%, E-value=6e-63, Identity=42%"; Hit description =predicted CDS, endonuclease/exonuclease/phosphatase family and RNA -directed DNA polymerase (XC178) [Caeno
SYFNNSFFILKSCAETYLTLSITDLFRISLDSGSLPDIWKESIVFPLFKKGDKFNPENYRPISITCSLCRVMERILSQKQLSPKNNKISEYQFGFVRNRSTTSQLITVVEDWYEAIINGKVDCIYIDFQKAFDSVPHNLLLYKLEKIGIKGKLLMCIKGFLSNRTFXVKIGDSLSSSKKVTSGVPQGSVLGPLLFLIYINDLPDALPSGVKIKLYADDVKLYISDTEIMHNALHNLFEWANKWQIKVSIQKTFIYLGSKNPKETYKFDGNTINAVDTIRDLGVDIDNKLQFSDHINQITRNAYLRMRS

SEQ ID NO: 149492 - protein, 107 aa, Heterodera glycines
  Coding regions on vcDNA: vcDNA=SeqID_75915; Strand=-; Position=1-321
MGLVLSGKQCFTHGQVYVAMSRVTQMEGIRVFSPNTCMGDNCYIHNVVFQELLGLPLNASTPTEQFFDVNGNNAGALNEILNDETEELVSVPDFGSVMAEGSSPIAD

SEQ ID NO: 149493 - protein, 65 aa, Heterodera glycines
  Coding regions on vcDNA: vcDNA=SeqID_75916; Strand=-; Position=1-196
MPSASAGTVSVSNGTKANGNQPNKHMQMLAMAGPAPFSDSPEAIAIRDAVDYTQKITLEMAYNNT

SEQ ID NO: 149494 - protein, 67 aa, Heterodera glycines
  Coding regions on vcDNA: vcDNA=SeqID_75917; Strand=-; Position=1 -45,272-334,394-489
  Homolog annotation: Hit_ID=NP_496987.1; Match level="QueryCoverage =82%, HitCoverage=6%, E-value=3e-11, Identity=52%"; Hit description =IMportin Beta (imb-2) [Caenorhabditis elegans] emb|CAB05586.1| Hypothetical protein R06A4.4a [Caenorhabdit
MDATNWQPSQEELNQIVSLLQHSQSPDNQMQQRVQQHLDQMNAHPEFCCYLLYILSELTEQDVIHWI

SEQ ID NO: 149495 - protein, 30 aa, Heterodera glycines
  Coding regions on vcDNA: vcDNA=SeqID_75918; Strand=-; Position=1 -15,65-142
MDCCCALSPAAEEEKEARQSNEMASGAEVN

SEQ ID NO: 149496 - protein, 128 aa, Heterodera glycines
  Coding regions on vcDNA: vcDNA=SeqID_75919; Strand=-; Position=1-387
MPKRSKAGKAQKRRWRKWSNFKKGIEEARRTGETTPALVAAHEAAHSIVVKLNEDIAESFISTTIIGQNGLDGQTLSTRRPNEDCTPAQLRAALMATMAGKAVEIKLVGVSTGHADDLADARAAAREV

SEQ ID NO: 149497 - protein, 142 aa, Heterodera glycines
  Coding regions on vcDNA: vcDNA=SeqID_75920; Strand=+; Position=1 -155,898-1082,1559-1653
  Homolog annotation: Hit_ID=NP_492974.2; Match level="QueryCoverage =100%, HitCoverage=20%, E-value=1e-49, Identity=64%"; Hit description= kex-2 Proprotein Convertase, furin endoprotease (77.1 kD) (kpc-1) [Caenorhabditis elegans] emb|CAB04086.
VLWLEQQVVKKRVKRDFRPVIHRRRRHRRESSSSLTSTDGQSSSNSRCRRHGVPNDPYWKDLWYLHRRDEQPDMDHNVKEAWYLGYTGKGIVVTILDDGLERTHPDIGPNYDPDASYDVNDRDEDPTPRYEYTDENRHGTRC

SEQ ID NO: 149498 - protein, 593 aa, Heterodera glycines
  Coding regions on vcDNA: vcDNA=SeqID_75921; Strand=+; Position=1 -379,484-1886
  Homolog annotation: Hit_ID=XP_318550.1; Match level="QueryCoverage =99%, HitCoverage=63%, E-value=1e-152, Identity=45%"; Hit description= ENSANGP00000020240 [Anopheles gambiae]
MDQILAEFEFATAYLDDVIIVSQSVKEHADHLKKVLEKFQEWGFRIKLEKCSFFREEIKYLGQIIDRNGRRPDPEKISAISKMPAPTDVPSLRSYLGMVNHYEQFVKNMRFVRKPLDDLLKQDSEWTDASELGIGAVISHKFPDGTIKAIAHASSALTPAEKNYSQIEKEGLALIFAVQKFHKMIYGRKFTLLTDHKPLLAIFGSKKGVRQCSANRLLRWSLILLAYDFSIEYISTNDFGQADVLSRLIANGKSDEDRVIASLRSDSEIDDILIGSIEALPIKFKEIIAAAEADKTIQKVKKFLTNGWPRNVGDESAEIKLFHRIKEQLCITRNCLMYADRVVIPEKLRQKTLHAFHKGHPGIKRMKQLARNYAYWPNMDADIQQMVENCQPCQMEAKAPVKSNLQPWPKPSAPWQRVHIDYAGPFFGKEYLIIVDAFSKYPEVFEMATKSTAATIEKLRYLFSRHGIPEILVSDNGTQFTSNEFAKFMAVNGVNHLFSAPYNPMSNGQAERFVDAFKRTFRKLKGEGAPSKEIIETFLVSYRTTPNDSLPNSKTPAEMFLGRKPRTTLDLLRPPPAQPIERDVEMARRFNKR

SEQ ID NO: 149499 - protein, 43 aa, Heterodera glycines
  Coding regions on vcDNA: vcDNA=SeqID_75922; Strand=-; Position=1 -56,381-456
MKINIECSEKQRIGDFMVGLVSLRNEMSKIFTTLTLKKRVWSF

SEQ ID NO: 149500 - protein, 28 aa, Heterodera glycines
  Coding regions on vcDNA: vcDNA=SeqID_75923; Strand=+; Position=1 -12,76-150
MISMAQNYFFQVYVEYYATFGFWSYCTL

SEQ ID NO: 149501 - protein, 71 aa, Heterodera glycines
  Coding regions on vcDNA: vcDNA=SeqID_75924; Strand=+; Position=1 -84,172-303
MIAIPIILIFFVQPVICLKILCFIHSKMFEANSFLQQQPNCSHLVIKDFAKIGLKEFKADLNARYKAQYLK

SEQ ID NO: 149502 - protein, 126 aa, Heterodera glycines
  Coding regions on vcDNA: vcDNA=SeqID_75925; Strand=+; Position=1 -154,453-679
MSPKNGNTLVFPIGIEGQKNFVQKLKRNLRHLRSLNPLTGKPIFSGLFFRAAAFQKEGEFFGFFPLLAKLREEKLRKKNTPSFGEFMLGIDSHFNPYTIGFPANKSIANLIDIFYLSMMSDGLIKV

SEQ ID NO: 149503 - protein, 126 aa, Heterodera glycines
  Coding regions on vcDNA: vcDNA=SeqID_75926; Strand=+; Position=1 -154,452-678
MSPKNGTTLVFPIGMKGQKNLFQKLKRNLRHLRSLNPLTGKPIFSGLFFRAAAFQKEGEFFGFFPLLAKLREEKLRKKNTPSFGEFMLGIDSHFNPYTIGFPANKSIANLIDIFYLSMMSDGLIKV

SEQ ID NO: 149504 - protein, 235 aa, Heterodera glycines
  Coding regions on vcDNA: vcDNA=SeqID_75927; Strand=-; Position=1 -15,145-597,1150-1266,1570-1692
MKNNLNNNNGNNNNNTNQTQPEKTSPILLPPFLASTVMPPAGEETSTVVDQHTVDGLTLTEEKPTVDGRGPMNSTPAEENHHTVAMENHTVDGGPTHTVVDGSSSHQQKGDQEDQDEADHQQQGEEEEDYAIDDDDDEDGGFGTLIGLANSETTVSAVPNCSECANGAKCVRVGQRIRCLCGADFAGTLCNIKKPLCAALKCHRPGELCQPIRGQPGGKKDMAHCECQLGMGGKR

SEQ ID NO: 149505 - protein, 136 aa, Heterodera glycines
  Coding regions on vcDNA: vcDNA=SeqID_75928; Strand=+; Position=1 -28,1622-1696,1795-1892,2060-2123,2332-2457
  Homolog annotation: Hit_ID=CAE57492.1; Match level="QueryCoverage =86%, HitCoverage=93%, E-value=8e-37, Identity=57%"; Hit description =Hypothetical protein CBG00462 [Caenorhabditis briggsae]
PAAVRTAMEFAIKMTVETVPADLRNLRACLVCSLVKSEDQVKSEDQFMADGCDNCERFLNIKGDIDKCYECTSANFDGIIAVCEPNDSWVCKWQKINRKCPGIYAVSVSGNLPKHVVAELSHMGIKYKSGQRDKSA

SEQ ID NO: 149506 - protein, 118 aa, Heterodera glycines
  Coding regions on vcDNA: vcDNA=SeqID_75929; Strand=+; Position=1-357
MPLKTMPFSALYPVLAPQNHIYPPSKPGGHWHSKVPGKFTHLPPFWHGPRNSDNSRPPPTSSPPKACDEEASTVSALRPTFAPWHSSMSSAQCRPSKPALHSQTKSFLIRGTLGWVFF

SEQ ID NO: 149507 - protein, 91 aa, Heterodera glycines
  Coding regions on vcDNA: vcDNA=SeqID_75930; Strand=-; Position=1 -138,866-1003
MASAKTWTTAATTAAFAMPISPAHIARQNANHRALWRRQMHRPALAGDHCELDVMAAAPCAGEDGSANGQCQNGGQCVPAGTKAFCICPTG

SEQ ID NO: 149508 - protein, 59 aa, Heterodera glycines
  Coding regions on vcDNA: vcDNA=SeqID_75931; Strand=-; Position=1 -123,812-868
MWRKISGRRGRRSGRLSSEFAWMSICACLPPGPGERRVPLRGLPINRRIIHFTFFFFWF

SEQ ID NO: 149509 - protein, 27 aa, Heterodera glycines
  Coding regions on vcDNA: vcDNA=SeqID_75932; Strand=+; Position=1 -62,436-457
MQKRLISFVVWLLISPAITFLFCFRVL

SEQ ID NO: 149510 - protein, 22 aa, Heterodera glycines
  Coding regions on vcDNA: vcDNA=SeqID_75933; Strand=-; Position=1-6,64- 126
MPLRDTRLMTKTLNVQNGKFAK

SEQ ID NO: 149511 - protein, 41 aa, Heterodera glycines
  Coding regions on vcDNA: vcDNA=SeqID_75934; Strand=+; Position=1 -8,100-217
MGRSRCGIGIQNFCGITGGQAVLDTRTRSTTKFGHLSSAEI

SEQ ID NO: 149512 - protein, 84 aa, Heterodera glycines
  Coding regions on vcDNA: vcDNA=SeqID_75935; Strand=-; Position=1 -67,324-511
MTCKKLTNFEMAWSMDELPKCEDFVRRAVREAMADGQTQPITAADQTSEYGQLDALVRAAKPEKGESIEKREKQQPIGADQCLL

SEQ ID NO: 149513 - protein, 419 aa, Heterodera glycines
  Coding regions on vcDNA: vcDNA=SeqID_75936; Strand=-; Position=1 -790,1068-1348,1438-1626
  Homolog annotation: Hit_ID=EAL34282.1; Match level="QueryCoverage =39%, HitCoverage=24%, E-value=6e-09, Identity=29%"; Hit description =GA21482-PA [Drosophila pseudoobscura]
MQNFPAASAPASSSSSTGFGISGGGCVAVTAPSPTFSSTTAITSVPQQQFIHPPYTTANSVTTVSPLSPAKHQQHLVVDQSAQQPQKHYHHQQRHPNVPFATPRGDGTTMVHQHHHHHRLAAHHHQYSSHGMGMGQPLARHSASLLPSTAGQSLEDLADLAQASSSLLQHATSSLMRSTSTASGPPSPPSQSSSAAGAVNHQQQLQQVQPVQTHQQQQQPTMHFKVVATNDNGSGTHNRPEILYHPKEYRQQVFTVQQQREEEANIRIEQQRQHYPLQHHRPPVAKKLTKKQMATIQREFNELLPFGSTSGGGGAAAANASTLCQQMEKAVTIDGDTKLLQQQQPKKRGRASKETIGVIPTKNDGTDNDGLAAADRPARRSASTVGAKRSAEADGGQKLSNEGTTSKKKRIWEGADYVT

SEQ ID NO: 149514 - protein, 90 aa, Heterodera glycines
  Coding regions on vcDNA: vcDNA=SeqID_75937; Strand=+; Position=1-273
MCLLIILCFCLFFFLFFFFFAFFEKCQKRIFEFPGDKKSNERMAKEEKALKSERKETNGNPPKEKLNFRTKVGMTAGHFESELIGVCCEL

SEQ ID NO: 149515 - protein, 217 aa, Heterodera glycines
  Coding regions on vcDNA: vcDNA=SeqID_75938; Strand=+; Position=1 -54,508-687,1125-1266,1563-1698,2180-2237,2279-2360
MRITDRIRTFEQIVTEIDFLYTVSTEVPSALSDEHWVQLLDTVSAAEREHLLRTIHYAQLVEKAAAAERQTLKNGTKTLDVIAGVNDDDDDGCVAHSSSSATTATNSPNYQQMFGDEFCDQSALKSRMDTHFGLALCRNFLLEPSDRMPNLFVDCRFMYAHKTAHILSAANQWHFLHGTPNEQSKEMGGGHFVPHPFAPQVTTRGLSEICERNSIPK

SEQ ID NO: 149516 - protein, 71 aa, Heterodera glycines
  Coding regions on vcDNA: vcDNA=SeqID_75939; Strand=-; Position=1-214
MKNLTYFFVSILFMLLLKHQIFVDGTKTGKSVEAKKRGETLGQLKAKEGKDKAENLQAEEKQKKKNLGDLI

SEQ ID NO: 149517 - protein, 236 aa, Heterodera glycines
  Coding regions on vcDNA: vcDNA=SeqID_75940; Strand=-; Position=1 -79,129-250,765-1067,1127-1240,2255-2347
MFSNKRKCSFNPDWENSDWLFRLFLNSKKGAEQLQFDIESVVYKLTSYFKGSTQRHTEFHEICDQYENFYKIVLKYIDRWFQLQLLPKNISWTNLQNHPLNSAEVVQLAEQICPEIAQLDELFDEVSAVNQTLADIPEEFWLKSAEDKWKGIFEADGATEAYANLYRIIPTSNAFVERVFSLASSQWTKERNLLEVESVKALLLVQESEQIFFCGDFLAVVFSILAPSNDNPKSNL

SEQ ID NO: 149518 - protein, 74 aa, Heterodera glycines
  Coding regions on vcDNA: vcDNA=SeqID_75941; Strand=+; Position=1 -82,237-379
MLFVRDPSGSVWNTDPGPSPDFQLQVLPFVFKPAIFVTSIKIILSYYEQLRKSVILRYGTHDMIVFFFYRLKNF

SEQ ID NO: 149519 - protein, 237 aa, Heterodera glycines
  misc_feature (6)..(6): Xaa can be any naturally occurring amino acid
  misc_feature (127)..(127): Xaa can be any naturally occurring amino acid
  misc_feature (139)..(139): Xaa can be any naturally occurring amino acid
  Coding regions on vcDNA: vcDNA=SeqID_75942; Strand=+; Position=1 -24,288-369,470-638,945-1018,1101-1239,1302-1421,1653-1705
  Homolog annotation: Hit_ID=CAE75210.1; Match level="QueryCoverage =92%, HitCoverage=38%, E-value=1e-44, Identity=40%"; Hit description =Hypothetical protein CBG23158 [Caenorhabditis briggsae]
STKNHXNVLILLEEDHIVAPDFLHTLQLIVKNRKNICICSNCEMLCLGTYPSTFANYAENINKLGVEVWFSSKNNLGLAMDRQLWRQIQNCAKFFCTWDDYNWDWTLLQLSIQCLPKSKGLVLIKHXLIGKGLVLIKHXLIGLQFILLLIRVIHVGDCGVHWHKCENDRRSLDQALRDLFRDLFDRVNDSFFPSKLEVSHVNGHMKGVPSGPNGGWADPRDHRLCELNTIHQLMIIP

SEQ ID NO: 149520 - protein, 121 aa, Heterodera glycines
  Coding regions on vcDNA: vcDNA=SeqID_75943; Strand=-; Position=1 -327,420-458
MRYIGESAKAISSVVGSTVPFGGGLGFPFGSGGTTSGTPLRRTASSGANRHNGLDDGAISGTPLRRTASSGAGLTRPNRHNDLMALEPLREAMYVPASLVNGDNEIMKEDLANCWAKENSR

SEQ ID NO: 149521 - protein, 53 aa, Heterodera glycines
  Coding regions on vcDNA: vcDNA=SeqID_75944; Strand=-; Position=1 -30,291-422
MSCLFTELTETGSFPPNRTRHFEQITDNKMLAMASKRRKARLSSSRKCEWKMR

SEQ ID NO: 149522 - protein, 39 aa, Heterodera glycines
  Coding regions on vcDNA: vcDNA=SeqID_75945; Strand=+; Position=1 -58,157-218
MLIFLIVISAVLINSALGNVDHPKTAVDKSTNEGIVTIF

SEQ ID NO: 149523 - protein, 74 aa, Heterodera glycines
  Coding regions on vcDNA: vcDNA=SeqID_75946; Strand=+; Position=1 -207,272-289
MVWLLAASSGFNGANAVGDNGVVQVNPTIPPANAPLPPKHFVNLRDLKPHTQLVPNVPRKFGKNANNGKKNGGQ

SEQ ID NO: 149524 - protein, 51 aa, Heterodera glycines
  Coding regions on vcDNA: vcDNA=SeqID_75947; Strand=-; Position=1-155
MCRARPGPGSKPGFFLGPGLNFSWIPGSSSRSRSFFVNMDFPGFLSRKSSP

SEQ ID NO: 149525 - protein, 149 aa, Heterodera glycines
  Coding regions on vcDNA: vcDNA=SeqID_75948; Strand=+; Position=1 -112,302-415,717-862,1401-1478
  Homolog annotation: Hit_ID=CAE66591.1; Match level="QueryCoverage =99%, HitCoverage=62%, E-value=4e-38, Identity=51%"; Hit description =Hypothetical protein CBG11915 [Caenorhabditis briggsae]
EEQIVGWEPDDYEKELVKRTWSDDFDFLYELGASIYDYIFEHNPQAKQLFPKIHRHGDEWRQSADFRSQALKFVQTIAYAAKNLYHMEECLKPSLLAIGERHVQYAARGFRPEHWNIFLARISTDLVWTLTRDPFLWDPKSSGLITIWS

SEQ ID NO: 149526 - protein, 117 aa, Heterodera glycines
  Coding regions on vcDNA: vcDNA=SeqID_75949; Strand=-; Position=1-355
PNPYQIPMILERPSDCIPSRDPDQVPINPDDFGKMIGTDPESGSRPNPDQIPIILEKRSERIPSQGPDQIPTKSRLFWKNDRNGSRVRIQTNPESGSRPNGDQSYYYFEFSIEKKLF

SEQ ID NO: 149527 - protein, 208 aa, Heterodera glycines
  Coding regions on vcDNA: vcDNA=SeqID_75950; Strand=-; Position=1 -276,327-677
  Homolog annotation: Hit_ID=AAL78214.1; Match level="QueryCoverage =88%, HitCoverage=94%, E-value=7e-14, Identity=30%"; Hit description =putative esophageal gland cell protein Hgg-20 [Heterodera glycines]
WICNDVWMDIFPSFDRAQLGLKLALLSPRFNALVDKHFNGKSELTIWRTIEIQKGKGPEPKLSVQMDDKFVPFPLPDRPLPSKIRFKRLRMWYIGHSVIAFLRSNHQIFNKRGTNLKLWLPSSHTTNGQRIWDIFTREIWHFFSTNIRHLGFYNGDHLDHLLRQISPTILIDLNQLVSIHSFDLLPEAIGDDFDVPNATISTGQALSK

SEQ ID NO: 149528 - protein, 156 aa, Heterodera glycines
  Coding regions on vcDNA: vcDNA=SeqID_75951; Strand=-; Position=1 -11,85-273,414-684
MNRRWICNDVWMDIFPSFDRPQLGLKLALLSPRFDALVDKHFDGKSELTIWRPIEIRRKDKGPEPKLYIDHSVIAFLRSNHQIFDKRGTYLHLRIPSPHTTEEQPIWDVFNNFCWPSIVQMVALSEKRWPTQAIALRWLQRTNGLRLDQQFQGGVA

SEQ ID NO: 149529 - protein, 29 aa, Heterodera glycines
  Coding regions on vcDNA: vcDNA=SeqID_75952; Strand=-; Position=1 -35,139-193
MYGFVLKWTELCLLDAASPGPSDQQKKDA

SEQ ID NO: 149530 - protein, 115 aa, Heterodera glycines
  Coding regions on vcDNA: vcDNA=SeqID_75953; Strand=+; Position=1 -47,324-624
MANRLTNFYHCGPVPKFIRSFFCDAFVCEHFNELELFYYGQRLIFRITDMEFANESEGKTKGEKKKTDEKGQAADEGRQNVKTHRISPLCAFDIHWNEVRENARREEDDDPENLC

SEQ ID NO: 149531 - protein, 122 aa, Heterodera glycines
  Coding regions on vcDNA: vcDNA=SeqID_75954; Strand=-; Position=1 -119,161-376
  Homolog annotation: Hit_ID=CAE63700.1; Match level="QueryCoverage =80%, HitCoverage=26%, E-value=1e-34, Identity=71%"; Hit description =Hypothetical protein CBG08215 [Caenorhabditis briggsae]
MRVAFPATQRTRCCDAFPSIEKIPRVRCPTLVIHGVDDDVIEFSHGMKIYVIEFSHGMKIYENCPGSVEPLWVRGAGHNDVELHAAYLDRLRQFIDSEVCNPPTHREQLKNAKRPQTNQQAQ

SEQ ID NO: 149532 - protein, 193 aa, Heterodera glycines
  Coding regions on vcDNA: vcDNA=SeqID_75955; Strand=-; Position=1 -170,303-352,401-604,648-681,815-937
  Homolog annotation: Hit_ID=NP_492210.1; Match level="QueryCoverage =93%, HitCoverage=43%, E-value=9e-63, Identity=64%"; Hit description =i-67 protein (1I607) [Caenorhabditis elegans] pir||T23321 hypothetical protein K04G2.2 - Caenorhabditis e
MTATTIAQDPTPSPRRVFLRDLCSLFCCPPLPSAIVAKLAFMPPEPSYRILTNDSGRTTLELIDGRTEWPHGQDELNNVEVFFTRTQRRNKIACMFVRPFELSHFTLLFSHGNAVDIGQMCNFYLGLGCRLRCNVFSYDYSGYGQSTGRPSEKNLYADIAAALKSLESRYQIPPEQVILYGQSIGTVPSIDLA

SEQ ID NO: 149533 - protein, 26 aa, Heterodera glycines
  Coding regions on vcDNA: vcDNA=SeqID_75956; Strand=+; Position=1-80
IHTPSEKTRCVPINRECQRKTLSFFL

SEQ ID NO: 149534 - protein, 371 aa, Heterodera glycines
  Coding regions on vcDNA: vcDNA=SeqID_75957; Strand=+; Position=1 -60,652-867,918-946,1120-1410,1452-1916,2366-2420
MLSGVNSSTDTENSYEFRTKARLSKEAVKDIARQQPDAQPRNVIAQERAQLSDEARMNLPSASSLQRSIERQREIPDRARIDANEIANDVIEGILLISEFFSRKNAYLHVYGNDVQIRFCLFHLGQSINRRVSKDKLIHYYTTNNEYKILVRSLAALAFLQEFQVVPGFNLLRLKAQELNVQVIQDGGQPISVFDYFGRTYVHGHAGHGPLFPIATWNHHESIIQDMGRTNNAQEGFHLALRTQFTSVHPPLSKSKCFAPFGNPSKCRLVTVLKKEERIAADKLRQYELDPTNGIRLRERKKVYRDNDVALRNLVEGFDLLADPNDDEFLTHLRSLQYRLMRNDFENWDGPDVEFVFEELMRAWAKYWPLE

SEQ ID NO: 149535 - protein, 272 aa, Heterodera glycines
  Coding regions on vcDNA: vcDNA=SeqID_75958; Strand=-; Position=1 -232,276-430,474-708,1103-1299
MIRNKLESQQKSRKKRYISDISNTNEDAVNLGVEFGEPNAVITFDNVEQQTLNEAEVSVMTFERGKTNFGGHCLWLNGFRYTHHSGDRWRCTIRSCSAYANITNNDEIGATGTLGQKEHNHLPAPQKQQAESRRQKIKESVLAEPCLKPTRLLAKVRRSATDEAFVAMSSNNALTQMMRREKRKLLGNVDVQNPLAFVIPATLREKGVLCDFEKAEITSVRTAFPTAQIKCCMFHYRQSLYRNFKRLGLVHLYGEKTERGEEVRNTFRLKFW

SEQ ID NO: 149536 - protein, 320 aa, Heterodera glycines
  Coding regions on vcDNA: vcDNA=SeqID_75959; Strand=-; Position=1 -531,844-1161,1521-1634
MIIILSTKLLPLSVLLLPIMLGITNAAGIGDRQKRAVEEEEQRSMSELCAIHEQKFKELFKVKTGNAEVLWMENKEKKAEEKQEEKEKREEKAAEETMDAKNKAWLSTLLGNYLCQKLRGKGGEQRHGKNNEKLDYGVEKNVWWTTPEKNSNEFKVRAEKIFGRIRVKNGISDEQLLVSLSELVPLKERGGSGGVFFRTKDDKFILKNLNPEHDEPAKMDEVLDKYAAYVIDGVISGQSEKGKQSTKKNSNTIHKSMMNTMFMCFKMKLYAKRKEDDGNERKKVIRLHELQFVVLNNAFEGLKLEYATLPHVVSLPPKKM

SEQ ID NO: 149537 - protein, 25 aa, Heterodera glycines
  Coding regions on vcDNA: vcDNA=SeqID_75960; Strand=+; Position=1-75
QFIYKGQGGNTNNFPSKKLCDQVCK

SEQ ID NO: 149538 - protein, 57 aa, Heterodera glycines
  Coding regions on vcDNA: vcDNA=SeqID_75961; Strand=+; Position=1-170
FLKMIYLSKIFYRYEFIYFLTNFNHFHLLFSLNSLLGLQHILSPSDSSHSSFIHLGL

SEQ ID NO: 149539 - protein, 83 aa, Heterodera glycines
  Coding regions on vcDNA: vcDNA=SeqID_75962; Strand=-; Position=1 -57,107-214,1546-1630
MSNFLFRAETPQLNFAEVEDRLRPNPNLLTENVTIPEFFEYAPIRDRIPARMREMRPPLRQHLRLHVHAKSILSGRAPYIGGA

SEQ ID NO: 149540 - protein, 75 aa, Heterodera glycines
  Coding regions on vcDNA: vcDNA=SeqID_75963; Strand=-; Position=1 -77,129-190,270-358
  Homolog annotation: Hit_ID=CAE57287.1; Match level="QueryCoverage =88%, HitCoverage=9%, E-value=8e-13, Identity=47%"; Hit description =Hypothetical protein CBG00196 [Caenorhabditis briggsae]
MVEVQRIYAFLALFTFIYFLESIGGTYMIASVQNIERQFRIPSKLSDDISYVLTVVFVSYYGSRGGGKWNYYFFY

SEQ ID NO: 149541 - protein, 80 aa, Heterodera glycines
  Coding regions on vcDNA: vcDNA=SeqID_75964; Strand=+; Position=1 -72,1603-1773
MFNDRILRDNVMVLCMMIIILQWNLQLEPGAGPDPAQDFAGSQSAILHFLENAGFAGLIRAGSGPAKIFEFQSLHRVPQI

SEQ ID NO: 149542 - protein, 21 aa, Heterodera glycines
  Coding regions on vcDNA: vcDNA=SeqID_75965; Strand=+; Position=1 -20,235-280
MLNLIFLAWLDTDPLESDNDN

SEQ ID NO: 149543 - protein, 131 aa, Heterodera glycines
  Coding regions on vcDNA: vcDNA=SeqID_75966; Strand=+; Position=1 -126,554-727,1148-1243
MLLDLVSISFILFPSIGLFLFLIYQKGNSAADDKNDDSFEDKKNMLYELFGIVHSFRSHLNKLFLECVLVGEVPKNWSDNSLFALFGAALNGQIETLKILHQKGDDVNGNGSVTFGDHKIISDKFNLINKN

SEQ ID NO: 149544 - protein, 382 aa, Heterodera glycines
  Coding regions on vcDNA: vcDNA=SeqID_75967; Strand=-; Position=1 -270,1108-1509,1727-1913,2119-2406
RKFDQLNACNSDQFDLIEYQRERGGEFALGSDGSGTMPLNKKRQQKVIKLRQKRQKVLIDGAFRAIPMVDTMCRIVESQDFDRTDLFPLGSHHLPSSSDGTGVDGNTNGGGGGIPPFRCPNQCLPWARHCADHITYNVAQQLFTFCKWRLCNEAMPTTDLVLFDGLCRRHFYAQQQHQNQQQHQQQQQRHQLVAPTEQQQHPHRLQHNNNGNNSHGIVNAMAQSGDLRLSMLHHGVACPDHSLKKNCHCFQQHQQQQQQFLLHHQRTAAHGDSSLSSAVTIRCEPFAMDVSLASVAKDLGFDGHDLTDMLAKLPVEEGFEGDMDPDEDTLLSNCPQHWVAFQSKVSPCLADINKEDSDEAPPGTTLGHSWADVEQFLLEQEE

SEQ ID NO: 149545 - protein, 101 aa, Heterodera glycines
  Coding regions on vcDNA: vcDNA=SeqID_75968; Strand=+; Position=1-306
MPLLLLLMLLLILVLLLCVKMASAQSIKQYQVRGWHRLVAQTPLAKGEQLLRHVVRDVVGTVPGPGQTLVRTTKRRYATATTVGVAVHAGAIRRRRQMMAL

SEQ ID NO: 149546 - protein, 152 aa, Heterodera glycines
  Coding regions on vcDNA: vcDNA=SeqID_75969; Strand=-; Position=1 -13,118-173,646-746,1178-1466
MEKGAPWKTGIYSRFAPKTICYLGGIIVDRPDSARHRSVFGFKCRQSGRIWVAFEVFPSAHLLRTSTKQMGEDGDDDGGNQQQIENVGRTRPWKGANKKKAAAWKGGAGGGRVEKRRQRREAKRERRKGGDWHRDGQQKRQTEENDGEEMEQ

SEQ ID NO: 149547 - protein, 154 aa, Heterodera glycines
  Coding regions on vcDNA: vcDNA=SeqID_75970; Strand=+; Position=1 -114,475-606,684-902
  Homolog annotation: Hit_ID=CAE71390.1; Match level="QueryCoverage =68%, HitCoverage=10%, E-value=1e-09, Identity=36%"; Hit description =Hypothetical protein CBG18297 [Caenorhabditis briggsae]
MLIFKINKQVHFTYLPWANQVENIKWTNKGTSRTVSQKIAFDFKVDEKDMPATDRAIEKLFDGIDAIYFMENGFKAIAHELEKLSAICSELEIDELERERFKLKRQMQIVSRKMSALIVKNSLSFNRQVENYESVRTNAEHLLRITRRMPRCEE

SEQ ID NO: 149548 - protein, 137 aa, Heterodera glycines
  Coding regions on vcDNA: vcDNA=SeqID_75971; Strand=-; Position=1 -142,228-499
MWRGKSAHFGTRRQFAIHKQFGGLCGQCPCVGALLGSDKNHQRMAKGGGFVYMDVPHKERTMENNLPRTPLTELLERHEGKRKPTNPAEELKPERHKSVWITSDLLELCRHFNWNVVEWRDVDDKVGNGFTIVIKKK

SEQ ID NO: 149549 - protein, 119 aa, Heterodera glycines
  Coding regions on vcDNA: vcDNA=SeqID_75972; Strand=+; Position=1 -90,865-1072,1598-1659
MVSDFFCPNTGGVETHIYQLSKCLLRNGHKFCIFSQGYRTHARVWSAEGHTVPVRWNTEGVLFARLGVGQQLFAVCARLVAVVPTHFHTRTNSNRPLPFEKPWPNVLSALVDLFVIFEG

SEQ ID NO: 149550 - protein, 107 aa, Heterodera glycines
  Coding regions on vcDNA: vcDNA=SeqID_75973; Strand=+; Position=1 -94,386-615
MRQTYGCNIANTKQCDLFRAEKGTDQIGKNVVNWQSQIEKGIINVLNEGNLFKYSTPLTLRPTDRPPPNSPTKRRVPLQRGRLRAVDVLRLIAKNGSLGRRHQRLEN

SEQ ID NO: 149551 - protein, 238 aa, Heterodera glycines
  misc_feature (186)..(186): Xaa can be any naturally occurring amino acid
  misc_feature (194)..(194): Xaa can be any naturally occurring amino acid
  Coding regions on vcDNA: vcDNA=SeqID_75974; Strand=-; Position=1 -114,485-520,583-627,956-1094,1610-1739,2041-2109,2471-2644
  Homolog annotation: Hit_ID=CAE60539.1; Match level="QueryCoverage =97%, HitCoverage=25%, E-value=2e-54, Identity=50%"; Hit description =Hypothetical protein CBG04166 [Caenorhabditis briggsae]
SSSEASSSITSLDSVEMVVLLYRAERIGGWKDDDISDYEMSISNYFKDKYIGQKYIGQHIRVLTISTSVQVEVDRAGNIIRSYFGFGLAVMILCSLFSNSLSAFFMHQFSIYKLPVAIFACLCPFMASGTALGILFFAGVRHSSILAVTPFLILALGVDDAFLMIHSWQLASKRRRHEGVANDANXLINQSINXDTGPAILISTLTNIFADLVGAFLGSEEITLLCIGNIASVSLAHL

SEQ ID NO: 149552 - protein, 25 aa, Heterodera glycines
  Coding regions on vcDNA: vcDNA=SeqID_75975; Strand=+; Position=1 -31,435-481
MNPQKWAKYSRTPLEGIPGRNNSIK

SEQ ID NO: 149553 - protein, 127 aa, Heterodera glycines
  Coding regions on vcDNA: vcDNA=SeqID_75976; Strand=-; Position=1 -139,610-854
MNDNDRAISNHRQKQQQQQQQGGDINGAIVINNFTDQQHQHQQQQKTADQQCHSPSASSSSSSSASSAAHSDTSSQSFSARCSLRLHAVVARAYRRWAHFVVAHPYKIVFICFILTAICVVKMAKTK

SEQ ID NO: 149554 - protein, 73 aa, Heterodera glycines
  Coding regions on vcDNA: vcDNA=SeqID_75977; Strand=+; Position=1 -135,218-304
MALRIRFSNFGLIITIVPESFFLVPSVILIVPESFFLVPSVILGKSRAARLNLPSLSLFWTASENVFPYFHPI

SEQ ID NO: 149555 - protein, 228 aa, Heterodera glycines
  Coding regions on vcDNA: vcDNA=SeqID_75978; Strand=+; Position=1 -360,425-542,587-792
MSSTQYLIFFLLLCCLKNISGIGFDEFAKNAGAINLADQYLKKEIKTKGELLEKLAQIGVEISLRTLERHLSKIKSNVFQNLTINFFLLLAMETNIENTKKRTKMQILSMPNAKRGFIHLNRLNGTVSNHSEIRKDVIEYLEETVYQHSFSNHHDNEWWLLFDSIENIRKHIENAIAPAIGTHEIEKWMNNLDLAAVTKMFRINIIVCERIQERIFRWQVYSPDLETS

SEQ ID NO: 149556 - protein, 96 aa, Heterodera glycines
  Coding regions on vcDNA: vcDNA=SeqID_75979; Strand=+; Position=1 -78,298-426,773-856
MDCPKKVKLPPELLTELANCLHYNSLRTEGEIDALKEALASLEQRHTLDGLEIERLKKNIRSLCRRKAKPPIDPPILEKEEEGEEPEAKRLKANDE

SEQ ID NO: 149557 - protein, 68 aa, Heterodera glycines
  Coding regions on vcDNA: vcDNA=SeqID_75980; Strand=+; Position=1 -44,310-472
MAQIVPLLSEPPEGGNVTLKPGLVIGWPTAGRETSQATSGQSLTNNCLIRWCFQWQKMIIEPIVDNGK

SEQ ID NO: 149558 - protein, 42 aa, Heterodera glycines
  Coding regions on vcDNA: vcDNA=SeqID_75981; Strand=+; Position=1 -53,1246-1321
MSQEELLLSFQDETALDWLIDHVKSFRMIPRLLDLIDKEKKL

SEQ ID NO: 149559 - protein, 54 aa, Heterodera glycines
  Coding regions on vcDNA: vcDNA=SeqID_75982; Strand=-; Position=1-165
PNEGCLSGFITGFGLVGYTALWLIEVPFTFNSPISDHKDLREKLQEALDDVIDY

SEQ ID NO: 149560 - protein, 92 aa, Heterodera glycines
  Coding regions on vcDNA: vcDNA=SeqID_75983; Strand=-; Position=1 -123,615-665,940-1043
MIQFRHPLILLLLILIGVEVICSTKDNNSNYKVHVKTVTWEEFVADALKSDNELEREEVEPLFDPIYKKDTERMKALIGTLSEEKLRRFLRT

SEQ ID NO: 149561 - protein, 66 aa, Heterodera glycines
  Coding regions on vcDNA: vcDNA=SeqID_75984; Strand=-; Position=1 -37,453-616
MAVNYGNMEKYGSIPNAIPICIQTNFKFEPSNFIAKWAYIRHYVNLNDVIQQKIFFAINQPIINWQ

SEQ ID NO: 149562 - protein, 359 aa, Heterodera glycines
  Coding regions on vcDNA: vcDNA=SeqID_75985; Strand=-; Position=1-1077
  Homolog annotation: Hit_ID=EAK87696.1; Match level="QueryCoverage =96%, HitCoverage=68%, E-value=9e-29, Identity=26%"; Hit description =large low complexity coiled coil protien with large repeat region [Cryptosporidium parvum]
MSRHESFIPKNPRKSRNQLSPTPPTVLVSISSDESDNESAEEQPEQQSKKQQTVVGIQQRPYNPKLHEFERSNVRVLNSIEQRRVSEQQKMVQFPETATESQREREIRELKQRILLLESENAKEEQKTEEKEEKAKKDAEEKEEKAKKDAEEKEEKAKKDAEEKEEKAKKDAEEKEEKAKKDAEEKAKEGKEGGDSELSLGEDDIEREEAERKIEEIREKLRKKERRDALKAKNDLRKTSEKEKGQSVVKGILRRKMTEEEKEEKTKREEAQGAAKKDQEEVGKNANQKGPLIGADAKKSILETINQPYVHGRVIGQVIDPRAEVEEPWDMTKALANREKEDEIRVKRKDEREEGWKNL

SEQ ID NO: 149563 - protein, 323 aa, Heterodera glycines
  Coding regions on vcDNA: vcDNA=SeqID_75986; Strand=-; Position=1-972
  Homolog annotation: Hit_ID=CAE72844.1; Match level="QueryCoverage =80%, HitCoverage=48%, E-value=3e-37, Identity=31%"; Hit description =Hypothetical protein CBG20138 [Caenorhabditis briggsae]
MAFDVDIIHRPGKRNQFCDYLSRYLGDKTDQGINSLKFDQKITREEMIAAQKQDKESQRICELIKNADEKGNSEGTFGRWKLFGGLLCVTDRGEWKIYVPECMRRRVMSEYHSDPFQGGHLGEKRTKEKIRRSLFWEGMDKDIGNQVKNCDACQRRKIIGINKSAEPICPIEPAARPFERLHLDLMGPLRTSKGGFQYVLMIIDSFSKFMAAIPLREQTATTVTSAFVEKFLCLFGLPKIVITDCGTQFLSATFESLAENWGFKHQTTVPYHQSANGQVERYNRTLVDMLVTTTGGKDWASALPILCFAYNSSIIRKLDITVL

SEQ ID NO: 149564 - protein, 141 aa, Heterodera glycines
  Coding regions on vcDNA: vcDNA=SeqID_75987; Strand=-; Position=1 -353,683-752
MGEFEGKFPILVSEDEGCPCAAIIGTDLMDHISEQGGEEEIGLNFKKGTVRVGHIHLPMIAAINFENKPTEVRLLQTQTLPPLSDSFVWGQINRNFDPEDTFITVEKEHGYFPIRVGNPNSMERLKGIISDNEEAFIRPGE

SEQ ID NO: 149565 - protein, 186 aa, Heterodera glycines
  Coding regions on vcDNA: vcDNA=SeqID_75988; Strand=-; Position=1-561
MTRPELDFGEITAMEVNNTDDNGNSISGIFSVGEILVEAAQEEGENLRQKASETIEKGKEWMEDPIGIVKYIKWTAFIIIAIIILIGCSVLLIKAKLYASALMLPLQLIRSLITTLVSCFSSGREIADQVRYPMVMEVELREQTKPTAPPEEALLETKAYVLNYMPKICQINRSGPKKKRCYVNIF

SEQ ID NO: 149566 - protein, 159 aa, Heterodera glycines
  Coding regions on vcDNA: vcDNA=SeqID_75989; Strand=-; Position=1-480
MANHLLLVPALLFHLLFVLHGRSKFSAILPFLLSGLVHNWPLFKPWVARMGHHSFPSDSPIPNTFCAMPAKPNSLSQELADLEKRKMELEKLIASATNEKPEGKARRPKKCQNPDEPPPTGRTGKKGTKGGSFIRFPDYAAIPFADQCCATATCRLRNG

SEQ ID NO: 149567 - protein, 480 aa, Heterodera glycines
  Coding regions on vcDNA: vcDNA=SeqID_75990; Strand=-; Position=1 -1213,1253-1480
  Homolog annotation: Hit_ID=NP_921821.1; Match level="QueryCoverage =99%, HitCoverage=33%, E-value=5e-66, Identity=33%"; Hit description =putative helicase [Oryza sativa (japonica cultivar-group)] gb|AAP54108.1| putative helicase [Oryza sativa
MFKFPLQAKSHSVQRLPVHLENEQIIYFDENDDVETITEKRDKKSKLMAYFAFFNENHCSPKFLYTEMPKYCIWNPKQGKWILRKNPEISKTIGRMFPISPTEGEKYYLRYLLLHVHGTSFEDLKTVNGIKYNTYAKACLARGLTKDDDEWKHCLNEASQFRFPAALRSLFTSILLYGDPKQPEILWEQFKNNLSEDFLIKNQPNIAYVLALTRINKNLLQEGKSLKDFKNLPQETSLTDENENINYEEEKKIAENLYKSMNADQKIIYEKIKQIASGKLNPKLIYIDGPGGTGKSFTLNALYHLVRSYKKHMTNMAFSGIAATLLKNGRTIHNRFKFPLNLNAHIISGVVQGTKAAEEIIKSDFFVIDEAPMTPRFALDAIEKKLRELTNCKQLFGGKTIILAVRSEIIDLTIKKSIFWSKFEQMKLIINNRAKDQIFAEQILEIGNGTFGDSMSLPNNCIIANDSNLIDEIYDDVFKE

SEQ ID NO: 149568 - protein, 320 aa, Heterodera glycines
  Coding regions on vcDNA: vcDNA=SeqID_75991; Strand=-; Position=1 -69,553-1186,1458-1715
  Homolog annotation: Hit_ID=XP_318271.1; Match level="QueryCoverage =91%, HitCoverage=30%, E-value=4e-55, Identity=36%"; Hit description =ENSANGP00000001497 [Anopheles gambiae]
MFRFLKYKEIFIILIMQLPSRITQWCVDQAARIEWSRLNYIRLHQKEICKESYNAIDKFLYAKAAETGAQVKKKIILPSSFNGGPRNLHENFMDAMAIVNEVGRPDLFITFTCNPKDEDIQKGILSGQQSFDRPDIVARVFHLKVTQFLKEIIDGKIFGRVVGFCYTIEFQKRGLPHVHILLTLDPLNKWKNTSDIDKFISAEIPNENNDRDLYELVTSLMTHGPCGSEFPNAMCYDAATLRCISNENGNIKELVYDETGTYLDARFLSPVEACWKMFKFPLQAKSHSVQRLPVHLENEQIIYFDENDDVETITEKRDKK

SEQ ID NO: 149569 - protein, 135 aa, Heterodera glycines
  Coding regions on vcDNA: vcDNA=SeqID_75992; Strand=+; Position=1 -57,201-364,979-1163
MYIKYEHNDKIWTNMEKTYNASVDEKNGRDNVKKIKLNKKEDDYKLQKRYHIDDKKEAEEKVDKVTKAKRSVKKTIDSLADIEKKDEMYLFGNFFNLPVRQKSAPFRAEILARENEKVIEMGKDYMTIWVKRNSQ

SEQ ID NO: 149570 - protein, 95 aa, Heterodera glycines
  Coding regions on vcDNA: vcDNA=SeqID_75993; Strand=+; Position=1-288
MWHPQKENDKKKAGKKKSTNVEPKVEPDPKKLKEVTEFLLLDAALDREARNLCLNLIFRVPMRNWAAIAKDMDDKEIENYFIKPLEEKHLKNNNI

SEQ ID NO: 149571 - protein, 242 aa, Heterodera glycines
  Coding regions on vcDNA: vcDNA=SeqID_75994; Strand=-; Position=1 -99,163-193,257-364,426-803,887-973,1164-1189
  Homolog annotation: Hit_ID=XP_514062.1; Match level="QueryCoverage =71%, HitCoverage=13%, E-value=4e-12, Identity=31%"; Hit description =PREDICTED: hypothetical protein XP_514062 [Pan troglodytes]
MIPFSLLSVQLFVIIVASVLTLVTQCCACCKKKKKPPTTNFADPADSRYSTLAGINKEIFVQKTPSQQQRSQAVPYGPYSSATPVKPALSDEYKFLPTLRVDPPAFPAQAAPPTSVLASPTISAKPTAPTKPTISAKPTTSTKRPTSAAPAPTAPAKPTISTKPTTSAPSASPTTSAGKSSISSTPMDLASTSMAETQPIIAEATAADSGYSQMDQFGPDMSIKVLTPEEAKNRTLDRMAYL

SEQ ID NO: 149572 - protein, 63 aa, Heterodera glycines
  Coding regions on vcDNA: vcDNA=SeqID_75995; Strand=+; Position=1 -74,1142-1259
MLYWSSQQKIDYSIRCLNKNKIYIIIYYAGQFIFLENVLKDKNNYFILPSLDMHMYFKFFIVM

SEQ ID NO: 149573 - protein, 169 aa, Heterodera glycines
  Coding regions on vcDNA: vcDNA=SeqID_75996; Strand=+; Position=1 -148,216-577
  Homolog annotation: Hit_ID=NP_495371.1; Match level="QueryCoverage =89%, HitCoverage=39%, E-value=6e-13, Identity=33%"; Hit description =glycosyl transferase, family 14 (2H20) [Caenorhabditis elegans] gb|AAK31555.1| Hypothetical protein T14B4
MAIKTRVQMAQIFTWMEGANDVDILPPGGRVANIATMDWSFKALSLFKNDSRNSAATEHGFPAHLLLSKGYFQVSLSRAMVEFIQLELNLTELVRRLNLIGYGRDEILLTTLHSADQLNAPGGFTQTCFSRKGGGRTNHLTRCFLTGFNLQIKSLSIFGMKHEIVKVLS

SEQ ID NO: 149574 - protein, 65 aa, Heterodera glycines
  Coding regions on vcDNA: vcDNA=SeqID_75997; Strand=+; Position=1 -84,206-319
MTYLHTGGEQLDKMEALVNKSVVEQLPNRFKRDMILRNKNNKQQKRGVGEKQLTFEEVMGFQCEV

SEQ ID NO: 149575 - protein, 104 aa, Heterodera glycines
  Coding regions on vcDNA: vcDNA=SeqID_75998; Strand=-; Position=1 -137,324-420,524-604
MVDKGEGYTGYQELKDGVYHGYQPLKPRKTPKFTAEFGLSSGMLNIAVARDIDSIPKGDNQDGSQYQYLSAHNVARGQYIPPTNPNLPNLDIPVQQQQQEVAEE

SEQ ID NO: 149576 - protein, 280 aa, Heterodera glycines
  Coding regions on vcDNA: vcDNA=SeqID_75999; Strand=-; Position=1 -678,1117-1176,1270-1374
  Homolog annotation: Hit_ID=EAA17085.1; Match level="QueryCoverage =78%, HitCoverage=39%, E-value=1e-23, Identity=34%"; Hit description =STARP antigen [Plasmodium yoelii yoelii]
KETDNSTSVKAETEDADYSTTETKETDNSTLVEAETDEADYSTTETKETDNSTSVEAETEDADYSTAETKETDNSTSVEAETEEADYSTTETKETDNSTSVEAETEEADYSTTETKETDNSTTVKAETEEADYSTTETKETDNSTLVEAETEDADYSTETDNSTTVKAETEEADYSTTETKETDNSTTVKAETEEADYSTTETKETDNSTTVKAETEEAESSSTVPIYEKMDLAIKELVHSGELIETKGIGSSVYYNLNVITNATPSAAENMVSMDVVLG

SEQ ID NO: 149577 - protein, 373 aa, Heterodera glycines
  Coding regions on vcDNA: vcDNA=SeqID_76000; Strand=-; Position=1-1119
  Homolog annotation: Hit_ID=EAA17085.1; Match level="QueryCoverage =94%, HitCoverage=36%, E-value=1e-36, Identity=34%"; Hit description =STARP antigen [Plasmodium yoelii yoelii]
MKKDVTKKVAVREVGKVDNSTTMKAKTEEAGNGNSTKGKVVETKEAVNSTTVKAKMEKVDNSTTVKAKMEHADNSTTVKAKMEDADNSTTVKAETEEADNSTTGNAEIEKSNSTTVIAEKEEVDNSTTVASETKKADNSTTVMAQADNLTKGKTETEEADNSTTETKETDNSTTVKAETEEADYSTTETKETDNSTLVEAETEDADYSTTETKETDNSTSVEAKTEEADYSTTETKETDNSTTVKAETEKADYSTTETKETDNSTLVEAETEDADNSTTETKETDNSTSVEAETEDADNSTTETKETDNSTLVEAETEDADNSTTETKETDNSTLVEAETEDADYSTTETKETDNSTTVKAETEEAESSSTVP

SEQ ID NO: 149578 - protein, 349 aa, Heterodera glycines
  misc_feature (10)..(10): Xaa can be any naturally occurring amino acid
  misc_feature (325)..(325): Xaa can be any naturally occurring amino acid
  Coding regions on vcDNA: vcDNA=SeqID_76001; Strand=+; Position=1 -60,503-679,735-867,1026-1247,1472-1637,1676-1865,2142-2165
  Homolog annotation: Hit_ID=NP_998649.1; Match level="QueryCoverage =97%, HitCoverage=71%, E-value=8e-67, Identity=38%"; Hit description =zgc:55732 [Danio rerio] gb|AAH44464.1| Zgc:55732 [Danio rerio]
SFKKPMSYSXSNRSQKERKNLPMKRKRSNTSRNLQVQSNGVPTKIPSEQTAIAAAAKQFKTDQSNLRLSDLGGCEAQFLEAIQLMTHLKEAIQLMTHLKHPKLCEQIGFTPPKGLLLHGPPGCGKSAFAMALAGELQLPILSVSSTELVAGVSGESERKIRTLFAEAKMAAPALLLIDDIDVIAAKRENAQREMERRIVTQLIASIDESENDNESCTVFVIGTTNRLEVLDASLRRAGRFDREIALGMPDQRARMEILKIVTRHMKLDVDVDLAVLARLHMKLDVDVDLAVLARLSPGYVGADLLALVQESNSKAISRIFLVSFXHIFIFSVRALCSVVDAKKHKIHLS

SEQ ID NO: 149579 - protein, 154 aa, Heterodera glycines
  Coding regions on vcDNA: vcDNA=SeqID_76002; Strand=-; Position=1 -53,86-436
  Homolog annotation: Hit_ID=AAC72366.2; Match level="QueryCoverage =75%, HitCoverage=11%, E-value=4e-24, Identity=53%"; Hit description =guanylyl cyclase [Heterodera glycines]
FNVPFCFFICLFFLPFVPPAFFPVLLLLLSVFGPSRHPAFFPVLLLLLSVFGPSRHQSLIGTGNPLPDIGIGTPIATTPSGAISLPTSSPISNSSVPPAVVGALPPIQLKIGLLFVNGSQRLRMLFGFGQSAPAVSLALERARQEHLIDNINFT

SEQ ID NO: 149580 - protein, 98 aa, Heterodera glycines
  Coding regions on vcDNA: vcDNA=SeqID_76003; Strand=+; Position=1 -277,2081-2100
MQVTLKGHKVKAIYDKNICNIVTISLEGCYSCTSGANWTLSCKTNFGTALANVECPSQKVRVNCDKEGKEQQIQLAYNKKNITENCEVICPDDITVKI

SEQ ID NO: 149581 - protein, 60 aa, Heterodera glycines
  Coding regions on vcDNA: vcDNA=SeqID_76004; Strand=-; Position=1-181
QKHILIKMRNCSVLWCKKIVFKGVDFSGNFRFETNGSLRSFPAPAHRLSLHPAFAALCLC

SEQ ID NO: 149582 - protein, 81 aa, Heterodera glycines
  Coding regions on vcDNA: vcDNA=SeqID_76005; Strand=+; Position=1-484
FFAYQIFAINAHLFKKYSILLKCSVFCYILRIAVHLKASVIEQISQISRKVQAVAVEIVYIKTMAIRISALGPFSKLMCFY

SEQ ID NO: 149583 - protein, 106 aa, Heterodera glycines
  Coding regions on vcDNA: vcDNA=SeqID_76006; Strand=+; Position=1 -160,307-467
MANNRRLMKREKRPLAKVSQIRGRSRAENGERGTFWGTPADTSEDGTIPLTRHLIGQRVSGMMPIGSPMLSTETDGKTPALQPADDESVNCADQRTKDGIFAWEFN

SEQ ID NO: 149584 - protein, 87 aa, Heterodera glycines
  Coding regions on vcDNA: vcDNA=SeqID_76007; Strand=+; Position=1 -103,507-664
MYPLKIFAKITKKKESTDNEKSLGIFLLCDAPKEVPSEVLSEDEVHAVYQFKSLPNFLGISDGLFPIPFPTNERYMEKDRVLLYIEK

SEQ ID NO: 149585 - protein, 217 aa, Heterodera glycines
  Coding regions on vcDNA: vcDNA=SeqID_76008; Strand=+; Position=1 -294,689-940,1231-1340
AHRAAQHIDLATVRRRQKQQQKQVGGGQHDDDDDDEHEHEQQQPVAEQQQWLRQRQQQLLLANTESSSQEAADEADQSCCSSSIASSSSVTCREEVSADNNLVTAVSSSTVAAADHFCHSQQQMPNSSVAELAASADPLASSALAHKPASAVVAVDEHDYTTMDKVSCSSDSFSHLPVPQHWDRQHSSIGIGGCCQEEICSCASDSGDSCYSSMVGH

SEQ ID NO: 149586 - protein, 20 aa, Heterodera glycines
  Coding regions on vcDNA: vcDNA=SeqID_76009; Strand=+; Position=1-62
MSKEQQMCSHLHLTWSIANT

SEQ ID NO: 149587 - protein, 361 aa, Heterodera glycines
  misc_feature (17)..(17): Xaa can be any naturally occurring amino acid
  Coding regions on vcDNA: vcDNA=SeqID_76010; Strand=+; Position=1 -183,269-328,379-474,526-576,618-733,832-896,938-1002,1113-1212,1264 -1325,1640-1723
  Homolog annotation: Hit_ID=NP_493468.2; Match level="QueryCoverage =90%, HitCoverage=37%, E-value=6e-58, Identity=41%"; Hit description =human KALlmann syndrome homolog, epidermal and neuronal morphogenesis factor (78.5 kD) (kal-1) [Caenorhab
IFTAIGVRMNMKIKKKXNCKKKIKKTPAPLNYKIWQNNAETRRLIRHQMSTLCKEDTFCASCILPCRESLYEFDVCSHTLCDTPDPTHCRESCVFMEQIAADTPDPTHCRESCVFMEQIAAKKAGHCPPQKPSISKECSAFCDVISKECSAFCDVDSDCAEVEKCCVVGCSRFCLSPSLNDVEKCCVVGCSRFCLSPSLNDSRLLPRPEGITVHERKRKRSAILRWVMKRLSPQHTATNSNLFVIQWRWSVHKQSFVIQWRWSVHKQSDTMAPWQTIMVRNKMYAILKHLLSPGRFYIFRVAAVNLHGTYGFSEGFSEPSRPPFKLSKEAKAPPAPLNLTCLRPFFTNAKNCWNAPISEIP

SEQ ID NO: 149588 - protein, 108 aa, Heterodera glycines
  Coding regions on vcDNA: vcDNA=SeqID_76011; Strand=-; Position=1 -137,930-1083,2136-2176
  Homolog annotation: Hit_ID=NP_491221.1; Match level="QueryCoverage =94%, HitCoverage=10%, E-value=5e-30, Identity=59%"; Hit description =PaTched Related (104.4 kD) (ptr-2) [Caenorhabditis elegans] gb|AAB42325.1| Patched related family protein
VFAVYGCSQLREGLEPVNLLVKDSYAIPHYRALENYFWHYGATVQIVVNNPPNLGDPDERQKIRSMVHAFANTRHTIGDESVQFWMDEMEHYYMDHPKFCFIDSFIIK

SEQ ID NO: 149589 - protein, 171 aa, Heterodera glycines
  Coding regions on vcDNA: vcDNA=SeqID_76012; Strand=-; Position=1 -51,383-466,817-1002,1773-1886,1992-2069
  Homolog annotation: Hit_ID=CAE66666.1; Match level="QueryCoverage =89%, HitCoverage=16%, E-value=2e-48, Identity=63%"; Hit description =Hypothetical protein CBG12004 [Caenorhabditis briggsae]
IRTYKSPYISFTYLYSQTLAEELKRNADTLVPRFVFAFFILIMFSVLCNMSTCRGNCYIDWTLSKPVLAILGVANGMGIVTAIGLLNMCSVPYNDIVGVMPFLVVAVGVDNMFLMIAAVRRTNRASPVCRRMGEAMADAAISVVITITIKTLIISFGGANRYFFFSFSFLR

SEQ ID NO: 149590 - protein, 1510 aa, Heterodera glycines
  Coding regions on vcDNA: vcDNA=SeqID_76013; Strand=-; Position=1 -4454,4764-4842
  Homolog annotation: Hit_ID=NP_508324.1; Match level="QueryCoverage =73%, HitCoverage=40%, E-value=1e-139, Identity=31%"; Hit description= predicted CDS, peptidase family A16 and RNA-directed DNA polymerase and Integrase, catalytic domain and
MAIHSTNVEQMPTINEVEHFFNLESLGIQDDPAQDDDQTALKLFNKSIRQEADGRYSVKWPWKESNPDLSSNFKMAHSRLSSVLTKLRHSPEILEKYDATICDQLQQGISEEAQRAPGQLEHFLLHHGVLTKKLRVVYDASAHTRGTPSLNSCLFRGPLLLPDLAGMLLRFRCPTFPLLADIQAAFLQISLEPEDREVTKFLWLKDTSKGLTPDNLAIFRFCRVAFGVVSSPFILAATLRHHLQQFDSPLSREISESIYVDNVLLECETVQEALEKYKFSKDILQQGCFNLREFISNSKEVMKQIPQEDQLDKPKAKVLGLPWDTEKDEIVFKFPTPDPLRPVTRRLVLSHLASLFDPLGVLGPCILPAKRLFQELWKEGHSWDDALSEEDSIRWNSIQRQWKDEEIRVPRRAMLNDTQSIELHAFVDASVHTFATAIYVRCAMNDKVQAWLIFSKNRLKPKSASKALTIPRMELLAILVGTRALKFAQRQLRRPIASLHLWSDSQIALSWVKTHETQPQFVERRLKEIQECLGCTFHFVRTGDNPADLATRGATPSELRNHHLWWKGPPWLAQASHHWPSELCFQVTESDQQPDSTENVGPSGAFLAHTHSNQPNEQVLIDPSRFSSWKRLMRTTMFVLRFLALMFKRGEEPIASLVKHRKEIRQISKSGDFKAEDFALAERVLIRLDQMDDAEEFQHFKTVTGDDGILRLRTRLEMSEKPYSFSHPILLAKHSALAKLIILDRHQKRHHLGVDTTLTEFLSEFWMPSARLNVKRALRDCLLCRRMNAQQFALPTMPPLPGERVRRHAPFQSIGIDYLGPTTISLAGEKIKAWILIITCLATRAVYLEATLDLTSESFINVLRRFISRRGKPDIIWSDNATTFKLAQKTLELLSAPGPDQEVQNFLTHNRIQWRFIAQISPWAGGFYERLVKLVKDCFKRTLGRRILSFDQLNTFVAEVEATLNYRPITAVSDAVDGPVPLRPINLLQPEIQINWETATDPIDSEEQISSTHERLASRIQALREANDVFWAKWHSEYLTLLRERAQWDHKGPRLQNFGEPKKGMVVLISQDLVPRNQWPMGRIVETHGRPGAIRSVKVEIPVRGTNNRKPKDMPRKTVLTRPVNRIFPLEAGPEMTDPGTEAVAATEQPNENHPKLAREPGHQMVTRRKAKLLEMLPVVAMIILTLALPYASGFPIGKCDECGLTCYTKGIVVTVPPEIQKFEICCAESCIVRQGIKALNFELPIEVLLNNHHCEARFWTDSQHTFTSNTTCPAVDECDLIDCYFCFTQLVNPTCQPVIAAMLAGGLSLSLLCFIFTMCSMVGYAMAGLRILFWIFSVLFARLFKPRKETWVLSEEEENLLYPHRRIRRPRPATRNWASGRVSQMAMLVMASLPFVHGGIETVAIMAKSESCLNNGTTKMCQVKGSVTLALLPAGQPNVLSIKTDDGLILGTLQVILKGLSLECQAFTKAWKRSRDRFHSQQTMSCAQMAQHQHFNNRGQPSTGPPIER

SEQ ID NO: 149591 - protein, 123 aa, Heterodera glycines
  Coding regions on vcDNA: vcDNA=SeqID_76014; Strand=+; Position=1 -294,457-533
  Homolog annotation: Hit_ID=NP_501697.1; Match level="QueryCoverage =100%, HitCoverage=5%, E-value=2e-18, Identity=38%"; Hit description =predicted CDS, integrase, catalytic domain containing protein family member (4K310) [Caenorhabditis elega
SLNSCLFRGPLLLPDLAGMLLRFRCVVSSPFILAATLRHHLQQFDSPLSREISESIYVDNVLLECETVQEALEKYKFSKDILQQGCFNLREFISNSKEVMKQIPQEDQLDKPKAKVLGLPWDT

SEQ ID NO: 149592 - protein, 651 aa, Heterodera glycines
  misc_feature (90)..(90): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (119)..(119): Xaa can be any naturally occurring amino acid
  misc_feature (121)..(121): Xaa can be any naturally occurring amino acid
  misc_feature (242)..(242): Xaa can be any naturally occurring amino acid
  Coding regions on vcDNA: vcDNA=SeqID_76015; Strand=-; Position=1 -218,297-2061
  Homolog annotation: Hit_ID=NP_500227.1; Match level="QueryCoverage =99%, HitCoverage=63%, E-value=2e-86, Identity=31%"; Hit description =predicted CDS, reverse transcriptase like family member (4D351) [Caenorhabditis elegans] gb|AAK68554.1| H
SPTRGNNLLDLLFTNNVLNNVKVGPPFGNSDHNAIQFSINLQVNSDASKKFYNFKKANYLEINGILSMVDWNYVPIQTTKKVEKLPEQNXSSIVNSFGRTFTKTIXKXNSXKFRKKSMXKXINFIKIAKKFLRTLDSKKRFQFINSFLKTKNTMIPAFTDKNSLILFSDKEKSNALAQQFFSVFTDQNLEQFQCIENPEKNIEYFNITPYEIYFSLSKLSNSNNTSIDGIPNIFLKIVKKIXSDLFHIFSFSLMTAKIPEIWKKSIICPVPKIQNPVNPVDFRPISLLCSVSKILEENIAGKIKNFVEKNNLLPNCQHGFRKAHSVTTQLLEVVDDFSFALENRKSIDVIYFDLAKAFDTVPHNRLISKLQNIGINNSLLKWIQNYLKNRKFFVKIGSDFSDEYPCLSGVPQGSILGPLLFLIYIYDLKILPENVKIKLFADDLKAYHVLSNISFSPLQNFINKFNRYCKLNGLKIASNKCLTLHLGHKNQKINYFIDDFPITRNEPVRDLGIYFTNDLKWAQHIEIISKKALRSAFAILKSIKTGDTKILVNLFNIYCRPILEFGSPIFNPYLKKDIEKLENVQKTFLRVIFRRNNYAADLPNYAELLNIYDQKSLESRRLKIDLKLFHEIILGKINLQNNESFSFPKTH

SEQ ID NO: 149593 - protein, 226 aa, Heterodera glycines
  Coding regions on vcDNA: vcDNA=SeqID_76016; Strand=-; Position=1 -33,133-260,360-504,550-635,828-950,1001-1166
MTSINTSSNDPLYLAYRSIGPSADLIVPAVALYLVALVGIVLNGTVLVVTARSNSLRGSANFLMALICLCELVHQIGHTFFLVVVISGTNFVSFLTADLIMKPSIFAINCGLMAMLCAAVDRLFTVISPLKHMDILLQFKYVYLFSYLLICTIYGAYSLNYVLANAFENAGNPTTGMVAESFRGTVGYKSITHTFIISLCSTCCYVAIFVLIRRRNFGNFWHYEKI

SEQ ID NO: 149594 - protein, 170 aa, Heterodera glycines
  Coding regions on vcDNA: vcDNA=SeqID_76017; Strand=-; Position=1 -183,484-715,765-863
  Homolog annotation: Hit_ID=CAE58748.1; Match level="QueryCoverage =56%, HitCoverage=32%, E-value=2e-19, Identity=49%"; Hit description =Hypothetical protein CBG01938 [Caenorhabditis briggsae]
VPLGSVPNGNRRVTWLIAMAWLLAILCALPMTVFRGTRPIPHTPFVQCYHLQGFNASHIIVFHFFHVITTFYIPLGVILFCYVSIGLSLRHQGASLRQSNCLANTDQHKRLQQNTKLRFLKATAAIVCTFVLSWLPYQVMALLRVVCEPESKCEQLASNFNWLQSILLAR

SEQ ID NO: 149595 - protein, 56 aa, Heterodera glycines
  Coding regions on vcDNA: vcDNA=SeqID_76018; Strand=-; Position=1-353
TMAKNIACSMIYNFFSEANRLNFLFRISSTLFILFIFKISKNFIEFQKSSGQKILT

SEQ ID NO: 149596 - protein, 113 aa, Heterodera glycines
  Coding regions on vcDNA: vcDNA=SeqID_76019; Strand=-; Position=1 -102,170-409
MVWKCHLDSKRQAFPIPSELRDYIVNALVEMGVEFSNHNNRRFKTNSSVDKVNVYGIVRSFRANPAESILLAVPMRSSKIEAVAVALAFADYAKSCAISARSQGRGTNALPIL

SEQ ID NO: 149597 - protein, 131 aa, Heterodera glycines
  Coding regions on vcDNA: vcDNA=SeqID_76020; Strand=-; Position=1 -180,287-392,439-512,639-674
MGSKNGRIPSELLFELISNLPFDIRWAFTRVSKAYDCFVWQKQNSWVRAELIRKNAGRKKKIELVHCINSVLVYAQNISDDVIRANEGECNAHIENLLCIRRQLARLYRLGRTSPIDTSQTVSAEEVNAED

SEQ ID NO: 149598 - protein, 193 aa, Heterodera glycines
  Coding regions on vcDNA: vcDNA=SeqID_76021; Strand=-; Position=1 -39,329-469,703-1000,1083-1184
MEQEQNPGVTNTEASSTSVAILDPSAVTESDRSSPLVPESAAVATDAATHFVAQGSPQASLPTPPYIENNDVWRGQFIWREQKFFDCTCTPLSGGPTVSKAGREMMTTVSEGEQSGSGDGGGRIFLIGLTDSCAVWKYVVELRDSWDEKVCMMIINKPEGGQLLDKYSECVTFCDKENQIGVLDFVDHPTIKD

SEQ ID NO: 149599 - protein, 16 aa, Heterodera glycines
  Coding regions on vcDNA: vcDNA=SeqID_76022; Strand=-; Position=1-49
PVSINPAVSNYPPVYE

SEQ ID NO: 149600 - protein, 63 aa, Heterodera glycines
  Coding regions on vcDNA: vcDNA=SeqID_76023; Strand=+; Position=1 -76,135-250
MIDNEQKPLERKFIQQLIDKVRPLYVDTKKDHLHLWSKLRILGHDKQIKDDISTTELLVKNLM

SEQ ID NO: 149601 - protein, 193 aa, Heterodera glycines
  Coding regions on vcDNA: vcDNA=SeqID_76024; Strand=-; Position=1 -141,205-531,795-906
MEDNSTQTDINDCHSEHCSKEKTHISELHKSVQKKFHLELEQTEKKVDVIIEEQSKKLEELQQKAHKDEVAKAALRQAVAEECQQKCDYADKLGKVEAALEKANKNNKELKDDLDKVRRQKAENDAQNAAEIRRLESDLELVQHVTSAIHQQRSHSAIGHFSFTTSTRTISSPEEEEEQNEKALDELAPIGAK

SEQ ID NO: 149602 - protein, 55 aa, Heterodera glycines
  Coding regions on vcDNA: vcDNA=SeqID_76025; Strand=+; Position=1 -56,107-148,226-255,302-341
MKRSSSGNESDSATKKIKWSPPEKINFNHYWTGKVTFAQYWDGGYLPPDPEFANW

SEQ ID NO: 149603 - protein, 52 aa, Heterodera glycines
  Coding regions on vcDNA: vcDNA=SeqID_76026; Strand=-; Position=1-156
MEDDGPAVRTEVSTVTKVVAPMTMDEEEEEAAADADFVEDKHKQLILAKFIM

SEQ ID NO: 149604 - protein, 87 aa, Heterodera glycines
  Coding regions on vcDNA: vcDNA=SeqID_76027; Strand=+; Position=1-264
LHLCRLLARSVCFTSAFSAWTRNRSDQSPILPPRGQTFQSTQMDIGHRIANSRERAMVWQEANGNCQCQLEAFANPTKSVAQQSHRI

SEQ ID NO: 149605 - protein, 207 aa, Heterodera glycines
  Coding regions on vcDNA: vcDNA=SeqID_76028; Strand=-; Position=1 -267,815-940,1356-1476,1636-1744
  Homolog annotation: Hit_ID=AAH75293.1; Match level="QueryCoverage =74%, HitCoverage=69%, E-value=2e-16, Identity=34%"; Hit description =Transmembrane serine protease 9 [Xenopus tropicalis] ref|NP _001005710.1| transmembrane serine protease 9 [
DLSPIIGLIVCCLLIVLFSPIKISHGNPVKSNNKWPWLVALFAREAGICGDDGNKFCCTASIIGPQHVLTAAHCFMSFKGEQRENMHEKIFVRLGSYNHSSKEAIEPNLAKVIVHSEYDELTFVNDLAIIKLAEPITFMENVEPICLANSTSEKDFNSNNNLHIVGWGHQNEAEYDEEGNELWRDPDVEPEMLREGLAQKRDEDECA

SEQ ID NO: 149606 - protein, 97 aa, Heterodera glycines
  Coding regions on vcDNA: vcDNA=SeqID_76029; Strand=+; Position=1-632
NLGMPHIHMLLILEERERVLTPESVDQYVFARIPPLPPMEDMSIEANQQRRLWHYVTTMMLHDCNSACTEVDEQGRTRCRKHFPKPYTDLTELSGNL

SEQ ID NO: 149607 - protein, 515 aa, Heterodera glycines
  Coding regions on vcDNA: vcDNA=SeqID_76030; Strand=-; Position=1 -118,537-1010,1290-1565,1619-1764,1872-2052,2101-2453
  Homolog annotation: Hit_ID=BAB01023.1; Match level="QueryCoverage =61%, HitCoverage=16%, E-value=4e-22, Identity=25%"; Hit description =helicase-like protein [Arabidopsis thaliana]
MDAVRSRADCTVIERADAPTAKQVAVIWVQEDGLAPEVNVHIKVVVAQNDSVFEPVFGVQTKKRELGIKKTGSEENISERQFYRYRLALRENSKGAFHWLWFARRLAEFFVIAVLNRIERNEMDHIKAIQQRKNYRQTLARDYIKAIEQGLQQQGRNAKLGSVYLMPQTFAGSRQYYQQKYADLMTIVRSLGNPTWLGMPHIHMLLILEERERVLTPESVDQYVFARIPPLPPMEDMSIEANQQRRLWHYVTTMMLHDCNSACTEVDEQGRTRCRKHFPKPYTDLTELSEVRYTNYVRLPADFSDSTLLAGAENAQPADLNSAEHFLPEDDPERDCNEEKCGLFYQKRNKRGRGVLLLDDSRVIPYNPFLLLKYGCHINVEYVFGQKACKYIFKYLLKGFEKAYVKVMQPRRGGASTNEEVYDYDEVAATFKVRYMTSMEAYLRLNSYRIVSMSHQIYQLSIHDELGQTIVIEEGHEEQGRRRIANKTRLTAFFALCAKEPAVSELTYNRVPYFY

SEQ ID NO: 149608 - protein, 18 aa, Heterodera glycines
  Coding regions on vcDNA: vcDNA=SeqID_76031; Strand=-; Position=1 -39,258-275
MENNLENGKCELTKFGNL

SEQ ID NO: 149609 - protein, 23 aa, Heterodera glycines
  Coding regions on vcDNA: vcDNA=SeqID_76032; Strand=+; Position=1-71
LSTAVRQRSSKIYSMPQILWAGY

SEQ ID NO: 149610 - protein, 23 aa, Heterodera glycines
  Coding regions on vcDNA: vcDNA=SeqID_76033; Strand=+; Position=1-71
LSTAVRQRSSKIYSMPQILWAGY

SEQ ID NO: 149611 - protein, 23 aa, Heterodera glycines
  Coding regions on vcDNA: vcDNA=SeqID_76034; Strand=+; Position=1-71
LSTAVRQRSSKIYSMPQILWAGY

SEQ ID NO: 149612 - protein, 211 aa, Heterodera glycines
  Coding regions on vcDNA: vcDNA=SeqID_76035; Strand=+; Position=1 -92,216-759
  Homolog annotation: Hit_ID=CAE66142.1; Match level="QueryCoverage =63%, HitCoverage=11%, E-value=1e-15, Identity=35%"; Hit description =Hypothetical protein CBG11371 [Caenorhabditis briggsae]
MAVLHWASLNEITTKKAAGRIASDADRPDEDDVELGAAPDGNKFSVAQKFSRSISMIGGTIHRQDTATGRAKKKAMGSPSEAAMLNYVNQLIDVEETRANNNVKWPNHTKWQRIGTFQIVFEVPFNSKRKWHLVILEQSEDNADGLKQYKMLMKGASEILSHMCSTFMDEHGHQQKLGNVELKQFEDAYTHFAEGGHRVIGFSTKTFSAPR

SEQ ID NO: 149613 - protein, 456 aa, Heterodera glycines
  Coding regions on vcDNA: vcDNA=SeqID_76036; Strand=+; Position=1 -36,270-422,467-533,589-794,858-993,1047-1190,1241-1458,1576-1727
  Homolog annotation: Hit_ID=NP_505083.1; Match level="QueryCoverage =98%, HitCoverage=34%, E-value=2e-82, Identity=39%"; Hit description =cation transporting ATPase, N-terminal and E1-E2 ATPase-associated region and haloacid dehalogenase-like
NIYLHTNCQIIKVIHGERISRLSPSEWDELIEKESVVFARTTPEQKLMIVEQCQRRGKLIAMTGDGVNDAPALKRADIGISMGSIAMTGDGVNDAPALKRADIGISMGSGGSEVAKQAADIVLVDDNFSSISEVAKQAADIVLVDDNFSSIVHAVEEGRVMFENIKKLLAYTMPHSFPEVWPVIINFCFGFPPGITALQILSIDLCTEILILSIDLCTEILPGVSLSRELAEGDVMARPPRAMNKVLISNTLLAYSYAYTGQIYAYTGQIQSLGCFLAYCCVFWYHGIAISDLWMSADKLEAGRSGICQVNGKSFSVEQQLYIGRQACSAWQVNGKSFSVEQQLYIGRQACSAWQMGIVFGQFFNIWSARTRRVSLFRHGFLSNKALLLALLVELALINCFVYMPGVNSFLGGAPIPWHCWAVVAAVGLFINAYNEIRKYFVRNYPQNRIVRCFKW

SEQ ID NO: 149614 - protein, 95 aa, Heterodera glycines
  Coding regions on vcDNA: vcDNA=SeqID_76037; Strand=+; Position=1 -12,604-702,999-1175
MYGQISTKFDIWSVGIIAFEIFIDQLSLEEKKAPMNGMERRTMLCNIGNLFFGFKRNRFGDYPGNVKEVPLLYSEDPNWVWQNKRRHSRGAATLA

SEQ ID NO: 149615 - protein, 208 aa, Heterodera glycines
  misc_feature (9)..(10): Xaa can be any naturally occurring amino acid
  Coding regions on vcDNA: vcDNA=SeqID_76038; Strand=-; Position=1 -201,507-709,764-942
  Homolog annotation: Hit_ID=AAH78560.1; Match level="QueryCoverage =88%, HitCoverage=60%, E-value=5e-44, Identity=51%"; Hit description =MGC85439 protein [Xenopus laevis]
RTNSSDQKXXTQNGVNFSYLDATETKWAQNYRMYSYILDELVLVFSTFSVEKNKCGIFGHSMGGHGALTIALKHPELFSSVSAFAPICNPSKAKGQKYLRVFLGNDEGKWANYDATELAKKYEGPKREVLIDQGSADPFLANGDLLPANGSADPFLANGDLLPANLLAVENPNLTWKYRLHPNYDHGYAFIQTFIGDHFEHHALLGNL

SEQ ID NO: 149616 - protein, 61 aa, Heterodera glycines
  Coding regions on vcDNA: vcDNA=SeqID_76039; Strand=-; Position=1 -211,260-350,411-435
  Homolog annotation: Hit_ID=AAH81180.1; Match level="QueryCoverage =100%, HitCoverage=21%, E-value=2e-15, Identity=54%"; Hit description= MGC84363 protein [Xenopus laevis]
MSLVELSKSRWFNGYQKIFEHNSAQLKCRMRFGVYLPDNQPESKLPVLFYLSGLKCTEENF

SEQ ID NO: 149617 - protein, 103 aa, Heterodera glycines
  Coding regions on vcDNA: vcDNA=SeqID_76040; Strand=+; Position=1-312
MSPIRYPSGVKLPPFARFYDNVYWKVKRYMKPQFFGVVATVTIIGAAFWAIAIQPMISNEYYAEKQREWWKRMPVSREELAGGLPVWRDPFDREDRKTPSYAK

SEQ ID NO: 149618 - protein, 110 aa, Heterodera glycines
  Coding regions on vcDNA: vcDNA=SeqID_76041; Strand=-; Position=1 -53,255-534
MSVGEVNGRKVARILATSCATSNKCNHSLAEERRIVITSRRQSPQAEDDELVEVLSAKTLTEERRAHSGGGQKSGKNGQRKGRNGEEDEEQSTLDQVTPIPTTLELSNST

SEQ ID NO: 149619 - protein, 256 aa, Heterodera glycines
  misc_feature (1)..(1): Xaa can be any naturally occurring amino acid
  Coding regions on vcDNA: vcDNA=SeqID_76042; Strand=-; Position=1 -85,142-246,650-766,832-876,1321-1450,1989-2200
  Homolog annotation: Hit_ID=AAQ06662.1; Match level="QueryCoverage =93%, HitCoverage=31%, E-value=7e-59, Identity=49%"; Hit description =acetylcholinesterase [Meloidogyne incognita]
XSLLFWCNLFMLFVSFFTCALIEFADIVSENIFGSVFMYYFVKRSSSENIFGSVFMYYFVKRSSANPWPRWMGIMHGYEIEYVFGMPFRHPQAYDQKELDMERAFSAKIMDFWGRFARTGEPIEFWPKEPIEFWPKYNRITRKSLVLSDEIARGNSHRIYVDVHGKLCRLLEEAQALARLAPDQRQRMAPGIDMASLNTWHRASSPSLNSATADQRNLHRPITFLTFGTLLTVSMASPLIIIPPQILFVHFHFTFS

SEQ ID NO: 149620 - protein, 117 aa, Heterodera glycines
  Coding regions on vcDNA: vcDNA=SeqID_76043; Strand=-; Position=1 -127,639-735,1077-1205
  Homolog annotation: Hit_ID=AAQ06662.1; Match level="QueryCoverage =90%, HitCoverage=15%, E-value=4e-45, Identity=76%"; Hit description =acetylcholinesterase [Meloidogyne incognita]
MNFAFVPIDEDANFFKGNLFEKLQRKEFKKDVSIMLGTVRDEGTYWLPYYLHKYGFGFNHTISPEDQYNQALVTEAEYTKAFDAFLPYFGNSQLVRHALMHAYARITPDHNHAKAVE

SEQ ID NO: 149621 - protein, 110 aa, Heterodera glycines
  Coding regions on vcDNA: vcDNA=SeqID_76044; Strand=+; Position=1 -156,473-649
MHPIKKFIFLYLILYQSVKIEQKPVHRRAILSVLAIGGIVALVLVPIVVGSAEHQRDHSNLCLVIGAAYGCKRVELISKRGNYSKSNFHLTDLYLFLSRLLVLFTNLGAK

SEQ ID NO: 149622 - protein, 598 aa, Heterodera glycines
  Coding regions on vcDNA: vcDNA=SeqID_76045; Strand=+; Position=1 -600,659-947,1105-1778,2099-2331
MDYPRINESELAFPIPSGIIVSGPSSSGKTQLVLRLLRHASLMFDPPPKAIGMCKGGFCAVDCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLTTRRESFLPPKMVKREQKIGERVVHNYDYLKKLGKTTSEKKRRHLLNSAGCEELLTLVEICLNVLNGSFCLSRKQKQRLAPFAKDIRQLARVRSERARETKNDDDIAERTNLGFVKRQVTAAVQKRKGNVSERNAMYNQHLRRYLKMRKEHKERPVRVQLSNGAQLLNKTVETGVQVRPGPDEPKDKSVMVTDEDEEEEIEVPKFLTPTSPTQGSSRSPRTNKKAAKQQKLIEKKDHLLAIIMSDPQRFGATDRGKIINPKTGREFIDSDLAWSIERLVDPRPENAPSPSGTKELKRKLAQNPLASSLLNRLFVGSGFVGQALSCKNSGYRYLLLVVDVLSRRMFGAPVKSKRPVDMKRAFEELFEQMPRVPDTMYTDRGLEFVAKPLKEFYAEKGIQ

SEQ ID NO: 149623 - protein, 152 aa, Heterodera glycines
  Coding regions on vcDNA: vcDNA=SeqID_76046; Strand=-; Position=1 -150,616-776,1096-1240
  Homolog annotation: Hit_ID=CAE60439.1; Match level="QueryCoverage =85%, HitCoverage=32%, E-value=2e-31, Identity=53%"; Hit description =Hypothetical protein CBG04047 [Caenorhabditis briggsae]
YDKVSGLKLPKPRRLVYTRTSLTISVLLSGGIGYYMYKILRGDERLHREWVVPMVHRWFAPESAHILGVKAVRLGFLDDFVESRKEYPELACQMFGKQLNNPIGLAAGFDKNGEAIDGLRKSGFGFIEIGTVTPKAQIGNDRPRVFRLREDQ

SEQ ID NO: 149624 - protein, 34 aa, Heterodera glycines
  Coding regions on vcDNA: vcDNA=SeqID_76047; Strand=+; Position=1 -86,201-219
MQTELNKRNKFGGWGTISVRDKLRMNASDETFVV

SEQ ID NO: 149625 - protein, 87 aa, Heterodera glycines
  Coding regions on vcDNA: vcDNA=SeqID_76048; Strand=-; Position=1-264
SPFKFVDDAISLKAASDGSSAVASSSIVAGVGDDQKSVKSCSNNSSSSNHANSSSCALDALVNGAGGDGTEYRIKLISVQNFKRMDA

SEQ ID NO: 149626 - protein, 85 aa, Heterodera glycines
  Coding regions on vcDNA: vcDNA=SeqID_76049; Strand=+; Position=1 -37,439-659
MAFGTVGKLTGTLPSPPAPFTNASSAQLLLLAWLDEDELLEQDFTLFWSSPTPATIELLATADDPSDAAFSEMASSTNLNGDCST

SEQ ID NO: 149627 - protein, 261 aa, Heterodera glycines
  Coding regions on vcDNA: vcDNA=SeqID_76050; Strand=+; Position=1-792
  Homolog annotation: Hit_ID=AAB97874.1; Match level="QueryCoverage =100%, HitCoverage=53%, E-value=9e-46, Identity=42%"; Hit description= surface antigen [Trypanosoma cruzi]
PNVVVPKSRVPKCRVPKCQGPKVPKCRVPKCRDPKSQVPKCRVPKSRVPKCRVPKCRVPNVGIPKSRVPKCRVSKCRVPKCRVLKCRVPNVGIPKSQVPKCRVPKSRVPKCRVPKCRVPVPKCRVPKCRVPNVGIPKSRVPKCRVSKCRVPKCRALKCRVPNVGIPKSQVPKCRVPKSRVPKCRVPKCRVPKSGSPKCRVPKSRVPNVGIPKSPVPKCRVSKCRVPKCRVLKCRVPNVGIPKSRAPKCRDPKSRVPKSRVP

SEQ ID NO: 149628 - protein, 120 aa, Heterodera glycines
  Coding regions on vcDNA: vcDNA=SeqID_76051; Strand=-; Position=1 -203,329-488
MAFAPLGPMALSVGPLFAAAPLMDEEDTDLEDDEDGAREGKASAKEDGGRQDDELDERERILGMEDANFCPNSLPFLLCSPSCSPAVVHGADGRPRQTNGQVVQQSQCKCNVRTPVGIFV

SEQ ID NO: 149629 - protein, 179 aa, Heterodera glycines
  Coding regions on vcDNA: vcDNA=SeqID_76052; Strand=+; Position=1 -153,209-346,483-728
MPPPLYLSPIIEVIRCQICAHSQFVQRDAQLVPRDQLLAHIAAHINYGPTSEKNERLKQICQREYEHCICIDFAERLGHLSGEDGHRHHEQQQANMTFPAAPPPPHFASSIPNIRSLSSNSSSCLPPSSFADALPSLAPSSSSSKSVSSSSISGAAANNGPTDKAIGPSGANAIKLERV

SEQ ID NO: 149630 - protein, 42 aa, Heterodera glycines
  Coding regions on vcDNA: vcDNA=SeqID_76053; Strand=+; Position=1 -63,102-167
MPTGREWGGRGEQIGKSGELMEEDEDIQQMYCSCLMPDNKET

SEQ ID NO: 149631 - protein, 132 aa, Heterodera glycines
  Coding regions on vcDNA: vcDNA=SeqID_76054; Strand=-; Position=1 -57,203-544
MNWAKAPDGLLPGRQSPVPPPLSADFMLDVTELLSVSKSITSKPLRRRWLRRQKRLSREASAENVKISMFFNIFWNFPTSMVAIPPLVLTVAHCQQITVEALRGRRTVQLKSNWRGRRTVVRIGGDKRGDDL

SEQ ID NO: 149632 - protein, 143 aa, Heterodera glycines
  Coding regions on vcDNA: vcDNA=SeqID_76055; Strand=+; Position=1 -275,804-960
MTNVNTDLVEDIVQMRPNSAKKLAEDEDKSLLRDVDELETDQQQRENNRRTKAPPPPMLRFPGVGLNGYQRKAVEMIISEMSANAALQQAFRAKMMKVRLGPNSAMFGQMLRTTCGPDEVCLSDSIPELGEKYPDQQLEIEAN

SEQ ID NO: 149633 - protein, 151 aa, Heterodera glycines
  Coding regions on vcDNA: vcDNA=SeqID_76056; Strand=+; Position=1 -135,211-531
MSQNRDENSQPPVLDGPYPLAQERNEFVEDEAPVLLEMLDRLSQGGICQAMGLFSFALADCLATFHTFAILFDCETPVPFDEQHKRYVFEHRDKPRLIYVSEDGSAIQVDGVVKQGEFVMSIETMYLDKRNGVDHFCTFLHTFGICFLMCH

SEQ ID NO: 149634 - protein, 530 aa, Heterodera glycines
  Coding regions on vcDNA: vcDNA=SeqID_76057; Strand=-; Position=1-1593
  Homolog annotation: Hit_ID=EAL49477.1; Match level="QueryCoverage =51%, HitCoverage=57%, E-value=6e-33, Identity=35%"; Hit description =hypothetical protein 42.t00003 [Entamoeba histolytica HM-1:IMSS]
MIAEVERLLTRKRSAPVHASFGNIDDDDEEEGEILDVSFVEEEEDNTGEAPLNPLSYLAKQSAAQQETLRHEKWAQEERKRREEEQRKQRENERRRREEEERRRKTEEDRRKTAEKAAKEKKAKEEKEASEKKAREEKLAREKKEEQRIAKEKKGEKETKDKKAEEERVAKERKAEDERVAKERKAEEERVAKAEAERVAMVTKAEEERAAKAEAERVAMVTNAEEERAAKAEAERAENETKKKQEEEKQLEELKRQQQAIRKQKELELLKEFRPWRGGYMRLVHGKDPTPDVHYLHETDDYHFVNAVHKYRVRHSELPWEAPEFNPSAHIQQNIGEFRELFEQEVYDENYAVKTREEKEELIELVKGFRFYFTEQIGRFELKVFNGKISHITLTDQLAYVLGYEQEQQIRNEELAKYAVDLGGGVSHLCIYLNSGVIESMIVGNTFANLLQVIAVEGKSGSVVEKDFQAPLFHKIIAREVDVLDVEIRTLTGRLGSSAGQLFLITYLREVPFEFGQVVLTLQFKKVLTF

SEQ ID NO: 149635 - protein, 96 aa, Heterodera glycines
  Coding regions on vcDNA: vcDNA=SeqID_76058; Strand=-; Position=1 -196,241-335
MDESKRENFSPQNDDDVITIGDNNNTQTLLDLQPGPSKRGRKPRLDKIHEEIASAMKKAKAMEAEVDESPKKQPTNVFEYPTIFWKLARPKVLANI

SEQ ID NO: 149636 - protein, 66 aa, Heterodera glycines
  Coding regions on vcDNA: vcDNA=SeqID_76059; Strand=-; Position=1-199
MDESKRENFSPQNDDDVITIGDNNNNTQTLLDLQPGPSKRGRKPRLDKIHEEIASAMKKAKAGGAE

SEQ ID NO: 149637 - protein, 803 aa, Heterodera glycines
  Coding regions on vcDNA: vcDNA=SeqID_76060; Strand=+; Position=1 -600,659-938,1105-1784,1952-2033,2075-2286,2345-2651,2698-2948
  Homolog annotation: Hit_ID=AAA93301.1; Match level="QueryCoverage =38%, HitCoverage=89%, E-value=2e-37, Identity=30%"; Hit description =HASI
MDYPRINESELAFPIPSGIIVSGPSSSGKTQLVLRLLRHANLMFDPPPKAIGMCKGGFCAVGCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLTTRRESFLPPKMVKREQKIGERVVHNYDYLKKLGKTTSEKKRRHLLNSAGCEELLTLVEICLNVLNGSFCLSRKQKQRLAPFAKDIRQLARVRTRETKNDDDDDIAERTNLGFVKRQVTAAVQKRKGNVSERNAMYNQHLRRYLKMRKEHKERPVRVQLSNGAQLLNKTVETGVQVRPGPDEPKDKSVMVTDEDEEEEIEVPKFLTPTSQTQGSSRSPRPNKKAAKQQKLIEKKDHLLAIIMSDPQRFGATDRGKIINPKTGREFIDSDLAWSIERLVDPRPENAPSPSGTKELKRKLAQSPLASSLLNRLFVGSGFVGQRNTTYTLFKPKRDKFRRLRTVPAGFMTDVQADLADFQALSRKNSGYRYLLLAVDVLSRRMFGSPVKSKRPVDMKRAFEELFEQMPRVTGHTVHRSRAGTSSKKKAAVAERAIRTLKTRLYKYFSSNNTSVWVDVLPKFLSAINNSVCRATGLRPNEISDTNAREVWKRVYGEGLAQLDKTPKIRAGETVRIPEPKHIFEKGYIPNYSDHVYTVDEARSTNPQHYLLKDYYGTKLKRKFYLPELTKVQVDENTMYRIEKKYKERVRDGKSEILVKFIGFPENIA

SEQ ID NO: 149638 - protein, 450 aa, Heterodera glycines
  Coding regions on vcDNA: vcDNA=SeqID_76061; Strand=-; Position=1 -88,163-238,289-578,833-933,1075-1239,1284-1364,1448-1568,1618-2048
  Homolog annotation: Hit_ID=NP_507780.1; Match level="QueryCoverage =91%, HitCoverage=29%, E-value=3e-21, Identity=25%"; Hit description =predicted CDS, DNA polymerase type B, organellar and viral family member (5T899) [Caenorhabditis elegans]
MLEDNPAMKAYFDNCPDSGPIDFHDAFFGVINPETGDWKSRTIKVKDFNSLYPSRNMYTNYPVGHPTVVQFDKDVEWRSPADIVGDDGIRLEGIIKCYAVPPRHCHYDIPVLPYRLNNRTLFPLCRTCSEMYPRGLIDPEYNCKHFEDSERASGYPASCTEAGISDEESARRKQDHIDKAKEKAQESAHKNRNRRVPCGIAKLLNDSKIEVSSIDQLTEKFWMVCYKAKDEHVVEHSTSNVAIALWTTSAARIHLLESLKKCMDLLLDTDSIFYDYLTRLGDPLPGGEQLGELADEHPNHTIMEFICAGPKAYGLWLRNNATGEDEYKLKVRGITLDSDACERITFEKMKDMVQNKLGQPDNNVRFNYPTKNFRITKKGEIFTVPLVKQFNPTVNKGVVRDHGLKVVPFGYSDKEWCKWNCPGACTCLFNPDLNVNMFTEEELNDPDIMP

SEQ ID NO: 149639 - protein, 182 aa, Heterodera glycines
  Coding regions on vcDNA: vcDNA=SeqID_76062; Strand=+; Position=1-549
MPTEPVAAALTQLADLPENNFSFRINPLPVVPRSVSIQYLDDVERFKVSFNDRLIRHLSFSPQLGYVLGFENPQHVVSNEVAKYPVDLRGGISSFAVYSKGLTENMIVGNSLSSLLRVVSVSGATPNDYNEKIYDSPIFARVLPREINEIEIELRTMDKGRLVPFAYGTTLVVLLFKKVINF

SEQ ID NO: 149640 - protein, 208 aa, Heterodera glycines
  Coding regions on vcDNA: vcDNA=SeqID_76063; Strand=-; Position=1 -150,250-444,491-723,998-1046
MKRPNPLNLPMNEKKPKLRRRLPAELNSELISFVPLVCLFANVKRTPIGPKGVIALFDVMFEEKRTPKKKKVGRLLLQEELPHDLSRNELLHYLCYGRLGTNLFETYFVMSQATNSIGIGNLFGLLLDFAMSSPTPWHMKRPICCGIFFRQHLPWILQQPMNVMLSHGFFPEVRSDGFEFFWLFNPHLKKYAGNDDTMTDGIFWAKLS

SEQ ID NO: 149641 - protein, 1279 aa, Heterodera glycines
  Coding regions on vcDNA: vcDNA=SeqID_76064; Strand=+; Position=1 -1707,1758-2815,2866-3793,3845-3990
  Homolog annotation: Hit_ID=NP_001004509.1; Match level="QueryCoverage= 96%, HitCoverage=81%, E-value=8e-99, Identity=26%"; Hit description =si:busm1-180o5.3 [Danio rerio] emb|CAD60788.1| novel protein similar to DNA polymerases [Danio rerio]
MNSWVSCTSLDRCSKAKEHQKRQRTTLKNSENNIEHMAKFHYVKIKSKFTITDLPSTPEALLAGIFQHCIDEAIVESRERNIEPTHLGCMISSPLLEGGDIPIPIRQMTNNTLDTILNQFKKVAQSKQQKNVSLWGEPFTVTITTLDRNGLPSKRRVKGGARRPVKTAVHHRINDQCLIKIRNNDNHFCLFYALQATMVDKTCNWPRWKFLDYLHDRHGQQGQLHHDTVKLMQQVKAPMDLVGYDADTFVPHVVDYWNNAQRQHRFAVFIFGSLGQYKPLYKYIDNIYDTPLLLYFNEDHFDGVQKQGGLFGQPYCLECERPYDKMSTHNKTCKARCVLCSRVGPAFPCPSSTGFIKKCKECNKKFTNNGCYQHHLQSGFCKRSKKCKDCGAVWDVVNNTQKGRKGHVCGERFCKMCNNYHNTERGCFIQPIEPKERDPYRIVAFDLETMQHTPSVKPEKREHLPNFIAARVACPDCIENESWREASGGCEVCGPNRTVAFCQRRFTETTVDKQVVAENPLEAFVSWLINDLPLAYDTYAFSHFGGRFDMVLVFRELFKRGYNPDMLRKGNKMYEMRIRRQKKRNPNIVFRDSFNLMPMSLASLVPSFGLDVEDKPFFPHMANHPDNYGKQIHPTPDDYLVKGMMPDKRQKFDDWYEQHRQEPFFLDEALASYCTNDVEILMAALVAFRHEFLDVTKRNEGIVAERAAFYEHHDGIDVLRECMTIAGACMKHFRTNHLPKKHLAIVPERGYDNAQNQSLLALRFFHWHAEEHGVVVQTAHSAGGEKKIGQYSVDGWVEEERRAIEVNGCVWHGCNECFPNNNMMMPNGKTAGEVRERDEKRLEFIESQVSRVDVYWECQIKRMLNRDPYMRESFGDYVDDGPLDIREAFMGGRTGPLKLYHKAGEGEKISYYDFTSLYPYVNFSTTYPIEHPKVLILNENVEWTSARDNPYKLSLLKVWVIPPRKCDVPVLPVKVNKRLCFPLCMQCCLDYPKGGVDFDYHCEHDDQQRGWVTTCTSIELDAALEEGYRVTKVFRVLKYRHGDDKLFQPYIAEFMSQKIEASGFDASIKGNEELEQQFITECAEKFGISIDKDNMKVNKGKRSLAKLCLNNLWGRFSLRNFGLAQTLITDDPSVLTEYVENSSIDIISVDELDEKHQLISYVQKKEWVEEHECSNIGEILKCRLLYTDTDSLIFVHPIGMNPLETGPNLEQFTDEYPKHEIVEYCSGGAKQYGLKLRRNGQDEFVLKLRGITLNYDVMQNQSLCYDTFKEEVLRYAETG

SEQ ID NO: 149642 - protein, 161 aa, Heterodera glycines
  Coding regions on vcDNA: vcDNA=SeqID_76065; Strand=+; Position=1 -177,223-531
MQKVVRTPGCRLLYTDTDSLIFVHPIGMNPLETGPHLGQFTDEYPKHEIVEYCSGGAKQYGLKLRRNGQDEFVLKLRGISLNYDVMQNQSLCYDTFKEEVLRYAQTGEYEPINVMYPNFLRPDIRGGGHVTSGPLQKCYRPYVGKGIVGPNYDVLNFGHTL

SEQ ID NO: 149643 - protein, 128 aa, Heterodera glycines
  Coding regions on vcDNA: vcDNA=SeqID_76066; Strand=-; Position=1-386
MQKTFFVDGISDHGAALTPAYGRLRQPYNINIAAHFYARHRIKLHLPYVPCVVEKYFWSGEDRYYPMELLEIVDEDYTNKERWLGKLFMEIEDDFIPVKRLGRVEEVEEIDDNDGGGRYECSQPSYVY

SEQ ID NO: 149644 - protein, 97 aa, Heterodera glycines
  Coding regions on vcDNA: vcDNA=SeqID_76067; Strand=+; Position=1 -133,179-339
MAKQFVQHETAEEQQVKAKKPNVDERFLWKITRGQFVLAIRLCSEDWNNLFHNKDKARRLEDGRVAIGLEMCEKCARINCCVSDMIADQKKKPKTTK

SEQ ID NO: 149645 - protein, 73 aa, Heterodera glycines
  Coding regions on vcDNA: vcDNA=SeqID_76068; Strand=+; Position=1 -62,203-362
MASYCEASKQQRHQQNHFNEMMCISERRNRQTDDESDFHNHKNRRALKRTTRPASGAPLWNSQGAARKNYSSN

SEQ ID NO: 149646 - protein, 239 aa, Heterodera glycines
  Coding regions on vcDNA: vcDNA=SeqID_76069; Strand=-; Position=1 -56,450-542,592-955,1003-1209
  Homolog annotation: Hit_ID=NP_507850.1; Match level="QueryCoverage =97%, HitCoverage=38%, E-value=2e-38, Identity=37%"; Hit description =GLYcosylation related (67.0 kD) (gly-4) [Caenorhabditis elegans] emb|CAC14394.1| Hypothetical protein Y11
MSFRIWQCGGSLEIHPCSRNTRRAAEVWLDDYKEFYFQTVPSARYVNFGDISERLRIKERLNCKNFSWYLKEVYPELKPLKNSGERRVQIIQQGMCLDTLGKFKWNQSPGLYQCHGMVFGNKYGTKLSCLCDGGNQEWMYSPLSGKLRHNAFKFCLTVNASSGVPFNGDCKVASVNWRLPTPLQGQNQHEANGLVKIGLKCLGSASETHEGNGLQFVLQTFSCDLRDPNQLWTVRYLSM

SEQ ID NO: 149647 - protein, 50 aa, Heterodera glycines
  Coding regions on vcDNA: vcDNA=SeqID_76070; Strand=-; Position=1-152
MPATKKKAQLDPLVRRSIALLWAYNGSDLVLLTFLPGECRFDEYCQANRK

SEQ ID NO: 149648 - protein, 239 aa, Heterodera glycines
  Coding regions on vcDNA: vcDNA=SeqID_76071; Strand=-; Position=1 -151,198-263,310-372,412-470,511-550,593-732
  Homolog annotation: Hit_ID=XP_394527.1; Match level="QueryCoverage =97%, HitCoverage=28%, E-value=5e-42, Identity=44%"; Hit description =similar to RE02655p [Apis mellifera]
FSHVLPPTSIIITFHNEARSTLLRTIWSIFIRTPSHLLKEIILVDDYSFDATIGRDLFTIGRDLFGIDKMRIIRNRKREGLIRSRVHGSILIRSRVHGSIIASAPVLTFLDSHCECNVGWLEPVLQRSHCECNVGWLEPVLQRLVENDKAVVAPVIDVINLVENDKAVVAPVIDVINMDNFNYVSASSDLRGGMDNFNYVSASSDLRGGFGWNLVFRWEALGREKKYSGEKNRKKPIKE

SEQ ID NO: 149649 - protein, 317 aa, Heterodera glycines
  Coding regions on vcDNA: vcDNA=SeqID_76072; Strand=-; Position=1 -81,145-1017
MLYFFPSISFTIFCYLLLVPVSSAIQSVDEGMLIEFMKGHNENKISEFSMQKYEAHIGILHFMEKNWQCDKIGEQFKAHYEQTKCQKYRKYLDILYEYLIGEYAGIPTVKPKFVFKNRHFEIEGPIIYAVNCLAIIWQFYLNSTISNYDELKLIHLINSHFKLNLLNEKRIINFNAKKDADEKEKDEKQMPINEMILQLAIDTDYQYQINKSVDRIIRKTLDQNLEKMLKKAEERAKDGRPKAKADEINGDKTLIILDSKFDDSKGWVREEFLGLAGVGRVPVFLGKNWPGYCWVQKSRAGPMSKFFNRVRVSGPSG

SEQ ID NO: 149650 - protein, 68 aa, Heterodera glycines
  Coding regions on vcDNA: vcDNA=SeqID_76073; Strand=-; Position=1 -75,631-762
MRNTKKYETLNTPKTQKDKPLNMIHPKILSCPTMAARNYGLRITEITGFWELRITGYGFLGFFRNFDP

SEQ ID NO: 149651 - protein, 140 aa, Heterodera glycines
  Coding regions on vcDNA: vcDNA=SeqID_76074; Strand=+; Position=1 -295,502-629
MRNLQKERKVLDLERYMRKREQFEQILKSNKRQIEKKLPFLEEFLAKKPNSFEKIYADKGKTKTYTNEQYLKGLKAIEDELNKFEFVWWHNEEKRWTISDRPAIRQIVWVVRHAEKRNGGTEDETLTEKGEEQAKELGKW

SEQ ID NO: 149652 - protein, 187 aa, Heterodera glycines
  Coding regions on vcDNA: vcDNA=SeqID_76075; Strand=+; Position=1 -144,189-298,399-511,729-925
MPVPRVRFKTVPITKVFASPFQRTMQTAASLLGEGHRAFVHIEPGLSEFEKPCDLKIGHKKLTELHKDKAFPHTNPNYWPMYSEKALKLIKAEREESKRKEESDCHFVVEQTLRRILTENKNAEHIVLVSHRDVIGHVNELLGGNWAVVDTATVNKYVQYANGKDQQKEDDDILSKFVIEHTGVHVH

SEQ ID NO: 149653 - protein, 345 aa, Heterodera glycines
  Coding regions on vcDNA: vcDNA=SeqID_76076; Strand=+; Position=1 -41,297-627,758-1423
MSHAFRVPPPHRPHNKSEGERNDADDDDDDQTEIEQFNRELNEICQMLREHYRNEVPKIGRLCAQMSEGTRQALAIQQQVPNPDEVQQHRENNARDNKNKNSSNKGISSSKGNNCDNANVKCESGLHQNAWWQQQFHEIEQALDNDADDEGISSGECSDNGTNENDNKSDDDIESDAESDDKPYECDCESADHPMECPLLAARRALRRLKLPTILDICAATEAEVRQYGTKLSDIVKQIAKLRVQNGGALTSELELRSRQKQAQNLLQQIGNLMPQLVVEEEEVAEILKFVEQSADRFSIGFRDRKQQKQFKKAIRQPKKVCSNLKLARSFFLLSLVEYFWYFVI

SEQ ID NO: 149654 - protein, 85 aa, Heterodera glycines
  Coding regions on vcDNA: vcDNA=SeqID_76077; Strand=+; Position=1-255
MFKCGVCTYSNVIQYTYLPSDIFFDGLGNKVRSTVKQTLAEQSTKNAEVAEAFALLKKLKKHRTQMDSCESVGTTDAEGAEQKQN

SEQ ID NO: 149655 - protein, 80 aa, Heterodera glycines
  Coding regions on vcDNA: vcDNA=SeqID_76078; Strand=-; Position=1 -169,738-811
MKKSVTISVPEQKEINQPNSEAEPPKTDTTKKRKVEDRELWKLAKGKFMLATYLCEVIIILALFALSVRHDFVVFAIRSA

SEQ ID NO: 149656 - protein, 151 aa, Heterodera glycines
  Coding regions on vcDNA: vcDNA=SeqID_76079; Strand=-; Position=1 -147,316-623
SCAYMERLAGCLICGPHWTVAFCQRLFADTNVDHQMVADNPLEAFANWLGNKMYEMKVRKQKRRNPNVVFRDSFNLMPCSLAALIQSYGLNVEDKPFFPHLANRPENYGSQIYPTPDDYLANGMMPGKRRQFDVWYEQHREEPFILDEALA

SEQ ID NO: 149657 - protein, 65 aa, Heterodera glycines
  Coding regions on vcDNA: vcDNA=SeqID_76080; Strand=+; Position=1 -114,175-195,390-452
IIVIGDISTGKTSLIQRFIHNSMSGNYKPTLGVDFATKLVQFEDTPGTFCKHDPSVLQGFARCHL

SEQ ID NO: 149658 - protein, 62 aa, Heterodera glycines; identical to SEQ ID NO: 125756
  Coding regions on vcDNA: vcDNA=SeqID_76081; Strand=+; Position=1-286

SEQ ID NO: 149659 - protein, 72 aa, Heterodera glycines
  Coding regions on vcDNA: vcDNA=SeqID_76082; Strand=+; Position=1 -76,675-817
MEERPGFKVDLGQWAANPRHFGGQQTTKGPKFAPFVSPRIGAEKETDEPEKLFPKRLLLNKYIICNLFGFFL

SEQ ID NO: 149660 - protein, 138 aa, Heterodera glycines
  Coding regions on vcDNA: vcDNA=SeqID_76083; Strand=-; Position=1 -130,650-768,1021-1186
ERIKTEEAKRFPAALQRNAKNDNGRSGQSVAAFVPMGRHQLAKNESQAAIKVEKVVTILLDDPSAFDHFCVALLLSQQFKLFKMQFLLHNFVAALHQHNKQQQKQLAATNGSNNSAPNVCPAPPIDETEQIMAPFPPP

SEQ ID NO: 149661 - protein, 229 aa, Heterodera glycines
  Coding regions on vcDNA: vcDNA=SeqID_76084; Strand=+; Position=1 -272,321-517,709-929
MDHNTFWNRKKLIQYMGTEEKVVKWGSDHGFIPKTAFCYGKWPNQHAKQEMVFENEGKVGNFRCPKCRKKQSLLINTWFENCHMPLSKIMSIMYSYAHEESYEKCTREAVENENGTLLGSDTITAWLFFTNSFLLNWNIRYKYCREMIVDHYIVREGMIEYGSEDFGLVACPEKIDSSADVLIPIIQQHIALGTEIHIDCWRAYARLTEFGYLNKVVNHSDPENRFVGI

SEQ ID NO: 149662 - protein, 176 aa, Heterodera glycines
  misc_feature (125)..(125): Xaa can be any naturally occurring amino acid
  Coding regions on vcDNA: vcDNA=SeqID_76085; Strand=-; Position=1-528
  Homolog annotation: Hit_ID=XP_308192.1; Match level="QueryCoverage =84%, HitCoverage=37%, E-value=1e-43, Identity=55%"; Hit description =ENSANGP00000021557 [Anopheles gambiae]
NLASNPIGKVQIPPARIAISRPRHLCERIGPDPGRSEAIRQMPPPHNLSTLRSFLGVLNYYGRFIKSMREIREPLDQLLRKDVKWEWTDEQQNAFQKAKEIMLSDLLLIHFDPSLPIVVAADASXDGIGATISPIFPDKSEKVIEHASCTLNDAQKNYSQIEKEALALVFAVQKFH

SEQ ID NO: 149663 - protein, 690 aa, Heterodera glycines
  misc_feature (11)..(11): Xaa can be any naturally occurring amino acid
  misc_feature (150)..(150): Xaa can be any naturally occurring amino acid
  Coding regions on vcDNA: vcDNA=SeqID_76086; Strand=+; Position=1 -73,2153-4159
  Homolog annotation: Hit_ID=NP_510849.1; Match level="QueryCoverage =94%, HitCoverage=47%, E-value=1e-135, Identity=39%"; Hit description= predicted CDS, zn-finger, CCHC type and RNA-directed DNA polymerase and Integrase, catalytic domain cont
LTHPILYACSXSDHNTSGVPVYSVTQKFGLIQLEKCKFLQPELLFLGHVISAKELPDPGRSEAIRQMPPPHNLSTLRSFLGVLNYYGRFIKSMREIREPLDQLLRKDVKWEWTDEQQNAFQKAKEIMLSDLLLIHFDPSLPIVVAADASXDGIGATISPIFPDKSEKVIEHASCTLNDAQKNYSQIEKEALALVFAVQKFHRMLFGRKFTLLTDHKPLLAIFGSKKGIPIYAASRLQRWALIMSNYEFDIKYINTSSFGQADVLSRLIANYPRPEEDILIANICTETDCYINTILQTATDQLPTTKAEISEWTPKDEVLRKISDHTKNGWPQKCTDPDLSPYFPKRKEIEIDGVLLYGKRVIVPTQLRERIIKALHMAHPGIVRMKALARQHVYWPGLDLEIERMVRQCEDCQSAQKSPPKAPLAPWTSCSRPFQRIHIDFAGPCSDGHSYLILIDSFSKWPEVYRMDRISTPATLQVLRSIVYRLGFPEEIVSDNGTQFHAAEFKEFCDEFGIKHTFTPPYHPQSNGQAERFVDAFKRAMKKCAKDGKFSAEKKLLAYRTTPNSALNGLSPDQLFFGRRLCTQLSLVHPKEEQAEVIDPAKIRKSQADYARKMARQFDQHHGAKPVEFLPKDPVLLLNFNRGKRFWLNGTIRKIGKIPTYRVHVPALGRAVHRHVNQLRHRYPLEENGM

SEQ ID NO: 149664 - protein, 27 aa, Heterodera glycines
  Coding regions on vcDNA: vcDNA=SeqID_76087; Strand=+; Position=1-81
SVSVTVRISANPSVQWHFFGRKSNHCA

SEQ ID NO: 149665 - protein, 63 aa, Heterodera glycines
  Coding regions on vcDNA: vcDNA=SeqID_76088; Strand=-; Position=1 -67,268-392
MTPFFAVVPIAQFWPSTVAILHKKKASVSVTVRISANPSVQWHFFGRKSNHCACCVSMSDTIK

SEQ ID NO: 149666 - protein, 114 aa, Heterodera glycines
  Coding regions on vcDNA: vcDNA=SeqID_76089; Strand=+; Position=1 -76,494-590,830-998
MRSENGEQNEGVAPLSAADQQQLKAPAKLLGWHRLPQRIGNHWCQTFDGPIQRKSLKRCAMIGLATKEMPLYGRVGTYPNGYGHRSDGLFWVNGSCQIGSQSAKFGIGDVIGSG

SEQ ID NO: 149667 - protein, 265 aa, Heterodera glycines
  Coding regions on vcDNA: vcDNA=SeqID_76090; Strand=+; Position=1 -238,283-391,468-891,1195-1221
  Homolog annotation: Hit_ID=NP_914450.1; Match level="QueryCoverage =98%, HitCoverage=35%, E-value=2e-19, Identity=25%"; Hit description =putative transposable element [Oryza sativa (japonica cultivar -group)]
MIRAVGNVITAKISEQISQSGVFGVIADETMDISGYEQLSISARIVNESNQIEEIFLGFVELEDQTAVTISKKIIFLLRGKYGLDLSKIVGQAYDGASVMSGGHNGVQAIVRRESGAHLLNLKLCAALTANHYHNVFDFLGKLTNFFHCSAKRTKILERSIDAISCSKKHRIPTFSDTSWTARHTVIEAVKELLPAVIAALCQIRNEDAAMRSEAAYLLDFFAQNEFQFCFIMIDKVMSAMKPLTLLFQSKEVDIEKGIFCRNVQ

SEQ ID NO: 149668 - protein, 19 aa, Heterodera glycines
  Coding regions on vcDNA: vcDNA=SeqID_76091; Strand=+; Position=1-59
MSHLPWCTRCLGIPSTVIA

SEQ ID NO: 149669 - protein, 583 aa, Heterodera glycines
  Coding regions on vcDNA: vcDNA=SeqID_76092; Strand=-; Position=1 -135,279-1161,1285-1778,2004-2243
  Homolog annotation: Hit_ID=AAL25524.1; Match level="QueryCoverage =51%, HitCoverage=47%, E-value=2e-11, Identity=28%"; Hit description =SD09360p [Drosophila melanogaster]
MVEEAALLALSVLPEANSLLPTESQKALNQCKERGTKLLEEACLAVLFRVAHHWYDDLYLAHLENTQQQQATTTALPPPAHPQPTQRIAPQQCVVRLMMHSPLHHSHQSQQQQQHFFPVHSAAASTSAAVVFSPSVPPPPTPPQQFVGPNVVIHPQQHNLSTGNNFIQYSHHLQLTPTAVPLFHGQTAAVSMAPMLHNGQAPSVSSCCFLSLPPPQLQAVQPPTVVDHKQTSQPHLQQSVAQFGSTIGYPHHHHVTAHQPPLSTPPPPLMLMALPGANAAASAFPPRHILQPTPAQHQLPNYTQQQQQTANQQWTLQKGIGKHSIGLNGEHCNCERMRIESALFRRDLLAARRVPGDWRSRLRAAVSREGVRLCVLTLRPPPIAPRRFQSLPFRPLLFFSNICPRFSVFPTFARCFASARLERRLSFGLANGQQRTGEDVHSAGEVGHGIASDGRPRGGVAAPRHSLLLQRRLPQVNAGCIFFGVTNLIFRLSYPNFSASDQEYICELALVVRDIFRHIPPYHHPPHHQQQQENGRRKYMDLFLEHLQEQKAFKNRKNGGMAAVRNTLSQQQQQRQLTDRSDD

SEQ ID NO: 149670 - protein, 121 aa, Heterodera glycines
  Coding regions on vcDNA: vcDNA=SeqID_76093; Strand=-; Position=1 -159,203-285,340-462
  Homolog annotation: Hit_ID=XP_417810.1; Match level="QueryCoverage =88%, HitCoverage=67%, E-value=4e-21, Identity=50%"; Hit description =PREDICTED: similar to archease [Gallus gallus]
SVSPPPPPSSNECPPPLVPCQYEYLDHTADVQLHAWGQSLGEALEQLTIALYGYMTIEIDRVEPIYTMDFSASGHDLSALVYNLLDNCLYSFCAEPFFIGRFAKFLNLKKPSGNTGEELSV

SEQ ID NO: 149671 - protein, 231 aa, Heterodera glycines
  Coding regions on vcDNA: vcDNA=SeqID_76094; Strand=+; Position=1-696
MKRTNASNITPPRAKRAMPPALDLDQNTATLEEQERQRTLVFIGLPESNAIRPSERVQEDREAATKILDHLEVEAEPTAVFRLGRFDPQRTTPRPLKVVMPTPTHQHVALGGWKHERARLRSQQNLTRLFVRPALSKEQLKEEYEARLRKRQQNPAPMAPATQLPQTNAPTPVVEDGPNQKKTSDDIPKQPEVFDETILVCYEALNSFPPTDKIVHQIQSLKKQYPHLFNK

SEQ ID NO: 149672 - protein, 231 aa, Heterodera glycines
  Coding regions on vcDNA: vcDNA=SeqID_76095; Strand=-; Position=1 -175,737-825,904-1200,1257-1388
  Homolog annotation: Hit_ID=NP_509676.1; Match level="QueryCoverage =93%, HitCoverage=45%, E-value=3e-71, Identity=72%"; Hit description =g-protein-coupled Receptor Kinase (grk-1) [Caenorhabditis elegans] emb|CAA88047.1| Hypothetical protein F
MYALKKLEKKRVKKRHAESLTLNEKQILQRINSPFVVSLAYAYETKDALCLVLTLMNGAPEIVKNERYSYGVDWWGLGCLIYEMIEGKAPFRQRKEKVKRDEVERRVREDTEKYSDKFTEAARTLCRGLLHKEPTLRLGCRRVGRPEDGAEELKAHAFFTQPDQKTGREPVPWRKMEAVKVGEAQGMLPPPFHPDPHSVYAKDVLDIDQFSTVKGVRPVRPVLFHPQTIPQ

SEQ ID NO: 149673 - protein, 270 aa, Heterodera glycines
  Coding regions on vcDNA: vcDNA=SeqID_76096; Strand=-; Position=1 -85,225-340,1142-1237,1600-1628,1681-1888,2043-2092,2157-2247,2304 -2439
  Homolog annotation: Hit_ID=NP_505960.1; Match level="QueryCoverage =57%, HitCoverage=14%, E-value=2e-27, Identity=45%"; Hit description =guanylyl family member, abnormal DAuer Formation DAF-11 (daf-11) [Caenorhabditis elegans] emb|CAD56284.1|
KRGETTQMPYYVPEQMIAFVDMDYGGSSNISIHSFHQHLAKREKEEERTDEVPEEIYSRKIATIEQKLWNFSSFVQMATQRHFEQWQWHSHSATDPKRRINDVTESGDGAGPLEPMEDDVGIFSAQAEERLPIVPEFPGEETVAPGANTPRSMVSSIDRVHPDLVALMRRCFGTPEQRSGSLVDQMIKNMEQYTGNLENLVKEQTGKLELEQQKIEQILLELLPKSVVDELRMGRRVEPQFYASVTIMYSDIVGFTSLCSESQPMEVVEL

SEQ ID NO: 149674 - protein, 70 aa, Heterodera glycines
  Coding regions on vcDNA: vcDNA=SeqID_76097; Strand=-; Position=1 -63,552-701
MAPENLVTNVLALLQLTNWRKTEFVNIVCISDYSPSPLALPWLSNGTMDSAMLNLFHGTILACFANVSIN

SEQ ID NO: 149675 - protein, 106 aa, Heterodera glycines
  Coding regions on vcDNA: vcDNA=SeqID_76098; Strand=-; Position=1 -265,322-375
  Homolog annotation: Hit_ID=EAK84170.1; Match level="QueryCoverage =64%, HitCoverage=16%, E-value=2e-09, Identity=52%"; Hit description =hypothetical protein UM03124.1 [Ustilago maydis 521] ref|XP _400739.1| hypothetical protein UM03124.1 [Usti
MTWTLNLGEILAWIQSNSSIIGTVVYIASLFEFFTNARRLLEITRMGRAGVVLSSGAEDMLQLRGPFDVSNLCSLFGLTPKCGRRFVSSNALSVLLRSQTRRHTVK

SEQ ID NO: 149676 - protein, 114 aa, Heterodera glycines
  Coding regions on vcDNA: vcDNA=SeqID_76099; Strand=-; Position=1 -69,121-263,366-498
MGYESVAINVDIGKFGKESDIIWSDEEDEVVSKKRKRKKQKKLHDRKSGDGNERTSESEIVPDPFLVDESNRLTVSIDADSIHHLQHNKKVKLYDIIAVRVPDEQILMTLQRYS

SEQ ID NO: 149677 - protein, 212 aa, Heterodera glycines
  Coding regions on vcDNA: vcDNA=SeqID_76100; Strand=+; Position=1 -116,160-280,332-454,498-773
  Homolog annotation: Hit_ID=CAE66385.1; Match level="QueryCoverage =90%, HitCoverage=20%, E-value=2e-51, Identity=52%"; Hit description =Hypothetical protein CBG11647 [Caenorhabditis briggsae]
MTLPSCSKDGAASLSPMSFKEPNACPMLERMHYQRITGRFCDACIFVKDRQFSAHRMVLAAHSPYFDSILRHNKIAKEKIIVNCQDPTVFDRILNYMYSGSVTIDRAIVVELLKLANNLLMIRLKNYCADYLMRYIDVANCLAIRDLASRYNLPRLQKHANEFFDSNINGLFGLLCVKSKSRFRCLLENADVLGWEPIKLVELLEMTRHASN

SEQ ID NO: 149678 - protein, 285 aa, Heterodera glycines
  Coding regions on vcDNA: vcDNA=SeqID_76101; Strand=+; Position=1-858
MCQTNGRNIEERTRPYAAKLFKICATIQPQQKQNFSQSFQPRENTVCYNCNEPGHFSRECRRPKQYFDGRANQSHAVPATGANSFQMRPNGPEKRALPQTSTKESDQRRSQNFLKQNCIVVQEEAPPEAFCRGVQLSSEIAEFFANEFKERKDGNNQREMSSDRVGKILVIKIETFGAKTEAMIDGGAQISLVGASFLYMLIREKGLDLQKTNFARTNDRIADVNGKELRCFGTLTLPILRKGCEQVAIHFYVTSAPFGFDMLFGTKADQFWNYGASAPVTTPIT

SEQ ID NO: 149679 - protein, 330 aa, Heterodera glycines
  Coding regions on vcDNA: vcDNA=SeqID_76102; Strand=-; Position=1-993
  Homolog annotation: Hit_ID=NP_001004509.1; Match level="QueryCoverage= 99%, HitCoverage=22%, E-value=1e-33, Identity=29%"; Hit description =si:busm1-180o5.3 [Danio rerio] emb|CAD60788.1| novel protein similar to DNA polymerases [Danio rerio]
MDWYAKRNGVSIQTAHSPGGEKKIGQYTVDGYIAATDTVIEVNGCHWHAHDHPRHRFQPQTVMANGKTAQRIREDDARRLSFITSQVQQVLVFWECEINAEKRDNDEMKRTFAQYKDSGPIRLKDCYHGGRVGPQRLHYEVPEGWRMKYYDVRSLYPHTNAVTAYPVGHPTRVNVIGEAEQAVDWRRADQVPVRGILKVFVVPPHHIDVPVLPVKFDQRLLFPLCRTCALQHPHGAVNEDYECTHREDDERGWVSTVTSIELEEALHNGYRCTAYYRSVEWDDTQWSDRVFRGYVAEFMAMKTHASGFPDEIGQTEEDQQQFIEECEEKF

SEQ ID NO: 149680 - protein, 605 aa, Heterodera glycines
  Coding regions on vcDNA: vcDNA=SeqID_76103; Strand=-; Position=1 -330,1155-2019,2106-2728
MPRVVSTRTGKGAVTGKPPNTTTVKNKNSSSKTTTTTPTRKTAKLVADEQLPVATLLPTLIHQMCKDRPGEENFYQQAVCWALFALYLMVIVSLILHQLCSICWLKKKKESVKSTFVIENLPANPESMLRALFAHCMSTALDESQQNGITPDQLVATISSDLLNPSIWIPIRRISDNTADSIMNRFLEVAQSKSREGSLWGSPFTVTITTLDVAQLPQRQQVRGSGKRTPYSVQHIVKESALLRINNSDDAYCLFYALEASRKYHSKEMPRRNFCYYINCQNGQRLEDVFGLMSGANIRTDLREYDAVVYVPIVVDYWNRKYATANQRFKVYIFGATGTYRPKFQYGPDNFNIEIPLYHHNDHFDGIRCGVGKAVFGRDYYCFSCECPYDNANDHTLQSCGKDFMSQDCFNHHLSSNVCRQFNKCKQCGIVWNIRQNRRKGRSGHVCGEKFCYTCKCYHKPERGCFIQQLKARRPKKYRLIAFDCETTQNTRIEGSGDRRLHSVNFISCHVACTKCITENSWRNSLQVPCSICGRQRTVTFSQSGYERTQTDAQFITPCPMAAFAQWLLSEFDPRYPTMLFAHFRVVLTTSCCFGSSSSTGFARK

SEQ ID NO: 149681 - protein, 361 aa, Heterodera glycines
  Coding regions on vcDNA: vcDNA=SeqID_76104; Strand=-; Position=1-1086
  Homolog annotation: Hit_ID=AAN75564.1; Match level="QueryCoverage =52%, HitCoverage=7%, E-value=3e-14, Identity=30%"; Hit description =adhesin FhaB [Bordetella avium]
MEQWRKRRYDIQQQQRQPPPLVVRDLLAEAAAAPLPESDDDDDDDDEYMLENGFALPAPSQYYGDLPVLPDNAEEIEEMDTAQRRIAIRRKLKKDEAYDDDDQRKKYRIYQPPPLPRAKVKVEQPRPPTPRPRPNVKREQQQKPKPEFKPPATSKKTGHPTPAKRVPEFVDLDPRPSTSRQAGYNPPPPTPKIKHEPTTKRPMPYRIPKREPKVEEAPQQQQPLPAAAVVVEEMPYVPPPRRGAKRRYPVYEDDEVQIRKRVRQPRRVRVQYSPEPGPSTSAQSDEQQQRQQQRELFAIPSNQLTMTQRVERLYIKCNHYADRMGVRGNTINTANGKPLVHTNLRMAIRYIIDGKSGPPHH

SEQ ID NO: 149682 - protein, 193 aa, Heterodera glycines
  Coding regions on vcDNA: vcDNA=SeqID_76105; Strand=+; Position=1 -280,324-625
  Homolog annotation: Hit_ID=AAL93203.1; Match level="QueryCoverage =92%, HitCoverage=25%, E-value=2e-10, Identity=30%"; Hit description =transposase [Bactrocera dorsalis]
MFGLREYALATFLDVRFKDKVLTENSATFRARVTVWIKNELKELDIDNDFEELQQNEFVRPVISPQPENLPAKRRMSFFERLKNITGANTSEQGLQTSQDDDIEKEIKEFLSVEIANPEANPLDEWKKIAPRFSILAKFAEKYLSAPATSVPSEQTFKVARDVFDYRRSKLSPETAEQLIFLNKSLPQMNYNY

SEQ ID NO: 149683 - protein, 144 aa, Heterodera glycines
  Coding regions on vcDNA: vcDNA=SeqID_76106; Strand=+; Position=1 -160,526-694,1508-1613
MNEQANVLKDLQFLITLINPFLYGFGRSGGSGAKLRGKAAVGQHRQKGRNACGGSKREFCANFDFCKEWLWHLSFVLLYAMMSLPISAVAILFLFSQINCHSSVHLILLGDFEQYLFRDHLMDKLHILKWHSCRRPSAAEYLCC

SEQ ID NO: 149684 - protein, 90 aa, Heterodera glycines
  Coding regions on vcDNA: vcDNA=SeqID_76107; Strand=+; Position=1 -129,766-909
  Homolog annotation: Hit_ID=CAE70690.1; Match level="QueryCoverage =52%, HitCoverage=11%, E-value=1e-09, Identity=51%"; Hit description =Hypothetical protein CBG17407 [Caenorhabditis briggsae]
MVWLLSYRWLFGDFGCRLYQFLSAFAYYSNSNVIVAIGLDRLKIAEYTQTTNLISRMNSQRQSRTFNSRRKTIRGVPMPTLSSSTNCCTR

SEQ ID NO: 149685 - protein, 77 aa, Heterodera glycines
  Coding regions on vcDNA: vcDNA=SeqID_76108; Strand=-; Position=1-301
PSRGAARRGKKTPATIWEIGFGQAATSKWSIGFGFETPPHRGFFMGRQIQRAAPSHRHGLVRETPATNPQPFGTIYY

SEQ ID NO: 149686 - protein, 146 aa, Heterodera glycines
  Coding regions on vcDNA: vcDNA=SeqID_76109; Strand=-; Position=1 -360,469-641
  Homolog annotation: Hit_ID=AAV53354.1; Match level="QueryCoverage =94%, HitCoverage=51%, E-value=3e-13, Identity=30%"; Hit description =TATA-box binding protein [Volvox carteri f. nagariensis]
MQKPIIVNIIALANLGTGIKLNSLTITECEFKYNPRKFNAAVIKCTAPIKATALLWESGKMICLGTKSLIDCENAIKNFIEIIKGSGCPGASYTGLNFKRGKSMTALIFWTGKVVITGTKNNSEIEEMYHHILPYLKMAQKNLMRR

SEQ ID NO: 149687 - protein, 62 aa, Heterodera glycines
  Coding regions on vcDNA: vcDNA=SeqID_76110; Strand=+; Position=1-190
TVRLITDELDDGTVTLLAERPARRHYAHTLGQRPTKPCSGSEQDLTVFYLSWGGGLFGNDSP

SEQ ID NO: 149688 - protein, 313 aa, Heterodera glycines
  misc_feature (1)..(1): Xaa can be any naturally occurring amino acid
  misc_feature (297)..(297): Xaa can be any naturally occurring amino acid
  Coding regions on vcDNA: vcDNA=SeqID_76111; Strand=+; Position=1 -189,638-821,1132-1287,1412-1505,2290-2400,2694-2900
  Homolog annotation: Hit_ID=NP_501223.1; Match level="QueryCoverage =94%, HitCoverage=94%, E-value=1e-116, Identity=72%"; Hit description= mitochondrial carrier protein family, embryonic tissue differentiation factor, DIFferentiation abnormal
XTNVVTNFIAGGVGGSCAVITGHPFDTVKVRLQTMPKPAPGQPPLFTGALDCVRQTVAREGFFALYKGMAAPLVGVSPLFAVFFGGTALGKWLLQNEPGQQLDFKQNFTAGAIAVVVTTAVMVPGERIKCILQVQSMDGSAGTTPKYTGPVDVVRKLYREGGIRSIYRGTAATLLRDIPASGAYIAVYELLKDKFSGGKRHELTPMATLLADGFAGIANWSVCIPADVMKSSRLETAPEGKYPRNIRGVFREMLREEGHRALFRGFVPVMLCVFHANAACFSGLEQTLWAFRQAGVXKKQTISLCLLYFSILI

SEQ ID NO: 149689 - protein, 119 aa, Heterodera glycines
  Coding regions on vcDNA: vcDNA=SeqID_76112; Strand=-; Position=1 -101,519-777
MVRKRKKVSPPVPTAGAGTAGGASDAGGYRFSAPPFTPTVPCLSTVYYTRYRTLFLCYLCPHVRFRPTELCKGRLEEMVGESGEEQRQHKGGQREQCGHHKEAKNGSGGGATSAAYVSC

SEQ ID NO: 149690 - protein, 146 aa, Heterodera glycines
  Coding regions on vcDNA: vcDNA=SeqID_76113; Strand=+; Position=1 -87,798-939,1076-1287
  Homolog annotation: Hit_ID=NP_741492.1; Match level="QueryCoverage =71%, HitCoverage=30%, E-value=3e-14, Identity=36%"; Hit description =bacillus thuringiensis toxin REsistant BRE-5, beta 1,3 -galactosyltransferase, Bt toxin resistance protein
MNALESEAAAHGDLLVGDFMDTYFNNTLKVSLDEFPFAAFPPYIAAGAVLLTGQTIAEFYAAIPHVRLFRLDDIFAGILSHLLAITPQHNANFAFYRQSFADDSLALASSETLTTLIAVHDYLPEEMRETYGKAVKQQNQQKLKLL

SEQ ID NO: 149691 - protein, 342 aa, Heterodera glycines
  Coding regions on vcDNA: vcDNA=SeqID_76114; Strand=-; Position=1 -68,112-652,698-884,937-1082,1129-1215
NFCGSLWKQIGQIDAIDGRKVKWFLGGDLCFLWAIIGHCGSAMTAFPSPVCDCRRERLISSAKCQLRSVQELERQAGQFEQLTQGGDKATAEARALTMGIVCAPLLPSINFEQMLLAPFHVFQGLGNALIKELEAGENAEIAQQFFRRIGTRREAFRKRDLTGNSIRKILVHADQMEALFETEWAKTICQTMVHLGKIQIFTKAQPLSPGDLDGLETAVYQFKAFLDEQPMVRTLLSKKTKAHLLLHHFVPFAHQHGFLGLLDEQGDEALHSVWGRLEQLWKTMPDSEQMRQQLEHHFVLNWLLDTGRLDELKLREEEQREQAEEDKTNEESDQDADVDIVD

SEQ ID NO: 149692 - protein, 354 aa, Heterodera glycines
  Coding regions on vcDNA: vcDNA=SeqID_76115; Strand=-; Position=1 -307,956-1713
  Homolog annotation: Hit_ID=AAA93301.1; Match level="QueryCoverage =71%, HitCoverage=82%, E-value=6e-36, Identity=30%"; Hit description =HASI
MPQPLPLRDMPQIHHPPRNVTSIWIKLWLLFLSLWVFLQGIHVRQIQREYAVPQFADPPPNVPYHPPENVPVMLGLVFRAFLIFPDAFSGNSTNATTAAAERPSYAGILKVLEEARKVDQNITLEDVNTFLEKQRTYTIHKPIKKIFPRLKTIPSGLHTDWQCDLCIFDQLKKHNVKIYSDSGLEFQAGKMKKYFEEKQILKHVMYSPDLHAGVVERANRTIKERLYKYFTQKNTLRWVDVIDKIITNINNSVNRTLGVKPSFVNFTNASEILNNIYGNKKEKIIKPKFKIGNIVRITKDKGKFGKGYYPNFTEELFAISNVLSSNPPSYRIVDMEGDQIKGIFYDQELVKTSV

SEQ ID NO: 149693 - protein, 63 aa, Heterodera glycines
  Coding regions on vcDNA: vcDNA=SeqID_76116; Strand=-; Position=1 -71,450-570
MDQKSRNMDKKWPKYGHKFSKLRVFFIFNFNSPTLPLFILSSMQLKTALVAAPSPKFRSVIGH

SEQ ID NO: 149694 - protein, 97 aa, Heterodera glycines
  Coding regions on vcDNA: vcDNA=SeqID_76117; Strand=-; Position=1 -216,566-643
MHVHNIDGILNINYTGTDDDDNGKAKRRTPIGGDADSTSLFKLALAIAAAIFYSLLSRRPSKDYWLQPTAKETLIRFGVQSTTFPIPHCVEKDKFYQ

SEQ ID NO: 149695 - protein, 16 aa, Heterodera glycines
  Coding regions on vcDNA: vcDNA=SeqID_76118; Strand=-; Position=1-49
MKTFFRNTRPAIQPCQ

SEQ ID NO: 149696 - protein, 38 aa, Heterodera glycines
  Coding regions on vcDNA: vcDNA=SeqID_76119; Strand=-; Position=1 -69,532-579
MTESAKGVGKRMMAMKLTGDEALGHPGRFGSISKPVPD

SEQ ID NO: 149697 - protein, 168 aa, Heterodera glycines
  Coding regions on vcDNA: vcDNA=SeqID_76120; Strand=-; Position=1-507
MAAVIKAGKGPRPFLPEMCWATWWERFEFFIQLKGVTDVATKRLLLFTEMGQVYEELRRMAQPEDVRTMDLAEIEQLMVERFGEAKSIAACRHELFSAKQQTGQSIRDYSVLLRSLIAKAEWSRDSIDMCLCALFINGISSDEIRVELIKKGDNNLKFKDACRDNAKS

SEQ ID NO: 149698 - protein, 71 aa, Heterodera glycines
  Coding regions on vcDNA: vcDNA=SeqID_76121; Strand=-; Position=1-217
KFEVDTINILLLKLCPTWSICLDEHRHDSSLSDRSRPPTFPRPATLRASPISSPSRPLHPAEFDANFLSPR

SEQ ID NO: 149699 - protein, 541 aa, Heterodera glycines
  Coding regions on vcDNA: vcDNA=SeqID_76122; Strand=-; Position=1 -86,139-1678
  Homolog annotation: Hit_ID=NP_491240.1; Match level="QueryCoverage =51%, HitCoverage=21%, E-value=3e-52, Identity=41%"; Hit description =zn-finger, CCHC type and RNA-directed DNA polymerase  and Integrase, catalytic domain containing protein
MQCRSCESWQSAKRTKEAEEKHGMLLWVRKCGKWGHWAVGCKSKSSDGNANPGQKPKTVSVIHEVNGVSADTGFIQLLIQNGKLNFELDSCADVTVIDEIDWKSIGKPKLEPSNGLVAYGGKSIGGILGKATLNVRHKGRSIESNIHVISGKHKNICGRDLIMGLKIDLNRAFGISTICAVKTKKDEFGRSKPRPMPFSLRNEVESKICQEEAPDERKVPLHPWESPERPWQRIHIDFCGPFWGSMWLIIIDAKSKWPEVVRMRKTTALATIEALRIVFTAHGLPGQIVSDNGQFSSKEFGDYCKSRGIVHTTIAPYNSKSNGAAERFFQTFKQGMNKLQKEGMKQDIALSQFLLKYRVTPHPATELAPSEILFGRRLRTLLDLVKPTAANDFEAAKVPKESYAERMKRNFDRGANSRKKFEVNQRVYARNYRDGSKWIQGQITRQIGTAMFLVRTARGIWKRHFDQLKENLTDQNSDNSSSESEENSDSEDEVPIEAMDDEQLQPPPEEPQPEQPQQHANAEPRRSTRKRKKPKIFDPSA

SEQ ID NO: 149700 - protein, 52 aa, Heterodera glycines
  Coding regions on vcDNA: vcDNA=SeqID_76123; Strand=+; Position=1-182
EIVAYFDAKKIVFKGVDFSGNFRFETNGSLRSFPAPAHRLSLHPAFAALCLC

SEQ ID NO: 149701 - protein, 77 aa, Heterodera glycines
  Coding regions on vcDNA: vcDNA=SeqID_76124; Strand=-; Position=1 -110,263-386
MAPMALDLRYVALHEIGHALGLRHSTYRHSVMNSYYRQNLALLDEQTEEFKLSKDDKAAIWELFGEKCHQKKKRRKS

SEQ ID NO: 149702 - protein, 96 aa, Heterodera glycines
  Coding regions on vcDNA: vcDNA=SeqID_76125; Strand=+; Position=1 -35,121-376
MLNRANDQFLLCFILKIKDEEEYQRNKMRPHEIDQTRPVAEVPRTKKYLENDRAIKNLIEQFDQFGPDQRDDQRWITHLHALSFRLTTKGIDHWLD

SEQ ID NO: 149703 - protein, 83 aa, Heterodera glycines
  Coding regions on vcDNA: vcDNA=SeqID_76126; Strand=+; Position=1 -62,646-703,1133-1261
MIRDVLLGQRWKLSNGPMALGEFFIEQKSTVLLTRVGPLQDHISELLERLFRQFGWLRSRMFYEKQFWETELHEAGFCKLLMN

SEQ ID NO: 149704 - protein, 109 aa, Heterodera glycines
  Coding regions on vcDNA: vcDNA=SeqID_76127; Strand=-; Position=1 -285,651-695
  Homolog annotation: Hit_ID=XP_424748.1; Match level="QueryCoverage =85%, HitCoverage=18%, E-value=3e-16, Identity=49%"; Hit description =PREDICTED: similar to SDCCAG10 [Gallus gallus]
GVGNTIFNFLKLKEYEVDKNERPIYPHKITSAKVLVNPFDDINPRKATKDDERKRSKREKNATNVAMAATKRNTSLLSFGDEIEEEDEQSEHLTKCYINQTLRLLRRRL

SEQ ID NO: 149705 - protein, 141 aa, Heterodera glycines
  Coding regions on vcDNA: vcDNA=SeqID_76128; Strand=-; Position=1 -35,144-270,773-846,2454-2643
  Homolog annotation: Hit_ID=NP_508674.1; Match level="QueryCoverage =89%, HitCoverage=52%, E-value=2e-17, Identity=47%"; Hit description =RNA recognition motif -containing protein (26.8 kD) (XE525) [Caenorhabditis elegans] gb|AAC04442.1| Hypot
MKDRCDAEKACRDPNPIIDGRKANVNLAYLGAKPRNNAHLAALSTTINQLPQLQAAQIQAIIQLQQQQQQQQQLSGRFGLGSHLYLQNSPLGPQFAAAATMNPLAAVQLAAVVSQAQPNTLAAVAAQQVEQRHQFLLFDLK

SEQ ID NO: 149706 - protein, 41 aa, Heterodera glycines
  Coding regions on vcDNA: vcDNA=SeqID_76129; Strand=+; Position=1 -19,92-198
MTKYLCDLYTPTFSSARLTPEAFKKSTSCSSAKGICNGFNA

SEQ ID NO: 149707 - protein, 40 aa, Heterodera glycines
  Coding regions on vcDNA: vcDNA=SeqID_76130; Strand=+; Position=1 -39,134-217
MSHEVLTESESYMLVNFVSDVGGQAGLWLGASILTLFEVF

SEQ ID NO: 149708 - protein, 25 aa, Heterodera glycines
  Coding regions on vcDNA: vcDNA=SeqID_76131; Strand=-; Position=1 -47,139-169
MVAQFGGLSLKYVCLRKSSKFPIIQ

SEQ ID NO: 149709 - protein, 55 aa, Heterodera glycines
  Coding regions on vcDNA: vcDNA=SeqID_76132; Strand=+; Position=1 -92,241-316
MDFWASSAGIPTFLGSDRPNFSGSLNFHPCCIIVNDQLIKLWCNWNRGRCTVAVV

SEQ ID NO: 149710 - protein, 119 aa, Heterodera glycines
  Coding regions on vcDNA: vcDNA=SeqID_76133; Strand=-; Position=1 -37,449-522,674-899,1013-1035
MALIWDFCANFLSFYVWIEEHEFWVVAVDGSYVKPKRFDSVLIHPGERYDLLIVSQQNPTHNFFRIIFESFDRFMGNFSTGEDRINVGLANLIYEDQIVGNESQKLGNFSNEGNSQISF

SEQ ID NO: 149711 - protein, 114 aa, Heterodera glycines
  Coding regions on vcDNA: vcDNA=SeqID_76134; Strand=-; Position=1 -256,372-460
MEEKSAEIPKWFLNAIFAALVVFAGVFSKEKSKCGQIWKSKGSMSRTDELKGRKAFGKLGTIFSPKAGEELADVAAANLENLLKIGLTLQRDFMPNRSTADTLAAPFNARMHYR

SEQ ID NO: 149712 - protein, 238 aa, Heterodera glycines
  Coding regions on vcDNA: vcDNA=SeqID_76135; Strand=-; Position=1 -271,728-1173
  Homolog annotation: Hit_ID=CAA24816.1; Match level="QueryCoverage =93%, HitCoverage=58%, E-value=1e-45, Identity=47%"; Hit description =unnamed protein product [Human herpesvirus 4] ref|NP_039875.1| nuclear antigen EBNA1 [Human herpesvirus 4]
MNNNNNVNDGEGGVEANAGGGAVGGGAVAIVGGGAVADVANAGDGAVADVANAGDGAVADGANAGGGAVADGANAGGGAVADGANAGAGGGGDAGGRGGGRGGGGGGRGGGGGGCGGGGRGAGGGGRGGGGGGRGGGGGGRGGGRGGGGGGHGDGGRGGGGRGRGGGSAVRGGGRGGGGHADHSGKRKASAGAKKGWKKAANGRGRDEQKQGGLRGGGGRGGGNDCGGAGRSVTINFF

SEQ ID NO: 149713 - protein, 258 aa, Heterodera glycines
  misc_feature (81)..(81): Xaa can be any naturally occurring amino acid
  Coding regions on vcDNA: vcDNA=SeqID_76136; Strand=+; Position=1 -543,979-1229
  Homolog annotation: Hit_ID=CAD22154.1; Match level="QueryCoverage =86%, HitCoverage=50%, E-value=9e-64, Identity=51%"; Hit description =pherophorin-dz1 protein [Volvox carteri f. nagariensis]
IAKKPLTGSISSTHQISQQFNKNATIQKKLIVTDLPAPPQSLPPPRPPPPLSPVSAHPFHVHLRPSSSPFLPAEAFLLPPXPPPPRPPPRTALPPPRPRPPPPRPPSPWPPPPPPRPPPRPPPPPPRPPPPPPRPPPPAPRPPPPQPPPPPPRPPPPPPRPPPRPPASPPNNHQSSPPPAPALAPSATAPPPAFAPSATAPPPALAPSATAPSPLATSATAPSPALATSATAPPPTMATAPPPTAPPPALASTPPSPS

SEQ ID NO: 149714 - protein, 155 aa, Heterodera glycines
  Coding regions on vcDNA: vcDNA=SeqID_76137; Strand=+; Position=1 -18,444-743,792-941
MTSSWKACPFRSKGLICRRKLSDDNMCEACGQKAIAPIHTVFVRLLLQDVEQADIAQRVTMFSSVAEEFLGMKAAELLAKEKEPESLAKHLDDLIAVKIIAKVNIKANSQTYTGFDWIVNLFKKCPGKNDSDVPKEKDDDDGDVDEIATKKTKKN

SEQ ID NO: 149715 - protein, 258 aa, Heterodera glycines
  Coding regions on vcDNA: vcDNA=SeqID_76138; Strand=-; Position=1-777
  Homolog annotation: Hit_ID=CAE56395.1; Match level="QueryCoverage =98%, HitCoverage=31%, E-value=1e-37, Identity=35%"; Hit description =Hypothetical protein CBG24082 [Caenorhabditis briggsae]
MVAAFERLFKRSKYIPWTLLTDQGLEFKAKEVQEYFKNKNVKNFFMYTSPRIHAGMAERANRTIKERRYRYFTERGTQKWVDVIQQIVHGINHSYNSSIKMRPVDVNFENAEKLRKKLKQNAVGGTAELKRKQPLPRFQVGDRVRIEKYKHVFQKGYTGRFTNEVFTVAEVHTDRFPVTYRIRDDDGSLIKGRFYANDLCRVLVRKNDDDDDDTLYDIEKVVRKRKKQGVEYVLVKWKGYSQRHNSWIPASSMTWKNI

SEQ ID NO: 149716 - protein, 68 aa, Heterodera glycines
  Coding regions on vcDNA: vcDNA=SeqID_76139; Strand=-; Position=1 -57,651-800
MPQFVMLEPTDQVILYIVLANFTAVLLSEFPVSFGASNINSQIVTNIQNNSFSPLFIYYQNNNPLYVR

SEQ ID NO: 149717 - protein, 203 aa, Heterodera glycines
  Coding regions on vcDNA: vcDNA=SeqID_76140; Strand=-; Position=1 -49,238-297,346-405,2348-2789
MTENFNEQRSTALIQNDLTNELPEDFNEQRSALSENDNLQYDQNEQQPADVNRRADGVLFIVVVIFLNFNCRCSRPSVVPGLPRPNVMALMPPQNLASMPSQNVALMPSQKCCFDAAAKCCIDATAKCCFDAAAKCCIDATAKCCFDAAAKCCIDATAKCCFDAAAKCCFDAAAKCGFNAVAKCGFNAATKCDFNAAASSGNS

SEQ ID NO: 149718 - protein, 39 aa, Heterodera glycines
  Coding regions on vcDNA: vcDNA=SeqID_76141; Strand=-; Position=1 -32,457-544
MSDWIFWGRKISLNWNAVFLKNGHDHLDRFSPSGAIFNF

SEQ ID NO: 149719 - protein, 196 aa, Heterodera glycines
  Coding regions on vcDNA: vcDNA=SeqID_76142; Strand=+; Position=1 -130,520-689,1061-1245,1619-1721
  Homolog annotation: Hit_ID=AAH43953.1; Match level="QueryCoverage =89%, HitCoverage=25%, E-value=8e-33, Identity=42%"; Hit description =MGC53016 protein [Xenopus laevis]
FFNFQHIYSGSNLPNGGQLLPLEWCRTRHFSREAAQTLLDKMKKCTAATLSYVLANLHNVKKPEALRTVEMLKMASIRLGMSPARTMAVAEKLYTRGNTSYPRTETSAYHDEFEFERVLSALERSPTFARIVRQIRSDGKLLPENGTNKGDHPPITPLRSFYKCLYEDAHALYEQIAYHFLATLMRPCKYMLKSVM

SEQ ID NO: 149720 - protein, 113 aa, Heterodera glycines
  Coding regions on vcDNA: vcDNA=SeqID_76143; Strand=+; Position=1 -15,232-319,855-970,1340-1462
MIFPKLKEETLAFYLNKFCNFEQRIDDVEEQVRAEIFDPANPRRQCFKCRRVMLTVRAVFNQQMQQHICPSCQFFSGKERLSCFFRLPTSFPESPAIEQMQRFLGVNPANCLI

SEQ ID NO: 149721 - protein, 246 aa, Heterodera glycines
  Coding regions on vcDNA: vcDNA=SeqID_76144; Strand=-; Position=1 -199,843-1124,2179-2438
MCFMGSQIHSDATAIDGVAVGCLCHQCRVFSRPGTLANLCDAKRRPEAFGNPSHFGACHEYQRHFHLHSHRIGSTTDIPRDAQKRGESAPFAPGQPKAGEHFAVRAAQIHCVGRAQKHRPDGAGVAIPKNLHPEVQRDLHSVRRHLRLHQFGIALHGRGFEIFAFCLLKFSKKSMPVRGIQHKKSNLRIPLRDWNSIFAGRDPARLILQNPSNFQKMRNCGLRFRAGSRPRAGSNFEEPCTTHPCF

SEQ ID NO: 149722 - protein, 69 aa, Heterodera glycines
  Coding regions on vcDNA: vcDNA=SeqID_76145; Strand=-; Position=1 -135,428-475,711-737
MAENEADDGILREFICELDEQFSLIIAVFSTHNYKPSLNLINVDEIEYTDSRYFGVLISWGLPKLPVIK

SEQ ID NO: 149723 - protein, 28 aa, Heterodera glycines
  Coding regions on vcDNA: vcDNA=SeqID_76146; Strand=+; Position=1-86
FSYRFSGSFLGLGLVSRFQVKITSRTAL

SEQ ID NO: 149724 - protein, 252 aa, Heterodera glycines
  Coding regions on vcDNA: vcDNA=SeqID_76147; Strand=-; Position=1 -244,294-437,1508-1658,1761-1980
MPSGSAIWQIGLYKKSNNNEFEYECAECSKNIKCKQGNTSNAINHLKSKHKNSEYEAKYEDLLKQKRGEKGTIETHLVLGSEGLSSFDKKVIHWIACTQSSFSDINNPTTIALFMGNNPLHKLKDESIYRKNHFSHSPSSGGAPCAIDDLKEMELSLSGISSTIIQQYCKAILNCYFHYDEVVRVNSAQVIRQTLEQGLVNAWHLGAHTDRHIHRPVDQHSGTGRSNALPRFLGLSAGLARQATYTTTRLGI

SEQ ID NO: 149725 - protein, 50 aa, Heterodera glycines
  Coding regions on vcDNA: vcDNA=SeqID_76148; Strand=-; Position=1 -15,56-193
MCNNLVGRYAHLGTPEKVVEKLVKHVTLLNALHDRGVENNQENGNKYPNF

SEQ ID NO: 149726 - protein, 16 aa, Heterodera glycines
  Coding regions on vcDNA: vcDNA=SeqID_76149; Strand=+; Position=1 -47,203-206
MAWTWLDQEKSKPGSR

SEQ ID NO: 149727 - protein, 264 aa, Heterodera glycines
  Coding regions on vcDNA: vcDNA=SeqID_76150; Strand=-; Position=1 -4,475-774,838-1290,1662-1699
MAAPQPNTDAETPQPSEDEPPTSEAPARDNDGRPPSTPTPMTPQEMDVPSVEMVDTDVQIPSTPADEDQQIQPMPSTSTARCDLMSTPSTSKCAGAFGLDDVHMFDELRRRHVWTEEELQRQRRSNAFLRKQLKAQRDRSTSLERSASACRQRKALSDVTNNQQGDNRLSAANDLLITLDAGISFKAREALKRSFAGQGHDVWAPTRAVKRLKAELCEAVNFHWTGNGETRALVSVDVRAMIEGRLQDLVNSGFSVQTSNSLRH

SEQ ID NO: 149728 - protein, 89 aa, Heterodera glycines
  Coding regions on vcDNA: vcDNA=SeqID_76151; Strand=+; Position=1 -57,487-699
MEKGRRSFPSPEPLGNFPGDIKSSSDMNNNSNSSSSVNAFGESDQIYVYTVWVTIIQQILSLFGIALNSALVYITIKHKSVTRIVLALF

SEQ ID NO: 149729 - protein, 43 aa, Heterodera glycines
  Coding regions on vcDNA: vcDNA=SeqID_76152; Strand=+; Position=1 -96,147-182
MKLGNSTEVSAFCWPSVLFVMHSLNWPLHWLPFSFFFVCGFLC

SEQ ID NO: 149730 - protein, 129 aa, Heterodera glycines
  Coding regions on vcDNA: vcDNA=SeqID_76153; Strand=+; Position=1 -124,182-447
MVYCEPGDMIQGEVFLVASLIMVIFTLATIVIYIIMGIMLKVIRSDQNNSNNSSQSQIEITRRIFKSLAVIMAVIFCFWFLFALITNILARGLITIEPSLQFLIIRLAAQMVTIAGAINAPILYICRQI

SEQ ID NO: 149731 - protein, 166 aa, Heterodera glycines
  Coding regions on vcDNA: vcDNA=SeqID_76154; Strand=+; Position=1 -100,196-451,695-839
MIQGEVYLLVTLIVVIFTLATTVIYIIMAIMLKVIRSDQNNSNNSSQSHIEITRRIFKSLAVIMAVTFCLWFLFALITNILARGLITSDPSLQFLIIRLVMQLTTIAGAINAPVLYFCSSEYHEIMKNEFPLAKFLLCSNNHNSPVVVVAVGQQILGSPNIQANAS

SEQ ID NO: 149732 - protein, 426 aa, Heterodera glycines
  Coding regions on vcDNA: vcDNA=SeqID_76155; Strand=-; Position=1 -186,233-760,1141-1397,1492-1663,1711-1845
  Homolog annotation: Hit_ID=CAE73465.1; Match level="QueryCoverage =51%, HitCoverage=29%, E-value=6e-10, Identity=25%"; Hit description =Hypothetical protein CBG20916 [Caenorhabditis briggsae]
VSPRAPTRFETGIRLFSTVPASKVVDFFIALLRHARIADSREDEPTTAYFGDGLGAEHVLVQSFFVWLENTEKRNRKGLPSSTTATPNAPATTAASPSSTAAAAKVRLATSDCDGFRPSQRTPTPPRKGGGRAKQQRHRAVTEEQQHQTQLRWEKGTMVDQQQQTEFANNDEDGKQHKRNEQQQSTHLEAMSDKLRKILCENEQQHDEDGQKQGDEQTQLQKQIEDDTGANDAGNGEEGTVHTAAAAGNSITTLSPQLPCLNRVLITSFHRDQLVTLLAPLSFPPRTHSNIWKTVVSVLELKHAKYLTTFVTIVKEMVHQGQIGFDLLNFCLQHFADKMHFNVHHLVHALLLGPLCAATVEQFAANQSDDFRAQSRALLLEAESWKYDENKWRAASLAYAHRTHEQLPDFKVFCYNVNTLMNELNM

SEQ ID NO: 149733 - protein, 91 aa, Heterodera glycines
  Coding regions on vcDNA: vcDNA=SeqID_76156; Strand=-; Position=1 -109,266-324,385-492
  Homolog annotation: Hit_ID=CAE71635.1; Match level="QueryCoverage =100%, HitCoverage=100%, E-value=7e-41, Identity=86%"; Hit description=Hypothetical protein CBG18602 [Caenorhabditis briggsae]
MTASTAVNPSTLLPLELIDKCVGSKIWVIMKNEKEIVGTLVGFDDYVNMVMEDVVEYERTPEGKRVTKLDTILLNGNHITMLVPGGEGPEI

SEQ ID NO: 149734 - protein, 166 aa, Heterodera glycines
  Coding regions on vcDNA: vcDNA=SeqID_76157; Strand=+; Position=1 -49,129-580
  Homolog annotation: Hit_ID=DAA01153.1; Match level="QueryCoverage =65%, HitCoverage=6%, E-value=9e-09, Identity=32%"; Hit description =TPA: RTl1 [Mus musculus] ref|NP_908998.1| retrotransposon-like 1 [Mus musculus]
MRYPDTGDEEAENAAQEDLLISKKKKSKEDQEQQQQQKGGNAWLKSHDPDLPASLSEVENSSSSVIGARRKAEDDTAESGEMGESGQQEEKKQSSRGEESGKKREGGRRKKTKSTTTEEEESEEEEEEEESATPFRPRPSTIIGFRTIQPMGTGQCPEQTVLAPTY

SEQ ID NO: 149735 - protein, 151 aa, Heterodera glycines
  Coding regions on vcDNA: vcDNA=SeqID_76158; Strand=+; Position=1 -206,500-604,939-1083
MAPHATTTPHADAPSPAPPPDPAASPPQPQRFETAAAYIRRKNRERRTRNLTVAVTELCPVRQDEWTTRFPSVDQPDYQPTSPGGGGLANRRKGSVGGQSEEGRITSIDESLSTKCRRPRATSRRTTGTQLPAVISTHWSATRTCQTTSGN

SEQ ID NO: 149736 - protein, 153 aa, Heterodera glycines
  Coding regions on vcDNA: vcDNA=SeqID_76159; Strand=-; Position=1 -72,142-330,1241-1438
MIGVRALPELRFSRNRVLRPDAQKGDWRRDAGRAEYLKTEELANWLVLCARNRFDTAQQFVERLGRMGNEKGIPIAEPEIVAFNSPDIGYDVNHPGMCYIIFSKELIEILYDHVFLTNHLFFPYVAPMPQQTRRLLASQGESQLSSLDPSCVG

SEQ ID NO: 149737 - protein, 40 aa, Heterodera glycines
  Coding regions on vcDNA: vcDNA=SeqID_76160; Strand=-; Position=1-120
DSARRERSSPDSGGGDYYPPEQQQRGGPPPMRAERGNIGE

SEQ ID NO: 149738 - protein, 83 aa, Heterodera glycines
  Coding regions on vcDNA: vcDNA=SeqID_76161; Strand=-; Position=1 -160,368-460
EVFHGDNPLSEPECANLAGFMHQHLPQIDAYLTLHSYSNVLMHGCNHSLITEWQRVGNEMAIAIEKAGGEHFKVGCGDEILCA

SEQ ID NO: 149739 - protein, 42 aa, Heterodera glycines
  Coding regions on vcDNA: vcDNA=SeqID_76162; Strand=-; Position=1 -61,240-307
MPRPGVVCVPGKGHKQIGQTNCQKVAGIARPSRAYEGVQSLK

SEQ ID NO: 149740 - protein, 79 aa, Heterodera glycines
  Coding regions on vcDNA: vcDNA=SeqID_76163; Strand=+; Position=1-658
FVLNYLFGQFVYALFRVHKLLPVAASEEKTKKYIQLLIKLINYAHKISSPCAHSRQGLQMESHKYQVGRELNVILSVAS

SEQ ID NO: 149741 - protein, 35 aa, Heterodera glycines
  Coding regions on vcDNA: vcDNA=SeqID_76164; Strand=+; Position=1 -89,344-362
MTTEQLLKGVKMGIELKFGWRGVPSRQMMRAEINF

SEQ ID NO: 149742 - protein, 189 aa, Heterodera glycines
  Coding regions on vcDNA: vcDNA=SeqID_76165; Strand=-; Position=1 -133,970-1070,1147-1203,1886-1971,2059-2104,2292-2400
  Homolog annotation: Hit_ID=CAA46108.1; Match level="QueryCoverage =97%, HitCoverage=97%, E-value=2e-44, Identity=51%"; Hit description =unc-4 [Caenorhabditis elegans] prf||1806384A homeo domain protein
SSDESIVNGPNTSSASMSESNGTADGGTALSPPPQLPRFDEDTQPSDTTTKRRRTRTNFTNWQLNELESAFECSHYPDVYVREALVYVREALAIRLDLLESRVQNRRAKWRKKEHCGHGLAADEQKQQQERVAEGGKTKTMPFSVEALLAASRVPRGRRPNAKYPRVQACKGIAPFMFPAFPITQPVGQ

SEQ ID NO: 149743 - protein, 226 aa, Heterodera glycines
  Coding regions on vcDNA: vcDNA=SeqID_76166; Strand=+; Position=1 -328,849-1070,1392-1522
MQGTGAGAACGVPLPGINVHAAWYNNLAKKQSCGNGGGGHGRNVGIYVNGRKVGAGAGGAIGSSIDARRRQSVAQIGTTGTAPTLNDHLQPHQRHGGGRRAISTVNPPAAFPIAIVRESSRCVGVAQFRRHQTESQPLKQQPQIHQNSTETDETVAEECVVDRMPPQQQISTEDSFDTNSSSNENCRICPEEADRKRSGQSIASRMSVWSLRIFSGQWRVSSFFYL

SEQ ID NO: 149744 - protein, 97 aa, Heterodera glycines
  Coding regions on vcDNA: vcDNA=SeqID_76167; Strand=-; Position=1 -134,647-806
  Homolog annotation: Hit_ID=NP_503114.1; Match level="QueryCoverage =87%, HitCoverage=29%, E-value=4e-22, Identity=62%"; Hit description =fatty acid ELOngation (elo-2) [Caenorhabditis elegans] emb|CAB02921.1| Hypothetical protein F11E6.5 [Caen
MKIRSPRIVAKFITSIQILQFVISVYIFTHIVYIKFTDVLPCDASWNVLSLGGLMYLSYLYLFAQFFYDSYISGKMKKRSLATTSSSNAMTEAKKIE

SEQ ID NO: 149745 - protein, 34 aa, Heterodera glycines
  Coding regions on vcDNA: vcDNA=SeqID_76168; Strand=+; Position=1-103
MHSQIHDSVHAEVQCQGPTAPRLFLRIGYGGVEE

SEQ ID NO: 149746 - protein, 148 aa, Heterodera glycines
  Coding regions on vcDNA: vcDNA=SeqID_76169; Strand=+; Position=1 -372,423-494
EDSDELRSAQSSRASTSRQQSQRKETAEKHSQEKQPRGHNEREEHQFPAPPPHFAHPFQFVFTNRQSANTFSLSSGAKVDELSTPEEESVVDEEGIKEGETTGPPKVPPLKLEELSPEGKSPSETDTYNSSLNMDTVLIREEEEELKK

SEQ ID NO: 149747 - protein, 46 aa, Heterodera glycines
  Coding regions on vcDNA: vcDNA=SeqID_76170; Strand=-; Position=1-170
KVFKNIKDAMIDCCCYCSLLPFRMENLCSPLFKHSNVWRQRSLTID

SEQ ID NO: 149748 - protein, 30 aa, Heterodera glycines; identical to SEQ ID NO: 141344
  Coding regions on vcDNA: vcDNA=SeqID_76171; Strand=-; Position=1 -12,103-183

SEQ ID NO: 149749 - protein, 99 aa, Heterodera glycines
  Coding regions on vcDNA: vcDNA=SeqID_76172; Strand=+; Position=1 -139,198-254,463-559
  Homolog annotation: Hit_ID=CAE66724.1; Match level="QueryCoverage =97%, HitCoverage=31%, E-value=2e-25, Identity=44%"; Hit description =Hypothetical protein CBG12070 [Caenorhabditis briggsae]
RATALFLVHEANESDAGAYRCVAKNAHGSTNSACQVSVKAFKEEVKKKEGAEPSFTRGLVDQYIERGDTLVFICAVSGDPAPEIKWFCNGKLLKPSDRS

SEQ ID NO: 149750 - protein, 205 aa, Heterodera glycines
  Coding regions on vcDNA: vcDNA=SeqID_76173; Strand=+; Position=1 -126,187-552,950-1072
  Homolog annotation: Hit_ID=NP_491290.2; Match level="QueryCoverage =100%, HitCoverage=33%, E-value=2e-42, Identity=34%"; Hit description= UNCoordinated locomotion UNC-89, PHarynx Muscle abnormal PHM-1, UNC -89 (unc-89) [Caenorhabditis elegans]
MPELVWYKDGEQVRPSERVQLERDADGTAYLIIPKCTMDDDGVYRVIATNPHGTAYDKCTVTVKKAAAEEGPTKHEGAKEFEAAKAPKLLEPLQNVKCPEGTEFVLRCRFSGEPTPTVKWWAKREGEAVKGLLIMLFPFLQVQGRRPTVSLRANANCGNVAGWLVQVQREKKPKEDLKELAKEFGRAPGFTIPLTVKHAKPGDTV

SEQ ID NO: 149751 - protein, 68 aa, Heterodera glycines
  Coding regions on vcDNA: vcDNA=SeqID_76174; Strand=-; Position=1-205
MMKNVIDEQKKSSNIKNNETQEIKMLLSLRKGFDPNRYNVQQTNEVAAIIVCNANEEIPAANIIVVEK

SEQ ID NO: 149752 - protein, 118 aa, Heterodera glycines
  Coding regions on vcDNA: vcDNA=SeqID_76175; Strand=-; Position=1 -84,314-492,851-944
  Homolog annotation: Hit_ID=NP_991199.1; Match level="QueryCoverage =88%, HitCoverage=44%, E-value=4e-18, Identity=45%"; Hit description =hypothetical protein zgc:77312 [Danio rerio] gb|AAH65338.1| Hypothetical protein zgc:77312 [Danio rerio]
MAEMEAQPNVSPKQKYRDLKKKFKYLVYENEYYQEELRNLQRKLLKLSRDKNFLLDRLGQYEQLSESSDDSDASTKTLEERGVTKQKSFWRRDSKEMMRNAIEPIRFASEGGNGPIRK

SEQ ID NO: 149753 - protein, 185 aa, Heterodera glycines
  Coding regions on vcDNA: vcDNA=SeqID_76176; Strand=-; Position=1 -518,1614-1653
  Homolog annotation: Hit_ID=AAS52858.1; Match level="QueryCoverage =86%, HitCoverage=20%, E-value=8e-11, Identity=31%"; Hit description =AER177Wp [Ashbya gossypii ATCC 10895] ref|NP_985034.1| AER177Wp [Eremothecium gossypii]
MMQQQSTQAQHSNPSQHLRNTPQSPAATAPPTSSQSQHFQQRPHVAYHQPPQQHYPLQQETNQSQHIRPQPGVRPAHPQQHPTEQQYPSMAGPLFQSQPSSVQALQEHEIGNVGQPRLAQHGHTHISHQQQVMMGQRHATHHPSQQQTLISQQQSQHPQQQHPTTAIRIEQSGKCSETHQILFTC

SEQ ID NO: 149754 - protein, 103 aa, Heterodera glycines
  Coding regions on vcDNA: vcDNA=SeqID_76177; Strand=-; Position=1 -124,687-756,1713-1832
VHRVPMPLLHATASRTDLAIPFPIPRHYESAGPSETPCGQKAGVRIWPTAYVNGHFFDRSYPMECASNGICGGGGCCGPACQPAPVACNPASCQPGYTCGTVQ

SEQ ID NO: 149755 - protein, 132 aa, Heterodera glycines
  Coding regions on vcDNA: vcDNA=SeqID_76178; Strand=-; Position=1 -118,284-427,625-759
  Homolog annotation: Hit_ID=NP_506709.1; Match level="QueryCoverage =38%, HitCoverage=18%, E-value=2e-10, Identity=51%"; Hit description =ubiquitin-specific protease otubain (32.3 kD) (5P547C) [Caenorhabditis elegans] emb|CAB02772.1| Hypotheti
MAKRQISLLKIEEIYEQMGNVYHAVNLNELEWVNQFFEKGVSIRIEYMDRSQAPSGGWHHDFLVEGDNQPKLFFLYRPGHYDILYRRGSSNIRSKLIIYGVQPRRHEGLLEFHEKPGGPGKVPDSDFWNPRP

SEQ ID NO: 149756 - protein, 36 aa, Heterodera glycines
  Coding regions on vcDNA: vcDNA=SeqID_76179; Strand=+; Position=1-118
QIKSNHNSILHISHIYYDSVISSTVQLTLLLEKNKF

SEQ ID NO: 149757 - protein, 182 aa, Heterodera glycines
  Coding regions on vcDNA: vcDNA=SeqID_76180; Strand=+; Position=1 -78,377-484,1078-1215,1311-1386,1592-1740
  Homolog annotation: Hit_ID=CAE72546.1; Match level="QueryCoverage =95%, HitCoverage=16%, E-value=3e-37, Identity=57%"; Hit description =Hypothetical protein CBG19730 [Caenorhabditis briggsae]
MSNLTFLNDASVLHNLRARYGAMLIYFAVSDEAYRNMLQNAENQSMLITGESGAGKTENTKKIQSGFLPDLKKQLLLDLPAKDYWFIAQAELTIDGVNDTEEHQLTHEAFKVLNFTDSETQDVYRLVAGIMHMEAEKTARMYGANPEEFMKALLKPRVKVGTEWVSKGQNQEQARQPNGIGI

SEQ ID NO: 149758 - protein, 300 aa, Heterodera glycines
  Coding regions on vcDNA: vcDNA=SeqID_76181; Strand=-; Position=1 -94,149-259,307-1004
MGKTKNFYSSQKKIKKIKFKIFVTYFEPIKFVLYILFTFIINNASAKCTSTEGLKNYGINAIENNGGKKMIASFSEQTMDWALAKGCEMAEKLWEKAKLGTKTANECVGEEMGQKMMEMCAGGTSKAKEIAQNWGKSALIATGQCVLAQMQTEEEQIQEEQNAEGMAKLAEFDASFKECAKALAPEQKAKSGIDKLLEAKANQQLKPSDLVQMLLDEAIFEHEIFQKFAESFNGGKQKNFVHRRRKRKNRGKAKKEFGYDTYIKLIFFLAITGQISTLAFLLLLFLLPDPVVVPTKAKEN

SEQ ID NO: 149759 - protein, 75 aa, Heterodera glycines
  Coding regions on vcDNA: vcDNA=SeqID_76182; Strand=+; Position=1-285
QLHFFTKNDQILAVLRQKTCKNSGNVGPAVPIGAAGKNFWKFECYLLRNLPIKLFNFRLGGGEFEKNFHYLLENF

SEQ ID NO: 149760 - protein, 120 aa, Heterodera glycines
  Coding regions on vcDNA: vcDNA=SeqID_76183; Strand=-; Position=1 -70,225-287,437-463,515-627,684-732
  Homolog annotation: Hit_ID=CAG32412.1; Match level="QueryCoverage =98%, HitCoverage=30%, E-value=2e-38, Identity=67%"; Hit description =hypothetical protein [Gallus gallus]
NKKVESMTWVIEDKRCVYLTLEKINQMHWWNKLIEGDPEIDTQKVQPENSKLSDLDGEDLDGETRSMVEKMMYDQRQKELGLPTSEEKKKQDILKKFMEQHPEMFMEQHPEMDFSKAKFS

SEQ ID NO: 149761 - protein, 66 aa, Heterodera glycines
  Coding regions on vcDNA: vcDNA=SeqID_76184; Strand=+; Position=1 -103,968-1065
MPSARRRTAIRICGQYAALLMRTPMDDQRTGGGAGNYFGFFGLKNPSPTHLQLQSVNKNYFCSIFG

SEQ ID NO: 149762 - protein, 297 aa, Heterodera glycines
  misc_feature (273)..(273): Xaa can be any naturally occurring amino acid
  Coding regions on vcDNA: vcDNA=SeqID_76185; Strand=-; Position=1 -268,651-790,1027-1157,1237-1333,1420-1638
  Homolog annotation: Hit_ID=CAE74364.1; Match level="QueryCoverage =84%, HitCoverage=59%, E-value=1e-83, Identity=65%"; Hit description =Hypothetical protein CBG22088 [Caenorhabditis briggsae]
LTKCQTRRFSSSASPTIAERSVRRATAPVHSVQPTMAPQIEHQQQQQPFVLLPDRPAIRLDSRLVCKYEVLSVVGKGSFSQVLRVQDRISKRFYAVKLVSTEQDFGAVNNELSILSRVQHPFVIRLEEVFRSATKLFIVMEMASGGEMYDRVVAKGRYSESEARMAIKMLLTGLEYLHSMHITHRDLMHITHRDLKPENLLYSDTRQEARLLITDFGLAHQSRSPDHQSRSPDEKMTDTCGTPEYIAPEILLRVPYSNRVDLWAVGVIGQFIXSRIVDIDHHFYHQSNCHFFDLIIY

SEQ ID NO: 149763 - protein, 54 aa, Heterodera glycines
  Coding regions on vcDNA: vcDNA=SeqID_76186; Strand=+; Position=1-221
FSKRIFNFRIRKIIIKKFRIEKIKPAQKVWDQKDLNLQKKKLNFLHLSLLVTGG

SEQ ID NO: 149764 - protein, 182 aa, Heterodera glycines
  Coding regions on vcDNA: vcDNA=SeqID_76187; Strand=+; Position=1 -71,495-702,745-1011
MPSGEGPRNVHKFDFGFKEHQRIGITNADKFCLFYALVASKFYLEVHRNIFNRFMNNIMRQRDAAIELLHNCGIDINEYSYGVEQLPNVQKYWDEIYPGKYRVVAFEKSADPRKSIRVLWKGPMGRENVVPLFLENGHWDGLKNFVCFFNRGRKFCIDCECFYDKDVKHAMECRARCYYCNK

SEQ ID NO: 149765 - protein, 35 aa, Heterodera glycines
  Coding regions on vcDNA: vcDNA=SeqID_76188; Strand=+; Position=1-110
DHFLKKKMPGRSTGKADKSTDERMIFVDITLFIGA

SEQ ID NO: 149766 - protein, 262 aa, Heterodera glycines
  Coding regions on vcDNA: vcDNA=SeqID_76189; Strand=+; Position=1 -98,1104-1520,1675-1948
IQEFYDNTLLNERVPLDMKTTETRKLAERWEQTKDGWHTQEYRTQTVDGPSGFQTETVTNNGLIDDQGKAWEVEDVVLEKNQLGLVSLHLSTMSTVLASFCRVSPFLAAMTTVPALISVSLTLRLGYFPFPIASANSAYALKGGVARDGRIRIGDVILKVNNTDTVDVPHQLIKRPKTSQASAFRPSSAEPLSRGSPPEGFGFGPPPPVPTHQQSFGESEAVKELEQMPGVRRMDLIKVESDGIHKGLGFSIAGGTGNQHYP

SEQ ID NO: 149767 - protein, 21 aa, Heterodera glycines
  Coding regions on vcDNA: vcDNA=SeqID_76190; Strand=-; Position=1 -41,401-425
MPCRKPKLHFILSFIIWLYFI

SEQ ID NO: 149768 - protein, 204 aa, Heterodera glycines
  Coding regions on vcDNA: vcDNA=SeqID_76191; Strand=-; Position=1 -501,828-938
MVIENQSYGNKSIYFISSYIDHSVIAFLRSNHQIFDKRGTNLYLWIPSSHSTNGQPILDIFGREIWPIFSANIRHLGFPHGDHLDNLRSLISPTILTDLNQLISIYSGDLSPAAFGDDFDGPNSTISAGKILSKWLHSPRKDGQPKRLHCEDIKEQTNTDWINNFKEKSEFSAIPGVAIIRPKRLRCVDYNKQTDLDWVNNFKE

SEQ ID NO: 149769 - protein, 116 aa, Heterodera glycines
  Coding regions on vcDNA: vcDNA=SeqID_76192; Strand=+; Position=1 -54,335-631
MCASGNPSVKQSVGYGQSAKSKHSTGSTAGGGLSVPAPNNRKKTPNQQQQQKGNSEGGGEGRENGGKREEKGGEKGAAAEAEEKEKKIAAEHHQKQQQQKQEVQAVQQQQQKQILV

SEQ ID NO: 149770 - protein, 48 aa, Heterodera glycines
  Coding regions on vcDNA: vcDNA=SeqID_76193; Strand=-; Position=1 -11,73-208
MNRRWICNDVWMDIFPSFDRPQLGLKLALLSPRFKCGWWTNISMAKAN

SEQ ID NO: 149771 - protein, 85 aa, Heterodera glycines
  Coding regions on vcDNA: vcDNA=SeqID_76194; Strand=+; Position=1 -171,268-354
MAKAENRKLKNGIEKMQEKFDKKEEQLEKNLEELQKKLVEMDHQQKEQQKSIDQMEKTNADAEKENDDNMKNKKSLRKMSWHKLM

SEQ ID NO: 149772 - protein, 102 aa, Heterodera glycines
  Coding regions on vcDNA: vcDNA=SeqID_76195; Strand=-; Position=1-410
  Homolog annotation: Hit_ID=AAQ23180.1; Match level="QueryCoverage =56%, HitCoverage=10%, E-value=3e-21, Identity=79%"; Hit description =forkhead transcription factor 1 isoform b [Strongyloides stercoralis] gb|AAQ23178.1| forkhead transcriptio
MALIRPKPKRVRRRTADGGTAPTGVTDDGAVGSGGQAAQQHSHKKPNPWGEESYSDLIARALGCAIDGRLKLSEIYQWFSDNIPYFAHRSSQEDAQGWKVKA

SEQ ID NO: 149773 - protein, 378 aa, Heterodera glycines
  Coding regions on vcDNA: vcDNA=SeqID_76196; Strand=+; Position=1 -433,591-789,1521-1673,1967-2140,2609-2739,2860-2911
  Homolog annotation: Hit_ID=NP_492815.2; Match level="QueryCoverage =98%, HitCoverage=71%, E-value=5e-84, Identity=46%"; Hit description =abnormal DAuer Formation DAF-16, fork head-related transcription factor (57.9 kD) (daf-16) [Caenorhabditi
EDEDDADSFPGELEPRGRCYTWPVPQFGAVSTAQQSPLSSLHPPPPNHHHLHHHHLFSGAPNSATTSATSSKSSLSSIIGCGGAGTACSSSSCSLLTGVEQQQPCTSSSHHSPFSALSIGSTTTASASFSSSTTVVVAVLLRCGGQAAQQHSHKKPNPWGEESYSDLIARALGCAIDGRLKLSEIYQWFSDNIPYFAHRSSQEDAQGWKNSIRHNLSLHSRFMRIQNEGAGKSSWWVINPDAKPGRNPRRRANTMEAATKAVIDKKRRGARKRVETRPTEGQQRRLFRLHGLHSQRSVGRHVPLGQRRAQRATATATSEYRPRAESTLSVVGGPASCSLSPPNESSMEFPLWMDQLQQQQVSELLDRTDQMRLEATTR

SEQ ID NO: 149774 - protein, 119 aa, Heterodera glycines
  Coding regions on vcDNA: vcDNA=SeqID_76197; Strand=-; Position=1 -12,367-608,987-1092
MNSMVLDNKIGEGEEVPNLNVIREDDPVNEFLGFLHYDQKLGHHIAKAYNETVFCAAKNQIAKRVVDQILQLTFSLAIRIMLCVIIFPFQIIRIDAQTKEHFWDEIKANSAREPQFIGG

SEQ ID NO: 149775 - protein, 24 aa, Heterodera glycines
  Coding regions on vcDNA: vcDNA=SeqID_76198; Strand=+; Position=1-75
SKSSLTTAQKNMVFVRFRPRGAQE

SEQ ID NO: 149776 - protein, 287 aa, Heterodera glycines
  Coding regions on vcDNA: vcDNA=SeqID_76199; Strand=-; Position=1 -66,159-287,382-551,745-863,924-945,1015-1320,1454-1505
  Homolog annotation: Hit_ID=CAE62262.1; Match level="QueryCoverage =91%, HitCoverage=71%, E-value=4e-83, Identity=54%"; Hit description =Hypothetical protein CBG06321 [Caenorhabditis briggsae]
MPFQKPRGVKEDPNQTPPNFIRPLRDKRALIGQNIVLECQIEAHPDPVVKWLKDGHNVSQCPDYKMEEEGKTYRLLIRKAQAADCGRFTVQAMNAAGIKQSTCMLIVAQAPTPVPGGMTSITSSPAPPQTPVGPSAPLFLKELKHQPMKPSEAAVLEARVVGVPLPQIDNTHSFLSRIKTEYDARSGICVLTVPQLFTEDLGEYTCRATNATGKAESRAHIMPQEQYDRWFADEKRMVTRERKQRLVAAQRAKTQPQQQQSQYQPQQQQYRVIKDKRKGLRRGGTAD

SEQ ID NO: 149777 - protein, 52 aa, Heterodera glycines
  Coding regions on vcDNA: vcDNA=SeqID_76200; Strand=-; Position=1 -66,1585-1677
MYLDFTNFSHYVLGNWHPCTWKKLRTRVEEIQFVFDNFSFISVQNKVVKIAV

SEQ ID NO: 149778 - protein, 235 aa, Heterodera glycines
  Coding regions on vcDNA: vcDNA=SeqID_76201; Strand=+; Position=1 -191,512-755,798-1065,1202-1206
MSDFEIGMLKAMRHVFPSCERSGCSFHMAQAVFRKARSMGIFNLLNEDDDEAPVQRKSVHKTFSISQASIMTGSGPIQFGLHSPQPSTPTIPLSEESSLQLIPRWEQDIVCPPRFPISFWNVYTRAQMAIERTNNGMEAAHGQFACELNHHPSLSDFIAAIIKDIDKQLDIGRAERLQKSTKRRQRYIIKEQNVVRILDEADFESEEGLTNALYLIGLVMQGFVEGLHVRGNEDS

SEQ ID NO: 149779 - protein, 114 aa, Heterodera glycines
  Coding regions on vcDNA: vcDNA=SeqID_76202; Strand=-; Position=1 -83,168-236,296-488
MSTNECFVDLSRRIISHLISKGSDQKFCNWHCGGAATVAEVAKTVLNEEHRLFLSGIRRGLLTFLHSQRQLFVLSNGTLSLRFWHSDYQRFEKEIGREKLRTFQCLFHQNHPDG

SEQ ID NO: 149780 - protein, 22 aa, Heterodera glycines
  Coding regions on vcDNA: vcDNA=SeqID_76203; Strand=+; Position=1-101
VEVTKVRMSDDQKGRVISVRNK

SEQ ID NO: 149781 - protein, 31 aa, Heterodera glycines
  Coding regions on vcDNA: vcDNA=SeqID_76204; Strand=+; Position=1-95
MHSAGGVQSGRKGKCICWDETFKKRTNDSFA

SEQ ID NO: 149782 - protein, 331 aa, Heterodera glycines
  Coding regions on vcDNA: vcDNA=SeqID_76205; Strand=-; Position=1 -212,334-544,613-813,1060-1181,1259-1508
MAYSLSLQPWPSSASASSVLSVFVFVLLFARCCSQSADASSSSFSLRGFACAKKDAAVHGGTFTVVGEKRLRVDPSQLTTNEGNAKIDALRLDDAADKRLVMSVLFPNGGGINCKTSFLSRVQMPTGCAVDERAVALEGRAGQDRFGENCGQGKCAFLNVTCNLLQMTPVDGLPNARHFTMSLWKNISDDDDDLVQCGWKAFIVRVISDDVVVLLNKAESGPELLVEQCWQKGGGILNLKDLLFYGLLGGGLLILATVLTIVIVLVVRRQRKSASHTVAGDDDIIDDKREKKKMERPAAATRIVVHSCRMGQPAAGGNLSQMSHEGDSDTI

SEQ ID NO: 149783 - protein, 312 aa, Heterodera glycines
  Coding regions on vcDNA: vcDNA=SeqID_76206; Strand=-; Position=1 -182,484-631,885-1145,1658-1921,1977-2059
QDSDFDDVNEIMVTLTKEERNEIKANHKIYDTELAKNKKKYEQVDGKKNKEDAPGLCTDLRKRESKLKGASKYAIVIINLCETNREQTFAPFSKKGKKEAALYTPATIKKDADLLKAFIKDASNNFDDVWTRNNEFINDMDGKDRVVRMLTEDNYERLRCVLVYYNHQHGNVIDDLDRTITEEIKKKKIPADALALLRLARLVFIDALYGRPFLLALLLHEKLERLYWSASEQWPKGQKTPNDKVNELSDAFNDASRLFILHAPVQLWEISKVYSDAIKKFKKSEVKLVDRLMEIKMVFEKKKKIDEAFVIS

SEQ ID NO: 149784 - protein, 186 aa, Heterodera glycines
  Coding regions on vcDNA: vcDNA=SeqID_76207; Strand=-; Position=1-559
MDNHRRKRFTNFSIDHILSEPKKPRQGFLINEHGIVHFHDSVQQAEGASKVAKDYVKKLEKNIEHMAKFHYVKVKSKFIITDLPSTPEAMWTWTFKHYIEEAFADSRERNIEPTHLGCMISSPLLKGGDISTPIQQMTNNTLDSILYQYKKVTQNNQLKDVTLWREPFTITITTVDRNGLGLSKKK

SEQ ID NO: 149785 - protein, 208 aa, Heterodera glycines
  Coding regions on vcDNA: vcDNA=SeqID_76208; Strand=+; Position=1 -150,252-446,493-725,999-1047
MKRPNPLNLPTSEKKPKLRRLLPAELNNEQISFVPLVCLFANVKRTPIGPKGVIAVFDVMFEEKRTPKKKKVWRLHLQEELPHELSRNELLHYLSYGRLGTNLFETYFVMSQATNSIAIGNLFGLLLDFAMSSPTPWLMKRPICCGIFFRQHLPWILQQPMNVMLSHGFFPEVRSDGFEFFWLFNPHLKKYAGNDDTMTDGIFWAKLS

SEQ ID NO: 149786 - protein, 105 aa, Heterodera glycines
  Coding regions on vcDNA: vcDNA=SeqID_76209; Strand=+; Position=1 -18,65-364
MSQATNSIAIGNLFGLLLDFAMSSPTPWLMKRPICCGIFFRQHLPWILQQPMNVMLSHDIFPEVRGDGFEFFWLFNPHLKKYAGYVRILPELSQPDNLHFFFSIF

SEQ ID NO: 149787 - protein, 52 aa, Heterodera glycines
  Coding regions on vcDNA: vcDNA=SeqID_76210; Strand=-; Position=1 -33,167-292
MEMTRDGTKLKMSACDVDNVYQHWTFKEYNEAKAREYAMIRGGGTDKNGGGL

SEQ ID NO: 149788 - protein, 93 aa, Heterodera glycines
  Coding regions on vcDNA: vcDNA=SeqID_76211; Strand=-; Position=1-279
MLKTVVGIVRETLDSEWAEIDEMAPAPKNEKSPEGEGKEWHDDAANRCWHITKDGIEKLKAMKLYELLYEHILEKHFDNSNDTTSNRQLVAQQ

SEQ ID NO: 149789 - protein, 65 aa, Heterodera glycines
  Coding regions on vcDNA: vcDNA=SeqID_76212; Strand=-; Position=1-321
FAKSQKFWLSFKKVMARRNSKTQQFELFFALIFLCINKKFLKICTILAFFQCFRIIPRMINLDEK

SEQ ID NO: 149790 - protein, 165 aa, Heterodera glycines
  Coding regions on vcDNA: vcDNA=SeqID_76213; Strand=-; Position=1 -117,620-808,898-1089
MHLDLKPQNLLYVKKENGEDSVMKAIDFGTAQFIVEEEDSPEHHKLCNWGYMLHNERSMRLSSKTDIWAFGIIAYEMAYFGLNFGPKLEGGEQQKICAVTNNKIEHNKFVAWLWTIFSAERDDVLFGKKVVQRMGTQFIFAKIIQFIRFNSQFQMLINMTRNYMD

SEQ ID NO: 149791 - protein, 76 aa, Heterodera glycines
  Coding regions on vcDNA: vcDNA=SeqID_76214; Strand=+; Position=1-791
ELKFNYFINEFIKKNIFILQSPEHHKLCNWGYMLHNERSMRLSSKTDIWAFGIIAYEMAYFGLNFGPKLEGGEQQK

SEQ ID NO: 149792 - protein, 31 aa, Heterodera glycines
  Coding regions on vcDNA: vcDNA=SeqID_76215; Strand=-; Position=1-246
WHPHKVSKPRNVQKSKNPRNVQNFSKFIKTK

SEQ ID NO: 149793 - protein, 118 aa, Heterodera glycines
  Coding regions on vcDNA: vcDNA=SeqID_76216; Strand=-; Position=1 -183,863-1036
MSKEEIVPKQQKLPMGQCHCGQSNLSEMNEALEMTNLVDNATIKLKLQKEEKPIGEGSFSEHAVLYAIGARPYNKCVALKRTYIDWETSDWQKHVKEWKIQKAFDALPKNERVIKLIA

SEQ ID NO: 149794 - protein, 232 aa, Heterodera glycines
  Coding regions on vcDNA: vcDNA=SeqID_76217; Strand=+; Position=1 -234,475-717,1057-1278
  Homolog annotation: Hit_ID=NP_491851.1; Match level="QueryCoverage =89%, HitCoverage=33%, E-value=7e-24, Identity=32%"; Hit description =predicted CDS, leucine-rich repeat protein (1H0) [Caenorhabditis elegans] gb|AAB54134.1| Hypothetical pro
MDFANCSFGGANVLPRWMPKCRHIGRISIINCGLRSALQLAHIGSAVQIRAKHNQIGDLHRVAFECTRLTELDLSANEFVRKILKKLYWSLKTSNLTKLQLSYLYFMTQIAKIGAHTLARCHFLRFLDLSDNPMGELPDKLFQGCRRLKDLRLDRLGLRSVRAELFLGLNALKSLSLSGNPLSRIDPFTFLPARSIRALRLDNCTLAQMPLAVTQCCLLDRCFFLFCFSRQN

SEQ ID NO: 149795 - protein, 165 aa, Heterodera glycines
  Coding regions on vcDNA: vcDNA=SeqID_76218; Strand=+; Position=1 -147,979-1315,1503-1516
MPAPLLALLPRLSHFSFANNPLLQLPLALFLYEHNRAEEALLEDIVDTLTFCRELREHNGCEATRRLRSVRADGKNAVGIRCDSATPSKATEKEATKNLGFNWHQNNANKKPNVKNQATSVGPSAFAYGPNGTDTVILGSDLLSTNACQTAYSVLPMGGSANIIF

SEQ ID NO: 149796 - protein, 28 aa, Heterodera glycines
  Coding regions on vcDNA: vcDNA=SeqID_76219; Strand=-; Position=1-85
MNNFVSFSTLLLLIGGFMSFGDVDGMYN

SEQ ID NO: 149797 - protein, 81 aa, Heterodera glycines
  Coding regions on vcDNA: vcDNA=SeqID_76220; Strand=+; Position=1 -198,460-507
MDKVLMRWINANCNSSSSKTSDFYSGICVFRQFILVPICPYGRLILVITVRGLGVSLAGIIRQFQPASRKPRGYRMRLKII

SEQ ID NO: 149798 - protein, 40 aa, Heterodera glycines
  Coding regions on vcDNA: vcDNA=SeqID_76221; Strand=-; Position=1-224
RFAPVSNFCCAFRPLRGLERALRARFLNFVGLIRALRARF

SEQ ID NO: 149799 - protein, 282 aa, Heterodera glycines
  Coding regions on vcDNA: vcDNA=SeqID_76222; Strand=-; Position=1 -216,608-1242
  Homolog annotation: Hit_ID=XP_311331.1; Match level="QueryCoverage =91%, HitCoverage=99%, E-value=1e-36, Identity=37%"; Hit description =ENSANGP00000001657 [Anopheles gambiae]
SSFNQYCTSSNHFCIFYHFCTSLNHICTSSNHCSSSFNHCCASFNHYCTSFNHSCTSFNHSCTSFNHCCTSSTSSNHRCTSSDQCCTSSNHFCTSSNRCCTSSNHCCTTSNHCCTSSNHSSNRCCTSSNRCCTSSNHSSNRCCTSSNRCCTSSNHCCTTSNHCCTSSNHSSNRCCTSSNRCCTSSNRCCTSSNRCCSSNHCCTSSNHSSNRCCTSSNRCCTSSNHCCTSSNHSSSCCTSKFKKRARSARMSSTNLKNGREAPVQGQQKLKNRAKRSTEAVKR

SEQ ID NO: 149800 - protein, 50 aa, Heterodera glycines
  Coding regions on vcDNA: vcDNA=SeqID_76223; Strand=+; Position=1 -123,287-316
LITFVPLLITSCTSSNHCSSSFNQYCTSSNHFCIFYHFCTSLNHICTSSN

SEQ ID NO: 149801 - protein, 95 aa, Heterodera glycines
  Coding regions on vcDNA: vcDNA=SeqID_76224; Strand=-; Position=1 -129,205-363
MECVEVQILLFGKAREMAECQEIRQILPKSLTSTELYNHIFDKIFPALMPIRNSCILAVNHRYCFEGRDALGGTENRIELEENSEIAIIPPISGG

SEQ ID NO: 149802 - protein, 108 aa, Heterodera glycines
  Coding regions on vcDNA: vcDNA=SeqID_76225; Strand=+; Position=1 -205,516-637
MALLGGSPPHCRDHWTKESPSPSVKGQGEPEGPVFRGRRNVMPEGTECGRKWDKGPERTSKGGARSSVDGVPKKKPNLIAFEVQMRIQLAAAGVLGKLISRFPINAFH

SEQ ID NO: 149803 - protein, 56 aa, Heterodera glycines
  Coding regions on vcDNA: vcDNA=SeqID_76226; Strand=-; Position=1 -52,262-380
MAESGCRDRSHLTLDLKGLKPTPNNDSGLSPIYTAMPLSPEKIQCKYDYAVLCFYV

SEQ ID NO: 149804 - protein, 175 aa, Heterodera glycines
  Coding regions on vcDNA: vcDNA=SeqID_76227; Strand=+; Position=1-526
MNLDRVFVNDRSNDNEQNLEYAYVFDNDYEVVESSYDILEEHNYSKRSRMDVVGGESQVSLNSDIGIAGPSRMSDSQFEERRRTEYLKRKRERERMRRENESQNQRVLRLEQMRDRNNSQRTEENANERRLRLEQMRNRNNSQRTEENANERRLRLEQMRNRNNSQRSEENANER

SEQ ID NO: 149805 - protein, 71 aa, Heterodera glycines
  Coding regions on vcDNA: vcDNA=SeqID_76228; Strand=-; Position=1 -104,567-679
  Homolog annotation: Hit_ID=CAE68383.1; Match level="QueryCoverage =100%, HitCoverage=2%, E-value=3e-20, Identity=67%"; Hit description =Hypothetical protein CBG14139 [Caenorhabditis briggsae]
IEARTDSFKQTAETGQRLLDEDIDESDEIRQCLQNLAMEQTSLNNLWEERRILYEQCMDLQLFYRDTEQAE

SEQ ID NO: 149806 - protein, 243 aa, Heterodera glycines
  misc_feature (235)..(235): Xaa can be any naturally occurring amino acid
  Coding regions on vcDNA: vcDNA=SeqID_76229; Strand=-; Position=1 -134,320-424,469-552,634-825,888-1002,1417-1456
  Homolog annotation: Hit_ID=NP_872005.1; Match level="QueryCoverage =97%, HitCoverage=89%, E-value=7e-57, Identity=51%"; Hit description =TPR repeat containing protein (2B594) [Caenorhabditis elegans] gb|AAO38571.1| Hypothetical protein Y57G7A
ANATLKKWREEHARRSEEVVEIWEFVLSRYAAALKGELWAVLEQVTIAALDQARHDLAIECLQQLHRRFPKSTRVTKLQAMRLEAIGNYAMRLEAIGNYEDAEELYRRLIEGDDTNPLFRKRCIAILIARGDRQLAIRELNKYLEIFANDSEAWLQQGELFLQEADFGRAAFCFEELLLSNPQNPTYLLKMAPQNPTYLLKMAEIRYTLGGPDNVEIARAYYERSLALAPKIKRXNFGILQRH

SEQ ID NO: 149807 - protein, 104 aa, Heterodera glycines
  Coding regions on vcDNA: vcDNA=SeqID_76230; Strand=-; Position=1 -83,127-170,214-288,339-451
  Homolog annotation: Hit_ID=CAE62916.1; Match level="QueryCoverage =100%, HitCoverage=18%, E-value=5e-40, Identity=71%"; Hit description= Hypothetical protein CBG07110 [Caenorhabditis briggsae]
DGDAGQLVRSLKDQTPFGLTGAVFSQDKDFLYEAKDILRDAVGNLYLNDKCTGSVVGQQPFGGARQSGTNDKAGGPHYVLRWTSAQVIKESFGPLTEWRYPHMD

SEQ ID NO: 149808 - protein, 60 aa, Heterodera glycines
  Coding regions on vcDNA: vcDNA=SeqID_76231; Strand=+; Position=1 -156,372-398
MIACFSAAVAALSAFTLFSLVSGEFSLALSAVESGGGGMPREGAKRPPSDAPHCQGQPKN

SEQ ID NO: 149809 - protein, 51 aa, Heterodera glycines
  Coding regions on vcDNA: vcDNA=SeqID_76232; Strand=+; Position=1 -6,738-887
PKSVCCMFADKSASLTVSPALTCAAHASFSVLAGAVARTAASIPHVAWRSP

SEQ ID NO: 149810 - protein, 52 aa, Heterodera glycines
  Coding regions on vcDNA: vcDNA=SeqID_76233; Strand=-; Position=1-183
FFQSVCCMFADKSASLTVSPALTCAAHASFSVLAGAVARTAASIPHVAWRSP

SEQ ID NO: 149811 - protein, 90 aa, Heterodera glycines
  Coding regions on vcDNA: vcDNA=SeqID_76234; Strand=+; Position=1-270
  Homolog annotation: Hit_ID=YP_148961.1; Match level="QueryCoverage =93%, HitCoverage=67%, E-value=2e-14, Identity=36%"; Hit description =hypothetical protein GK3108 [Geobacillus kaustophilus HTA426] dbj|BAD77393.1| hypothetical protein [Geoba
MTELCQLLKSEIRRLETKMDYGFNELGKKISGLETKIGGLETRIDGLETRIDGLETKIGGLETKIDGMETKIGGMQTKIDGMDMKMNQFE

SEQ ID NO: 149812 - protein, 144 aa, Heterodera glycines
  Coding regions on vcDNA: vcDNA=SeqID_76235; Strand=+; Position=1 -24,242-352,395-505,664-747,876-980
  Homolog annotation: Hit_ID=NP_002936.1; Match level="QueryCoverage =81%, HitCoverage=19%, E-value=5e-22, Identity=42%"; Hit description =replication protein A1, 70kDa [Homo sapiens] gb|AAH18126.1| Replication protein A1, 70kDa [Homo sapiens]
MGIIDGDGACPQQGCKKKVSMEGNQYRCEKCANTFDTYKNIMMLQVELADFSGETWATIFEDKAEALLGVKADQMAQWQREDPARFDSAFNVIRFHEFLFRVGVKYEMYNDKSRLKWSVFNIQPVPLAKCKAFFEQSVQKLEGI

SEQ ID NO: 149813 - protein, 231 aa, Heterodera glycines
  misc_feature (127)..(127): Xaa can be any naturally occurring amino acid
  Coding regions on vcDNA: vcDNA=SeqID_76236; Strand=-; Position=1 -29,934-1064,1299-1485,1637-1871,1939-2009
  Homolog annotation: Hit_ID=CAE68437.1; Match level="QueryCoverage =89%, HitCoverage=34%, E-value=4e-40, Identity=43%"; Hit description =Hypothetical protein CBG14222 [Caenorhabditis briggsae]
SGGSSKGNGPALNAAFASLQCFSGDQLVRTARGPVRMDQLRIGDLVLSMDESLLSFSPVLMFLHRKPSESALFMRIFTEFGHQLQLTALHLIWVARGDRLIRANELRPGQCVYVTRQRGLIGPNQVXMALKVRGHGIYAPLTANGNILVNGVLASCHANLAAQTLQQTFFNWWRPEGIWPQFSLRRFRPGGEDLPMGVHFLVTVLDTLEDLPMGVHFLVTVLDTLMPESIL

SEQ ID NO: 149814 - protein, 315 aa, Heterodera glycines
  Coding regions on vcDNA: vcDNA=SeqID_76237; Strand=-; Position=1 -430,527-1044
MKSHLFLLITLNILAQIFTPYKCMDRKGKKRVERTYSKGSFEDERDKEFYFRDDSYGIEPYRINVAPEGFRGTIQAMTASKDDPVREQLSQEMRWNSTFQQLPPNQQKEMYNLVKNGPNSASSSRSPQPFQSSNQFPSNQFGSGTVPLGKAYLGQQPLVASGSSSRPLQSSGTFLRPNPSRTSVAKPSFIVPKSTSSNAFTSSSQFNSRFNSSGTFLVPQNPSSNAFANSSQLNARLNALNSFKMPQNASLNALDNSSQFNSGLNPSNSFNAPQNPSSNDFASSSSYHSLFEFEYPQVDTLESLLFGCKKHKTDN

SEQ ID NO: 149815 - protein, 328 aa, Heterodera glycines
  Coding regions on vcDNA: vcDNA=SeqID_76238; Strand=-; Position=1 -615,662-736,857-1153
VQAVQRRAQEIGASVPTDHTIKNRTCAIRKKMRNKQKKDEEEAQQKLQSEQIVPIPQHEQIQQQPSTFQTPTDWRNSPTDDEDEIEILGCYEIERTNISTEVEGNNEQNSDNNNIITTNCELVHSTNNENNQEDAEKESYEENTVVDVAEETVAKSMDQLEEGIEVGTVVNEEMAQNVPEEPMASVQLAKRSKPFNQRIVENIGWRKEFGRVPPKERDSLGLIECIDGATFRSRNACGNKKSEVSLQIDEFDEFYKRWISNYEQEGAGKSHGEENSEHDGKEESESGDEEEEPPQNSRGPVIKCPRMPKIRINLKRRISTISIEKAKE

SEQ ID NO: 149816 - protein, 458 aa, Heterodera glycines
  misc_feature (259)..(259): Xaa can be any naturally occurring amino acid
  misc_feature (282)..(282): Xaa can be any naturally occurring amino acid
  Coding regions on vcDNA: vcDNA=SeqID_76239; Strand=-; Position=1 -237,277-344,386-488,540-628,702-752,794-834,887-1089,1142-1353,3592 -3671
  Homolog annotation: Hit_ID=CAG11096.1; Match level="QueryCoverage =98%, HitCoverage=45%, E-value=1e-52, Identity=31%"; Hit description =unnamed protein product [Tetraodon nigroviridis]
LRKQCIRGHLRNSHLRSIVWRLLLGVLPMEDRTQWVEVIGQERRNYTELRHRIESNPRINNSPEDFDGNNPLSLSAESPWCRHFENQSTRKNIEKDVDRTSAESPWCRHFENQSTRKNIEKDVDRTCPDLKFFCPDLKFFQIDDVKQTMVNVLFFYSKLNSQISYIQGMHELLGPILFVLDSDGMHELLGPILFVLDSDQKAFQDMKEQDILSHCHCLVVLNDPVFLEHDAFALFTRLMSLIRALFTRLMSLIRCFFTXKESHSQKGIFYVLNSIPICFFTXKESHSQKGIFYVLNSIPICFLKFAGKSSELLRRLDYICNGLLLEVDPPLHHHLSNLDILPQIYGVRWLRLLFGREFSLPDRWLRLLFGREFSLPDLLYLWDVIFAECHQQQSLEIIDCIFVALLVQIRNVLLNGDYSACIHCLMRYPPIVDSTSFLLMSTVLSSPLRHPPHILTLF

SEQ ID NO: 149817 - protein, 111 aa, Heterodera glycines
  Coding regions on vcDNA: vcDNA=SeqID_76240; Strand=-; Position=1 -51,247-312,379-597
  Homolog annotation: Hit_ID=XP_394668.1; Match level="QueryCoverage =98%, HitCoverage=13%, E-value=5e-12, Identity=38%"; Hit description =similar to ENSANGP00000009739 [Apis mellifera]
MTQTHLVLGSPRESLSTGLYASYQRDSDNAERQFRAALKLKGPNDDAELSTLANLGLALIFLSSGREAQFYELFDSLSPSRIPSQANSLRSAAHLIHGFHYFLHARHNECK

SEQ ID NO: 149818 - protein, 103 aa, Heterodera glycines
  Coding regions on vcDNA: vcDNA=SeqID_76241; Strand=+; Position=1-312
MKEKEEEEKKRREGKEKETEKKKEEMKQKDETETKRSLSVGTTKDDEISIVDSEERERDAFEYPPKPTNERMAFWESTLNNEAKKDLREDKEKALKTQAKLLS

SEQ ID NO: 149819 - protein, 94 aa, Heterodera glycines
  Coding regions on vcDNA: vcDNA=SeqID_76242; Strand=+; Position=1-285
AFASSPVNFIVVISFPLHFAFSVVPFDLINEFTREQLALKIIDNNRRFLLIRCPIARDESKWTKWEEEAIGWRIYNQWSSIEIRIYDEDEIGDG

SEQ ID NO: 149820 - protein, 58 aa, Heterodera glycines
  Coding regions on vcDNA: vcDNA=SeqID_76243; Strand=+; Position=1 -62,348-462
MEPAKAPWDGRSECTRRRWQRLSASGRQAVRARAWAHRRCRVIVVELAPSVRVAVASD

SEQ ID NO: 149821 - protein, 55 aa, Heterodera glycines
  Coding regions on vcDNA: vcDNA=SeqID_76244; Strand=-; Position=1 -112,953-1008
MRPIKTLTKSERKEETDRERENAKRQREIDRASERDNYFCRVWVDGAPGKNASNK

SEQ ID NO: 149822 - protein, 211 aa, Heterodera glycines
  Coding regions on vcDNA: vcDNA=SeqID_76245; Strand=-; Position=1 -442,1384-1559,1714-1731
  Homolog annotation: Hit_ID=EAL47145.1; Match level="QueryCoverage =71%, HitCoverage=71%, E-value=4e-16, Identity=32%"; Hit description =transcription initiation factor TFIID, putative [Entamoeba histolytica HM-1:IMSS]
MQKPIIVNIIALANLGTGIKLNSLTITECEFKYNPRKFNAAVIKCTTPINATALLWESGKMICLGTKSLIDCENAIKKFIEIIKGSGCPGASYTGHTVENIVSTFKFGHEIELNEFRKNRRAFYEPEIFCGLNFKRGKSRTALIFWTDSARELTPFFSINHIFFIHFLSRSHELYYFLNLYRVNLIKDLNNINFLRFYTASETFKSILNAN

SEQ ID NO: 149823 - protein, 98 aa, Heterodera glycines
  Coding regions on vcDNA: vcDNA=SeqID_76246; Strand=+; Position=1-297
MGVRQKQRYSPSLTNPGELFLNRDDPFEIVTAELLHAQMAEPTVPLSRKSKIGAEKIDRWRIGRSSSRTLAEQWDMGMGETSKNGRKRRKNEAKGRHF

SEQ ID NO: 149824 - protein, 102 aa, Heterodera glycines
  Coding regions on vcDNA: vcDNA=SeqID_76247; Strand=-; Position=1 -129,523-702
MTAHIVDKHPQYAAKLLAKQLEFDGGSCHLQQIAKVEGTEETECPTSTTPKCPTPANTDANLTTRTTPTAPTNYSPSTELDSNRRMGRDDDKWVTENGAGFA

SEQ ID NO: 149825 - protein, 15 aa, Heterodera glycines
  Coding regions on vcDNA: vcDNA=SeqID_76248; Strand=+; Position=1-50
QLQHGKNSLALVLRE

SEQ ID NO: 149826 - protein, 221 aa, Heterodera glycines
  Coding regions on vcDNA: vcDNA=SeqID_76249; Strand=+; Position=1-666
MKFCILLFLFLIALIIPIESEKKKLQQKSFDEIFGEKWQEKEEERRNELKKREIIAKFYKIKEKIKQKGRKYSTKEWSKINTKIAKSLGTNRNKIYKWIKEIGLYKYHKSKTDEQKREIVQKFIVMKNEFKQNRKYSQKEWEKNYAEICKKIGVGRETLRKWKKQFGMNKFITKKEKMEKMKKYWQTKKENPKMSEREIAKTLQIDRKSISRWKNQFGEEI

SEQ ID NO: 149827 - protein, 36 aa, Heterodera glycines
  Coding regions on vcDNA: vcDNA=SeqID_76250; Strand=+; Position=1 -13,292-389
MLIKALTATKTQDTVDRGLISDFVILQSTAVLNLLS

SEQ ID NO: 149828 - protein, 116 aa, Heterodera glycines
  Coding regions on vcDNA: vcDNA=SeqID_76251; Strand=+; Position=1 -70,759-1039
MAFNALDFGFDFLDGIAWKGITEWAHKRNKYPFSIFSSIKNQFTNQSIDSKGKWNESKKNRREDIVKYRAWHFFQISQIKNSANLSALTAAKTQDDKVKDVPISDVVILQSTAVLK

SEQ ID NO: 149829 - protein, 129 aa, Heterodera glycines
  misc_feature (126)..(126): Xaa can be any naturally occurring amino acid
  Coding regions on vcDNA: vcDNA=SeqID_76252; Strand=-; Position=1 -146,446-529,1374-1531
  Homolog annotation: Hit_ID=NP_701482.1; Match level="QueryCoverage =96%, HitCoverage=98%, E-value=7e-33, Identity=62%"; Hit description =PfpUB Plasmodium falciparum polyubiquitin [Plasmodium falciparum 3D7] gb|AAN36206.1| PfpUB Plasmodium fal
MQIRIKTLTGKTLTLRDVLPSNTIEEIKAKIERIGGHPRGEQILIFGGQLLEDGRTLKYYNIRDGDIFHLVVLRFCGMQIFVKTMTGKTLTLRDALPSNTIEEIKAKIERIEGHPPDQQRLLFAGXLIF

SEQ ID NO: 149830 - protein, 254 aa, Heterodera glycines
  Coding regions on vcDNA: vcDNA=SeqID_76253; Strand=-; Position=1 -116,602-883,1226-1360,1592-1739,1797-1877
  Homolog annotation: Hit_ID=CAE62199.1; Match level="QueryCoverage =75%, HitCoverage=30%, E-value=5e-14, Identity=28%"; Hit description =Hypothetical protein CBG06249 [Caenorhabditis briggsae]
MEMREQVHKKIMEEFNAETGKGNADFYLQKMEAQRQHNNENSQPEPWRDMPNSTQFLAQLFEKDAKDGLPFSLDLLLYKPSVEVRQVLVGSADEVPRNVPKPAKGKATEAAAFKLPYVRAMERGKTEPILAESLNDQTLAKLRELVKPMMVELNKTEQAKAHHKEPVQVVDCAQSPEKCKQMFFVSETDMLKAIHTALLDEVISSGGDEINGDRFAALRKFVELLIQRFPKKTFERNPQLSAHPKGTALSSIGK

SEQ ID NO: 149831 - protein, 135 aa, Heterodera glycines
  Coding regions on vcDNA: vcDNA=SeqID_76254; Strand=-; Position=1-408
  Homolog annotation: Hit_ID=CAE58895.1; Match level="QueryCoverage =53%, HitCoverage=12%, E-value=5e-09, Identity=43%"; Hit description =Hypothetical protein CBG02142 [Caenorhabditis briggsae]
MALVLLPSGLRIGMAICAILLCCSLPNSTEAALAEVGQQPKGNNPLLYSVDDPIVHLDADTFEDTVLRPNRDRAYIVEFYKDWSVRHRVFGHRGTVETEQNSSSNRTITPRGRARALPEKKWDMPKLTIFSVEML

SEQ ID NO: 149832 - protein, 47 aa, Heterodera glycines
  Coding regions on vcDNA: vcDNA=SeqID_76255; Strand=-; Position=1-142
MLLIRSVNPQSLLSLLSFRLCRPSVASLTFIHRFSKWAATKSPPRGG

SEQ ID NO: 149833 - protein, 480 aa, Heterodera glycines
  misc_feature (14)..(14): Xaa can be any naturally occurring amino acid
  misc_feature (185)..(185): Xaa can be any naturally occurring amino acid
  Coding regions on vcDNA: vcDNA=SeqID_76256; Strand=+; Position=1 -50,478-512,559-694,761-832,881-966,1034-1091,1190-1409,1469 -1604,1659-1791,1848-2115,2814-2844
  Homolog annotation: Hit_ID=NP_493364.1; Match level="QueryCoverage =99%, HitCoverage=80%, E-value=2e-67, Identity=33%"; Hit description =mitochondrial substrate carrier (55.1 kD) (1O25) [Caenorhabditis elegans] emb|CAA21607.2| Hypothetical pr
SHNLFVHILPSPKXNTDPMASAALGFSNFVNGALIFVNGALIRHPFVVLRRQCQVHDHATRKHLTPISLLPVVVNLAGKDGTFSLWKGAIGSGVLWVVSHASEFLIAQLFNLPKSFVPEGSSERLIAQLFNLPKSFVPEGSSERFWRHVFLKTASFFACTPASFFACTPFIVSSFIETVRPSWSXGHSPPILFRAIIKSLSAPPYIFGTGVEGRRRHPLFLLAMPTAIYHTAHFLLYRSVYSFAYSCTRAYVSRKLSRKLPSERKRYHSIMPELFSTMTSMFVADLVCYPLETVLHRLYIQGTRTLVDNLDHGQSSLVPVLATRTLVDNLDHGQSSLVPVLAGAYSGVVDCFIKIVRKEGALALYSGIGALFLQYLLQHGVALGIGALFLQYLLQHGVALAVYWVLDKGFVLRVSFFLTMQKMTSAGGTAAVTCPQSLRPCVRKKTFCVPTAPLSTHSPKKHSRPPREPTWYPPFDENFF

SEQ ID NO: 149834 - protein, 350 aa, Heterodera glycines
  Coding regions on vcDNA: vcDNA=SeqID_76257; Strand=-; Position=1 -214,1456-1571,1673-1826,1943-2184,2232-2448,2500-2526,2574-2655
ILHDLHSIASFGSANSGSFRKRNVRVGDNLCMDWWLVPDTMNGQGYPRRVEKRRQHRGVVHAQGDQISPSFYISNTNEDAVNLEVELGEPNAVITFDNAEQQTLNEAEVSDFVTHTTQGTVGDAQFVVAQHVQTSQTMTKLELLEPWVKKNTTTPSASETTTKVRRSATDEAFVAMSSNNALTQMMRREKRKLLGNVDVQNPLAFVIPATLREKGGEDIVLYDSRNVRQGEKDVVLIFGSVKTLDILRQCGTWHLDGTFKCAPAMWEQFFVIGASVNQKMCICMWCLLPGKQRRYYEEALNFLRERISPEVPSKVLYDFEKAESALGTTISTINSEHSYAASPIFIDGIY

SEQ ID NO: 149835 - protein, 116 aa, Heterodera glycines
  Coding regions on vcDNA: vcDNA=SeqID_76258; Strand=-; Position=1-351
MNQWILFFLIVLFLIIQIEIGAEKKKFEQKTFDEIFGEKWEEKENEQKKREIIHKFYKIKEKIKQKERKYSAKVWSKINSKIAKKLGTNRQYIYKWIKELGIYKWHNKSETDETKI

SEQ ID NO: 149836 - protein, 163 aa, Heterodera glycines
  Coding regions on vcDNA: vcDNA=SeqID_76259; Strand=-; Position=1 -96,211-384,438-557,610-708
  Homolog annotation: Hit_ID=S29742; Match level="QueryCoverage=98%, HitCoverage=25%, E-value=1e-50, Identity=61%"; Hit description =malate dehydrogenase (oxaloacetate-decarboxylating) (NADP)  (EC 1.1.1.40) - pig roundworm
MESFNERPIIFALSNPTSKSECTAQAAYKGTNGSALFASGSPFAPVKFDDGRTFSPGQCNNSYIFPGVALGIILFQIAHIPDKLFLIAAVQLAEFVTDDELSSGNLFPSMNKICEISIQIAVAIAEECYKDGLARLYPEPADKELFVRSQVYSTDYEELIPKM

SEQ ID NO: 149837 - protein, 217 aa, Heterodera glycines
  Coding regions on vcDNA: vcDNA=SeqID_76260; Strand=-; Position=1 -120,312-379,757-803,1580-1787,1850-1958,2009-2107
  Homolog annotation: Hit_ID=S29742; Match level="QueryCoverage=63%, HitCoverage=22%, E-value=5e-47, Identity=65%"; Hit description =malate dehydrogenase (oxaloacetate-decarboxylating) (NADP)  (EC 1.1.1.40) - pig roundworm
MERSEPKQQQISLRELYKTEPSGPNAGKGHSQLKDNRTNKGLAHSMAERQLFGLDGLMPQGVNPLLAMRAFILSTDTQSVEISVGKLSLYVALGGVQPKWCLPIQLDVGTDNETLLNDANYAGLRQRRVRGEQYDQFIDNFMVACCKKFGHKILVQFEDFGKNNADRLLKRYQDRYCTFNDDIQGTASVSVAGLLAAVRITGRKISESKFLFHGAGT

SEQ ID NO: 149838 - protein, 141 aa, Heterodera glycines
  Coding regions on vcDNA: vcDNA=SeqID_76261; Strand=+; Position=1 -322,750-853
MRLNVLLAILAPLLLLIATATLCGATGKEAAANKIGVAAVALSEADNSTTPAPPPPPSPGGSDDKKKDDDDKKPDEDPAKKGNGTDTGDDGKKTDEAGGAFGAGSIFVAILFGMALMFGLIKMYVHWEKRRESDPPNYQMY

SEQ ID NO: 149839 - protein, 269 aa, Heterodera glycines
  Coding regions on vcDNA: vcDNA=SeqID_76262; Strand=+; Position=1 -573,633-869
  Homolog annotation: Hit_ID=AAO85457.1; Match level="QueryCoverage =35%, HitCoverage=45%, E-value=3e-16, Identity=43%"; Hit description =putative gland protein G19B10 [Heterodera glycines]
MANFGTENAKHFTAIKEQTKQICATEKTQKFDIQKLTNAITAAFEKEGAKLVEAMKKGEHTVTVTVDGAYGTLTELLPKSMEFRPYWTGINMLCLMNEQMDNGPGKKVIAKFLNATTVTGDGSAIANTVMPSDLMKIMIELWHILFHNVTGMGKIGGPKFLNQSFGQGAKSDRQEIPKRRNSDQIIVHGQQFGRAIPAISGHPLRRRRRRNLNITARQMANLFHALTVVVLALNLLRVVLRNMADQLDQPPIFMMVALAATIRYFMTMD

SEQ ID NO: 149840 - protein, 132 aa, Heterodera glycines
  Coding regions on vcDNA: vcDNA=SeqID_76263; Strand=+; Position=1-399
MMDNPPPPFRNRTPPVRFNNSGASFVQEYDSANREKMKDEEKGKGKSTAQKAEERTARPKKHNGQDDDVNEGTMAKIWKIFAPKQQLKKREETVPTHDKVPKNDNSSKSVVDDNNVPMPIDCANCAIRLGGN

SEQ ID NO: 149841 - protein, 73 aa, Heterodera glycines
  Coding regions on vcDNA: vcDNA=SeqID_76264; Strand=+; Position=1 -63,148-208,255-352
MRKHTSDLRVAIKKCGNTSVARLEQSRQEDDDFQQQLSSVRSAQPSRFCEEQKNGTESEIGGRSAFIELSDTP

SEQ ID NO: 149842 - protein, 279 aa, Heterodera glycines
  Coding regions on vcDNA: vcDNA=SeqID_76265; Strand=-; Position=1 -163,255-417,930-997,1139-1322,1371-1410,1459-1680
  Homolog annotation: Hit_ID=CAE72089.1; Match level="QueryCoverage =60%, HitCoverage=64%, E-value=8e-40, Identity=47%"; Hit description =Hypothetical protein CBG19177 [Caenorhabditis briggsae]
MLIQFKARACAKDDDEWTALEYLNEFLMNTKGMDKQQEEKLRKFGDLIRHRQAEAKEGVAAEKQQNFSEQFHFRIKWAAEKEKTDKRRLRKWELFEKPIGQREQKRMDKLDEPIYSNKVRFVCISDTHNKLDGEELEQFNSDIGSLPHKYKIVIAGNHELGFEDGEDVEGRRADALMWAMGSGRRGTPRGYERLTNCIYLHDSSTEVFGLTIFGTSWHPLPGFSFYRPRGVPIHKEWMKIPTVQPRPVVDVLMTHTPPLGSQIEWHLRKANGKNKSLHK

SEQ ID NO: 149843 - protein, 153 aa, Heterodera glycines
  Coding regions on vcDNA: vcDNA=SeqID_76266; Strand=-; Position=1-459
MKLIWLSLFFYLCFATVTSILTRKVSFSNIQKILAPYQNSTPPPENENAEKVGQNIDGTMTVDQQIDQKHTTKTDDSPAAITTSNNNEENGGTTIRQKNATKTSNGILPPKTPKEMRLIVGTTVPQKSQQQQPLKGNSSAISKALTSPAPKKK

SEQ ID NO: 149844 - protein, 83 aa, Heterodera glycines
  Coding regions on vcDNA: vcDNA=SeqID_76267; Strand=+; Position=1 -66,864-1049
MSSAYRSPTTVLFCKKRSSIWKIDEDKDKSISKKEAILYLTSLGNKNLTDQGLSKDSSWFDAMDKNQNQKIEPEEFDQILWHK

SEQ ID NO: 149845 - protein, 33 aa, Heterodera glycines
  Coding regions on vcDNA: vcDNA=SeqID_76268; Strand=-; Position=1 -31,73-143
TYQGCAEPDKIRFRLNRRFRLWPKIRLIAIPIT

SEQ ID NO: 149846 - protein, 175 aa, Heterodera glycines
  misc_feature (28)..(28): Xaa can be any naturally occurring amino acid
  Coding regions on vcDNA: vcDNA=SeqID_76269; Strand=-; Position=1 -317,384-508,706-781
  Homolog annotation: Hit_ID=CAE56330.1; Match level="QueryCoverage =99%, HitCoverage=39%, E-value=5e-29, Identity=42%"; Hit description =Hypothetical protein CBG23995 [Caenorhabditis briggsae]
RSRVLKSSARQVPVPVLAKIPGPVALYXKIIILITNPSLAFQSEMLTSPFRSAMVTLLSSLGGGCTSIVISLIATRKCQIDLLIDGLLASLVATTAGCQLSNSWDSIAVDSIAVGSIGSALALSVYPLIERLEIDDPVGVIPVHVIGATWGELAPLINCHACELHFVPKCLFLLS

SEQ ID NO: 149847 - protein, 67 aa, Heterodera glycines
  Coding regions on vcDNA: vcDNA=SeqID_76270; Strand=-; Position=1 -138,544-609
MPPLHRYEQFVHRVGRVGRSGNVGEAFVFFNPEDPNDMYMAEFLRDELDEDQDEMRDDASFANSDWN

SEQ ID NO: 149848 - protein, 34 aa, Heterodera glycines
  Coding regions on vcDNA: vcDNA=SeqID_76271; Strand=+; Position=1 -71,516-549
MKAGIGRSPMQNPTKIKLLREFQCFLSDSINVRW

SEQ ID NO: 149849 - protein, 147 aa, Heterodera glycines
  Coding regions on vcDNA: vcDNA=SeqID_76272; Strand=+; Position=1 -115,176-244,449-525,627-729,1053-1132
  Homolog annotation: Hit_ID=CAE72750.1; Match level="QueryCoverage =98%, HitCoverage=84%, E-value=5e-42, Identity=37%"; Hit description =Hypothetical protein CBG19995 [Caenorhabditis briggsae]
SVNVEHNAISKVPFGIFAKANNLSKLNFKENELTAFPLDFGTWVTITELNVSNNEIHELPLDLEENELEVIPSEIGFLTALTKLWIQSNQLTSLPRTIGNLSNLVDFRIGENLLTFIPEEIDIIEGGPSLVIQYLKMHGPYRGVLNM

SEQ ID NO: 149850 - protein, 57 aa, Heterodera glycines
  Coding regions on vcDNA: vcDNA=SeqID_76273; Strand=-; Position=1-300
QFTVIAQYKSLLKSGEYLVSAKLKIIFCKGNECNGKAIFISVKDTQSMRINTVNSSV

SEQ ID NO: 149851 - protein, 76 aa, Heterodera glycines
  Coding regions on vcDNA: vcDNA=SeqID_76274; Strand=+; Position=1 -144,315-398
VAEQFFKWVGPYQRGFFCDDDSIRLPYKSSTVPDWLLLVYALCVPPFVFAFGEFICLSKPPALAIRQRLNDFEFGE

SEQ ID NO: 149852 - protein, 136 aa, Heterodera glycines
  Coding regions on vcDNA: vcDNA=SeqID_76275; Strand=-; Position=1 -102,439-629,1474-1526,1618-1682
MNELTGGNAWRLVLYFDNRRMERCTDDFRRQRLARTNCESLSFLLLHTAIVDLIIQINNNCEGVKRKTFYFFNISITFNGKIQIYLEGESKCELTFNSRKRARNCAKVRALTSKRPVTRNAATQSNNVMMSVPDAQ

SEQ ID NO: 149853 - protein, 41 aa, Heterodera glycines; identical to SEQ ID NO: 141076
  Coding regions on vcDNA: vcDNA=SeqID_76276; Strand=+; Position=1-128

SEQ ID NO: 149854 - protein, 83 aa, Heterodera glycines; identical to SEQ ID NO: 148173
  Coding regions on vcDNA: vcDNA=SeqID_76277; Strand=+; Position=127 -342,398-433

SEQ ID NO: 149855 - protein, 83 aa, Heterodera glycines; identical to SEQ ID NO: 148173
  Coding regions on vcDNA: vcDNA=SeqID_76278; Strand=+; Position=127 -342,398-433

SEQ ID NO: 149856 - protein, 698 aa, Heterodera glycines
  Coding regions on vcDNA: vcDNA=SeqID_76279; Strand=-; Position=1 -141,536-846,904-1099,1171-1330,1391-1504,1582-1873,1979-2075,2123 -2324,2367-2475,2517-2553,2669-2854,2894-3055,3097-3186
  Homolog annotation: Hit_ID=BAB14505.1; Match level="QueryCoverage =77%, HitCoverage=57%, E-value=9e-70, Identity=43%"; Hit description =unnamed protein product [Homo sapiens]
MPIVATTISTTRNTFMLTTVRLTLSSPFLFLLIRPLFSDSLHSLFCALNYQKLFAELTKSTPSSEKVFAQEKLSIASPVNTEYEAIARMLAQRAKGVIHFVKLAFPELVDCPTDGADGKTLLHFSSQEHTDEDNNATKITNEGADDADTMKQMTETGHDDEFEKRVVFDLDQLAHSQSEPPLLLDNDDALKIGTPVGAHLLFESRFESGNLRKAIQVSPNGYELVLAPDINQCGAHFQWFFFQVSDMRSGVPYTFEVVNCAKSFSMFSEGMQPVLFSVVEAVRYKNPCWSRVGSSICYFPNPKLEHDLATPNNEDISADFQVDSVSSRTRSSNQSGETSFTSTPSVAGNDLSSKMQLRRQQTEKNNTQQKEEAEHLLDGKQSKGKTKKTRTASAHKIAAEKGDGKRNFTLRFTIQFPHEADVCYIAYHFPYTYSRLQATLERFFSSSSSHNIYMHRQRLTSTLCSNPVPLLTITAAPLEVKCREFVLITARVHPGEANSSWIMHGVISFLLSSHPLAVRARELFIFKLVPMLNPDGVINGCQRCSLSGHDLNRDDLAKKRPFAFVDLHGHSRKSNVFMYGNNLEESWRQSDRDAAVDTSAVFRQSFALLPQILDEISDSFALKDCAFSITKAKEFSARVTTCRQFGIEHAYTMESTYCGFDQGSKMGRQIKMEDMKLVGADLVKAMVKLWETQQPTDS

SEQ ID NO: 149857 - protein, 41 aa, Heterodera glycines
  Coding regions on vcDNA: vcDNA=SeqID_76280; Strand=+; Position=1 -46,91-168
VKGHLRQFVLDMHSGKLHREFHQWPDPTEQPAPTTTQPPAS

SEQ ID NO: 149858 - protein, 46 aa, Heterodera glycines
  Coding regions on vcDNA: vcDNA=SeqID_76281; Strand=+; Position=1-139
MEVKLKPYSDPSRWVAIYPLYIDASKSLAQGRRIAKAKAVNNPTCQ

SEQ ID NO: 149859 - protein, 54 aa, Heterodera glycines
  Coding regions on vcDNA: vcDNA=SeqID_76282; Strand=+; Position=1 -121,470-513
MPINVLILHDFLSMEILRLIFVTYLLYCKKNAKFEEWLREFGLYHNPSVAMSKQ

SEQ ID NO: 149860 - protein, 140 aa, Heterodera glycines
  Coding regions on vcDNA: vcDNA=SeqID_76283; Strand=-; Position=1 -186,430-666
MAIKYGPKIAKYGHKMAKISKYGNKWQKCQNMDINFSKLSAKFLQIYWLKLHMRYISKFFDSKFWRKNDFLKNFSGFGLKKANLAAGGRSNRGFFEKCQNMDIKYGPKCQNMEKYGNMDINREIWKNMDIEILPRSFKPS

SEQ ID NO: 149861 - protein, 51 aa, Heterodera glycines; identical to SEQ ID NO: 124998
  Coding regions on vcDNA: vcDNA=SeqID_76284; Strand=+; Position=1-155

SEQ ID NO: 149862 - protein, 22 aa, Heterodera glycines
  Coding regions on vcDNA: vcDNA=SeqID_76285; Strand=+; Position=1 -55,881-894
MALADQGRIQDLGLGVGGEFFP

SEQ ID NO: 149863 - protein, 214 aa, Heterodera glycines
  Coding regions on vcDNA: vcDNA=SeqID_76286; Strand=-; Position=1 -128,181-376,705-1025
MMEEHQSKNFLELLNRLVLVEQKIVTVAFLLRSTPLNVFQTQSLLTRFLEFNSNVTANYYLLGPLKAELGKKHCAIVKGDQLADAKRRLAKVDICNVFSIQTKRTDCEVPSPSEFRSLSPILSPSKDKKEEGKEMDEEDDREAEENATEVKKATGAKTLIRRPISFTPICKEEEQRKKQPVTRILLFLQLGPFLTTQLEGRKRPTDWETTHRKG

SEQ ID NO: 149864 - protein, 41 aa, Heterodera glycines
  Coding regions on vcDNA: vcDNA=SeqID_76287; Strand=-; Position=1-126
IVQNLLVFKKKIKKFTTFHQKFRKSEFRPQKCRKSEVFPCH

SEQ ID NO: 149865 - protein, 97 aa, Heterodera glycines
  Coding regions on vcDNA: vcDNA=SeqID_76288; Strand=+; Position=1-291
MASCKQAPGERVYEFANRLSDAVRTALAGESEEIIRKRMFEEFLEKLTPELQFEVKAGRPTSYSNAYEIAQHFEQLLAAKRHNQVSIADSVAELSHK

SEQ ID NO: 149866 - protein, 613 aa, Heterodera glycines
  Coding regions on vcDNA: vcDNA=SeqID_76289; Strand=+; Position=1-1842
MLSRSLNATEKRRKKRAYAFVNGLKREYVINETDTTVTWLEPHPEIEQLQSVGLVYSSQLAAQLTALSAKVTFNTQKLFAETVRKICNSLRFLADQTLTLAEANPTLLARFFLANPFLTARLVTKEMLEISPCFAINDREMHFQWQNGRCFERLPVTFYLHSSYETKKHGFLDPKTLIVHHNSKENSCKEFRYLYVPLKGSIMQYDQLSGDVKEIPPDSVRYLARQGKIDFPEVHIQLFRNKVLANLSELYSPESFDETIEVAKIAKEIARLSKPNAWEFNSERTDNMATNIVSNGLFSFLRGGLISINQMWVFVCCCYVTLTILLQLIVPAPLAQAIQYLGVGGILLNKVRQIRNHMGKRKQRQPREAIKGKAGQSVIEIEKIAMEQTAATQMNREKAAVKSRENSPIVEKKNVTFAIPLTERWPSPDVAASTSQQAVREQQAGKNGKNDKVIIAVAGSSQCDEKFRINGEANEWKMSFLLDTGAHVTLCNKYTALKMGIRKLIASDITAVIGISDKLVPILGKAEIKLKIAECEVITTVYVVETKIGGAGSYEMIIGRSTLRQLPLLLDLQAGALIRKRDMKVFICEPPSDRADAEIQKKRGTKDRVGMVP

SEQ ID NO: 149867 - protein, 45 aa, Heterodera glycines
  Coding regions on vcDNA: vcDNA=SeqID_76290; Strand=-; Position=1-138
EIIGEIEDLKRSLKDACDLLQKYRQEKAEDAKEQQQNEAQRTENS

SEQ ID NO: 149868 - protein, 75 aa, Heterodera glycines
  Coding regions on vcDNA: vcDNA=SeqID_76291; Strand=+; Position=1 -76,126-277
MGLIFMARINYFRAFSSTVSRSFKQVKHTVQDNVTTIELVDVPIASTHRELKESAATQSVVFFLYCISLFNLCNV

SEQ ID NO: 149869 - protein, 23 aa, Heterodera glycines
  misc_feature (20)..(20): Xaa can be any naturally occurring amino acid
  Coding regions on vcDNA: vcDNA=SeqID_76292; Strand=-; Position=1-70
MARKDFRFPTFLGSEFRLPXFLM

SEQ ID NO: 149870 - protein, 41 aa, Heterodera glycines
  Coding regions on vcDNA: vcDNA=SeqID_76293; Strand=+; Position=1-125
MMLGAQALRTKQKAEKREKEKRKQKKMKGLTNERENLQRAA

SEQ ID NO: 149871 - protein, 28 aa, Heterodera glycines
  Coding regions on vcDNA: vcDNA=SeqID_76294; Strand=+; Position=1-84
MPFPWVVLLVLLVNPAAGCCWVVDVIAA

SEQ ID NO: 149872 - protein, 299 aa, Heterodera glycines
  Coding regions on vcDNA: vcDNA=SeqID_76295; Strand=+; Position=1 -73,207-433,483-643,729-849,1238-1407,1470-1617
  Homolog annotation: Hit_ID=NP_491427.1; Match level="QueryCoverage =74%, HitCoverage=76%, E-value=2e-42, Identity=40%"; Hit description =dna-directed rna polymerases iii polypeptide (1F273) [Caenorhabditis elegans] gb|AAC24412.1| Hypothetical
MEQQIVRLLGEHPEEGLSNARLLQAVGDDSADGTDASSSVTEQLGAAINRLLAQGTIEMLRETVPTGEGVGGAGGFILRLKRGSQLNNASPEEQLVSLGNVFSIIEESQRMGVWIRDIRERSGLNEVQLRRVLKALEQRKLVRSIKAAGTTKKTYILSGLEADDTLTGGTFYSDQQLDSEFVQTLLHVCVNWLLVARYIHEKGLCRIQLGVADVERCAINKTIKQLLLTISVLDIAVLDGKIEKRLNHTYRAIRKQQLHPSPLASVPCLQCPVSAECTPGTGHLISPENCEYFRLHFDL

SEQ ID NO: 149873 - protein, 169 aa, Heterodera glycines
  Coding regions on vcDNA: vcDNA=SeqID_76296; Strand=+; Position=1 -7,732-1234
MRGDLQKLEIPSLGFGRPNVDPALLALLLLQHRCNHLRGGFCGQRPSWDFKTSEFRVTNPHKSLVAIIVIHIQGIGVNAGGGGAEERDPHGAGQQTGHPRLSVPGGSSQGVGLGGLSSKLICILYFQFRRYETGHSKSSKPQRPKATDWTKQWNFLLLLFNLPNDQTNA

SEQ ID NO: 149874 - protein, 52 aa, Heterodera glycines
  Coding regions on vcDNA: vcDNA=SeqID_76297; Strand=-; Position=1 -70,169-257
MESDEEFTEVVGVDEAEGGASNTDLKRMLLLHSYIIQGWKALTDMKYPSTLG

SEQ ID NO: 149875 - protein, 143 aa, Heterodera glycines
  Coding regions on vcDNA: vcDNA=SeqID_76298; Strand=-; Position=1 -69,921-1026,1199-1455
MGGGMALKRMDSEERNRNEKLLSSVGPQLTSHPKFSLRKVFPLANCIVNPTEIVQIPYPNCPWTIHFRSPQLESDRNKSNESLFKNEKYIFVFLAEAKKLLLGMLTAAVAKRLDAEKVIRSEWVMAMMAQSADENVWEAANKG

SEQ ID NO: 149876 - protein, 115 aa, Heterodera glycines
  Coding regions on vcDNA: vcDNA=SeqID_76299; Strand=+; Position=1 -111,162-224,268-357
  Homolog annotation: Hit_ID=AAH86505.1; Match level="QueryCoverage =99%, HitCoverage=48%, E-value=8e-21, Identity=47%"; Hit description =Unknown (protein for MGC:97702) [Xenopus tropicalis]
ESDLVATWQVPMSDKMHKIEFEHGTTTGKRILRVDGKEILRHEWMFKLEILRHEWMFKLVGREMFELNGKQTKKQINIDAAGIFAKQTKKQINIDAAGIFAYEYSLTVGGKAFEK

SEQ ID NO: 149877 - protein, 70 aa, Heterodera glycines
  Coding regions on vcDNA: vcDNA=SeqID_76300; Strand=-; Position=1 -131,172-253
  Homolog annotation: Hit_ID=NP_493077.1; Match level="QueryCoverage =87%, HitCoverage=19%, E-value=1e-10, Identity=52%"; Hit description =esterase lipase YbfF (1M774) [Caenorhabditis elegans] emb|CAB03219.1| Hypothetical protein R05D7.4 [Caeno
MPTLFLHGANSTYFLEDDKIALRKIFSHANFEEIPEAGHWSEKKLHAEQPKRFIDSVTKFLKKGYFTYDE

SEQ ID NO: 149878 - protein, 56 aa, Heterodera glycines
  Coding regions on vcDNA: vcDNA=SeqID_76301; Strand=+; Position=1-173
EGTKTHLELATGSSAYILSESSGNRHIGMVHRLFVNDSLVKPSELADEGEENEKPK

SEQ ID NO: 149879 - protein, 142 aa, Heterodera glycines
  Coding regions on vcDNA: vcDNA=SeqID_76302; Strand=-; Position=1 -92,1205-1265,1338-1613
MVEKIKPRGYYFMKNGINATIFIRVASPTSGSYQSLISPDDDFMVEIGDRKVILSAARLRCFSPVIDRMLSVEMREKQQPSVTLNDLGIDMDQFMDFLLYISPNALSQPILPNCKMIFPIIMRGHGVDEIKLYMINLQDFSK

SEQ ID NO: 149880 - protein, 26 aa, Heterodera glycines
  Coding regions on vcDNA: vcDNA=SeqID_76303; Strand=-; Position=1-79
RMLSVEMREKQQRSVTLNDLGIDMDQ

SEQ ID NO: 149881 - protein, 151 aa, Heterodera glycines
  Coding regions on vcDNA: vcDNA=SeqID_76304; Strand=+; Position=1 -72,547-669,720-764,836-921,1504-1633
  Homolog annotation: Hit_ID=NP_741710.1; Match level="QueryCoverage =58%, HitCoverage=7%, E-value=6e-16, Identity=46%"; Hit description =aboc, EXpulsion defective AEX-3, Rab3 Guanine nucleotide Exchange Factor, regulator of presynaptic activit
MDGGDYFKGGLYFNKYGNHCLLFQEEFLRSLGRQAVEHKSIDSEQQQQPLNIDGDQIDVACRVAMIHFYNGANIFANFSESYPGKIHLGIIRTEKKFSKILLLHKKKVLYFAECSLCPANEAYVRVQAGCTQAVQIGDKDNGSRLVDACLF

SEQ ID NO: 149882 - protein, 157 aa, Heterodera glycines
  Coding regions on vcDNA: vcDNA=SeqID_76305; Strand=+; Position=1-474
MENFGQKRCFSPTGRPIFGTHGFLPDQLFFGRRLRTQLSLVHPKEEHAEIIDPAKIRKSQADFARKMARQFHQNHRAKSVEFLPKDPVLLLNFNRRKRFWLNGTMIERLEKSPTYRVHVPALGRVVHRHANQLQYRYPLEKEGNGTIRIPADGYANA

SEQ ID NO: 149883 - protein, 107 aa, Heterodera glycines
  Coding regions on vcDNA: vcDNA=SeqID_76306; Strand=-; Position=1 -94,625-854
MRKEEMMSQDSNDLIIKFYTILNIYHLITLKSNFTPTRGSLPSRCKTAQNFFDQRQIEEFEFNWMSNEKSWEKIFLLENRHMNEPPVTSPTSPKWRCKLQNSGWKML

SEQ ID NO: 149884 - protein, 138 aa, Heterodera glycines
  Coding regions on vcDNA: vcDNA=SeqID_76307; Strand=+; Position=1-417
MGGKWGTSQNGDGTKMGDGTKWGTAQKWGKCGENETAGENGTNRRTAQFGDGTGVVGSAHVNGTGRAALSGRCVKAVVGHGRARIGMAQNSRRTNGQGQESTARTDGRRSCRRLLSARGEGEGGKGGRGNASQKPLVY

SEQ ID NO: 149885 - protein, 475 aa, Heterodera glycines
  Coding regions on vcDNA: vcDNA=SeqID_76308; Strand=+; Position=1 -631,1632-2428
MKHTKKMVVMVPETEYIALMNIVKSMGSRGDPIQDEKTSLDSNIHKNLNDKTIGADIKMKRHSWLYKRRRQLKELKENKPQKVIIEGNPSSAIPNVAPYMGIHKIPKIETAVEQENKRQPIRSIRASRKKKSENVFESSADYSSATEGSSSTPIRSQDVKLSQKNFSKIMNIIGKNPDKFGIDMQSGQVLTNFNKPVTGSNYTESLKLLSGPTTVTLKVKIPSIQFHSVEHMQKSLNSIIQSAYDVKFPKEKRVKRATAASADKELEPETRPEPDKELTREVSSSKTLDKELIREVPLPATYDIELPRGDEPKPLEKEIGRETGPAQLSDKQLGELEGEKPQKEQMPATPIVEHGEISTIDQVRMDLAKRVTEQSWKETVKLAANAADIAEKAKTALNRAEQARKRAPNAPHVKKWFDRLSNMENYLRELVEKISQESKEAAEAKRKLDVHYDSCNNCLALQQSDNFLYPIFMYK

SEQ ID NO: 149886 - protein, 230 aa, Heterodera glycines
  Coding regions on vcDNA: vcDNA=SeqID_76309; Strand=-; Position=1 -177,238-543,642-851
MNRNNLKRFQIKPLSAESKGSEEQPTSRTKTLSEVKEFDSAGTFFLRAKLVSVLFCIYKSCPMRSKGIPCRKKLDSEDFCVSCVHRAKKPSRNLYLRVVLQDCDDEECEQETTAFSYAAINFLSIASVEAFYNLSENAPNKLESILQSKIDQPVLVKVNIKENNDTAKLDWIISSISVEKPVSVKVLDDKNNDDGVEEEASSSEPPKKRTKNNQVERAIDEDADDIHTIE

SEQ ID NO: 149887 - protein, 73 aa, Heterodera glycines
  Coding regions on vcDNA: vcDNA=SeqID_76310; Strand=-; Position=1-222
MTMDAPKVKVSEGTKSARNAHETKLLKRMDRETAKPWRNQQKTVANENETGEGPTTFRMLSAYLTTSAITSPP

SEQ ID NO: 149888 - protein, 151 aa, Heterodera glycines
  Coding regions on vcDNA: vcDNA=SeqID_76311; Strand=-; Position=1 -240,302-514
  Homolog annotation: Hit_ID=AAP30770.1; Match level="QueryCoverage =70%, HitCoverage=41%, E-value=7e-25, Identity=58%"; Hit description =putative gland protein G17G01 [Heterodera glycines]
MLTFLRHSITIFIIVSDLPIALKNRSVSSSFTENKSYKCGNIIMEKKIVYFKLLQFVLTLTIIWQLISLRQFCGTFADPKTFLCKSIGNCDYTLIGQDSETGEFGSMFNKLYKQFFMNSTNRRTTGEPKYALFYFLVSKLPPAGHHCIPIT

SEQ ID NO: 149889 - protein, 26 aa, Heterodera glycines
  Coding regions on vcDNA: vcDNA=SeqID_76312; Strand=+; Position=1 -57,179-202
MRAFCWKHSLYIGPYSIESDFFELWH

SEQ ID NO: 149890 - protein, 203 aa, Heterodera glycines
  Coding regions on vcDNA: vcDNA=SeqID_76313; Strand=+; Position=1 -304,771-980,1024-1121
  Homolog annotation: Hit_ID=CAE62791.1; Match level="QueryCoverage =95%, HitCoverage=73%, E-value=2e-34, Identity=40%"; Hit description =Hypothetical protein CBG06965 [Caenorhabditis briggsae]
MAVVSSAKSSSAHKWVSLIVLIGQTTALVLTLRYSHTQKSYPSDGPKYLSSTAVLMAEIVKFFTCVAVLGHQNGWNFGRLLRDFDWKDLLNVGVPALLYVNAPKKFSESPSLAADENAFGADNRPQQSTGDGFVGLCAILAACCSSGFAGVYLEKILKTSRVQLWVCNLQLAFFSMFGAFAMTLLCDWAQLQQWGFFHGYNWA

SEQ ID NO: 149891 - protein, 20 aa, Heterodera glycines
  Coding regions on vcDNA: vcDNA=SeqID_76314; Strand=-; Position=1 -3,1082-1141
MNFIFKILFYFSSIKWQFIF

SEQ ID NO: 149892 - protein, 154 aa, Heterodera glycines
  Coding regions on vcDNA: vcDNA=SeqID_76315; Strand=-; Position=1-465
MIDTMNYYLCVYDKSCIFICHIIIFYAHVGGFTKCPRWRIYETPTLADLRNAHSGGIYEMPTLADLRNAHSGGIYEMPTLADLRNAHSGGIYEMPTLADLRNAHVGRFTKCPRWRIYETPIVAEFTKCPRWRIYETPTLADLRNAHVGGFTKRP

SEQ ID NO: 149893 - protein, 142 aa, Heterodera glycines
  Coding regions on vcDNA: vcDNA=SeqID_76316; Strand=+; Position=1 -244,833-944,992-1064
TKIYNYLKPMHSLFKHQGAAELCRPLPVYGMQASPLYRNGGVGRARGQWRQIGGAVAVGTGRGRHFVPDPSHISLPIADAGAATMNGGGGTAKICAADSSALAKNGGTLCSLEGTVPERFFAENRSNGIGEAQQLLMMHNAN

SEQ ID NO: 149894 - protein, 38 aa, Heterodera glycines
  Coding regions on vcDNA: vcDNA=SeqID_76317; Strand=+; Position=1-116
NGALRANIFTVRAFAARNNQIHQGELGKARRTPFRIAP

SEQ ID NO: 149895 - protein, 200 aa, Heterodera glycines
  Coding regions on vcDNA: vcDNA=SeqID_76318; Strand=+; Position=1 -258,721-949,1069-1182
MRKRNYLSTPIKQQIIKAKEAGQTDRAVSEQFNISNSTVSRVYARHRQTGDISTKPKSGRPRKTSEWQDRAIARQLKLDPNKSASEVTRSHSHAPSSTRIEVLIAKSDIRRAAVNAISATPGAIVANALEGISDAAKHQLPKIANLKKTATRQRKGIGDGAAENPLPSRETLRKRLVQNYRNGSHRRTTVTVPMPQTSHY

SEQ ID NO: 149896 - protein, 195 aa, Heterodera glycines
  Coding regions on vcDNA: vcDNA=SeqID_76319; Strand=+; Position=1 -195,667-886,1179-1351
MLSSFVSQLEEVDAVLRNSERSGGGGAEMAAQMRKELEHICAHKEDLEAYLMATEPIVEWIEFFEESDQPTIHRALPALAGIESGLNTLRMLAIQSCDGNGTTNNCQTMSNSAVLQRELCEAALDALDWNISPLRGAKINKHLLCTAAALNPSAWRRELPAVFAKVARWTEEEVLMNAEIKNGILLGVGQQETTV

SEQ ID NO: 149897 - protein, 83 aa, Heterodera glycines
  Coding regions on vcDNA: vcDNA=SeqID_76320; Strand=+; Position=1 -229,867-889
MEPDRAMEMLLFNTDIAMNSSSSSNASESEANGAETVPQTTGPNSGSSTTTAAIREGEEPEQQAELYYNERFNFDDVKTSYLQ

SEQ ID NO: 149898 - protein, 68 aa, Heterodera glycines
  Coding regions on vcDNA: vcDNA=SeqID_76321; Strand=-; Position=1-203
GGGEKNEMKCHVKFKFGILTTVCLDNGLIFCWHLSFLTLLRRREVTAFFIQLERNKVNSLAERSNPSG

SEQ ID NO: 149899 - protein, 90 aa, Heterodera glycines
  Coding regions on vcDNA: vcDNA=SeqID_76322; Strand=+; Position=1 -111,527-687
MPQGIIMNGKALAAKSALAAQKAKRASWTKTFVPFSDSVDHGQSSRSADADQQENNNNNNRSSSGAAARRRRRQSRHIVAHDNAGDKIFK

SEQ ID NO: 149900 - protein, 134 aa, Heterodera glycines
  Coding regions on vcDNA: vcDNA=SeqID_76323; Strand=+; Position=1 -75,125-214,319-393,617-778
TVSTDQTNSATSDPRPLPVVTESVPEESTYDPPWDDRPLRFIKTMAALQSHRSTNVLPTVPSTSADSDPRPLPVVTESVPTSDLTALFAEFLRTNCVGHVPKEFLVNHLEEAIKILNLGGGQSDDNSKMSKFRK

SEQ ID NO: 149901 - protein, 126 aa, Heterodera glycines
  Coding regions on vcDNA: vcDNA=SeqID_76324; Strand=+; Position=1 -90,314-604
EESTYDPPWDARPLRFIKTMAALEAHRSTNISDIVARLTAVVDANELTRLPPDVVGHLDAAVTHLEASAQRLNLGGGQSANTPKISKFRKVLFHSLLNNRTGRAQWGFTGSPGITFLDQPPGRAAR

SEQ ID NO: 149902 - protein, 137 aa, Heterodera glycines
  Coding regions on vcDNA: vcDNA=SeqID_76325; Strand=+; Position=1 -99,275-589
MEVKNGRLNQLVVLQNSDPSKCATVYSASLSLSHLEKCGISTNSCAELECISSKIPQQFSTIALGSDLLDKKEEDDFSPEAALSSTPGSLLDSLVIDQDEQDNDKGMTETETNKHEVMSRSLTVTRIVRETPSLLAV

SEQ ID NO: 149903 - protein, 21 aa, Heterodera glycines
  Coding regions on vcDNA: vcDNA=SeqID_76326; Strand=+; Position=1-64
MQLMRKVELRNQFKGFPTNRS

SEQ ID NO: 149904 - protein, 52 aa, Heterodera glycines
  Coding regions on vcDNA: vcDNA=SeqID_76327; Strand=-; Position=1 -105,155-207
AFDSINHSMCPFKLENFGVYLPAWHKPVTNRYGKRKRVVREAGGMEVPGDTE

SEQ ID NO: 149905 - protein, 174 aa, Heterodera glycines
  Coding regions on vcDNA: vcDNA=SeqID_76328; Strand=-; Position=1 -319,475-680
VQATSKAFTDLKEKTQKLVEAEQQKKAKDMPKSQKASDSQRQVKTHNSFLAKYATKRTHSPSPNLTNRLTNPSSVPIKQRKQAEDATKLLPKKMVVSQSKERIEPHGRSINLTGFNCYFYSQDNFATHRPSSFCGKHPPTQFFMLTGRLIWVNDYSNETNKGLVSGIYNDPKPG

SEQ ID NO: 149906 - protein, 184 aa, Heterodera glycines
  Coding regions on vcDNA: vcDNA=SeqID_76329; Strand=+; Position=1 -228,314-597,645-687
MAPSILSECPSLRFVIFYAGDLFAEFPADDSAAASDGQMLAKWLFTPRPDDVPKVLKCWLDTDDGNLASKIEAFKAAFLDASSPANFIFVIWFPPSADSVVPFELINEFTREQLALERINNSDRFLLIRCPIVRNASKWTKWEKEAFNWRIYDQRNRIDIEIYNEDDIGDRLLDEIPDPSDQQK

SEQ ID NO: 149907 - protein, 179 aa, Heterodera glycines
  Coding regions on vcDNA: vcDNA=SeqID_76330; Strand=+; Position=1 -47,110-385,650-863
MSDRRKEAEAKMAKAIFISADGWLKVFDLLPPSQLGLEIATISHRFNAYVDEHFKTRKWALKFIQIRREIGKKGTKKLELANLDGEKLPIPKKPMPKKVVGFEAISISKCQSLRIVKFCDDDNFFIEFPADDHAAASDGQVVAKWLFTALPDNVPPKMLKCSLDKDDGFLESDIEDFKE

SEQ ID NO: 149908 - protein, 274 aa, Heterodera glycines
  Coding regions on vcDNA: vcDNA=SeqID_76331; Strand=-; Position=1 -45,1648-1702,1756-1913,2004-2104,2177-2261,2489-2564,2613-2690,2781 -2831,2901-2942
  Homolog annotation: Hit_ID=CAE57739.1; Match level="QueryCoverage =93%, HitCoverage=29%, E-value=1e-75, Identity=55%"; Hit description =Hypothetical protein CBG00750 [Caenorhabditis briggsae]
AQSKASKLNINVNALSTNDTEEQQIIEQAMGFEELHDEIAIKGQARENLIFELHDEIAIKGQARENLIFAVEEKPLDERVRLSQAKDELILKCSFNQHDCDIEKDFKLFHDPTYGNCYTFNWDRNAQVTAHRAGANYGLRVLVYANVSEYLPITEAVGFRITVHDKWTVPFVDAFGYNAPTGTLSAFGVRMKKFFRLEHPYGHKKFFRLEHPYGHCREGGERAEWYIYNNYNYSIEGCHRSCTQREVVRVCGCADPMFPVVVRVCGCADPMFPV

SEQ ID NO: 149909 - protein, 258 aa, Heterodera glycines
  Coding regions on vcDNA: vcDNA=SeqID_76332; Strand=+; Position=1-774
MNTKIVLFLLLPLLIIGWVTPTNTTNEKRTDKGKGLQRSAEGSAFSAYIKSAFRPYKQKDNGKNAKNETDGQQRADVIGDNEKLQAVAAENVDEQRAYTTGDNELLRAVSTGNSEQSRVVAARDDDQHRAISAGGVDLQEMDAVAEPMDVSADGSRSAKTQKPSGGGDGSTTSMRKSGVNQSSLGRHEDAQQSSEATLSADTPNAGNNGGAENDDHEMAERDGESQKKTPKKRRLIKQKTMEKSSKRSAAEKKKNVDS

SEQ ID NO: 149910 - protein, 336 aa, Heterodera glycines
  Coding regions on vcDNA: vcDNA=SeqID_76333; Strand=+; Position=1 -663,1073-1420
  Homolog annotation: Hit_ID=EAA16908.1; Match level="QueryCoverage =89%, HitCoverage=26%, E-value=3e-17, Identity=27%"; Hit description =Drosophila melanogaster CG8797 gene product-related [Plasmodium yoelii yoelii]
MERSVNSNPFKSAEDAPSLASTSQNNLLEAQVKEQAAQIQKLTEVLNELQQKVNVGKEEGQQSTQQPQTVAASVEQQQQLLQQLHLSQEPPEQLGQQQQQLPMAQQQPVADVPLQPQNAAPFSVAQQSQPQPFASVLDPITRQRLSVRMITAGQLLADRQQQQQQQLRIQLQRRMQLQLQQQHELMGSPPASRSSSPNRLNIQHLQQQRPQPAARPLTSSNLSPISNARRAKEQQRKQQHDAGTSSGSVAGEVQQQWQQPQGDYAIDATPLRASIPLREGQPNQVGTSGAGPSGYSGDQQQQIQHLRMSANVGGNLVESQRRHSRVEKAKVMLLHW

SEQ ID NO: 149911 - protein, 259 aa, Heterodera glycines
  Coding regions on vcDNA: vcDNA=SeqID_76334; Strand=-; Position=1-777
  Homolog annotation: Hit_ID=EAK89729.1; Match level="QueryCoverage =92%, HitCoverage=79%, E-value=9e-22, Identity=28%"; Hit description =uncharacterized glycine-rich low complexity protein [Cryptosporidium parvum]
MNDKIDWLGRFAPSHHFLGFSPISGTQPTSNSISGTQICGILNIHHHLITGTQPTNIPINGTQPSSISIIGTQFSRIQISGTQPTNIPINRTQPSSIQSLGLNPPTFQSTGLNPPAFQSVGLNPPTFQSTGLNPPAFQSVGLNPPTFQSPGLNPPAFQSVGLNPPTFQSPGLNPPAFQSVGLNPPAFQSVGLNPPAFQSVGLNPPTFQSTGLNPPAFQSVGLNPPAFQSVGLNPPAFQSVGLNPPTFQSPGLNPPAFQS

SEQ ID NO: 149912 - protein, 224 aa, Heterodera glycines
  Coding regions on vcDNA: vcDNA=SeqID_76335; Strand=-; Position=1 -112,168-307,409-830
  Homolog annotation: Hit_ID=CAE56115.1; Match level="QueryCoverage =93%, HitCoverage=11%, E-value=7e-11, Identity=31%"; Hit description =Hypothetical protein CBG23721 [Caenorhabditis briggsae]
MSSTRSRRSGIVDSGGLNPSTIHLLPMARVKKELEARGLDTKGSAADLAFRLQEYVRLAGGFVSKFDPSPASEPTTPLKKRKRKQLDVEVDENVAGFDRQEASSPVAAKTFRHFSWAIAPPTAPHPVKEAKKEEIIESGNEEERDEEEEAEKEQNDQIQIGRKIEETERQQKTKVGGEEEGVEEVVQQPQTTTEKPADATQPTAEPAKIQGKLDNNENANGSAN

SEQ ID NO: 149913 - protein, 88 aa, Heterodera glycines
  Coding regions on vcDNA: vcDNA=SeqID_76336; Strand=+; Position=1-267
MRELRGPLDELLKKEAKWEWGAEQQKSFEKVKEITSRPKLSNCRSRPKKLLIHENGRLPSKISKFPAQEWPQKCTDTDLMPFIKKETK

SEQ ID NO: 149914 - protein, 110 aa, Heterodera glycines
  Coding regions on vcDNA: vcDNA=SeqID_76337; Strand=-; Position=1 -170,231-393
MSVGWGSLNTDHLDSRPSRVTIWSGCNQTMARSLRSNWASDPTERLDWEKESSTKNCNNSFSAIKILKIKTAKPTRKTPLSRDNSDCALLSGIHQSAHNLTNLLWSVKKD

SEQ ID NO: 149915 - protein, 294 aa, Heterodera glycines
  Coding regions on vcDNA: vcDNA=SeqID_76338; Strand=+; Position=1 -45,479-666,710-827,869-1053,1107-1270
  Homolog annotation: Hit_ID=NP_741604.1; Match level="QueryCoverage =95%, HitCoverage=30%, E-value=1e-46, Identity=36%"; Hit description =small optic lobes homolog (5K366) [Caenorhabditis elegans] emb|CAC42267.1| Hypothetical protein T11A5.6 [
GSGIRKFLQLWAFSQKNDQFFVDDSFSQSNRSVGSLAQLERRDLAIVWLQPDQIVTRDGRLSRWSVFNDPQPTDIEQGLLGNCWLLSALAVILLGNCWLLSALAVIAERPDILEKLFITKEYNHRGVYEVRLCIDGIWQRVIVDDFFPCHRSVYEVRLCIDGIWQRVIVDDFFPCHRSGRLIFAVGRKNQLWVSLIEKALAKAYGNYAILRAGRTVEGLSTLTGQPTLSIDLEYLDMDQGLSTLTGQPTLSIDLEYLDMDQQSRTADLDIAWAKLISAREARFLMGCSCGAGQF

SEQ ID NO: 149916 - protein, 97 aa, Heterodera glycines
  Coding regions on vcDNA: vcDNA=SeqID_76339; Strand=-; Position=1 -103,147-337
MNQMRKILTETQQMDQSESAHFTDFSESDESALKLDIWNSNPKSPCCSSITPSTLSGEPAPAVGTKIEAQLALYKDVERVGIDADIFLWWKERTSLS

SEQ ID NO: 149917 - protein, 209 aa, Heterodera glycines
  Coding regions on vcDNA: vcDNA=SeqID_76340; Strand=-; Position=1 -183,226-390,436-584,627-759
MSEIWSFYKKSQTSETALCNLCRNSFSCKKSSTKGLWDHLKTMHNDEFEQWQKNKGNTNKEGQENKITKFFQQSDDQKQKADELVLKLMLRTNSSFLITESPELRELYSKAFPGFELHSREYFRKIVLPKMANAIKEKICSQVSNDYFTITTDGWSQPTSTPSLLSITIHHIDNEFNRNDFVLEASTYRITILATTLPTQFMMHLMKTD

SEQ ID NO: 149918 - protein, 32 aa, Heterodera glycines; identical to SEQ ID NO: 133941
  Coding regions on vcDNA: vcDNA=SeqID_76341; Strand=-; Position=1 -14,192-276

SEQ ID NO: 149919 - protein, 196 aa, Heterodera glycines
  Coding regions on vcDNA: vcDNA=SeqID_76342; Strand=+; Position=1 -251,556-721,927-1100
  Homolog annotation: Hit_ID=CAE60520.1; Match level="QueryCoverage =59%, HitCoverage=84%, E-value=8e-15, Identity=43%"; Hit description =Hypothetical protein CBG04139 [Caenorhabditis briggsae]
MSSSVASTPASPISLTAAPRRASVFADLLTVFRRKSTATTALSTRRRSIYHAPVPSSYTARNRRSGAAKKAEEMELFTDRDSLHEADRGEKDEEEETAGKPLTRQHLLNKIREKKEVINKLRCQAWNMNRKRRTLRWDTTCPEILGAERVQSVQNAFVQGGVGETVALVPPLVEQHWHLFCGNCATFSVFCDLFSF

SEQ ID NO: 149920 - protein, 223 aa, Heterodera glycines
  Coding regions on vcDNA: vcDNA=SeqID_76343; Strand=+; Position=1 -68,306-488,636-1053
MRRKNMQNHTTYNPNYNLFNLVSWVCSDVWLDIFPHFDRPQLGLKLALLSNRFNALVDKHFDGKRELSIWSDITIGKMGAKAKLYIDYAVIKFLRANQQIFAKGTDLDLHVPFPYKAKDVQNFACEIWPVFATNIRHLSVTDGRHLENLRRHTSPTILSDLNINAIHSDDLLPDAIADDGPNATAGQALSKWLNIPRSDGQPKQLSCCGAVSRTIKLVNSFKE

SEQ ID NO: 149921 - protein, 88 aa, Heterodera glycines
  Coding regions on vcDNA: vcDNA=SeqID_76344; Strand=+; Position=1-267
AFLHATTSSASYIIRLEDFEPTEIEPFELVNERTNEMLTFEKEDDHQNTNNVACLLKRFQIGVTATIHWVDENLDNLNNVNFHLYEFG

SEQ ID NO: 149922 - protein, 675 aa, Heterodera glycines
  Coding regions on vcDNA: vcDNA=SeqID_76345; Strand=+; Position=1 -370,422-764,812-1383,1429-1620,1670-1765,1813-1943,1992-2315
  Homolog annotation: Hit_ID=NP_001004509.1; Match level="QueryCoverage= 93%, HitCoverage=43%, E-value=1e-72, Identity=29%"; Hit description =si:busm1-180o5.3 [Danio rerio] emb|CAD60788.1| novel protein similar to DNA polymerases [Danio rerio]
MAALVAFRREFFEISRRQDYVDGIDDKENHDGIDVLRECMTIAGACMRHFRTNHLPDEHLAIVPERGYDNAQNQSLIALRFFHGYAKEHGVQVQTAHAAGGEKIGPYSLDGWIEAERRAIEVNGCTWHGCKRCYPNDNMLLPNGKTAGQVRERDSKRMEFLRGKVNRMDVYWECEIHRMLERSKEMRKAFDDYVDDGPLVIRDAFMGGRTGPLKLLRKAGPGEKISYYDFTSLYPYINFTTRYPIGQPNVHVLNQEVDWRSAADNPYPLALLKVWVVPPRRVDVPVLPVKVGERLCFPLCITCAKEHPTGGVNPNYHCEHNDRQRGWVSTCTSIELNEALDEGYLVTKVFRVLEYEQSDDKLFRPYIAEFMAQKIQASGFDNSIRGDAEKEQQFVRECAEQFDITIDPTKMAVNKGKRSLAKLCLNNLWGRFSLRNFGLAQTLITDDPATLAEYLDNKSIEVTSIDELDEQHILITYLQKKDWVDEHSCSNIVISLWTTSAARLVLLKAMQKVVRSPGSDLLYTDTDSLILVHPEERCPLKTGPHLGQFTDEYPDHDIVEFCSGGAKQYGLCLRRKGAEAGAQLEHVLKVRGLTLNYDVINNQGMRYENFKEEVVRYATSGEYEPIIITYPNFLRPNIREGGRVVSMPMQKCYRPFVGKGIIGADFNVLNFGHTL

SEQ ID NO: 149923 - protein, 138 aa, Heterodera glycines
  Coding regions on vcDNA: vcDNA=SeqID_76346; Strand=+; Position=1 -211,266-407,790-853
MKRRIAPLTTATAPAEQHKIIGPESPKPHEETAKNVEPKDELATKKRKVDDRELWKLAKGKFLLTTYLCHDDWNRLYNNQQKVKRLEGDRFAFGFEMCEECVWANCRATDLLAPMKKKMRRVPFGPVQGVRKTEGTEL

SEQ ID NO: 149924 - protein, 73 aa, Heterodera glycines
  Coding regions on vcDNA: vcDNA=SeqID_76347; Strand=-; Position=1 -59,108-270
MADNQLRRKRMKMTTQLGKRGTNCCGGRWPINALHRPARAAQSRAQRRPHCLPLRQMPPEDRGKITTKVDVYR

SEQ ID NO: 149925 - protein, 286 aa, Heterodera glycines
  Coding regions on vcDNA: vcDNA=SeqID_76348; Strand=+; Position=1 -299,349-910
  Homolog annotation: Hit_ID=NP_001004509.1; Match level="QueryCoverage= 81%, HitCoverage=15%, E-value=1e-29, Identity=32%"; Hit description =si:busm1-180o5.3 [Danio rerio] emb|CAD60788.1| novel protein similar to DNA polymerases [Danio rerio]
MLLPSGKTAGQVRERDAKRMEFLREKVNRMDVYWECEIHRMLERSKEMRKAFEDYVDDGPLVIRDAFMGGRTGPLKLLRKAGPGEKISYYDFTSLYPYINFTTCYPIGTPKVHVLNQEVEWRSAADNPYPLALLKVWVVPPRRIDVPVLPVKVGERLCFPLCITCAKEHPTGGVDNDYHCEHSDRQRGWVSTCTSIELNEALDEGYLVTKVFRVLEYEQSDDKLFRPYIAEFMAKRSRPVGLTTVSEAMRRRNNSLCGSAQSSSTSPSTQPKWRSTKGSGPWPSSA

SEQ ID NO: 149926 - protein, 214 aa, Heterodera glycines
  Coding regions on vcDNA: vcDNA=SeqID_76349; Strand=+; Position=1 -88,329-680,961-1165
MNEKPSHLFIFPSKYESSLFLSHISTKLFRYFKEAQRTFAIKVTDLESVSEKFKQKFLPRELEVWRELDHPNLVYLYKDFQWNNYQFAVMELVVGGDLVISSFVLCVLHYFTVYSSAFVPPKMWPRQRNDLSQLDAPNCCCFGLSPPSLGVTAFIMITNTMPFHEDLPNQQIVDSQRKRRYKYPSWLNITKQCRTAIDALLTYQPAFRPVEFCF

SEQ ID NO: 149927 - protein, 56 aa, Heterodera glycines
  Coding regions on vcDNA: vcDNA=SeqID_76350; Strand=+; Position=1-170
MAIARTSVLSPLLLFIFLLFNCCLCQPNVFSPNDFACAKKNAIFHDGLFTLTEDNR

SEQ ID NO: 149928 - protein, 52 aa, Heterodera glycines
  Coding regions on vcDNA: vcDNA=SeqID_76351; Strand=+; Position=1 -127,260-291
MRPHFGPSLLSLFVLSLLIFAIASLNAADEMPGTEGEEIIIPSWFEACRMDF

SEQ ID NO: 149929 - protein, 51 aa, Heterodera glycines; identical to SEQ ID NO: 124998
  Coding regions on vcDNA: vcDNA=SeqID_76352; Strand=-; Position=1-155

SEQ ID NO: 149930 - protein, 133 aa, Heterodera glycines
  Coding regions on vcDNA: vcDNA=SeqID_76353; Strand=+; Position=1 -106,1154-1449
MDAVECAVGKDLAREFQRMDENPFQMRGGAMLRLSVALTLSYLLSSLDRRRYVETRIASECPAALAIAAANAKESAGDGGGPSTAKKVKVAGPEDDILYRAAEQVKHHGSKRNEELLSNQMLVGIPEVDLGIE

SEQ ID NO: 149931 - protein, 105 aa, Heterodera glycines
  Coding regions on vcDNA: vcDNA=SeqID_76354; Strand=-; Position=1-318
MPSNAFAMAQSQSAPTSPAVTAFAMSEQHPLLLRQQQQQQQQQQQHWSQQTPMTTVAMMAQHQQQSSPCRHFSASPDGMEVPNICVTGTDGGDIDCFQVLLLAIS

SEQ ID NO: 149932 - protein, 96 aa, Heterodera glycines
  Coding regions on vcDNA: vcDNA=SeqID_76355; Strand=-; Position=1-291
MPQMSAPQVSAPQVSRRKCQRRKCQRRKCHAANVSAASVSAASVSAANVSAASVSAANVSAANVSAANVSAANVASPILYWPNETFNYLEFYYINY

SEQ ID NO: 149933 - protein, 117 aa, Heterodera glycines
  Coding regions on vcDNA: vcDNA=SeqID_76356; Strand=-; Position=1 -225,269-397
MEKYHNHLSDGILYPLQFSNRNRCFYDANWNCVCSATFQIVSRMNDEARNWTDNFSAAFNNSNKGWGFPSFITLAELMDPNNGFYDKDEDKGTLAIHFIINPNQKAGRKFQSLLDPK

SEQ ID NO: 149934 - protein, 58 aa, Heterodera glycines
  Coding regions on vcDNA: vcDNA=SeqID_76357; Strand=-; Position=1 -32,657-801
MCVVCTDSAASFVVTESDRLPMTPAFFCRKCFRAFHYDGEQRIGQFKAFHFMDHAGTE

SEQ ID NO: 149935 - protein, 19 aa, Heterodera glycines
  Coding regions on vcDNA: vcDNA=SeqID_76358; Strand=+; Position=1-57
YKISSKSPIFHLCERTSGL

SEQ ID NO: 149936 - protein, 88 aa, Heterodera glycines
  Coding regions on vcDNA: vcDNA=SeqID_76359; Strand=-; Position=1 -109,667-824
MSAFTTTAQRQLAEKRGNKFCKIYEQNFCNSTVFANLFINRQMQAATSQQVVDHNGTKREPTTTDNEGTSNVDRGRARRRQHNITTAP

SEQ ID NO: 149937 - protein, 55 aa, Heterodera glycines
  Coding regions on vcDNA: vcDNA=SeqID_76360; Strand=+; Position=1-166
MKKQLHKLRNEQESKIISQGQNSVNKFIRNKLSKVNEIPTLIDSAGNMFSSNVQK

SEQ ID NO: 149938 - protein, 79 aa, Heterodera glycines
  Coding regions on vcDNA: vcDNA=SeqID_76361; Strand=-; Position=1 -78,1359-1518
  Homolog annotation: Hit_ID=NP_508492.1; Match level="QueryCoverage =93%, HitCoverage=12%, E-value=4e-21, Identity=63%"; Hit description =5'-nucleotidase cytosolic II (64.3 kD) (XD454) [Caenorhabditis elegans] gb|AAC68740.2| Hypothetical prote
MEQQYGVFGSLFRSGTRTSFFASQVGVERYADLYAGSCLNLVHYPVFYFFRAPMALMPHESTVDHGAAIPDKGSRQNMD

SEQ ID NO: 149939 - protein, 45 aa, Heterodera glycines
  Coding regions on vcDNA: vcDNA=SeqID_76362; Strand=+; Position=1 -21,135-245,422-427
MSGNRIQNLPPFRPLFAMAKNPNTNKNYNALFEFVEKVDKPCDQR

SEQ ID NO: 149940 - protein, 111 aa, Heterodera glycines
  Coding regions on vcDNA: vcDNA=SeqID_76363; Strand=-; Position=1 -213,261-383
MHPTSCGIQSPEDYMSEYICADVPSMPDTRLQSAEEAKRMRELYKTITTKHTHTYSAQRYLVDGKCKKHFPKPFSYGYVYSENAYPCYLRRPPAPNETMRQKHPHCISEVE

SEQ ID NO: 149941 - protein, 64 aa, Heterodera glycines
  Coding regions on vcDNA: vcDNA=SeqID_76364; Strand=+; Position=1 -120,193-267
MTMRFMSFHPRENFSKRLHLTLVIFSNSPTLIIDLIRRVLGNSASEGLSNDTKNVEFGWQRKKL

SEQ ID NO: 149942 - protein, 46 aa, Heterodera glycines
  Coding regions on vcDNA: vcDNA=SeqID_76365; Strand=-; Position=1 -63,172-249
MTGKLSTYNFTKFMNNANTPRIYEYNIWVPSKVSKHDNKNAKKSGF

SEQ ID NO: 149943 - protein, 616 aa, Heterodera glycines
  Coding regions on vcDNA: vcDNA=SeqID_76366; Strand=-; Position=1-1851
MQQAAPVQHLQNDRNEQPQNIENRPINTANTGVAENSVNDGEILAHTMNYDQILHAVLNVGSANRQSGHGQDEENVENQDLAIHPNLTQQHGGLRMRFRRLPNLGENSERELWQAGNENNSGHHSHHILNRNFLRTSTPNNEHIIHELHIQHPRQNPPNIQANPNFVRQNLQKTVTDNQRQANPNVLIPPPQVIQQPIAVYPPVQPPIPETYWGYPAPYYPHPPPPMGYPNQQMFGNANTKVPQPTQIRHQSPTQINGQQTALNGLECVLILDKLPDIKGNEGNDSIKSFFKKFSQYTSDWPNKKRIDSLESKLSGRAERAFNSALANEPFIFENIKRHILQQLEATDCHEMAAFDELMQGIRRKPREGLDDLADRIVSLVRRAYPGLTRNLADEYSIKHLIRSFDNAELALSLELNRRPGMSFDEFVALAARAETTQNAARRANSDRTQQNFGRSQPHRQYDGPMAKQSTNAFEPNKFQRFNENRITCQSCGREGHVARNCFKRFADQDQRRYFGQNQNATGANRAQMATHSNPNVSQKSEQNQFEQRQQHQQSRNFLKKNFLVEQNEKQVESSNVQCDGVISNTPEMLDFFRKFWTKCDETVDDGQKEAFPIGK

SEQ ID NO: 149944 - protein, 21 aa, Heterodera glycines
  Coding regions on vcDNA: vcDNA=SeqID_76367; Strand=-; Position=1 -58,932-939
MVEPRHRSPALVIAGTPQPEI

SEQ ID NO: 149945 - protein, 249 aa, Heterodera glycines
  Coding regions on vcDNA: vcDNA=SeqID_76368; Strand=-; Position=1 -123,177-299,352-473,526-648,701-823,879-1016
RRGTVRTAGTSSSIAGTSTHPKHQHRGHGSQTTGTASASKRRRGTVRTAGTSSSIAGTSTHPKHQHRGHGSQTTGTASASKRRRGTVRTAGTSSSIAGTSTHPKHQLVDMDLKQPARHLLLSDAVALCALLERRLPLLALRHIRNTNIVDMDLKQPARHLLLSDAVALCALLERRLPLLALRHIRNTNIVDMDLKQLARHLLLSDAVAKKQKGTAKTQMSQAAAKTQMSQAVKSSMMSNSANMLIDKYL

SEQ ID NO: 149946 - protein, 123 aa, Heterodera glycines
  Coding regions on vcDNA: vcDNA=SeqID_76369; Strand=+; Position=1 -90,533-814
MTMDEEEEAAADADFVEDKNKQLILAKFIMLHLCRLLARSVRFTSAFSAWPRNRSDQSPILPPRGQTFQRTQMDIGHRIANSRERALVWQEANGNCQCQLKRLPIPQNPLPNKVIGFKHITFM

SEQ ID NO: 149947 - protein, 57 aa, Heterodera glycines
  Coding regions on vcDNA: vcDNA=SeqID_76370; Strand=+; Position=1 -20,721-855,1385-1403
MPFGKTKHSNFQLLTPINSSLQIVEYWTRHRHTSDTTQQGQLARTLRFGISLFLKPQ

SEQ ID NO: 149948 - protein, 116 aa, Heterodera glycines
  Coding regions on vcDNA: vcDNA=SeqID_76371; Strand=-; Position=1 -86,940-1204
MDSLRFASLNDYEKWAFSEAIYLAAETQSRKPNGLLEMSECDATIFRVLLEFVYGNIAKCMSELLKLDIDKRMEMVKAAKHFGMRRLDESAQKVTGEAITVEHFAKVYTFARVIST

SEQ ID NO: 149949 - protein, 220 aa, Heterodera glycines
  Coding regions on vcDNA: vcDNA=SeqID_76372; Strand=+; Position=1 -156,206-712
  Homolog annotation: Hit_ID=NP_702308.1; Match level="QueryCoverage =54%, HitCoverage=2%, E-value=1e-13, Identity=37%"; Hit description =hypothetical protein PF14_0419 [Plasmodium falciparum 3D7] gb|AAN37032.1| hypothetical protein [Plasmodium
MFFSSHLTALAPFGCPIAAPTNSVSSIAIAQFSGVHPKKSGNIFESIGTADDRHKRGDSTNDHQRKVGKQWEEGNRSGGEANEQPKKGGEKGIKSGKGKAKEKAKWKSQRKSQKEKPKERPKGKAKRKPKERPKEKPKEKPKGKAKRKSQRKSQKEKPKERPKGKALEKGQRMIINRKRASQKTTPPERCPRAELFSRVSEVRTIRPFSATVPMAVPFLY

SEQ ID NO: 149950 - protein, 133 aa, Heterodera glycines
  Coding regions on vcDNA: vcDNA=SeqID_76373; Strand=+; Position=1-402
MWQRIGQGVEQFRDRNGLGGEGSAMVQKVGKEKVENGGEEQRDLPMRGERMAPKEWHGEKRPSRQQWHQFESRSSTGERVRRLNASIGFDHSAIATALTDQRLFGRNVRRFSEHDESHAKQEKWAKTAEFGGE

SEQ ID NO: 149951 - protein, 70 aa, Heterodera glycines
  Coding regions on vcDNA: vcDNA=SeqID_76374; Strand=-; Position=1 -140,178-250
MLKQNVIDAKQKNEEFDGSSKKEKGRAKGEQSDQSFTRKMERSMRNCPGVEHERDLQHFFAQFATFGFLA

SEQ ID NO: 149952 - protein, 35 aa, Heterodera glycines
  Coding regions on vcDNA: vcDNA=SeqID_76375; Strand=+; Position=1-107
HCFFIQLVPLIGSSIAVTLQLGIGIDRLFGVMLPL

SEQ ID NO: 149953 - protein, 565 aa, Heterodera glycines
  Coding regions on vcDNA: vcDNA=SeqID_76376; Strand=-; Position=1 -106,616-2150,2237-2293
  Homolog annotation: Hit_ID=NP_510671.1; Match level="QueryCoverage =97%, HitCoverage=55%, E-value=3e-80, Identity=34%"; Hit description =predicted CDS, endonuclease/exonuclease/phosphatase family and RNA -directed DNA polymerase (XR69) [Caenor
MVSDPKRVLLMAKYVTIFSRRNPTKRIRILVFFDPETLNECIPMKKITKKDLTPKYPTHLLASIKEKARLYRQCKTDPTKKALYDSISLHIKIQTNKFHSQIEKKAISKGRNSIFKYLQKYDVNPFEIPNLVFENKCYHDGDEKCELLANLFANSFNNSDVDPGYLNLGNTFVNQCFISDIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLITVVEDWYEAIINGKNVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDDKLYICYKARTDTEIMHKALHNLFEWANKWQIKVSMQKTFVLYLGSKTPKETYKFDGNTINAVDTIRDLGVNIDNKLQFSDHINQITRNAYLRMRSLFRIIKSKSSKIWITLYKTYIRPLLEYAPEPSANSIPKSIRIPATANT

SEQ ID NO: 149954 - protein, 71 aa, Heterodera glycines
  Coding regions on vcDNA: vcDNA=SeqID_76377; Strand=-; Position=1 -139,300-376
MKASQFHFIVVDICHGINSESPGKCPQDEFTEEKTVKELSTNLAENAASNRQQSTSDAPTLPEILQPLLLC

SEQ ID NO: 149955 - protein, 461 aa, Heterodera glycines
  Coding regions on vcDNA: vcDNA=SeqID_76378; Strand=-; Position=1 -182,248-558,633-1525
MFLAHASDHFVTGPPACDHLVTVAPVSGLIIFVAYACDHLVTGPPASDHLLTGALASGHIISHACDHLLNGPPAGGHIMFLAHARDHFVTEPPACDHLVTVAPVSGLIIFVAYACDHLVTGPPASDHLLTGALASGHIMFVAHACDHLTTVTPANGYIMFLSHASGTHAVGRLMTGPHACDPLSFVLKPRRSARLRAPGYRPLFRVIFHQSSTTGDPAAERRKQQRRSSRRCRQRLLRRRLSTERQPFWRLLEHEWGEDERHRALEEDDWQLYGDQLATTRDVILADGRPLDDWIGHDETVDEWTPLDHSELKQLSDGVHRKADVGAEACPICMEPLVDQVLLCTGCCAQRFCSVCLWTHACQSRACPLCRRHMLTGESLTVDASGADDSNDDVDSIDDDHGGAEATVSPRQQQQHIRPPGRRRRHGPATEAGCSGYGTWGSPSSNSTEGSFVELSEWHDE

SEQ ID NO: 149956 - protein, 164 aa, Heterodera glycines
  Coding regions on vcDNA: vcDNA=SeqID_76379; Strand=-; Position=1 -265,336-398,442-608
MGTDKSIFGGRKLVLKFELEVTQLLTVKEWERHDRPSELARAQPRDRVQLNRLNVVTSKAGATVENTFLFSTTYGQFSTMNIIAHAGHEWTPTGSAPLPQNVLAIANFEDGTRVGTSGTATVNLAQQPQLQPRNEVDENEEDDDLFVFSDEVREVRGDQQTSVS

SEQ ID NO: 149957 - protein, 189 aa, Heterodera glycines
  Coding regions on vcDNA: vcDNA=SeqID_76380; Strand=+; Position=1 -187,770-1152
MAHKQPSNSNNVQVPSWDEFNLVQEEANSNRLSANGFENDQQEIGPIYEPGHAEEFGPNLPPEYDIGTSLPPDEPQCSMDLAKKVPEGTNIHRKPKSILERTNFGPTLPSSSDEEEEEKKEDKTEDGGNEHFGKGEGTDERRHDVGWEEGEEETVGPMPPMPGKTEEEGHAEYLGRLTEFEFNKHTQVI

SEQ ID NO: 149958 - protein, 252 aa, Heterodera glycines
  Coding regions on vcDNA: vcDNA=SeqID_76381; Strand=-; Position=1 -112,165-317,426-497,539-620,879-1142,2030-2054
  Homolog annotation: Hit_ID=CAE61215.1; Match level="QueryCoverage =99%, HitCoverage=63%, E-value=1e-61, Identity=51%"; Hit description =Hypothetical protein CBG05009 [Caenorhabditis briggsae]
FSSHLDRFDRNWRDDPFWRDLYPRWAEPIFKDGIDVKTNITTNITNDSNRFAVEMDTYQFRPEELQVKTMDDTLLIEGRHEDVRDRDNYTKMYFVRKYQLPADVESHSISSHIDSSGRLSVEAQKLAGRGREGRLSVEAQKLAGRGRERSIPIESGSRHATRSETGGIPRGGGPNGKATPPPPAQPFRPFSSRSGSAANVLPPAAYAAHRVAFERRGRRQRRQAKNAANRRTSAERLQPPRASIVWTRGALG

SEQ ID NO: 149959 - protein, 66 aa, Heterodera glycines
  Coding regions on vcDNA: vcDNA=SeqID_76382; Strand=-; Position=1-201
MLTNFIVFHAMWTSHSEQQEKTQLFDTYQRKKHKNNAKAANISQGIAEFASSSTTPTNSTKNELLL

SEQ ID NO: 149960 - protein, 41 aa, Heterodera glycines; identical to SEQ ID NO: 129572
  Coding regions on vcDNA: vcDNA=SeqID_76383; Strand=+; Position=1-163

SEQ ID NO: 149961 - protein, 187 aa, Heterodera glycines
  Coding regions on vcDNA: vcDNA=SeqID_76384; Strand=+; Position=1 -118,423-491,844-1062,1121-1277
  Homolog annotation: Hit_ID=NP_740922.1; Match level="QueryCoverage =51%, HitCoverage=9%, E-value=8e-13, Identity=41%"; Hit description =CEll Death abnormality CED-1, cell corpse receptor with EGF motifs (118.8 kD) (ced-1) [Caenorhabditis eleg
MASDVSRVAPRHFGASAVQKSAFVMRMVAFVTPTMAHAVVTANANVRLALKAICASVAVRNGLFATPDIWGNAAREVFSIFNAFEYKAKRAFCSACPAGTFGKECKQTCSKCSEGQICDPAVGCCSLNSGLCGIAYAEQQGVQRSSVSAYLLPGLLLLLVTSVTLIAFALYYRHKYQRARDPPLPTV

SEQ ID NO: 149962 - protein, 169 aa, Heterodera glycines
  Coding regions on vcDNA: vcDNA=SeqID_76385; Strand=-; Position=1 -284,376-601
QLRNNSEKCKMIKGFFFRQNYWDANVCHKNLEIIDDKSWTVHHKGKDYGIFEQFVINHFFSSKDWSSVFAKHPILLDNNSSNIFYYEISVKNKKGWVFFGFAFKQHIKLDWIIENIGTYAYENDGEILINKQRKGINAEHSNGVGDTVGIGVNSPLADHFTKNDLRLGW

SEQ ID NO: 149963 - protein, 106 aa, Heterodera glycines
  Coding regions on vcDNA: vcDNA=SeqID_76386; Strand=+; Position=1 -103,441-520,588-626,881-922,1249-1305
MMPMFFFFVFIFNCFFNNNGTFGGVCVSKYDPMINAVNYAKKTNTPGYQSPYYTPTRSPIKNGFPFNHREDLGQRDSFTPNDKEKVKEANRRHLGLSNVTNNVEFG

SEQ ID NO: 149964 - protein, 105 aa, Heterodera glycines
  Coding regions on vcDNA: vcDNA=SeqID_76387; Strand=+; Position=1 -108,222-350,550-630
MSLSHSGKFNSEQPEESRQESEEEEEETSSSLDAKKVLNFNHADQNGQYKEKNTVLDRTKEVTNLHYKLQIQFIRYNEKDCLTLDSPAVFEKIFVDERMTDVRKK

SEQ ID NO: 149965 - protein, 47 aa, Heterodera glycines
  Coding regions on vcDNA: vcDNA=SeqID_76388; Strand=+; Position=1 -40,483-586
MEKKALNKRKMPAAEDNACRFSKVKNSRTKAKRKKERDLASAVNELK

SEQ ID NO: 149966 - protein, 89 aa, Heterodera glycines
  Coding regions on vcDNA: vcDNA=SeqID_76389; Strand=+; Position=1-438
TILALPIPSTIAFIHHIMSAKIIRVPKIACDLSLEKNGLSKNRNYAQKASQTILALPIPSTIAFIHPIMSAKIIRVPKIACDLSLEKMV

SEQ ID NO: 149967 - protein, 58 aa, Heterodera glycines; identical to SEQ ID NO: 138265
  Coding regions on vcDNA: vcDNA=SeqID_76390; Strand=-; Position=1-230

SEQ ID NO: 149968 - protein, 338 aa, Heterodera glycines
  Coding regions on vcDNA: vcDNA=SeqID_76391; Strand=+; Position=1-1017
MEYTDLAVCDKRLMEGKHMTAQAKISDLSRVHDDVIGLEEGINRNLRAINRKVTQVVGRVSDIEADVNTGFGTTAARVDTLGEVVMGLESKFDTWKNELELRENMEFDELNRSSGVQKILSLGKQLTSPRPIFPPTPPPTQNAINSFGIFQSTSNVQNSNNTAGDPANGSMTNQSRLISINESGEEDDVDGNLNALTDMNTSSTQPGVFCGELASAFDDWEIKFRDYVDVFGSAWSEADKLNRLKLHLGAQARTIFENLSPNEKNNLANALKNIRSKLDSPHFRELAYKKLAACYQREGESVSEFVKRLVPLVHTTSVHIPSKARRGPLSVSHGESET

SEQ ID NO: 149969 - protein, 770 aa, Heterodera glycines
  Coding regions on vcDNA: vcDNA=SeqID_76392; Strand=+; Position=1 -2203,2832-2941
  Homolog annotation: Hit_ID=CAE56861.1; Match level="QueryCoverage =25%, HitCoverage=12%, E-value=3e-14, Identity=28%"; Hit description =Hypothetical protein CBG24691 [Caenorhabditis briggsae]
MGKIWLSDDGQLGLTFGNSSKLMDCGQNITISDQGFGSTIVQAPESHSRIVRSVKKSKTLSDGIVTSSQLASQLTYLDAAITQTMTFAFHHSFQSFCQFIEDNKRWAESAFFSNPTDLARSVFSNPYVVAKRAARTLLKVWPCVPLDENEYEFRPTKLKDECFEYLPIIIKAESRDHLAFVDPTTMIISPYSKKGSCEEFRRIVIQIKNQILEIDQIEGKITSATLSKIKANAPKLSITEFVPQIESHAFHQLVLLNLTDIKSHAFVSNMVRTSQMTYQIREKDTQITATVSQEWEEVENQMIKAVVGDYRKNWMIIISVIVLILAADFTIRFGLSLAEIYAGNGRLGNMLFGPAIQKAGKRVIEMQSIRRLNSERDELYEEPNNAASWPPRIRRTGNLLSQSLKRLNKHNPSRRATAKPENIFECSAIMGQIGALMQRPTTVTTQVALNGIRMKCLTDTGSSTSVAPKALAEWLGTKTYKAEARLMSASGHAVHVKEATRVNLRIGNESVNIVIHLFENDLSWTMKDYDFILGCDALALLPPITIDIKNASMYINDVCMPIGKSANNTLYGLKVCASQTVELSPNEQRVLKAEVRAPRTLRHDIIFENLDQRLGDQGIGLIPSISKLNSGQIQTVLTNPTATVKRIFKGTCLGRANEILATEHDSIYKEANHDETYQKLNSLGKSEVEIDPKFKINFEKSSVKGANLDTLKALCEEFGDIFSKSQYDLGNCVADPRFWSLFCGPGALQFFPIPVPKSFVINPPVMAFFL

SEQ ID NO: 149970 - protein, 392 aa, Heterodera glycines
  Coding regions on vcDNA: vcDNA=SeqID_76393; Strand=+; Position=1-1179
  Homolog annotation: Hit_ID=CAA82797.1; Match level="QueryCoverage =41%, HitCoverage=25%, E-value=8e-10, Identity=26%"; Hit description =gag protein [Ascaris lumbricoides]
MCNAIQSKETRALLMTTKATIFNPSRPSLSMMGTIFIDPGSHRSFISSSAAEQLDLNVLSTEECYLSSFGEREPKRYISDRVAIGILCPDQDRFIFNLNALKFLLNDLPVLQLNALDNDELQQKKLSLPNESRQPDILLGMDVWHQLNVQPIEQLPSGFTICQSKIGNIISGTGRIELKQPSNISFVLMVNNDESPQSSKAAQRQKNIQQKEKDELRRHQRNKLLSSIATLRSRRKRESAPISSKSIVIDLSSDSDASGIEIIQNPVRDRQAKSPNEHSTAPIPMAVQRLTPTRKSSSVAKRPAFSSSKQPKGKAANPAQTSQTNKLNRKMKALSPTASGSGANHHCVATLARSSDSTTVIDKGSQQNCPNMSSATISKTPCQQHSSEKTLN

SEQ ID NO: 149971 - protein, 198 aa, Heterodera glycines
  Coding regions on vcDNA: vcDNA=SeqID_76394; Strand=+; Position=1-597
MTSNKQRQLVHKDVKLRHQFKQKHSSMQLTARFRKQIHMSSTIEEVQQRMNHNRPQPRRSQQRGLRPTQAPKICQSGMAQYKQGRGIRLHTASSAMALTGPRRRLSEQPLQQEQGHESSTSPGRERRPRKSQLHAPDRVSTIWKLKSTENSPFCRPPPSLTAQWLNLAIELFAKNHQARADHLCMALLCKTHHEALLH

SEQ ID NO: 149972 - protein, 318 aa, Heterodera glycines
  Coding regions on vcDNA: vcDNA=SeqID_76395; Strand=+; Position=1-957
MAIHQECPFAKSEMTNHEAQLWSTNDELEVNFPGPITGLFKGEQISTATNCFAQPATLFNCQYATEFCQLPDNSTLIWKSTCNGNECQTCDYEKAEAINGKFTAAYGESMATWISEDHKKALTFAKNAPELIACDGTRIVMSEQNFGIARSNTTTLSAPRQDGNRHPTRTARITALGIPSGNKRCVESALHAGVSAKHESSQPNSPSQTLTTTAKRPGALDRRNDNGSVSMRQRFAPGHLLPTNERLPCLHPSDSAFPRPSDSSISGSRIAHHFFDGAIGKLQQSPFPSSSTAKQSEHLATDRLTNRDCASNAKGLHA

SEQ ID NO: 149973 - protein, 320 aa, Heterodera glycines
  Coding regions on vcDNA: vcDNA=SeqID_76396; Strand=+; Position=1 -398,704-892,1062-1187,1430-1638,1980-2033
  Homolog annotation: Hit_ID=CAE58521.1; Match level="QueryCoverage =95%, HitCoverage=17%, E-value=3e-69, Identity=38%"; Hit description =Hypothetical protein CBG01673 [Caenorhabditis briggsae]
FILQFFKIYFRFSFSTRDLVTLSELLANYFTVGIPLPMALFHAIEANVFDAVGVLPSRLSFDRRAVIDACIKQVYMKSNGVWIYTKFLFVGEFLSVLNQKIKLNSKHSQKNILLFSVQLKIPVSFIDLRLPVGFSLNAPATRRNALRVARALASTKPVMLEGSPGAGKSSLIVALAAATGHKLVRLNLSEQTDLHDLFGGDMPVTGPDGSASFTWRDGPVLKAIKEGCGILLDEMNLASQSVLEGLNSCFDVRKQIYIAELDRTFTLDCSRCKFFACQNPHQQGGDRRALPKSFLNRFISVAFLAPYEDFIYILCEFCKA

SEQ ID NO: 149974 - protein, 64 aa, Heterodera glycines
  Coding regions on vcDNA: vcDNA=SeqID_76397; Strand=+; Position=1 -135,192-253
TDPNYGTLKNLDADILTKNAPAKPAAAPKAGPAPHGGGGQALTPTTDPNYGTLQNLDAEIFVKK

SEQ ID NO: 149975 - protein, 74 aa, Heterodera glycines
  Coding regions on vcDNA: vcDNA=SeqID_76398; Strand=+; Position=1 -84,330-428,1178-1219
MSCLNVYVNIQSPYAEIDQDKAEVSPEEGTSAPPTNCPPAAAPPNYQLANPPLQHQAGTSQRKETPKKDSDGKN

SEQ ID NO: 149976 - protein, 48 aa, Heterodera glycines
  Coding regions on vcDNA: vcDNA=SeqID_76399; Strand=-; Position=1-174
VVVSIIVLLNDPNPDNSPLNAEAANLYRTDRAEFNRRAREMTLAYARR

SEQ ID NO: 149977 - protein, 147 aa, Heterodera glycines
  Coding regions on vcDNA: vcDNA=SeqID_76400; Strand=+; Position=1 -106,635-693,806-841,919-956,1402-1447,1513-1636
  Homolog annotation: Hit_ID=NP_493376.1; Match level="QueryCoverage =88%, HitCoverage=52%, E-value=3e-39, Identity=65%"; Hit description =RAB family member (24.0 kD) (rab-27) [Caenorhabditis elegans] dbj|BAD07035.1| Rab27 [Caenorhabditis elega
QQIIAQLISIVIPPWCPFPHFRDWLSQLKIHAYTETPDIILCGNKSDLENRRQVSTARAKQLADQLGLPYFETSALPYFETSACTSSNVEKSVDCLLDLVMQRIQMSVDGDNLIQMSVDGDNLPTEYMGGITLDEEVTSASYYCANC

SEQ ID NO: 149978 - protein, 21 aa, Heterodera glycines
  Coding regions on vcDNA: vcDNA=SeqID_76401; Strand=-; Position=1 -38,609-636
MATSCTGAKVTFRQTYSFNDE

SEQ ID NO: 149979 - protein, 94 aa, Heterodera glycines
  Coding regions on vcDNA: vcDNA=SeqID_76402; Strand=-; Position=1 -92,598-790
MYGLLASVCSAFLYALSASPLVIILFMVLDSVTVHAIAPLFNILFSEFIEDDKQRYARKCVIIRARTGPGPRRDFTGTPGPGFFGQTTGTGSPV

SEQ ID NO: 149980 - protein, 88 aa, Heterodera glycines
  Coding regions on vcDNA: vcDNA=SeqID_76403; Strand=+; Position=1-264
MDTTTINRILAGNTKTREHYLGCFPCDKLPSKINQFPSALVANNDPSNKEGSHWIAIFITDNSTAYYFDSFGRTPNRCISHFLRNYEK

SEQ ID NO: 149981 - protein, 243 aa, Heterodera glycines
  Coding regions on vcDNA: vcDNA=SeqID_76404; Strand=+; Position=1 -292,343-782
MFIVDDRTVYYFDSFGRKPNRCISQFLRNYEKVISNKPAIQSVFSENCGYYCIYFVHCMCSLGGRNYESNFEKMTKKLIGEDNPDLFVVNFVKKLIKNTIIASLLNCPARNLCDRLNHPDEIQKVEKYLKGKTLQTTYKNQLDEYKDFEYGGITRESARKQMAYNGFKNVTVDQHFYVRHRICLRYSSNPCVIEKHKNGNERFYPLELVKVKDNDIIYLGQNFPKPLIRDDNMFIDDQQYLNW

SEQ ID NO: 149982 - protein, 175 aa, Heterodera glycines
  Coding regions on vcDNA: vcDNA=SeqID_76405; Strand=-; Position=1 -67,279-739
  Homolog annotation: Hit_ID=CAB40395.1; Match level="QueryCoverage =99%, HitCoverage=69%, E-value=4e-32, Identity=40%"; Hit description =TATA binding protein of transcription factor IID [Guillardia theta] gb|AAK39780.1| TATA binding protein of
MQNPTSDILCLRQLLNCRLTFSSPSTKYNPRKIHAVIMKVYNPNATALIFSTGKFVCTGAANEKECRQAAEQVTERIRQCGYYEARIHEFAVKNLIATADAGFHIQLGPLSDFLGAKYCSFTPELFPGLVYRNKSPKVSIIVFSSGKLNITGSKSKTEIDSVFNKFYSLLCNFKH

SEQ ID NO: 149983 - protein, 26 aa, Heterodera glycines
  Coding regions on vcDNA: vcDNA=SeqID_76406; Strand=+; Position=1-79
CKSTPLYPMVYSLYTFSHSQLGMFPC

SEQ ID NO: 149984 - protein, 439 aa, Heterodera glycines
  misc_feature (393)..(393): Xaa can be any naturally occurring amino acid
  Coding regions on vcDNA: vcDNA=SeqID_76407; Strand=-; Position=1 -154,305-349,402-551,669-823,881-914,974-1099,1152-1214,1268 -1435,1538-1757,2223-2288
  Homolog annotation: Hit_ID=CAE63043.1; Match level="QueryCoverage =100%, HitCoverage=82%, E-value=2e-77, Identity=37%"; Hit description= Hypothetical protein CBG07310 [Caenorhabditis briggsae]
LNHHEFAVFEHCVFYFLANRAQQQAGSQGLIHPIASMPPTYNDVKKLRLSVSKITIQHFHLNEFMRNEFMRDLNIAGYLELRWHDERLTWDSQQFKVQQIKIASANHLWVPFLTGQGYETALRNDYENMEVRRVDVRNSGNVTAILGFKFTTFCDDTDFKHFPDDIYRCCFYLCCFYLEPMNQRSIVRLISDGQPVFTDSIVRLISDGQPVFTDPKYFRDYGWSLSGTVPLVYMDPSNVTQLNFCLNLQRSSSSLKLNFCLNLQRSSSSLKTELRIPAWSCGILFLFVPIFTNIAWSCGILFLFVPIFTNIRIQLITKLFLLLLQFFTLLLFTNRVSPQMGKNEIFTKPLQILELGVVLNVISIMCTFCVLALTKLRNNQPPWDFLIKFLRFXNHFILVEIFHGVFINLIYISIKKLKFSFRSDVGCFLAFHAVAIFAL

SEQ ID NO: 149985 - protein, 50 aa, Heterodera glycines
  Coding regions on vcDNA: vcDNA=SeqID_76408; Strand=+; Position=1 -79,209-282
MWAALRRLDELRLRNGSPESRLVVGHVKTCNIFEEFFALNGIDSAVQPKK

SEQ ID NO: 149986 - protein, 77 aa, Heterodera glycines
  Coding regions on vcDNA: vcDNA=SeqID_76409; Strand=-; Position=1-233
MASFSPVFIAILIIIYTSAVGAQFGQFGSLLNGFGGANGGANLMNGMAANSRNFANMGSSFGGMINQFKGMGRNFKR

SEQ ID NO: 149987 - protein, 111 aa, Heterodera glycines
  Coding regions on vcDNA: vcDNA=SeqID_76410; Strand=-; Position=1 -334,422-529,664-766,853-929
  Homolog annotation: Hit_ID=NP_501562.1; Match level="QueryCoverage =80%, HitCoverage=28%, E-value=1e-14, Identity=42%"; Hit description =UDP n-acetylglucosamine transporter like (35.5 kD) (4J751) [Caenorhabditis elegans] emb|CAA92454.1| Hypot
RAVPAAQSVSKCTANKIGSSFSLFSFASFVFMALVTLAEHPEFLRRRRIPLRAYLQIVGIFFVVSLLNNRVLGFGLPFPLIIVFRSSTLLANVLLSWLLQNRTFSPARLFS

SEQ ID NO: 149988 - protein, 88 aa, Heterodera glycines
  Coding regions on vcDNA: vcDNA=SeqID_76411; Strand=+; Position=1 -142,682-806
MSVQKLVVALLSIPCAAFARGTFAAEQRKKRNANANQQNGEKSGGGKAINCRPPDTHLFAVHFDTDCAAGTARQRPKDGRHWNWALMR

SEQ ID NO: 149989 - protein, 105 aa, Heterodera glycines
  Coding regions on vcDNA: vcDNA=SeqID_76412; Strand=+; Position=1 -49,151-291,521-648
MKLILLIIVLIECFSSAHFLICRAGAFGTVDQPFVRKKPTNFSGICDPPFKFCGKEVCFRDGKAEDYLTNYTCAIETAFAALCPFWQCSSAKQKATETKKTVKRR

SEQ ID NO: 149990 - protein, 371 aa, Heterodera glycines
  Coding regions on vcDNA: vcDNA=SeqID_76413; Strand=-; Position=1 -25,139-247,291-1269
  Homolog annotation: Hit_ID=XP_346518.1; Match level="QueryCoverage =56%, HitCoverage=15%, E-value=2e-13, Identity=24%"; Hit description =hypothetical protein XP_346517 [Rattus norvegicus]
MIAAEKAEVPNFSTALPMPIVPINQPPKQTLLFPHFFEDITAQEKNVSIETPVDYDDSDEGEENNLKRSDETATPKQMPTMEMTTMAQRQMMEVPTMEMPIIAVPKMEVPTTEMPKIMVSTLEMRTMAQRQMIEVPTTGMPTIVVPNKAQIPTVAVPTTALIQTVHTLHFATDEQTQIDQRREEEQREEEEEEQQNIDEELQKEEKRTETTKTAHLIVPKTEEEQNVEEKGQQKQQIEEPNAEEVAEQSDGQQGQQTVPATQPSVEEETSQPKVREEQQQQQHEQKAQTETIALVKALQTPPKRVAQETATTELENAPQHAQAVRPPSEEATKAPINGQKSMHQSSAEKEVPSPSGGQAAHPPSATPPFRA

SEQ ID NO: 149991 - protein, 146 aa, Heterodera glycines
  Coding regions on vcDNA: vcDNA=SeqID_76414; Strand=-; Position=1 -196,265-509
  Homolog annotation: Hit_ID=CAE64412.1; Match level="QueryCoverage =97%, HitCoverage=9%, E-value=5e-10, Identity=31%"; Hit description =Hypothetical protein CBG09105 [Caenorhabditis briggsae]
MSTSMELLQKQQGEEKEEEEKGTTAKMRKVSRQTADTTTAKAKVPTTATAQTEEREPPGISPQPPGFSPIATSSSSTTTTPTAKMERTSKGLAGEEEEREGEEEEENGEEKSEREEEKREREGKKSGRKKGDEEEKRDGGKETKYW

SEQ ID NO: 149992 - protein, 252 aa, Heterodera glycines
  Coding regions on vcDNA: vcDNA=SeqID_76415; Strand=+; Position=1 -47,115-390,446-881
  Homolog annotation: Hit_ID=AAL78214.1; Match level="QueryCoverage =58%, HitCoverage=77%, E-value=2e-10, Identity=26%"; Hit description =putative esophageal gland cell protein Hgg-20 [Heterodera glycines]
MSDNCKEVEEKMAKAIFISADCWLCVFDLLTPSQLGLGISMISHRFDFYVDEHFKSRKWSLDSMAIWRTIGENGTNEMEIFNSDGKPLPIPQVQMPRKVIGFERIDICFINRNAIAFLHRFRQLFAACQINLTIHPTSDRISEFILRNIWPIFGENICGIFLLSDVFRRLRKLVPSFLYDFPSLRVVNLCDADLFIEFPADDNAMASDGQAVAKWLFTPRPDNVPKVFTCLFHEDYGNWSSKIEAFKAVLTN

SEQ ID NO: 149993 - protein, 30 aa, Heterodera glycines
  Coding regions on vcDNA: vcDNA=SeqID_76416; Strand=-; Position=1-94
LDFLIFLFLAASIFYNNLSVWSDVRQTEKI

SEQ ID NO: 149994 - protein, 242 aa, Heterodera glycines
  Coding regions on vcDNA: vcDNA=SeqID_76417; Strand=-; Position=1 -258,345-586,851-1079
MKLQCPLLPLFFIQIFFQFLADKSIGIPSYQWDSADSVQNVHKFVQFINDIYTDYDHTGQDYSVEQKRIIFNLTFVKYAAEIATFRVLDNIIGEGEAMPNLNVIRADDAVNEFLGLLHYDQKLGHHIAKAYNETVFCADKDQISKKVVNQILQLTFSLAIRIVLSVIIFPFQIIRIDSEEKKHFWSEIDSEEKKHFLSEIDSEEKKHFLSEIDSEEKKHFLSEIDSDSAREPQFIGGIKNGI

SEQ ID NO: 149995 - protein, 68 aa, Heterodera glycines
  Coding regions on vcDNA: vcDNA=SeqID_76418; Strand=-; Position=1 -110,359-455
MAIKLFSNGPYLDLYLEFYLLFHFKFRQQIKFATKDCSQLLRKCVVLFFRRLFILSTNKHYSIFLFVL

SEQ ID NO: 149996 - protein, 298 aa, Heterodera glycines
  Coding regions on vcDNA: vcDNA=SeqID_76419; Strand=+; Position=1 -105,149-230,305-432,486-817,1035-1284
  Homolog annotation: Hit_ID=NP_500864.1; Match level="QueryCoverage =51%, HitCoverage=46%, E-value=6e-12, Identity=26%"; Hit description =putative protein family member (4G558) [Caenorhabditis elegans] pir||T15727 hypothetical protein C31H1.5
MTVLLFLICLLIAMFAMQSMAKSVPKARDSEIIDYEEWNCGATDFEKPLSHQLAKEDCPKRMFEADLCCRVHDMCYMEEQKSREQCDEAFCYCLQRTVAQNANQTTNGCAGVSTSFCEIVKIFGGIAYLSSQELRTKQQKAMAKFEEKEKQRKTMEMSSSTTPKPTTESTKPSSTDRASSITQTEQTISSSTIQTAQATSSSTASKPTNDTTPMPNAVLLHPSIAPLRLRAAQPTEVGLIRRRLRGRFFAQRSIGRVFLPILRLLVGGECPRSVGKRAAAAAGRRAVRAKLGTNLLTI

SEQ ID NO: 149997 - protein, 101 aa, Heterodera glycines
  Coding regions on vcDNA: vcDNA=SeqID_76420; Strand=+; Position=1 -103,170-372
  Homolog annotation: Hit_ID=1010166B; Match level="QueryCoverage=50%, HitCoverage=73%, E-value=1e-12, Identity=67%"; Hit description =oothecin,juvenile hormone regulated
MLSTKLFVASCLLTVFLFNCLLVGQTQAYWWPYYGSSYGSMGGYGGMGGYGGMGGYGGMGYGGMGYGSGLGYGGMGYGGMGVGKREAAFVASPPAPPPKGQ

SEQ ID NO: 149998 - protein, 74 aa, Heterodera glycines
  Coding regions on vcDNA: vcDNA=SeqID_76421; Strand=+; Position=1-225
MASFCHTFGVGFAAAFAAVAAVSRASVEVTVVVIVGRTVVSVVVTVTVIGGGVVSLILLLIVEEIVENLVNSSN

SEQ ID NO: 149999 - protein, 701 aa, Heterodera glycines
  Coding regions on vcDNA: vcDNA=SeqID_76422; Strand=-; Position=1-2106
  Homolog annotation: Hit_ID=NP_704325.1; Match level="QueryCoverage =85%, HitCoverage=48%, E-value=4e-12, Identity=20%"; Hit description =hypothetical protein [Plasmodium falciparum 3D7] emb|CAD51144.1| hypothetical protein [Plasmodium falcipa
MESTGFQQRYNFRVRRPINYMEQEESSHSRHSRRNGTEQNNGLNLAPQNILDNVQNPNPFPRNFENSIPQQVGVQQNVEEQMQLAVFRPPNQNVAQSFGNPRAHSTPQNGSPHISYNGGQQNFEQNQNRNPDANRFGNEIHGQNMQFHRRQNPRIFVNSQMTNNHQFSALNFEQNRELRAQPVRHAHNFGYEEMLGEQNQNFPNPNYGREIGVNHPIQNTRDFGNGPNFQNFHPVRNINQPNYQQRPNPNFENLAPQPNHFPNVQNFEFVPQQNFQQNQIPDIVMELHKVTLSNQYANTLREIPNLYGTEGRDKIKDFFLNVQMCAGEWRPEKQKELLQTKLKGKALKAYHIALNKFGNEATFGILKTEIMSILRETDYKEANAFSELTQNGKRKPNEDIIKFGERIQRLVNCSYIGLDENQLDEVSKKHFISNINDVNLARFLECQTKANQTFDELLMMANRLSLIEDGKNRERNESVGIPVQFQQTGPQQNRTVPFQNPNYGQRFERNFPNFGMGAQNNFRPNRQSGFKNQTFQQENRNYCPNKNFDHFQNQNLVPYQTYGPKNQWVSDPQNGFQNDIFYESNPNSRPSQRFVHFQNQNSDHQQDVNDHKIEAISANRTQFDSNQQSNPMATQNMELNMIKVKGKGTEKCEKKSVKISHIEHSEPPAYEKFFNSLIAHSLNFPLTNRHKYQIQNVFVLE

SEQ ID NO: 150000 - protein, 27 aa, Heterodera glycines
  Coding regions on vcDNA: vcDNA=SeqID_76423; Strand=+; Position=1 -9,220-294
MEVICSIGLTKAMPLDGWTKTMAIFDK

SEQ ID NO: 150001 - protein, 133 aa, Heterodera glycines
  Coding regions on vcDNA: vcDNA=SeqID_76424; Strand=-; Position=1 -53,149-239,328-585
MIRRKFWKKSVKWRSSENTADQFSKIQNDQKKIGEKISALEQEPKQRKASSNFRQNYWDANVCHENLKIIGNKSLNVHYKRMSFGFAVKQQNKLDGTIRNEKGTYAFDSDGKIWINGKEKEQIVNIPTVKVIL

SEQ ID NO: 150002 - protein, 17 aa, Heterodera glycines
  Coding regions on vcDNA: vcDNA=SeqID_76425; Strand=-; Position=1 -27,200-226
MNCRITTNRLLYCSQVM

SEQ ID NO: 150003 - protein, 214 aa, Heterodera glycines
  Coding regions on vcDNA: vcDNA=SeqID_76426; Strand=+; Position=1-642
  Homolog annotation: Hit_ID=NP_989541.1; Match level="QueryCoverage =96%, HitCoverage=14%, E-value=1e-12, Identity=32%"; Hit description =diaphanous homolog 2 [Gallus gallus] dbj|BAB20321.1| diaphanous homologue [Gallus gallus]
MSGSLNAISPCPYISGSLNAISPCPYMSGSLNVIFPCPYMSGSLNAISPCPYMSGSLNVISPCPYMSGSLNVISPCPYMSGSLNVISPCPYMSGSLNAISPCPYISGSLNAISPCPYMSGSLNVISPCPYMSGSLNAISPCPYMSGSLNVISPCPYMSGSLNVISPCPYMSGSLNMISPCPYMSGSLNVISPCPYMSGSLNVISPCPYMSGSLN

SEQ ID NO: 150004 - protein, 598 aa, Heterodera glycines
  Coding regions on vcDNA: vcDNA=SeqID_76427; Strand=+; Position=1-1797
  Homolog annotation: Hit_ID=NP_002448.1; Match level="QueryCoverage =51%, HitCoverage=58%, E-value=6e-38, Identity=34%"; Hit description =mucin 2 [Homo sapiens] gb|AAB95295.1| mucin [Homo sapiens] sp|Q02817|MUC2_HUMAN Mucin 2 precursor (Intest
MGKKRVNTPKIRPNKKPNTRRGQIAAEITTITTTTAIPPIISPSTTVIPPTARTITTAIPPTTRTITTAMPPITRPSTTVIPPTTRTITTAMPPITRPSTTVIPPTTRTITTAMPPITRPSTTVIPPTTRTITTAIPPITRPSTTVIPPTTRTITTAIPPITRPSTTVIPPTTRTITTAIPPITRPSTTVIPPTTRTSTTAIPPITRPSTTVIPPTTRTTTTAIPPIISPSTTTIPPVTRPSTTVIPPITRVKTEEIPNITIETIEKLIKRLEKMTGIRENRVKPTPFLMPEDVEEESPTTVVSKRDAPEEDSEKWWQQRNLDHENSRLNYLGWRSHLTNLQNSRDKWFSDCNERKNALAVAKALARQMPEDAARSLYRRDDITAFWAKSTALNPMWTITLCKQIKAENILWDQKVGNKCYRELPIIASKEVLFVKVGTRDLKKEGKEIQCNNDGSNPWASNFNVTTEGLQPSMEHRFAPEQFTNRQNPFLFFTKGSIFESEQLRLEQSLKDMSNRMTRPELDFTDVGLMNINITEEHGDSVAGIFSIGEILVENAQVEGEKLRKKAEETIERGKAWIEDPIGIIKYIKWTGITIVTI

SEQ ID NO: 150005 - protein, 46 aa, Heterodera glycines
  Coding regions on vcDNA: vcDNA=SeqID_76428; Strand=+; Position=1-138
MNRQHGELDYVGQHLANFQNKISLTMSNVPMHEAVLAARVLSSVQT

SEQ ID NO: 150006 - protein, 42 aa, Heterodera glycines; identical to SEQ ID NO: 130888
  Coding regions on vcDNA: vcDNA=SeqID_76429; Strand=-; Position=1-128

SEQ ID NO: 150007 - protein, 134 aa, Heterodera glycines
  Coding regions on vcDNA: vcDNA=SeqID_76430; Strand=+; Position=1 -63,579-703,769-871,939-1035
  Homolog annotation: Hit_ID=CAC86663.1; Match level="QueryCoverage =97%, HitCoverage=41%, E-value=5e-28, Identity=48%"; Hit description =Six2 protein [Platynereis dumerilii]
LEKNEAVLKAKKVIDLHKDNFNELYAFLGTHKFARQTHPKLQKIWWDVHFFEVEKTQGNLSALEKYKVREKYPLPPTIWDGQRKNGFFSENTMTLLMTLLNEQFAESQYLPPPDIWALAEATGLSETQVGNRDV

SEQ ID NO: 150008 - protein, 22 aa, Heterodera glycines
  Coding regions on vcDNA: vcDNA=SeqID_76431; Strand=-; Position=1-67
GRLFFNILRKGDIIGDRAFNGD

SEQ ID NO: 150009 - protein, 53 aa, Heterodera glycines
  Coding regions on vcDNA: vcDNA=SeqID_76432; Strand=-; Position=1 -35,362-488
MAVLRGTAISGRSATPEWAQVPPIAGMTWPSTSLFVIVPSISEMTNLSYHLSK

SEQ ID NO: 150010 - protein, 171 aa, Heterodera glycines
  Coding regions on vcDNA: vcDNA=SeqID_76433; Strand=-; Position=1-516
MSVANGNTNALMRILLNISLCAPHNEWPTERSHAQFLSTFWQWTEKAVELGEEKVEIKGHTAIWGMQFDQIDQKGDALIANGLGGGKVEKAEAMGKAKGQNGVGREGTKLAEKGATKCGFEKGLKTYSKTELIRVRSVEQRRTRGASAEQRRDSSTTRQMQWSVKKANQRN

SEQ ID NO: 150011 - protein, 25 aa, Heterodera glycines
  Coding regions on vcDNA: vcDNA=SeqID_76434; Strand=+; Position=1 -66,417-428
MLKCLCILSELLGIRRGTIERVKML

SEQ ID NO: 150012 - protein, 225 aa, Heterodera glycines
  Coding regions on vcDNA: vcDNA=SeqID_76435; Strand=+; Position=1 -173,482-573,632-795,905-1153
  Homolog annotation: Hit_ID=CAE58931.1; Match level="QueryCoverage =98%, HitCoverage=14%, E-value=8e-65, Identity=56%"; Hit description =Hypothetical protein CBG02196 [Caenorhabditis briggsae]
MAGCQKKSSPVVAIVGPAKSSTTIAVQNLLQVFRIPQIGYSATTTDLSDKEQFGYYLRVVPSDAWQAMAINQLLMHFNWTYIAVVYSAGNYGEKGFEAMERLTRNGGSEVCIAHAQKVKSLGEPTEYRNALLALNRLTPRPQVIVCFCEGMALKRMFLAQKALRQEAATEAAEGTENGNNTTKSRVKGRRKLRQQQQQQQYHHQNVNAFQWIGSDGWADRLDVVR

SEQ ID NO: 150013 - protein, 585 aa, Heterodera glycines
  Coding regions on vcDNA: vcDNA=SeqID_76436; Strand=+; Position=1 -1114,1854-1964,2037-2123,2168-2332,2390-2670
  Homolog annotation: Hit_ID=NP_502721.1; Match level="QueryCoverage =67%, HitCoverage=29%, E-value=5e-55, Identity=35%"; Hit description =endonuclease/exonuclease/phosphatase family and RNA-directed DNA polymerase (4O953) [Caenorhabditis elega
MTAQIPEIWKKSIICPVPKIQNPVNPVDFRPISLLCSVSKILEENIAGKIKNFVEKNNLLPNCQHGFRKAHSVTTQLLEVVDDFSFALENKKSIDVIYFDLAKAFDTVPHNRLISKLKSIGINNSLLKWIQNYLENRKFFVKIGSDFSDEYPCLSGVPQGSILGPLLFLIYIYDLPKFCETENVKIKLFADDLKAYHVLSNISFSPLQNFINKFNRYCKLNGLKIASNKCLTLHLGHKNQKINYFIDDFQIPKNPGNEPVRDLGIYFTNDLKWAQHIDIISKKALRSAFAILKSIKTRDTKILVNLFNIYCRPILEFGSPIFNPYLKKDIEKLENVQKTFLRVIFRRNNYTVDLPNYAELLNIYDQKSLESPKNGLDAQKKRKFKEYEQFWCRRKTKTEGMAPGSGSQCPRQTTKAPSTTGEGTSTETMPSTSNAEPRQRPSPRPLSTTPIRRHVRTRPTTTDQTTGTDFRATVQSTQTVLETADGATQTETEQGPIQRLCTELNKAKRRIGTLERQLQKKTEEVNLLKKRPAVENKGKLKRVSSLDDLSRRSRTKRAKEIARNLSHLFRPGRLLPNSYFYNMFD

SEQ ID NO: 150014 - protein, 287 aa, Heterodera glycines
  misc_feature (10)..(10): Xaa can be any naturally occurring amino acid
  Coding regions on vcDNA: vcDNA=SeqID_76437; Strand=+; Position=1 -96,1059-1216,1423-1590,1650-1893,1949-2073
  Homolog annotation: Hit_ID=NP_543138.1; Match level="QueryCoverage =91%, HitCoverage=90%, E-value=1e-77, Identity=53%"; Hit description =SPRY domain-containing SOCS box protein SSB-4 [Homo sapiens] dbj|BAB71165.1| unnamed protein product [Hom
TISEVNHSLXLVRGLSPLTERVEIGGQPGGPFKLDAILGKSELPIEKIENHAWNPEDRSLNLYDVLTMHRHPVAQSTDGMREKVGYTRGFHVWQLNWPVNQRGTHAVVGVATKDAPLHAPGYVSLIGADAEGFGWNIGGNKCYHDAQNTKPWSFNKCYHDAQNTKPWSFPYEQPFVAPEKLFCVLDMDEGQLAFATDSKYLGVAFRGLKGKKLYPAVSAVWGHCEITLRYLGGLDPEPRQLMDICREPRQLMDICRRSIRLSVGKARIERISELNLPPSLRHYLLYK

SEQ ID NO: 150015 - protein, 200 aa, Heterodera glycines
  Coding regions on vcDNA: vcDNA=SeqID_76438; Strand=-; Position=1 -441,870-1031
MGNGSNLNELTSVVSVENETITNLEEEADLIIKAFGADFEEKNARQCPGCGVKKTNRTREYHFCKIPSHCRKSTRRKLAVTMYAVPICNATRGSVGVAARTTSAGCIFWVNGVTHRFGNNSDCPILVKRCKPGYEDILKALYPLKFFISMLFEFAEYITSFFGYGDWFGSYKRAEEGRRAERARNRLHRLEQRKRRIKTP

SEQ ID NO: 150016 - protein, 204 aa, Heterodera glycines
  Coding regions on vcDNA: vcDNA=SeqID_76439; Strand=+; Position=1 -199,457-598,924-1062,1586-1741
  Homolog annotation: Hit_ID=NP_506859.2; Match level="QueryCoverage =92%, HitCoverage=6%, E-value=4e-55, Identity=56%"; Hit description =speract/scavenger receptor (5P989) [Caenorhabditis elegans] emb|CAB03852.2| Hypothetical protein C06B8.7 [
YKLIYNLHLINENPLRGETLKGNGMGFLMEPCVNTELVINSNKFHGIQNVALLVRNARWPHLSALPARVQIAKNDIKMNTAQFIVSIGLNEDAPEQSLVFNQQNEVRGNTVLNPFPFLKPRSTPYAALVVSSSNVLIRHNCFRNQNADFEIGTELMEHAKRIDARENNWGDPQAHNFMHRIFDQFNRYSLATIEATNFQLKLNK

SEQ ID NO: 150017 - protein, 287 aa, Heterodera glycines
  Coding regions on vcDNA: vcDNA=SeqID_76440; Strand=+; Position=1 -180,558-647,698-856,1403-1593,2233-2451
  Homolog annotation: Hit_ID=NP_506859.2; Match level="QueryCoverage =100%, HitCoverage=8%, E-value=3e-88, Identity=56%"; Hit description =speract/scavenger receptor (5P989) [Caenorhabditis elegans] emb|CAB03852.2| Hypothetical protein C06B8.7
RKNIIFIKINPYAAVCNQRAPALTFLQQFFRQFRHQNSPFLVGGTVFENNDLPAGKYIVQDDLHITPGAKLTLAPGTTLEFMSGIGMLVQGELLRNDGELLRNDISSAGPFLPIVFTGKALGRNLPKLEHVRLVDEFGDENVLAGRLEVRPDGQWGTVCNRSWTAHHAQLVCNQLGLTMDPQHFENWRIFPSHGQFPIVMDNIRCEEREWDITKCRHDGALHNVRSSCRPTEVVGLRCAPPYWAGVRYSLLANPPTMTGQPTMSNWVLEKAGLFDFRTSTFSPALQV

SEQ ID NO: 150018 - protein, 360 aa, Heterodera glycines
  Coding regions on vcDNA: vcDNA=SeqID_76441; Strand=+; Position=1 -904,956-1134
  Homolog annotation: Hit_ID=EAL51907.1; Match level="QueryCoverage =96%, HitCoverage=32%, E-value=2e-11, Identity=23%"; Hit description =Viral A-type inclusion protein repeat, putative [Entamoeba histolytica HM-1:IMSS]
MKIKIFLFILFLKNLNKIYAGGIKEEKSFDEIFGQRWEENEEENLENETDQNGRIEQMDGQNEAKNDQIFDEHFEVKEKDSEEMSTNGEELEQMSRNIEEICDQNRIFNEKQKREIVEKFHKIKEKIMQMEKKYSRKEWKKIERKIAKKLGENRKKIYKWKREFGMMKNKNYSVEEKRIMLKQFDQIYGKLKTKLNGKLEGKRTKCQKIIAKHLGTNIKTIFYWKKQLKDGKLIKNQNKDEQKREIVEKYFKIKIKFMQNGKHSRKEWEEFRAEIKQNFRVAYTAIEKWAEKLKINQNISKKRNMLSIAEKMEKIKKYYQIKKQNPNLSDIKIADILNIPTSSLRKYKAEFGIKPKNKLL

SEQ ID NO: 150019 - protein, 147 aa, Heterodera glycines
  Coding regions on vcDNA: vcDNA=SeqID_76442; Strand=+; Position=1 -23,277-697
MSKYGKKKNLKIKIIFLILIFINAIGNIYARKINDEKNFDEIFGQKWDEKLEENGENETDQNVIIGQTDGQNEANYGENISRFNQIFDGNLEMKEEIATIYDSLEQMHFSNAIDKTKREIIEKFNKIKEKIMQMEKKYSRKEWTKIE

SEQ ID NO: 150020 - protein, 107 aa, Heterodera glycines
  Coding regions on vcDNA: vcDNA=SeqID_76443; Strand=+; Position=1 -145,815-993
MKYLAWDEKSEENGGNETDQNGTIGQKDGQNVTKNDQIFDENLEMKEEKRKMLSIDEKMEVIKQYYQIKEQNPKFKEYEIAAKLGIPMSSLDKYKTKYGNESKNKLL

SEQ ID NO: 150021 - protein, 75 aa, Heterodera glycines
  Coding regions on vcDNA: vcDNA=SeqID_76444; Strand=+; Position=1-226
MVKKLRGTMMPTMNKHKAVVVDVEKKTVVSSRYYCCVKNDPFLPLFGKKLEKIHKKNLTLCTLFYHLWSKEFSGK

SEQ ID NO: 150022 - protein, 153 aa, Heterodera glycines
  Coding regions on vcDNA: vcDNA=SeqID_76445; Strand=-; Position=1 -78,570-750,811-950,4018-4060
  Homolog annotation: Hit_ID=NP_506859.2; Match level="QueryCoverage =99%, HitCoverage=4%, E-value=1e-61, Identity=68%"; Hit description =speract/scavenger receptor (5P989) [Caenorhabditis elegans] emb|CAB03852.2| Hypothetical protein C06B8.7 [
QLVYDSKLPELRLIDGPTVRQGRLQIRFRDRWRSVCTQMTNWTSIDTGTACRTMGYDDGAFWRFFRRNNDTYPFEMPAPKCTQRQNSLWNCPGSLWNCPGFEDKEQIPLSENLCQGEDDIGIYCWGRPTFTGWARHWKGCSWLASSFHAVSSP

SEQ ID NO: 150023 - protein, 40 aa, Heterodera glycines
  Coding regions on vcDNA: vcDNA=SeqID_76446; Strand=+; Position=1 -4,629-747
MEICLQTALPDPWDRQLAVILAICYRTPAALGAIWSIYCC

SEQ ID NO: 150024 - protein, 39 aa, Heterodera glycines
  Coding regions on vcDNA: vcDNA=SeqID_76447; Strand=+; Position=1-118
MELTPESDKNSEKEKLKKSKLAELQFEEFGFTCNGLTKM

SEQ ID NO: 150025 - protein, 182 aa, Heterodera glycines
  Coding regions on vcDNA: vcDNA=SeqID_76448; Strand=+; Position=1-546
MDEFYVVLRSNSPGPGNSTSKFTVRLPHTLELDANWMVALSSIIYPYSFPSVGIDDDDFISIKLVNPNFTFADDKRFVDIELKIPSMQFSSVGHLRQTLNDIIKDAYKQRFGLSPQKAAGTTVKAKRQIDVTDLFFHDHPGDYWEKIEELEKKLAELKEEIATKEREHGAKGTEQKRKRNLK

SEQ ID NO: 150026 - protein, 38 aa, Heterodera glycines
  Coding regions on vcDNA: vcDNA=SeqID_76449; Strand=+; Position=1 -28,473-561
MVKHNGKNSGFCSVFGKMSIPNGSFFYYEVTILHKHYE

SEQ ID NO: 150027 - protein, 78 aa, Heterodera glycines
  Coding regions on vcDNA: vcDNA=SeqID_76450; Strand=+; Position=1 -168,223-291
MLYELFGIVHSFRSHLNKLFLECVLVGEVPKNWSDNSLFALFGAALNGQIETLKILSESNDVNLRMGQLKTAGGTIGD

SEQ ID NO: 150028 - protein, 159 aa, Heterodera glycines
  Coding regions on vcDNA: vcDNA=SeqID_76451; Strand=+; Position=1 -280,540-608,649-740,784-822
LNAALEEGYRVTELLRVLEYSKSDNELFRPYMSEFVVQKLHASGFDQNIRGNLEAEEQFIAECCEQFGMKIYRNKMMPNKGKRALAKLAVNNLSRLHLLKAMQKVVRTPGCVLLYTDTDSLIYAHPTGKNPLSTGPHLGQFTDEFPEHDILEFVSGGSK

SEQ ID NO: 150029 - protein, 175 aa, Heterodera glycines
  Coding regions on vcDNA: vcDNA=SeqID_76452; Strand=-; Position=1-528
MLLTEKIAQILNCRVSELRDRLNHPSDFEHVVKALKGCHVQTTYKDRNGFTKSFAFGGITPQGASTTMAYGRLGRPFNVNVTAHFYVRHRIKLRHPFLHCVIERFPEGQEDRFYPLELCKINAGQIEPGWLGRIFTETGSDNNNNINTDENASTETSLISSGRQECSQSDGYSLW

SEQ ID NO: 150030 - protein, 120 aa, Heterodera glycines
  Coding regions on vcDNA: vcDNA=SeqID_76453; Strand=+; Position=1 -55,99-253,298-450
MPTPPHDNKIYKKSEYLKVDDADEVDTDPSPEEVEKWTPEQVIEWDQRSYGKMPAEEEIWQEFLDKGEANVLREFFGGEGALKVEKSLREYAKKKEQRDEILMRKRKEYEEKMENNKGEN

SEQ ID NO: 150031 - protein, 31 aa, Heterodera glycines
  Coding regions on vcDNA: vcDNA=SeqID_76454; Strand=-; Position=1 -55,197-237
MAGLISELQGNDGRNGQKGKCEKISSLRRVA

SEQ ID NO: 150032 - protein, 213 aa, Heterodera glycines
  Coding regions on vcDNA: vcDNA=SeqID_76455; Strand=-; Position=1 -77,557-852,902-1095,1145-1217
  Homolog annotation: Hit_ID=XP_311206.1; Match level="QueryCoverage =62%, HitCoverage=34%, E-value=1e-33, Identity=53%"; Hit description =ENSANGP00000019078 [Anopheles gambiae] gb|EAA06830.2| ENSANGP00000019078 [Anopheles gambiae str. PEST]
MSANLSNDSEFCTGTHALPRNSFQIRQNRAPIRHRSQIWIGMKWTLPLWQRAASTRPAQFGTLRWQISTGSNYANAFPPKTNQPIGQAPSIKGLQKTQLIAHEKPVHDIAFTRLDNGRDQFATAGADGSIRLFGLVVISATLTLVFEDLRALQHSTILYEDAERRMLNHLSWNKRDPTKLATVAQESKEVVILDVRVPCRPMAKFGNHRAAIN

SEQ ID NO: 150033 - protein, 121 aa, Heterodera glycines
  Coding regions on vcDNA: vcDNA=SeqID_76456; Strand=-; Position=1 -87,134-220,287-478
  Homolog annotation: Hit_ID=NP_496787.1; Match level="QueryCoverage =100%, HitCoverage=16%, E-value=4e-32, Identity=51%"; Hit description= elongation factor g (83.7 kD) (2N411) [Caenorhabditis elegans] emb|CAB04216.1| Hypothetical protein F29C
MMREAYDRAAWILLEPIMKVSCTVPKMFHEKVAGTLTKRNGIMTGTTQSEEFVTFECEAPLNDMFGYSTELRTETQGKGEFTMEYSRYAPVPEATQERIVYEWKMENGLIEPEKEKKERKR

SEQ ID NO: 150034 - protein, 123 aa, Heterodera glycines
  Coding regions on vcDNA: vcDNA=SeqID_76457; Strand=+; Position=1 -325,615-661
MRQKTYVLAKAILERKDILFGSIENVVKPQAMKEKEDAWETVRTEMIEQGFVNFERKSWRDVRNHDWQYLRRSAVAKYEHNQKAGVEMIQYNEACAKFRGHSQRLVGAEQKGGYNNHLKVSLF

SEQ ID NO: 150035 - protein, 123 aa, Heterodera glycines
  Coding regions on vcDNA: vcDNA=SeqID_76458; Strand=+; Position=1-372
MRKLDDLSGLSGEHQSDNACRSAKDGGQHGLTERDHFGIVQRSDDALKHAEHGAKAEHQQHHEEQNGPEGRERKLEDRFCEHHEGQARPFSRLQRKSIELRENEKQSEEYRQTWAMIWPSSHF

SEQ ID NO: 150036 - protein, 355 aa, Heterodera glycines
  Coding regions on vcDNA: vcDNA=SeqID_76459; Strand=-; Position=1 -83,256-324,387-644,694-846,1054-1197,1233-1340,1461-1583
  Homolog annotation: Hit_ID=AAH59804.1; Match level="QueryCoverage =74%, HitCoverage=38%, E-value=1e-52, Identity=42%"; Hit description =Unknown (protein for MGC:66050) [Danio rerio] ref|NP_956030.1| Unknown (protein for MGC:66050) [Danio reri
SNHTKSTNAPHSFVPNSSFSDNTNCLNSKFPDIIHHPSYQKCELGQIIAQAAEGTGLAFVAAEGTGLAFVVFTEAILQFPFPPLWAVLFFMMLLMLGLGSMFGMLEGVITSLNDAKMIPLSKPLAAILCTSACIVGLVFTTQAGQYWVSLYWVSLFDQFAGSYALMCVAFFEIIAVIYVYGCDRFVRDIQYMTDESVGPYWTITWRFISPVIMAVIFVASVFKSFSDVPKYSAYDSTTVCPRPPPFPLLHNVPYPTWALFIAFGLVVTSMASVPFPLLHNVPYPTWALFIAFGLVVTSMASVPFIWFVRKFKIWCAVICPSIELSSLVALNCKISAEMASATAQCLEARDRRRCR

SEQ ID NO: 150037 - protein, 86 aa, Heterodera glycines
  Coding regions on vcDNA: vcDNA=SeqID_76460; Strand=-; Position=1 -108,889-967,1175-1246
  Homolog annotation: Hit_ID=XP_426061.1; Match level="QueryCoverage =93%, HitCoverage=10%, E-value=9e-23, Identity=61%"; Hit description =PREDICTED: similar to solute carrier family 6 (neurotransmitter transporter), member 18 [Gallus gallus]
MYVTATFPYVVMTLFLFRSIMLDGATAGLRYMITPNLSRLSEPEVWLDAATQIFYSMGLGFGGLIAFASYNPLKGNVKKECDQECR

SEQ ID NO: 150038 - protein, 76 aa, Heterodera glycines
  Coding regions on vcDNA: vcDNA=SeqID_76461; Strand=+; Position=1 -34,418-510,801-904
MFSKFYLSPMGASYGFNKIWITILINFIYKYDEILCQHSYFFVKLICPHNTRITSIQFHRLISKNSSDLSNDTKIC

SEQ ID NO: 150039 - protein, 71 aa, Heterodera glycines
  Coding regions on vcDNA: vcDNA=SeqID_76462; Strand=+; Position=1-215
MERKRKRKRKRKRKTEEEKGRGKVNGRGKGRGTAGEAKFSPKGCDQRKSQLRAAAACQCEMHCKMNHMRSG

SEQ ID NO: 150040 - protein, 51 aa, Heterodera glycines; identical to SEQ ID NO: 124998
  Coding regions on vcDNA: vcDNA=SeqID_76463; Strand=+; Position=1-155

SEQ ID NO: 150041 - protein, 317 aa, Heterodera glycines
  Coding regions on vcDNA: vcDNA=SeqID_76464; Strand=+; Position=1 -171,293-929,1082-1226
MEQQNITYYPTEIVHGQTNGDSQEQFHREHVFHSDANVNFHATNDTNFGGGGRRAAFQRQQHIVVQQGPTSIPQRVSTTNIPASTAGQQTVHVQLVPHNQQGNSPIPGQQQQQRQQIVVQHAPTSMPQRISTTSIPTSTASGQQTVHLQLVPQQGNSPIPGQQQQQQQQQHIIISAQPVQTTNTTTESADGNPIAAFMEYFVEQQQQPTCSTNTLPNVQTIQQYGSPVLDSKWALFASLIYKGVSGHGPYDGRLIKGGGGCLGIKFRYGGLISVDLFNILCLRFTLKNKLLSGMDKSSEKAEREAVKRARQAEAARQ

SEQ ID NO: 150042 - protein, 182 aa, Heterodera glycines
  Coding regions on vcDNA: vcDNA=SeqID_76465; Strand=+; Position=1-549
MASIFGKRKYGRRRMKRGEEEVEEIGRRMGEGEGGEEEKEGENGREEEGRQMGEIAQREHPKRRGGNSKIPKCPHGFRPMNYPGTQWTFLECVMDEELKLMKRRKKTKRRKQKDKRRRSKRKKRRGNKEWEDEVEEEEAEEQQKGSDGIIISKVKGTRRTSGRQKGRKRQSSTKEKSAVCQC

SEQ ID NO: 150043 - protein, 228 aa, Heterodera glycines
  Coding regions on vcDNA: vcDNA=SeqID_76466; Strand=+; Position=1 -210,258-452,495-727,1001-1049
MKRPNFNNALPMSEKKPKLRRRLPAELNCELISFVPLVCLFANVKRAPIGPVCYQFECFRSRRQKNFEYLKGVIALFDVMFEEKRTPKKKKVGRLHLQEELPHDLSRNELLHYLCYGRLGTNLFETYFVMSQATNSIAIGNLFGLLLDFAMSSPTPWLMKRPICCGIFYRQHLPWILQQPMNVMLSHGFFPEVRSDGFEFFWLFNPHLKKYAGNDDTMTDGIFWAKLS

SEQ ID NO: 150044 - protein, 125 aa, Heterodera glycines
  misc_feature (19)..(19): Xaa can be any naturally occurring amino acid
  Coding regions on vcDNA: vcDNA=SeqID_76467; Strand=+; Position=1 -38,1510-1712,2036-2169
  Homolog annotation: Hit_ID=EAL31098.1; Match level="QueryCoverage =98%, HitCoverage=47%, E-value=7e-43, Identity=65%"; Hit description =GA10883-PA [Drosophila pseudoobscura]
PKMLTIDSPSLVHPNLFFXADDTVVIDIGTGKVTDYVKFDAGNICMITGGHNIGRVGIVGHRERHPGSFDIVHIKDSAGHVFLSRMTNVFIIGKGATPLISLPASKGIRLSIAEERDRRLAQKQK

SEQ ID NO: 150045 - protein, 126 aa, Heterodera glycines
  Coding regions on vcDNA: vcDNA=SeqID_76468; Strand=-; Position=1 -154,244-404,766-831
  Homolog annotation: Hit_ID=AAH74551.1; Match level="QueryCoverage =100%, HitCoverage=54%, E-value=2e-63, Identity=70%"; Hit description= Protein phosphatase 2 (formerly 2A), catalytic subunit, alpha isoform [Xenopus tropicalis] ref|NP_0010054
VWNYFTDLFDYFPLTALVDGQIFCLHGGLSPSIDSLDHIRSLERLQEVPHEGPMCDLLWSDPDDRGGWGISPRGAGYTFGQDISETFNHANGISLISRAHQLVMEFDPAPRRGEPHVTRRTPDYFL

SEQ ID NO: 150046 - protein, 218 aa, Heterodera glycines
  Coding regions on vcDNA: vcDNA=SeqID_76469; Strand=-; Position=1 -369,434-690,1116-1146
MDLYLDDVHDDNGIVQPMWNDFAREIWPIFAPNIRHLTVPVGHHLDDLRRLISPTILTDCIQLDSIDSDYLLLDAIADDGPNAYSAGQILSKWLHIPTKNGQPKQFRDDYTSETNEWVNNFKKAFLRATTSVSYIIQFKTHTSITQFELVNERTKEKLTLKVKAEDDDEYTYINCVLERCQIGETIQWEDKKTDNLNKIAFELYGNCIGVATFSDEKS

SEQ ID NO: 150047 - protein, 135 aa, Heterodera glycines
  Coding regions on vcDNA: vcDNA=SeqID_76470; Strand=-; Position=1 -164,244-487
MAPVKKKKKLSSANHRPISATETNHQKKPLGSFVTFGIRRSVRVAMKTNRILKKIWVCNDILMDILPLFRRRQLGQKMALISPRFNALVDKHFDGKSETIWRQIRIAKNGTKLLSVVTKSNSLPIKIRFNNLRIE

SEQ ID NO: 150048 - protein, 29 aa, Heterodera glycines
  Coding regions on vcDNA: vcDNA=SeqID_76471; Strand=+; Position=1-87
MKEGQKPRQSRHKGRLSKKTRIVRELVRE

SEQ ID NO: 150049 - protein, 225 aa, Heterodera glycines
  Coding regions on vcDNA: vcDNA=SeqID_76472; Strand=-; Position=1 -198,296-376,431-576,854-969,1042-1101
  Homolog annotation: Hit_ID=CAE58867.1; Match level="QueryCoverage =97%, HitCoverage=87%, E-value=4e-84, Identity=69%"; Hit description =Hypothetical protein CBG02097 [Caenorhabditis briggsae]
LSFWPMSYNYLFKIVVVGDHNCGKSCILLRFSENSFRSDHVSTLGVDFKLKTIKIGRDKIRLELWWSLGMERYRTIYNSYYHSAHGVMCVYDLTNEKSFQNLENYWLRTNEKSFQNLENYWLRQVKEHAPQNAVLLMVGNKADLDSERKVDFDRAENLAKKIGVSIYEVSAKTGINCDDAFVELATVMRDRLLNSALNSDSDKSDHLNSDSDKSDHLSSAFHIDG

SEQ ID NO: 150050 - protein, 248 aa, Heterodera glycines
  Coding regions on vcDNA: vcDNA=SeqID_76473; Strand=-; Position=1 -5,729-834,1301-1379,1685-1912,1973-2301
  Homolog annotation: Hit_ID=EAL24924.1; Match level="QueryCoverage =78%, HitCoverage=29%, E-value=4e-28, Identity=32%"; Hit description =GA21361-PA [Drosophila pseudoobscura]
MRGSPDFLTVSCKLLICRTPRRRLNCTRNCLFCYGNVVFHKLITSGNHKLQSLFDCLLTIVVNGNSNLVYTIIRKRQVFYQLANLSSDSVSIAQNLKKGKKGATLKANEDSEQQQAVEEQTKKEEETEGQTERAKQQQIELKSSSLAQTPAIGAMTTMEESLESKRTSEQNQTQQEVEQLKQLENREEGAKNGQQTNETVAIEEEWTPTSEWVESWKKKLPLQTIMRVLQILVPQVEKICIDKSEMGF

SEQ ID NO: 150051 - protein, 191 aa, Heterodera glycines
  Coding regions on vcDNA: vcDNA=SeqID_76474; Strand=+; Position=1 -117,178-447,605-793
  Homolog annotation: Hit_ID=CAE72576.1; Match level="QueryCoverage =84%, HitCoverage=26%, E-value=6e-30, Identity=46%"; Hit description =Hypothetical protein CBG19763 [Caenorhabditis briggsae]
MGVSGRAHPSLAKMRENLINGTIDFQEVPIIDMNPEDIRAELKRVYTQLRMYKLKNAYQDNPHISKRKGGGAVKKSAAGDATVSGRLSSGAGLSGAGLPKGVRGTEGYCAVKRNSIPREATPNAVTSPKQLHGADRPPPLVFMDEDKSGGDLTVESAPHNVHLLTSRLARGPPTIATPPVTSMGTDCSIRV

SEQ ID NO: 150052 - protein, 40 aa, Heterodera glycines
  Coding regions on vcDNA: vcDNA=SeqID_76475; Strand=-; Position=1-122
FNNFYPLTKTKNGNNKTAKDASSVAHFKFESLASSQRLRG

SEQ ID NO: 150053 - protein, 118 aa, Heterodera glycines
  Coding regions on vcDNA: vcDNA=SeqID_76476; Strand=+; Position=1 -31,76-116,188-216,272-307,365-488
  Homolog annotation: Hit_ID=NP_741580.1; Match level="QueryCoverage =100%, HitCoverage=18%, E-value=4e-37, Identity=70%"; Hit description= MODulation of locomotion defective MOD-1, serotonin-gated chloride channel (56.1 kD) (mod-1) [Caenorhabd
RYGFYILQAYVPTYLTIIVSWVGFCMEYLTIIVSWVGFCMEPKALPARTTVGVSSLLALTLQVGVSSLLALTLQFGFGNIHKNLPRVSYVKAMDVWMLGCISFVFGTMIELAVVCYIS

SEQ ID NO: 150054 - protein, 268 aa, Heterodera glycines
  misc_feature (16)..(16): Xaa can be any naturally occurring amino acid
  misc_feature (28)..(28): Xaa can be any naturally occurring amino acid
  Coding regions on vcDNA: vcDNA=SeqID_76477; Strand=-; Position=1 -273,354-501,549-699,938-1076
  Homolog annotation: Hit_ID=AAQ84518.1; Match level="QueryCoverage =88%, HitCoverage=62%, E-value=4e-52, Identity=48%"; Hit description =two-pore K+ channel [Caenorhabditis elegans] ref|NP_494333.1| TWiK family of potassium channels (37.0 kD)
NYGAKTLRDGLCPILXIFPSIPPPPLFXGLVMFQSIGERLNTFCSILLKRLKLLLRRPPLVSPMDLIVVCSLLSTACIATGAWVFSHYENWSYFDSVYYSYFDSVYYCFITLVTIGFGDFVALQKDGALEKRPEYVIFSLIFIVFGLTVISAAMNLLVLRFLTLNTEDERRDTVISAAMNLLVLRFLTLNTEDERRDKREARLAAKGLVNDGDKADQTRRCPPNDTVSIISCSCYQLAKRALCRSRRWHRLGRSKQPKLSNSSCKMLP

SEQ ID NO: 150055 - protein, 50 aa, Heterodera glycines
  Coding regions on vcDNA: vcDNA=SeqID_76478; Strand=-; Position=1 -32,73-193
MAIKIIKKILMHDSVCSFAPKEMGLCAVHLRGTPKECGYDDDNDDDIAAK

SEQ ID NO: 150056 - protein, 265 aa, Heterodera glycines
  Coding regions on vcDNA: vcDNA=SeqID_76479; Strand=+; Position=1 -310,590-1075
VTVRLSKDGTELTALGPTLTTAKQKAATLALAHLRPELEQLKRLLKEAEGTAEEEQIVPKLVTKNDGTEQRSNKGNICWIVMPYQNAIVHFHHHRLIKWINSNTNAAAGQSSIMTTTNSTENNYNTNADFALPSTPENMQMPIIDMFVVPPEEPDIVEADNNDNASQWNNNNSNNPIINQCQTIFMEKQWHQQDDEEEEEQNGSIVAGRGGEWHHKATEQLAQMPQKQRQAVPKALGRSPTWSSSAFRQQQLMNNINSLCSNNNN

SEQ ID NO: 150057 - protein, 161 aa, Heterodera glycines
  Coding regions on vcDNA: vcDNA=SeqID_76480; Strand=-; Position=1 -141,491-691,734-877
  Homolog annotation: Hit_ID=NP_649008.2; Match level="QueryCoverage =62%, HitCoverage=17%, E-value=4e-09, Identity=47%"; Hit description =CG32190-PA [Drosophila melanogaster] gb|AAF49304.3| CG32190-PA [Drosophila melanogaster]
MPAQLQPVSVQQAMPAQLQPVSVQQTMPTQLQPVSVQQEQPTQQQATQQQQIQLQPPVQPAAQQQTLPMNVQMPTAQFESFLVQMPQAPPPVLQTQQGQPAQQTDDMFRLIGENEEAAPGILSTSGRSGGGGGGGWVVRAVNGLDPSMVQGTSQQIVQNRF

SEQ ID NO: 150058 - protein, 137 aa, Heterodera glycines
  Coding regions on vcDNA: vcDNA=SeqID_76481; Strand=+; Position=1-413
NGLSKNRNYAQKASQTILALPIPSTIAFIHPIMNAKIIRVPKIACDLSLEKNGLSKNRNYAQKASQTILALPIPSTIAFIHPIMSAKIIRVPKIACDLSLAKNGVSKNRNYAQKSFSNNFSASNSFYNRLYTSHYER

SEQ ID NO: 150059 - protein, 703 aa, Heterodera glycines
  Coding regions on vcDNA: vcDNA=SeqID_76482; Strand=-; Position=1 -643,865-1641,1915-2604
  Homolog annotation: Hit_ID=AAA93301.1; Match level="QueryCoverage =40%, HitCoverage=76%, E-value=7e-46, Identity=40%"; Hit description =HASI
MQHTKRYLLVPEEIYQSLASPPPYDGTPIGLVRNRIKQIKNDDGINEAERAIKYEQELKRLNKLTRDEDERPVGVKLENLSDVVDAMPKPVNVKRPIVVATRRHLKVGRARKANVEQLEDVDDDDDDDDETPKPSSSNKRQPTQREILKLIYKNAQSLGVSEEGQVLRAGGRPFITSSVYDIVSHLMNKDKRGQNKEPTAFKEFVERARQIPLLTTQRTYTLHRQAKRRYRRLPTLAPGLHTEWQADLAIFDRLAKQNRGYKYLLVCIDTLSRQVFVEPVKTKTSANMIIAFGRIFKRSKYIPWKVLTDQGKEFTARAVQQFFRTKDVEHFCMLTSPQFHAGMAERANRSIKERLYRYFTERNTYKSIDVVQDIVYAINHSPNSSIRMCPADVNFKNAEALRQKLHGAAAENFVRHQPKYRVGDRVRIEKYKHVFQKGYLPRFTNELFTVAEVHSERSPVVYRLRDDNNEIISGNRTNSFRVRLPRKLQFNSEWEVGLAVIVYPHSWPSIGTVEQQFVQIEWQTGNMVRIEVPPSNVTNPHELSKNLYRLLGEGSDPLAKKVRSTQNSFMLTINKARRWAREEYIKRKTKEKRGVRDEELLLQAMLADTGTLVDLNSVAQGFLTREKSAATSNVPLRMPADDTSSYQEKLDEYFSKLSDKNLNILDELGMTKLNAEIKNLTEEERVILEATKEMGTEAWIQAY

SEQ ID NO: 150060 - protein, 61 aa, Heterodera glycines
  Coding regions on vcDNA: vcDNA=SeqID_76483; Strand=+; Position=1 -40,440-585
MTLTPQLCEPRVKNFNGFNSCHRLDKQRLSRNGFTGHQQREQRANEKPIGGGGRSQLDQPD

SEQ ID NO: 150061 - protein, 306 aa, Heterodera glycines
  Coding regions on vcDNA: vcDNA=SeqID_76484; Strand=-; Position=1 -56,101-384,441-723,776-1073
  Homolog annotation: Hit_ID=NP_001004509.1; Match level="QueryCoverage= 88%, HitCoverage=17%, E-value=5e-12, Identity=26%"; Hit description =si:busm1-180o5.3 [Danio rerio] emb|CAD60788.1| novel protein similar to DNA polymerases [Danio rerio]
MEFNPGLRLIAKTLANSLWGKLAQRVGQTEIRYTRTPAEFHALLDDPTLDKLDFVHVSEHMDRCVVRKRPEFARAPPTNCLPVAAFVTSYGRLHLYDYMEQVSAIVGAELLYCDTDSIYYVSKMGGPCVAEGEALGQMKREHTDRRIVEFVAGGPKNYGIRHTARDGTDERANLKIRSFRLSYTAQQLLTFEAMKNLTLATYNIDGPIDDALDNDDLYVYGGGEHRAIRVNFPQIDRNVYADLYTQEAHKDYRPFYAKGRVRPGMQTRPFGYVEDDGQPNKGQRTHRRKRNLVEQDPTQPGHSGWF

SEQ ID NO: 150062 - protein, 243 aa, Heterodera glycines
  Coding regions on vcDNA: vcDNA=SeqID_76485; Strand=-; Position=1 -87,1268-1922
  Homolog annotation: Hit_ID=NP_493834.1; Match level="QueryCoverage =97%, HitCoverage=17%, E-value=7e-44, Identity=38%"; Hit description =putative endoplasmic reticulum protein of ancient origin (2B142) [Caenorhabditis elegans] gb|AAF60594.1|
KTFLLNASSINSEIPQSKLAGSDFSKKSFLSIVSENWNEMAKSAILAPKNVDVSKMNNSFRNLPGEEVVYTSIDLAQDENRQRADDYLDEYLNALNPSGFPRHKLRLKKNAIVLLMRNLNIEMGLCNGARMNVEQMQPNLIVCKILTGDKAGQTVYIPRITLCCSEDYPFDLHRHQFPLVLAFAMTINKAQGQTLEQVGIDLRKDVFSHGQLYVALSRARAWNKLRIRFLERKVKNVVYRELL

SEQ ID NO: 150063 - protein, 123 aa, Heterodera glycines
  Coding regions on vcDNA: vcDNA=SeqID_76486; Strand=+; Position=1 -123,176-424
  Homolog annotation: Hit_ID=NP_501684.1; Match level="QueryCoverage =93%, HitCoverage=47%, E-value=2e-30, Identity=56%"; Hit description =glyoxalase II (26.4 kD) (4K272) [Caenorhabditis elegans] emb|CAA92800.1| Hypothetical protein C33A12.7 [C
MGSVQLFEAKSFTYTYLLGCTKTRQALVIDPVIETVERDASLVHELGLDLKYVVNTHIHADHVTGSGELKRNKYFPKAISILSGKAGGRADLLVKHSDLIRWGDGLELEVRETPGHTNGNKDF

SEQ ID NO: 150064 - protein, 65 aa, Heterodera glycines
  Coding regions on vcDNA: vcDNA=SeqID_76487; Strand=+; Position=1 -28,211-380
MPISNSLREEFEQQNDWLAYDFLNSIQTPNKNCQKEAKSVSLRRLYEMFPKLSKKVIGRVAKEME

SEQ ID NO: 150065 - protein, 90 aa, Heterodera glycines
  Coding regions on vcDNA: vcDNA=SeqID_76488; Strand=+; Position=1 -85,431-618
MRGKRTSKMYDYFLSLPYVFFGNISGHYRIHAFDFYYLWAYSFPLIISIWLYSIVYRAYKFVQQNEEHKNGGQYGQNVKQYQQNANAKVI

SEQ ID NO: 150066 - protein, 107 aa, Heterodera glycines
  Coding regions on vcDNA: vcDNA=SeqID_76489; Strand=-; Position=1-323
MAKTLDQYQNLERVPISSLVFTVNFFGCQGQDKIMALLLVKQSAALDCQCARLPRAGRANVQESENQHAGGRPAYGRAIQRGASDRGGPGIGTHIWRMGEAEPGEHL

SEQ ID NO: 150067 - protein, 64 aa, Heterodera glycines
  Coding regions on vcDNA: vcDNA=SeqID_76490; Strand=-; Position=1 -54,671-811
MSRFLELFYADPWSEGIPSYEELRQTYYDIQAGVANATHLGLQIELLKRFVAPKSENEREFVRI

SEQ ID NO: 150068 - protein, 79 aa, Heterodera glycines
  Coding regions on vcDNA: vcDNA=SeqID_76491; Strand=+; Position=1-240
VFESIRSHLENFSTLEAVNSRQKSKMLSTRHWHGIIEMPCSPPMHHFSPECLRSTGRHRTVRGTVTSVGTPLVGPSHCV

SEQ ID NO: 150069 - protein, 233 aa, Heterodera glycines
  Coding regions on vcDNA: vcDNA=SeqID_76492; Strand=+; Position=1 -542,590-749
  Homolog annotation: Hit_ID=NP_494393.1; Match level="QueryCoverage =94%, HitCoverage=97%, E-value=5e-38, Identity=42%"; Hit description =predicted CDS, NIMA-interacting 1 (2D174) [Caenorhabditis elegans] gb|AAF60409.1| Hypothetical protein Y1
MAGEEEEETVVEHPLPKGWEKRMSRSSGKPKWRIKKQKLKNGLSYCDIVFLTGREYYFNVFSQKSQWERPTRDAEDTAKKPETVHCYHILVKHERSRNPKSWRSDKVTRSKEDATKTLECPFKLWAPQAENYHLYWKIKGASILKMHKNANSNLRPPLFQIKHELFIFGVKLIMPNWLHWTDCSSAKRSGDLGPFGRNKMQKPFEEASFALNVGQMSDIVDTDSGLHLIYRFA

SEQ ID NO: 150070 - protein, 49 aa, Heterodera glycines
  Coding regions on vcDNA: vcDNA=SeqID_76493; Strand=-; Position=1 -93,847-900
KVGTGTKFFDRDRDSEKTRDRDFCFSKNRDRDRDLKNPGFPAPVPVPLN

SEQ ID NO: 150071 - protein, 87 aa, Heterodera glycines
  Coding regions on vcDNA: vcDNA=SeqID_76494; Strand=-; Position=1 -45,537-755
MSSLSEEVKKVKQAAVLEIDTEKVQGIVRDFLRGSSVKIEIKPCQTDKHELDLNDVFSSISRRPDEQSDRSLRTFLEMLTSQPFLNA

SEQ ID NO: 150072 - protein, 63 aa, Heterodera glycines
  Coding regions on vcDNA: vcDNA=SeqID_76495; Strand=+; Position=1-189
MPMSSPASTRSGWASEAAIGVRTVTAVGAGHAWTINWAINKLAIFTALSFSLIDQKLIVTGKS

SEQ ID NO: 150073 - protein, 64 aa, Heterodera glycines
  Coding regions on vcDNA: vcDNA=SeqID_76496; Strand=+; Position=1 -18,261-437
MRSPPAKISNCYEFLEREWLIFLQNANGAKLGEDGLPNLLTVSSPEFAHHLALLLEVPNLEMEI

SEQ ID NO: 150074 - protein, 191 aa, Heterodera glycines
  Coding regions on vcDNA: vcDNA=SeqID_76497; Strand=+; Position=1 -400,879-1054
MEKRTSHNHTTAEALARAVQMEMDFIQRILLGPQRGNLTAIEYLKAQNLGKSLSSTKPNDGTEWKNGEKVPKFNIEKHAKGNDGAEKAKSTEDKSETNGKHKIGMGRMKREVGECKVCARPSLYCYYGVKCCENGIRCRGCRLDKCLLAGMDPTMIKANAKDGEALAQYLARLELRKRNALARNNCAERNN

SEQ ID NO: 150075 - protein, 352 aa, Heterodera glycines
  Coding regions on vcDNA: vcDNA=SeqID_76498; Strand=-; Position=1 -552,626-1132
  Homolog annotation: Hit_ID=XP_318162.1; Match level="QueryCoverage =91%, HitCoverage=43%, E-value=2e-78, Identity=46%"; Hit description =ENSANGP00000020700 [Anopheles gambiae]
MPAPHDKTTLRSFLGALNYYGRFVKPMREIRAPLDQLLRKDESWSWGDDQQSAFEQAKAIMVSELLLTHYDLTVPIVVAADASKDGIGATISHIFPDKKEKVIEHASTVLTNAQQNYSQIEKEALALVFEVQKFHRMLFGRKFTLLTDHKPLLAIFGSKKGIPIYAASRLQRWALIMANYDFETEDILIANICTETECYISTILQTKTEQLPVTADEIAEATPKDEILAKILAFTQSNWPKKCSDPDIAPYFPKRDILEIEGCLLYQNRVVVPQSLRNRMLKSLHMAHPGIVRMKALARQHVCWPGMDSEIERIVRQCEECQKAQKAPIKAHGVNSRSRFMVTKTVNFTNFR

SEQ ID NO: 150076 - protein, 254 aa, Heterodera glycines
  Coding regions on vcDNA: vcDNA=SeqID_76499; Strand=+; Position=1 -95,174-317,487-598,764-1040,1125-1258
  Homolog annotation: Hit_ID=NP_502167.1; Match level="QueryCoverage =62%, HitCoverage=30%, E-value=2e-13, Identity=32%"; Hit description =putative protein, with a coiled coil-4 domain, of fungal and metazoan origin (4M247) [Caenorhabditis eleg
MNFARRSKARLPGTPSKYCSNKCIGVMLRLTMGGETLDQLIQLSVTQVEGMKDETAHCLDPGKLVARLVNIISTIPHLKARPCYELKSDGPFLREKTQRKRTNQKMKEEAQVVKGKTLSQMSEATSATASEDGTGAGSSTAVNKELDNVRRHLKRVYKQNGTDSVDYYRFVLHPDSFGETVENMFFVSFLIRDGQVRLRVDPNSGLASIVKLSREEREERCSARERPKTQTVPRLDYTTWHRMVQELNITVYSN

SEQ ID NO: 150077 - protein, 262 aa, Heterodera glycines
  Coding regions on vcDNA: vcDNA=SeqID_76500; Strand=+; Position=1 -117,169-246,299-346,506-562,603-697,838-897,950-1147
  Homolog annotation: Hit_ID=NP_502222.1; Match level="QueryCoverage =76%, HitCoverage=57%, E-value=4e-50, Identity=53%"; Hit description =putative protein, with at least 3 transmembrane domains (4M505) [Caenorhabditis elegans] pir||T23162 hypo
LIACSFCLFCQPHPIYQLISLLCFCAWVSLLSPLPFTVWYYVLGDGLYYVLGDGLRQMNQSVAMCHLYRTSMEVIPHTVIPHTMDTLVTLFSVLLKILRFLTQYHRSTLKLRTIERFSRAILFIIIISVLLGILRFFLRTIERFSRAILFIIIISVLLGILRFFEHDAALYSFCMDTEPGPFWAQRCMLTDGPLISLLPLISLLGRPFWKVFLPLADLFAQFLLPGSCLILLHIGFNREPVIEIGNENSHNRFGRSLRDQTK

SEQ ID NO: 150078 - protein, 74 aa, Heterodera glycines
  Coding regions on vcDNA: vcDNA=SeqID_76501; Strand=+; Position=1 -90,1081-1215
MSKIKCYKRMASEKNENYQNAIYSETKEYRNLSRKSQEKCGQTAAFSSSVRLRRCAAVGPRKRRWATGAAAAGR

SEQ ID NO: 150079 - protein, 139 aa, Heterodera glycines
  misc_feature (1)..(1): Xaa can be any naturally occurring amino acid
  misc_feature (14)..(14): Xaa can be any naturally occurring amino acid
  Coding regions on vcDNA: vcDNA=SeqID_76502; Strand=-; Position=1 -102,236-341,399-490,2256-2336
  Homolog annotation: Hit_ID=NP_498054.1; Match level="QueryCoverage =58%, HitCoverage=4%, E-value=2e-27, Identity=72%"; Hit description =novel Channel type/putative Nematode CAlcium channel (nca-2) [Caenorhabditis elegans] gb|AAA81424.2| Novel
XVGGTSNLIHFAFXCHEMERINNGEDVSFHDILSMLSYRSVYIRKSLQLEELVQREELEYLIEEEVAKHTIRSWLESCLRRITIRSWLESCLRRIKQQQNTAHDNEMPHIADLKLIYINIKRSINEQNTQKAKFYNGNY

SEQ ID NO: 150080 - protein, 183 aa, Heterodera glycines
  Coding regions on vcDNA: vcDNA=SeqID_76503; Strand=-; Position=1 -202,413-579,629-810
  Homolog annotation: Hit_ID=CAE58730.1; Match level="QueryCoverage =95%, HitCoverage=9%, E-value=1e-27, Identity=40%"; Hit description =Hypothetical protein CBG01916 [Caenorhabditis briggsae]
MDSFRPLKSPEKLSSFVNRQFFWWFNSVCALGSRKPLELSDLYALNPNDTCNELVPQWERLWKRAITDYNSKNSLQSPDELCQPPKESVINVTDGDVNVQHQQEPESDLAPLIRHGDDLTTHDQVMANYGSTQSDHSSSSSKRKTSPPSLIWRLVLLFRWNIITAMIMKCFSDLLTFANPVLL

SEQ ID NO: 150081 - protein, 37 aa, Heterodera glycines
  Coding regions on vcDNA: vcDNA=SeqID_76504; Strand=+; Position=1-246
GAPTKCPSHEMSKRVKTHEMSKIFKIYKNKMSLIWGF

SEQ ID NO: 150082 - protein, 83 aa, Heterodera glycines
  Coding regions on vcDNA: vcDNA=SeqID_76505; Strand=+; Position=1 -174,911-988
MAPLFRLLFVRFSARLLLFLLLFLLFPFFLFIVKLRPIRAERLGLNQAEKAHRRHSAIISTLSFAKLANMRVQHTTYRTTTSA

SEQ ID NO: 150083 - protein, 253 aa, Heterodera glycines
  Coding regions on vcDNA: vcDNA=SeqID_76506; Strand=-; Position=1 -111,158-376,421-543,608-916
  Homolog annotation: Hit_ID=CAE65084.1; Match level="QueryCoverage =35%, HitCoverage=83%, E-value=2e-13, Identity=46%"; Hit description =Hypothetical protein CBG09942 [Caenorhabditis briggsae]
MSLVVVKINDQPCRAVIATNFTHSFCGSGIVNSLKLNQILLPFLYNSIKPQVIDLNDAPTVTTSEGTPIEFLGQALVQLEFGPWHSDGFTPLLIAYDCPADMLIGQDLINEISATLPIKFEYHKNSVNVGGTRVSMLDPMAAEEKFFSVRVEIGLETWKKGARESIEMGGMVKRRVEVTREPNAEKEEGEEEKEKGGIEEEQKEEEEKKGMQEEQKEEEEREEKEKGYYEQKEGEDERKEEEDERKEDDERKG

SEQ ID NO: 150084 - protein, 185 aa, Heterodera glycines
  Coding regions on vcDNA: vcDNA=SeqID_76507; Strand=-; Position=1 -4,282-835
  Homolog annotation: Hit_ID=NP_608540.1; Match level="QueryCoverage =80%, HitCoverage=59%, E-value=5e-17, Identity=34%"; Hit description =CG2839-PA [Drosophila melanogaster] gb|AAF51469.2| CG2839-PA [Drosophila melanogaster]
MGLDESGYLGKTGSGYFRVQQSRVRVQVFKPGTGGTESGRGTESGKEQKVEEKVEEEQKWKRKRKWKRNRTWKRNRTWKRKCKRNRKCKRNRKWKRKWKRNRKRKRRRGTESGRGTESGRESGRGTESGREEEEQKVEEKQKVEEKQKVEEEQKAEEKVEEEQKVEEKVEEEQNVEEKENVEEKV

SEQ ID NO: 150085 - protein, 252 aa, Heterodera glycines
  Coding regions on vcDNA: vcDNA=SeqID_76508; Strand=-; Position=1 -88,143-403,444-715,762-899
MDQRPTQTDQLNPGTEASSGYEKPEEQKNVQLIFEEAKASFLTAKSKIKDEIANKESEVSKRIYGLVSEAGAALRDEQFAHESFVQQINLKLQPEKLRLIQLKNNLSTLKHAYTTKGNISAGALDEVADLGQAIQKQIDCLTKVEVSCDKQIKAENARYHQKRTELWMAILPDIEQLEGSKKEFFNSRFCELQNLAQTMNKARKSLQVGTIREKADQCDVHMLEEDKENNDVHLVGTEQKETDDDIIEFDEH

SEQ ID NO: 150086 - protein, 690 aa, Heterodera glycines
  Coding regions on vcDNA: vcDNA=SeqID_76509; Strand=-; Position=1 -239,287-540,598-881,929-1140,1187-1622,1668-1925,1984-2373
  Homolog annotation: Hit_ID=NP_920291.1; Match level="QueryCoverage =88%, HitCoverage=39%, E-value=9e-72, Identity=32%"; Hit description =putative helicase [Oryza sativa (japonica cultivar-group)] gb|AAP52578.1| putative helicase [Oryza sativa
MQEACAEMTNLKRLQHYFAMLLAHAHPSNPQALFDEFLDEMNPPVAANHPGAVPKSAEVRAAEVMLNLEYYLNCMGTNTKDVGLQGLPVGYDFQHQAQLLEEDNILDSFYGEDARQRCKPPQQVAIEQIGRLNPDQRAAFDEISTSILGGCNQKLFFLEGAGGCGKTYFYNTLIKWCIAGKPSLDGNANAQWVRNQELKRNSAVAAASTGIAALLLIGGGTAHRHFYVPNDVSQETPPMLNFESAKAEQLRHAQLIIIDEISMLSNTVLDYIDRLLRDVCANVTPFGNKVVVLSGDWRQLTPVVEHGTREDQVGTSIKMGALFRLFKKISLTINMRTAPGEQSLRDWLQEIGNGMHRVGTDSQGFTNQLRIPPELLVDDLDHTIHFCFPEALFDDPLANADAIAHNAILCPTNNDVQHINEVALGRMSGCGREFLSIDEPLEPNEEMNNFRTDFNMEAVHNEMPSGMPPHKLTIKVGTPVMLIRNLDVTQGLCNGTRLQVMRTSENNLFCRILTGPRAGAQNIIAIPQIQFEYGRARHHRGLRFRRLQFPVRLCFAMTINKAQGQTLQRMALVLNGRQCFSHGQVYVAMSRVTQMDGIRVYAPFSQSGYGTHIENVVYHELLDLETQQPRTPNRGLMDVDNDPDAAIPDVGPRVPDVDNDPDVERDNGNAAGANDQEPNDLDSSFDDFFD

SEQ ID NO: 150087 - protein, 495 aa, Heterodera glycines
  Coding regions on vcDNA: vcDNA=SeqID_76510; Strand=-; Position=1 -87,177-323,681-798,843-1075,1117-1459,1503-1768,1814-1961,2004-2149
  Homolog annotation: Hit_ID=NP_494302.1; Match level="QueryCoverage =57%, HitCoverage=19%, E-value=3e-12, Identity=27%"; Hit description =predicted CDS, putative protein of ancient origin (2C878) [Caenorhabditis elegans] gb|AAB95006.1| Hypothe
MPSKEQRRKEADRLRRRAIRNTPDVANVLNHLPQPMSKHKHNHEVLLNLLWVRPQWIWTPVLFRLRPPPDYGLYLLLELAELNVTLLEERMQKVVRDYLSREWPKQPVIAQKRRRSTDARCTRCGSGCNCLSYSQCLKNATAFIAAWVYLKEFTHGVFPAPIFFTATRNIKGVRPTERCHRNTFLKCAARSSGHRIDYYDSGQFGDAFCGHCCARLLRGENEIIKRGRQTPCCANGAVHTGQMVAEFHELQQPPPAYLHGLVDVDDERVRDAFLNNNMAFNNLFAFASTHGEKAPPDQMGGRLDTCKYNGQFSFLFSDLIAPGVRRPSFAQVYTLSPEDALAVREEAFETAVSPHVRRTIMERLEALMRENPFGQTFQTVGTKVQATRAATGEVPHFRIALLTDRDLKGGPLQGRNDITVIERVDAPTAKQVAVIWVQEDGLPPQISAFWVSDKAGKMRELKSGMPQIDPCCFPLLHPLGTLGWRWYMKKRGSEV

SEQ ID NO: 150088 - protein, 849 aa, Heterodera glycines
  Coding regions on vcDNA: vcDNA=SeqID_76511; Strand=-; Position=1 -373,420-499,697-961,1009-1262,1320-1603,1651-1862,1908-2343,2389 -2646,2705-3094
  Homolog annotation: Hit_ID=NP_921821.1; Match level="QueryCoverage =88%, HitCoverage=49%, E-value=5e-78, Identity=28%"; Hit description =putative helicase [Oryza sativa (japonica cultivar-group)] gb|AAP54108.1| putative helicase [Oryza sativa
FEKAYVRVAQPRRSAQQCRNDGTAGADEVYDYDEIAATFKVRYMTAMEAYLRLNSYKIVGTSHQIYTLSVHDELGQTIVVEEGHEEEGRWRVRENTRLTAFFALCARDPHAAQLTYDRVPYRYTWDFKSRAWRKRVRQLEEDPHKAKMFVLSDEVFRRAMQEACAEMTNLKRLQHYFAMLLAHAHPSNPQALFDEFLDEMNPPVAANHPGAVPKPAEVRAAEVMLNLEYYLNCMGTNTKDVGLQGLPVGYDFQHQAQLLEEDNILDSFYGEDARQRCKPPQQVAVEQIGRLNPDQRAAFDAISTSIHGGCDQKLFFLEGAGGCGKTYFYNTLIKWCIAGKPSLDGNANAQWVRNQELQRNSVVAAASTGIAALLLIGGGTAHRHFYVPNDVSQETPPMLNFESAKAEQLRHAQLIIIDEISMLSNTVLDYIDRLLRDVCANATPFGNKVVVLSGDWRQLTPVVEHGTREDQVGTSIKMGALFRLFKKISLTINMRTAPGEQSLRDWLQEIGNGMHRVGTDSQGFTNQLRIPPELLVDDLDHTIHFCFPEALFDDPLANADAIAHNAILCPTNNDVQHINEVALGRMSGCGREFLSIDEPLEPNEEMHNFRTDFNMEAVHNEMPSGMPPHKLTIKVGTPVMLIRNLDVTQGLCNGTRLQVMRTSENNLFCRILTGPRAGAQNIIAIPQIQFEYGRARHHRGLRFRRLQFPVRLCFAMTINKAQGQTLQRMALVLNGRQCFSHGQVYVAMSRVTQMDGIRVYAPFSQSGYGTHIENVVYHELLDLETQQPRTPNRGLMDVDNDPDAAIPDVGPRVPDVDNDPDVERDNGNAAGANDQEPNDFDSSFDDFFD

SEQ ID NO: 150089 - protein, 222 aa, Heterodera glycines
  Coding regions on vcDNA: vcDNA=SeqID_76512; Strand=+; Position=1-669
MILDRLPDIRGNEGGDSICNFFKKYSQYTADWSNKKRIESLEAKLSGRAERAYNAALANEPFVYENVKRNILQQLEDNDCREMSAFNDLMNGVTRKHGENLDDLADRISSLVRRAYPGLTRNLADEYSIKHLIRSLNNPDLALNLELHRRNGMSFDEFVALASRAEATQRATKRQSAEHRPNQERKYMHPSDREVETNFKNQLRPNPVVCYNCNEPGHISRN

SEQ ID NO: 150090 - protein, 83 aa, Heterodera glycines
  Coding regions on vcDNA: vcDNA=SeqID_76513; Strand=-; Position=1 -186,241-306
MPSESDKRIAHEMSMPTSDFLPKSNKTLMDDIEQKAHKLSDRVKRELLTLFDEKQNHDKIERCSKRLLRKKEQVILTRNELIA

SEQ ID NO: 150091 - protein, 227 aa, Heterodera glycines
  Coding regions on vcDNA: vcDNA=SeqID_76514; Strand=-; Position=1 -102,607-801,1305-1499,2000-2191
MDDIEQKAHKLSDRVKRELLTLFDEKQNHDKIERIYVFDVLKKQKWAYDANQPTSDFLPKSNKTLMDDIEQKAHKLSDRVKRELLTLFDEKQNHDKIERIYVFDVLKKQKWAYDANQPTSDFLPKSNKTLMDDIEQKAHKLSDRVKRELLTLFDEKQNHDKIERIYVFDVLKKQKWAYDANQPTSDFLPKSNKTLMDDIEQKAHKLSDRVKRELLTLFDEKQNHDKM

SEQ ID NO: 150092 - protein, 164 aa, Heterodera glycines
  Coding regions on vcDNA: vcDNA=SeqID_76515; Strand=-; Position=1 -102,603-797,1287-1481
MDDIEQKAHKLSDRVKRELLTLFDEKQKHDKIERIYVFDVLKKQKWAYDANQPTSDFLPKSNKTLMDDIEQKAHKLSDRVKRELLTLFDEKQNHDKIERIYVFDVLKKQKWAYDANQPTSDFLPKSNKTLMDDIEQKAHKLSDRVKRELLTLFDEKQNHDKIER

SEQ ID NO: 150093 - protein, 110 aa, Heterodera glycines
  Coding regions on vcDNA: vcDNA=SeqID_76516; Strand=-; Position=1 -99,415-648
MEQDKRALVQKPVVLVMPGEEGTRMIRDAEGGRAPTDEDCGDDAEKELSEALSVVNKIRMGDEEEIESENVNTSTAPFTLSIADLPGILDDASRNRWGQNCHKREKRVAN

SEQ ID NO: 150094 - protein, 89 aa, Heterodera glycines
  Coding regions on vcDNA: vcDNA=SeqID_76517; Strand=-; Position=1 -112,479-636
MATARREDLAVGRTGKRAATKKDYSHQLAKEEEKGELENPNLSFFSVHPRNGAGQKGPCSKAGGLGNAGGGGDENDKRCRGRKGKYAKR

SEQ ID NO: 150095 - protein, 62 aa, Heterodera glycines
  Coding regions on vcDNA: vcDNA=SeqID_76518; Strand=-; Position=1 -39,450-599
MINLFIYNFLFMVKIWDCLDNDACEYYKCPFGVLKQLWGAKIQRRIKVQAIGKLFRKDSVSP

SEQ ID NO: 150096 - protein, 70 aa, Heterodera glycines
  Coding regions on vcDNA: vcDNA=SeqID_76519; Strand=-; Position=1 -60,114-266
MTHQFMVAKCAYQFKVPQVASDFYRDNVLIFYEKNPIIPPVTAWIVLPNIFTPLSIIFNLSIILLTITTM

SEQ ID NO: 150097 - protein, 32 aa, Heterodera glycines
  Coding regions on vcDNA: vcDNA=SeqID_76520; Strand=+; Position=1 -63,119-154
MMHQFVMEKCAYQFKVAHVAASDFYLVTITTM

SEQ ID NO: 150098 - protein, 33 aa, Heterodera glycines
  Coding regions on vcDNA: vcDNA=SeqID_76521; Strand=+; Position=1-102
LNFLIFLFLSANIFYNNLSVWSDVRQTEKIIKI

SEQ ID NO: 150099 - protein, 22 aa, Heterodera glycines
  Coding regions on vcDNA: vcDNA=SeqID_76522; Strand=-; Position=1-67
SFICNHAKTATRKWPRENVQAR

SEQ ID NO: 150100 - protein, 281 aa, Heterodera glycines
  Coding regions on vcDNA: vcDNA=SeqID_76523; Strand=-; Position=1 -120,299-636,1626-1902,2479-2586
MHNAKRIISEFVNYADILDFMAWNGDKLWDFNSINFNSLALALPDPPNDLPKETIGKPKDVPKSKIEKPFNMPKTIIAKPNDVPKQKNAKKKASKNDGGQKKEKLVVSRPSSPNGVPIEFELEINEYTNGQLINKNTISGQWDKRNEKIIDEMSFAVSLYDDDDGKAHKKLRKAAAESLIQFEQDSSRSSEDKNKMKAIIRANLSEGDSMSNYHNSIAEYATYYVLKNRNYAGVAECYALAIHLNDYNNITSDKYKQIWELVDDPIVIWHDGDEHFNSICL

SEQ ID NO: 150101 - protein, 208 aa, Heterodera glycines
  Coding regions on vcDNA: vcDNA=SeqID_76524; Strand=-; Position=1 -53,109-219,352-518,880-1165
  Homolog annotation: Hit_ID=CAE61283.1; Match level="QueryCoverage =99%, HitCoverage=12%, E-value=8e-71, Identity=62%"; Hit description =Hypothetical protein CBG05103 [Caenorhabditis briggsae]
TLSGPFGDGTQEWHTRRVVVVVVFVGGGIGITPYASTLMDLVLERASGNHSGIKCRKVYFLWICPTHKNFEWFVDVLKQVERHDQDGILEIHIFVTQFFHKFDLRTTVLVSRLRIYLSHFQQYICEKHFRGDNSGISMFTGLRATNHFGRPNFDSFFKFLQQSRHPEVAEIGVFSCGPAQVNKQIRRACTEANRFRNAPSFVHRFETF

SEQ ID NO: 150102 - protein, 141 aa, Heterodera glycines
  Coding regions on vcDNA: vcDNA=SeqID_76525; Strand=+; Position=1 -108,1096-1251,1478-1639
  Homolog annotation: Hit_ID=NP_508591.1; Match level="QueryCoverage =72%, HitCoverage=13%, E-value=6e-19, Identity=45%"; Hit description =DeHydrogenase, Short chain (dhs-27) [Caenorhabditis elegans] pir||T15411 hypothetical protein C04F6.5 - C
MFKDLFPSLGFCPFHALLWVLKGYLIFRSIKFFEIFCLFPLLVATKLTQYAAEDANLLVLDAKSYARQAVNIIGNYRISTGCFMHDMQIAFGSFIGFNLFKLFYVPFGILGIHKRRIDAYNRKKLANERKSGGKGEGIKSE

SEQ ID NO: 150103 - protein, 83 aa, Heterodera glycines
  Coding regions on vcDNA: vcDNA=SeqID_76526; Strand=+; Position=1 -234,492-509
MPSAYNPAFKVANPTNSVELTGNEQQQLSQNQGQMQSADEQQSNRSKQDASQRDEKGTDDARGEAAEKPKQFGVTQQQNLRSE

SEQ ID NO: 150104 - protein, 47 aa, Heterodera glycines
  Coding regions on vcDNA: vcDNA=SeqID_76527; Strand=-; Position=1 -79,231-295
MKERWPHNNSHPSSGGCGLVAKTTDPRKTDCFISVKDLWPKQKIDFI

SEQ ID NO: 150105 - protein, 651 aa, Heterodera glycines
  Coding regions on vcDNA: vcDNA=SeqID_76528; Strand=+; Position=1 -250,302-529,581-1976
  Homolog annotation: Hit_ID=NP_500227.1; Match level="QueryCoverage =96%, HitCoverage=57%, E-value=1e-83, Identity=30%"; Hit description =predicted CDS, reverse transcriptase like family member (4D351) [Caenorhabditis elegans] gb|AAK68554.1| H
PPTIFSKLLAVPTRSKSELIHDLTVLENFSTSDHKMVGFKIKEKFSNKNPRVYRRDFKNINFAKCRAILENRFDVSINSVYTTFIPNRPLKSIIKPYPQKIRDLTFIPNRPLKSIIKPYPQKIRDLFSEKLRLHKLVKKFPEKSDLILNYKIISREMKKQLKQFRNEKESKIISQGQNSLIDNAGNMFSLIDNAGNMFSSNVQKCKILAEIFQKSFLRKSIVNGPQTQSTQNKTKLFDIESGIIWNILRRLPRRNSTSPDNIPYILLKNCADPITKILADIFRLILDSGQIPEIWRTSLVVSIFKRGEKTDPLNYRPVSLTSTVCRAFERILSSKILEFLNSTRFFDKEQFGFLKNRSTTTQILKTMDDIYNSIQKNQQIDINIYIDFVKAFDSVPIDLLLQKIKKIGIEGKIYNFLTNFLKNRSFKVKIGDQLSESFKIFTGVPQGSVLGPLLFLIFINDLPSFISNKASSVGIKMYADDVKLYYAHENDDHSNQLDKAVEALEKWSKINGLEISTEKCFVLYLGKNNKKKEYFINSKKISESESVRDLGIIIDSKLNFSEHISKIIRNAYLRIFQILRVLKSREIKTLTAAYKTFVRPQLEYATKVWNPNLKKDIDKIERVQKFFTRKALRKCGFVYKKYGERLKITGL

SEQ ID NO: 150106 - protein, 139 aa, Heterodera glycines
  Coding regions on vcDNA: vcDNA=SeqID_76529; Strand=+; Position=1 -351,416-485
KAEVQRIWDVFVDGIWPIFAPNIRHLSLASYEIHYDIYEHKPTPIEPFELVNERTNEKLTLKKEVASFFAISHWVLKRCPILGETAAVQQQQQKKDENLCRLNNVSVFMLCNTNCIGPLSPPAEAAAERTGQSSEKGAV

SEQ ID NO: 150107 - protein, 129 aa, Heterodera glycines
  Coding regions on vcDNA: vcDNA=SeqID_76530; Strand=-; Position=1 -82,251-354,692-789,959-1059
  Homolog annotation: Hit_ID=CAA27317.1; Match level="QueryCoverage =98%, HitCoverage=72%, E-value=1e-59, Identity=85%"; Hit description =unnamed protein product [Gallus gallus] sp|P26990|ARF6_CHICK ADP -ribosylation factor 6
MGKILSKLFGKKEIRILMLGLDAAGKTSILYRLKLGQSIKSIPTVGFNVETVVYRNIKFSVWDVGGQEKIRPLWRHYYVGTQALIFVVDSADRDRIDEARQELHKIINDREMRDALILIFANKQDLPQV

SEQ ID NO: 150108 - protein, 152 aa, Heterodera glycines
  Coding regions on vcDNA: vcDNA=SeqID_76531; Strand=+; Position=1 -108,156-212,328-414,609-815
MGESASFKGIPGGRSSVKADEAYSDVSTPTSIEKECEDKDVNTKSENNSTLGKKRHGSTCDQWLTKPAASVADKIFDEDDPTFIPMAEFMENLEQKNRRGAKGFYVDPVLELRFLSAGDRNFELIRRYRFPDEGIDFISSLVKDDLQPKRWQ

SEQ ID NO: 150109 - protein, 80 aa, Heterodera glycines
  Coding regions on vcDNA: vcDNA=SeqID_76532; Strand=+; Position=1 -44,207-349,438-493
  Homolog annotation: Hit_ID=NP_510362.1; Match level="QueryCoverage =100%, HitCoverage=30%, E-value=4e-22, Identity=50%"; Hit description= isocitrate dehydrogenase (41.6 kD) (XO790) [Caenorhabditis elegans] emb|CAB02822.1| Hypothetical protein
MPNLYGSIVDNLAAGQIANPTAMILCCANMLNHLHLNSYGTALRHAVEKVLKEGKVRTRDLGGFANTSDFASEVIANFQM

SEQ ID NO: 150110 - protein, 185 aa, Heterodera glycines
  Coding regions on vcDNA: vcDNA=SeqID_76533; Strand=-; Position=1-558
  Homolog annotation: Hit_ID=BAA95789.1; Match level="QueryCoverage =96%, HitCoverage=47%, E-value=6e-11, Identity=26%"; Hit description =KED [Nicotiana tabacum]
KENGTNTGESSKNKTKKKKKAKKTKKEKNGEKENGKDMKNTFEDKMSQDKVSTFDDTNENVKGDKMFTKNWEDQLSEEKESTKKFYDTVSFAVSEKMPKNDAKGNCQTDKVSPYEKTDDNDDKALTKNLEGKEKVDKTQNKEKENKINEEEKTKHKDSGTNGEGTVAKKEAAVTNAKTKKAYRIA

SEQ ID NO: 150111 - protein, 327 aa, Heterodera glycines
  Coding regions on vcDNA: vcDNA=SeqID_76534; Strand=-; Position=1 -24,84-329,3640-3911,3959-3980,4600-4738,5066-5220,5487-5610
  Homolog annotation: Hit_ID=AAO19577.2; Match level="QueryCoverage =27%, HitCoverage=33%, E-value=6e-43, Identity=94%"; Hit description =chorismate mutase [Heterodera glycines]
MDANKMIQKGYVKLWTANKPLPPQNVPDLQKDTRPKVTAATEEMILALKVFQKFRKNKNCWASVEKKLLKSQTFLSLAEPNGKDAMRKAAMSYLRFSADQLDTLPLSALLREFRYLIGLKEHFERRAVVLAERVFGADVITLEDEQNLRQLARNIGQLRASLDTIKRRLGFAVDAGATDSEATNGQMNVYVGEIANGEGVLWSLEIQPEAAKESFAARGREMLANPMHLSSPNHDDARRFEGYSNFVYGSSALVLLLVLCCGCCALFLLLWRFCFDRAEQDAMDRKGFKPLRSFELVEDDDELVSEESDIEGDEEKGAAKAQAKGTD

SEQ ID NO: 150112 - protein, 55 aa, Heterodera glycines
  Coding regions on vcDNA: vcDNA=SeqID_76535; Strand=+; Position=1-303
QWALMSPGLRTVHSPDQQKYFRVRFTRSSVKSNIFFGIHHAHQPKVKSLLKLHIN

SEQ ID NO: 150113 - protein, 325 aa, Heterodera glycines
  Coding regions on vcDNA: vcDNA=SeqID_76536; Strand=+; Position=1 -199,250-1028
  Homolog annotation: Hit_ID=XP_526439.1; Match level="QueryCoverage =71%, HitCoverage=65%, E-value=1e-44, Identity=30%"; Hit description =PREDICTED: similar to zonadhesin [Pan troglodytes]
MPFKIDILFACALFIAASASPILPTSADAKDAIKPSDDHGDEISTPIRHKLVKDTDGEETANKRAFLFDGQTPFTPGVMPFVPGGMPPNVPGTSPMIPGMMPSVPGMMPSMPGMTPNVPGTSPMIPGMMPNVPGMAPSVPGMPPNVPGTSPMVPGMPPNMPVMPPNMPGMMPNMPVMPPNMPGMMPNMPGMQPNMPGMQPNMPGMMPNMPGMMPNMPGMMPGMMPNMPGMMPNMPGMMPNMPGMMPGMMPNMPGMMPNMPGMMPNMPGMMPNMPGMMPNMPGMMPNMPGMMPGFTPQFPGINFNNNLINPSLNPGGFNQMPNQIG

SEQ ID NO: 150114 - protein, 47 aa, Heterodera glycines
  Coding regions on vcDNA: vcDNA=SeqID_76537; Strand=-; Position=1-144
RQAFESTKKGFGQTVVLGVIDQELKIPPDMLLMGRTIKGAIYGGVIN

SEQ ID NO: 150115 - protein, 86 aa, Heterodera glycines
  Coding regions on vcDNA: vcDNA=SeqID_76538; Strand=+; Position=1 -92,269-394,770-812
  Homolog annotation: Hit_ID=CAE66990.1; Match level="QueryCoverage =98%, HitCoverage=40%, E-value=1e-16, Identity=45%"; Hit description =Hypothetical protein CBG12388 [Caenorhabditis briggsae]
MKGLMDAGKKAFGCTRKCMNTKAGNCEKTLKCGLDFPPDNVAVQEVKKCALNSGLNTANAQALCKCASAAGVKNLTPAICAKVKVT

SEQ ID NO: 150116 - protein, 65 aa, Heterodera glycines
  Coding regions on vcDNA: vcDNA=SeqID_76539; Strand=+; Position=1 -116,176-257
MYKKAKEWIKLEKGREKGKSAASFYDPFWSLWHFTLMTCPNLFKVKNHNLPIFCFSFSDMLTTLF

SEQ ID NO: 150117 - protein, 68 aa, Heterodera glycines
  Coding regions on vcDNA: vcDNA=SeqID_76540; Strand=+; Position=1 -56,107-257
MRFGLPAVKPMFQTVGKIRPIILNLRALTNEFDRLSESYFGIGNDESSPNNLHLTNEHELNYIITGNE

SEQ ID NO: 150118 - protein, 283 aa, Heterodera glycines
  Coding regions on vcDNA: vcDNA=SeqID_76541; Strand=+; Position=1 -97,589-925,1297-1714
MDGVFMLRMLTIHAGILVCTEVVDAMWEDFIANRLQLRTAATESPPAVSTPPKPPPAVICFSAPKASYAATGGGVECVTAATTASDPTIYRRKTSVLVPLLSAVQEQCHKTEFAQDLPRHSATYTAASGATLAVASRQILVPPRRDQFLLKTPNPSEYHSEQRQALRHLTVSSDNKPSNVAAPLVPKYHQFSMMSKCRQRHLAPASYGKIGCRSRRRTSSSNGQGGIVPSWSAMFGSALAPFQNRSFSLNSAVAQQLPSEIPEVSSCGEEASLVEVPAQFGNI

SEQ ID NO: 150119 - protein, 146 aa, Heterodera glycines
  Coding regions on vcDNA: vcDNA=SeqID_76542; Strand=-; Position=1 -195,710-955
MHEYINQALAMQKLEIGIKERNIFKCQDAEIISDTNFSEIKSYQKKIGNYKFNIKMLYNEIRVTAEFRHQWKERRLLWEREEAEKKDPKTWKKRTDEMKKICEERLEQSKGAGGSNKRQEPDTYTRNWDELLRQEREYLDGGLWGK

SEQ ID NO: 150120 - protein, 69 aa, Heterodera glycines
  Coding regions on vcDNA: vcDNA=SeqID_76543; Strand=+; Position=1 -100,372-481
MTYCSYSNFIVQRFDIKFIIPYLFLITFYLRKIEIFQFLVILFFIKLIFGLLSTSGIIVTSSVMTSFKG

SEQ ID NO: 150121 - protein, 150 aa, Heterodera glycines
  Coding regions on vcDNA: vcDNA=SeqID_76544; Strand=-; Position=1-453
MNSEKSEKANTILVEAAKKETERAWRDVAALAEVGDFAKSSRETLNRAIKSREKAPYANGVRELYLKMSDSIWEIFKIMDQINLESIKAESAWREFERCKTFDQATKFEEQSQNSLIEARRLHFESRRVQSQMLNYENRLQTIVWEHMGI

SEQ ID NO: 150122 - protein, 364 aa, Heterodera glycines
  Coding regions on vcDNA: vcDNA=SeqID_76545; Strand=+; Position=1 -52,210-419,738-1570
MLFNIISLLLFFSYFAEVILTSDDEKNSFAFDLKKRLEQFKRSNKNEKANEMEEIENKVESQIEEAIGLIKNLTNNEIQRLQNFNEFGSSYSFDSDNLPTKDHRASSNTFHIPNCGIRIGTSAEHKAKSRTSNRNNKMFNELEQQAAGIKQTLSAQKTATNEQPQNTLSNTRKKLLELRARMDKVGIKPMHKANSGEERKQSLTISPTKSPKGIVVDKRKIQRDKILNKWRWLMGSVVLSMQELYFNAEKSQKYKPIERQLLSETLTNLKLAKHEASKDSAQILGLLSNAKKFFDQYQTHRKKLQQAQKIGHEHLSEDDDLYQSDLGSENEQENSGKNQGLPVVFIFRKEKWMLGAIKDFKKAP

SEQ ID NO: 150123 - protein, 292 aa, Heterodera glycines
  Coding regions on vcDNA: vcDNA=SeqID_76546; Strand=-; Position=1 -37,123-345,737-863,909-1012,1101-1267,1475-1695
  Homolog annotation: Hit_ID=NP_490770.1; Match level="QueryCoverage =94%, HitCoverage=98%, E-value=2e-12, Identity=27%"; Hit description =phosphoglycerate/bisphosphoglycerate mutase (24.9 kD) (1B166) [Caenorhabditis elegans] gb|AAK21514.2| Hyp
MSMITDLERLLDNHRPTIVQTLYLIRHGHRLDIIEGIDGGWKKQLESKKDLVLSNISDQDLPLSEMSDQDVPLTKHGFEQAKELGEWFKSIPIDQIYSSPFQRTVATANGILEGRNGGIYLNIEPGLTEFYKPCQQKIEYLHQNDSYQLFKFSNSKYSSVYNKRLLELGIMGRPLLKQPKELENEKAIKLEKEKAKELENECNSVVEQTLRHILRTNKNAKHVVLVSHLGVIALIHELLSGEWVSVGQTTVSKFVQYAEKDSQNVDDELKRFRLEYSSGMSHLSETHYLRPH

SEQ ID NO: 150124 - protein, 75 aa, Heterodera glycines
  Coding regions on vcDNA: vcDNA=SeqID_76547; Strand=+; Position=1 -117,747-857
MKRERNVRRLPQDEKTVRDHKARNLQRDDVHPVAEKSEWNNFRTFEFNRPDEKTIGTLISLQCFVSFAKIIDNVS

SEQ ID NO: 150125 - protein, 213 aa, Heterodera glycines
  Coding regions on vcDNA: vcDNA=SeqID_76548; Strand=+; Position=1-642
MTSLYACGGLHSTRRIYAAEDFTLRLRRTSLYACGGLHSTRRIYAAEDFTLRLRRTSLYACGGLHSTRRSTSLYAAEDFILRDGGLHSTRRRTSLYAAEDFILRDGGLHSTRRRTSLYAAEDFTLRGGGFHSTLAEDFTLRLRRTSLYAAEDFVFTLRQRRYFSLFLDAAEDFSLYACGGVSACPGIELPLTKSLSNTLHGPLTNCNVNNIST

SEQ ID NO: 150126 - protein, 167 aa, Heterodera glycines
  Coding regions on vcDNA: vcDNA=SeqID_76549; Strand=-; Position=1 -252,323-470,529-629
MSKFPSHKFKFNIKIEHTEFGNGTKYFFHLYCAKREYNNFYAETNLGKKEGQIEFWDGICENNMYRLGVIVAQSTANQLTFLIEEDFYVNIQCQRLMLNANQRDINYDLDINKNGASGAEIKCYQTKERTESERRRIGDDVAGPSEQKELPDKNRVPKITQDLLANF

SEQ ID NO: 150127 - protein, 118 aa, Heterodera glycines
  Coding regions on vcDNA: vcDNA=SeqID_76550; Strand=+; Position=1 -45,122-282,728-878
MNSSAMEVQIIKESELYLHFKDERPCWPFIGLSLTFGMLATVDFYFALIQIVNHNLVWLGYLGHSTGDRSHYRETFAVELKKFSSLIGLGNLSLGNNTISASGQLFQTPAIQLISSAN

SEQ ID NO: 150128 - protein, 552 aa, Heterodera glycines
  Coding regions on vcDNA: vcDNA=SeqID_76551; Strand=-; Position=1 -358,437-568,617-736,841-944,1115-2060
  Homolog annotation: Hit_ID=EAL43426.1; Match level="QueryCoverage =77%, HitCoverage=28%, E-value=1e-16, Identity=26%"; Hit description =hypothetical protein 388.t00006 [Entamoeba histolytica HM-1:IMSS]
NFITLKRLHEQNLSIYEAIEMIKLFQDKAGEDPKGVFNTSKIITDSAHNIRQEFPSGNTTTSEKGRKIAFWQFFQHITPNLMRMLDNNAALYMSIDENKLLKNVIKNVKNEIDKNFVEILKEKIQNVEFHHSAIEGEIAKYIKEEVDAKKNCDEQLKAHYWSMLDAKELDADSYLKDIENDFIQIANDKESEKKKIEGYFEGLRRKWDDVISKEAKIELMKNIRYDLAINFEFNPSKDIHDRVKSMDFDEKLNDVRQISSFVSNEHYLPIIVNLSKIEIVNYKYDTKTALEKLRELVDGTIKEQENELEKANKEKKGIEWKKWETDREKQKTSKEFEENTKASEENDKKKQTLETNKKEMENEKSKMVATNKEFIAVIEKIKNKETITAEDKKALQNLCAFTKWYINHNGTINGIATKLEQTISEQKKKQPNLEKKLHLKTKEEKQLEQVKNIQQKLKGIVDKIGGIEKSSGTNLWEFCAEEESGKEKKVDEQNKEIIETNASSSSSSSLSEPKQKKSKTKKEGTADGGKKRTHLLDKFGGILHHEETAEEK

SEQ ID NO: 150129 - protein, 134 aa, Heterodera glycines
  Coding regions on vcDNA: vcDNA=SeqID_76552; Strand=+; Position=1 -153,358-609
MSFRSHPWILNQEFERKATNNESEALDATRRCASHLGPHLNNKSIKKEVGNTGTTLKNPKNGTYNGPANGLHGLLRRVRIGRVGGAPVLLHAAVPVRHCALHVALQIAHTQRHVLLAQRGQQLPSVENALIFEA

SEQ ID NO: 150130 - protein, 44 aa, Heterodera glycines
  Coding regions on vcDNA: vcDNA=SeqID_76553; Strand=-; Position=1 -104,2087-2117
MVKISDFSPAAPIGTVMPRELLFIQRKMAQNRKICAFGITKSDF

SEQ ID NO: 150131 - protein, 97 aa, Heterodera glycines
  Coding regions on vcDNA: vcDNA=SeqID_76554; Strand=-; Position=1 -254,483-522
MANHFNRQPLLLCVLSLFVLLQLLAVLRPPAIDATGLPSGGGCCCCQQQAAPPPPPPQQSCCCCGGGGGGRRKRQLFSGLAELEKFREESNFGEEAH

SEQ ID NO: 150132 - protein, 26 aa, Heterodera glycines
  Coding regions on vcDNA: vcDNA=SeqID_76555; Strand=-; Position=1 -18,452-514
MKVKTRIVYLKFKANRKNQDFLNNLN

SEQ ID NO: 150133 - protein, 312 aa, Heterodera glycines
  Coding regions on vcDNA: vcDNA=SeqID_76556; Strand=+; Position=1 -354,711-856,908-1346
MMNRQIDTKKQKPKITYEGQLYTFDKSSADGTRKFWRCEYKNSCKGRIWTDLDDQFIRLATPHTCPVNAANVEAQKVKTAIKRRALTTLEPPAVIRSEALQNVPSPAGLLVTQDASKLRYCTDTVLAENLRMLTSVAFLPLSDIRTAVIALDTEFGNVAALRPLIDWLLNNYIGQPRPNGTWSQPLFPPEQWNVYTRTLNGEARTNNYAEAEHHRLQGAFNCRHPSIWHFIDVLRREQKGTNGKYASFIAGLEPPKKAKKYQAADERIFNLVQNYNPVNPNYDNDHNYHINHNHHIILEFLRGISRNYHMNP

SEQ ID NO: 150134 - protein, 146 aa, Heterodera glycines
  Coding regions on vcDNA: vcDNA=SeqID_76557; Strand=+; Position=1 -7,1493-1588,1655-1861,1921-2051
MPTKNGAGQANSGERSKLDKSTARGVGNGSPKEAAVPATTPQPAAGEASGEREWGDENGKFIISFVRSANAAAKAEVSQRKKEKPDIFITKKLPENKKREFVSGKNPDYETLKQLDMQIFLKKKLSGTQARPHDFQSQVSSQQSAM

SEQ ID NO: 150135 - protein, 219 aa, Heterodera glycines
  misc_feature (149)..(149): Xaa can be any naturally occurring amino acid
  misc_feature (215)..(215): Xaa can be any naturally occurring amino acid
  Coding regions on vcDNA: vcDNA=SeqID_76558; Strand=+; Position=1 -130,194-230,290-422,493-604,821-1041
  Homolog annotation: Hit_ID=NP_508928.2; Match level="QueryCoverage =93%, HitCoverage=20%, E-value=2e-61, Identity=58%"; Hit description =drosophila Discs Large homolog (107.0 kD) (dlg-1) [Caenorhabditis elegans] gb|AAK39197.2| Drosophila disc
KLIGICSLLVNYVRPVIVLGALKDRINDELVSRHPDRFSSCVPHTSRPPREGEVHGRNYYFVTKRNYYFVTKAEMERDVKSNLFIEAGQFQNNLYGTSVAAVMEVAESGRHCILDVSGNAIRRLQNTAHIYPVSVFVKPLNYQQLLSAXFIVISFREWDSLLSEEDALKQFERCQRQEQNFGDLFTGKCRPLVGWDLFLFKITKYLNKHNPVPKXLVLP

SEQ ID NO: 150136 - protein, 176 aa, Heterodera glycines
  Coding regions on vcDNA: vcDNA=SeqID_76559; Strand=-; Position=1 -87,248-554,1079-1215
  Homolog annotation: Hit_ID=CAE63234.1; Match level="QueryCoverage =97%, HitCoverage=41%, E-value=2e-15, Identity=35%"; Hit description =Hypothetical protein CBG07596 [Caenorhabditis briggsae]
MQLQIALALSKEECEKERELRRGDDIRLQIAIEESKRELARSSSLSSPSGGIDPVEKQGTSKSHGALDDLLSLGLDDVFRSNIPNATAPGSSAQTQQQPPQLGVFNDPWSPRPSTTIPMVETAPPVSAHQTTTNPFLVGSSTTAMTNNKNNPFSTNERPSPSLNEMMQAKNGGGAY

SEQ ID NO: 150137 - protein, 287 aa, Heterodera glycines
  Coding regions on vcDNA: vcDNA=SeqID_76560; Strand=+; Position=1 -98,141-180,225-390,433-593,761-919,972-1211
  Homolog annotation: Hit_ID=NP_509241.1; Match level="QueryCoverage =96%, HitCoverage=20%, E-value=3e-17, Identity=22%"; Hit description =putative protein, with 4 coiled coil-4 domains, of bilaterial origin (XH957) [Caenorhabditis elegans] gb|
VYFLQMFHIFFVNRGYMLVLEPPALGSVYDLQKCIADSINIDINEQYLFLSGGASINRNAMLSAISDVGTDTNPIFLVRRITNTQSEPTKTNSDGINEIYQDWEISMDRMLGIVPTNSPSAISECVDLGKKCAQLAENIVRFCNNVLIEHQFLYQGWMSVISNLDENILRIQRRLDKSIGQAEKLETFRQNGRSLLNGFDKILETLKKIVLPPSLLSLGHSSTNLSDSDGSAEEITLFDWISSKDPAYSLSSFSQHVLDHLGKTTDEELREAQHLLAMVQDVSQKPQ

SEQ ID NO: 150138 - protein, 245 aa, Heterodera glycines
  Coding regions on vcDNA: vcDNA=SeqID_76561; Strand=-; Position=1-736
MENKFILVPSDLYKNLLKPDAGEINVDNAKNKLSSLLKQRKLDATSKNLLYNQELRRFLKLRKEIEDKPVKVELSDGSLMVFKPKQRERDSKIPTQIVNDEGLDETGSIPTLEDPYTTAEESDAESTTSTPKTRPLIKPMRVGTSKFRQKQKSFVVKKKGKIMSIINNDPEKFGVGYRGHILRADGTAYLKSNVNQALERILRRSPENAPSPIGTKALEQRLRNDPRTSGILKQKFNEQSGSGVK

SEQ ID NO: 150139 - protein, 284 aa, Heterodera glycines
  Coding regions on vcDNA: vcDNA=SeqID_76562; Strand=-; Position=1 -317,531-1068
MSSTSSKKTLQSVVEQVIQQDAEIKSSEKPLKQNELEKSERKSTHTVYNLLDHKQSFWKLARPKFAVINFLCPGCRRINYKHKDQFKLMGEDEFHFTQVMCPGCVKERDELISPHPKSVLYCYGQFNDSIPVLQKMGVHVHKGPPRDELLSSLKKPLLLILDDLLTIIDEKTLSELFIKKAHHLNMGVIFITQNLFERKVKVARINSQYIVLMSAPNAALQIRNLGVQLFPKNLAFFLSAYKDATLSPYGYLFLDLHPASTPLLRIRTRIFKEDEEKALYIQND

SEQ ID NO: 150140 - protein, 45 aa, Heterodera glycines
  Coding regions on vcDNA: vcDNA=SeqID_76563; Strand=-; Position=1-140
FVPNLVVHPEDNDPLPTGKGHLGELTDEKPDNILEFISAGCKNYG

SEQ ID NO: 150141 - protein, 65 aa, Heterodera glycines
  Coding regions on vcDNA: vcDNA=SeqID_76564; Strand=+; Position=1 -65,425-556
MNSSSTFISDGWPGVLERINQGRTQFTHCPYVPTSAVVFAASADELQNVVRLFVSQLTEMSLSCR

SEQ ID NO: 150142 - protein, 736 aa, Heterodera glycines
  Coding regions on vcDNA: vcDNA=SeqID_76565; Strand=+; Position=1 -181,491-2520
MDPFPLFRMLIGGPWILVAIGAGAVGLLALYLYIKFNPAFRIYRSLITVIILLGLVGSGETVQRRISLPSTFTPHSLSYCHSLCEPSMTDDFANGGFGDCNDDFGGGGGGEVSPRAQAGRDAQRRRSLSNHSELGAHGRPMARCKSLGRPKPLPPKSERRCVADDVNLFAGENWGDDPWQRVEVERFFREQEARGKRMIHERTGEQVPFPSTLGLLPANRQEIAPGWTVADYFAETRCRSLKWPQWPCIYSPGGVIGSSKRSRTLQQKGHVPWRLGQTHCDWHPLEELWWTTQSELDSECDGAPMTRERARADSTERVAQPAGRWGISPPNWPTKGALHRIDAINNGRPPRPCHSIWGRSPSPRPVSPPKHLPPTEDTIHSHHFHCHQTLSHQGTFPSDRSELAFSKTPSLLRSYSSSSSFCSFSTFSSKMYRSRDTERSSGRTARRLRLLELTAAELARGEFDHNRMVQQHGGNADRVLAAADHLTELRGKFSRNWSKCHDIPGKDRLRHRFDVDRWLVVAPSNAGENGGQNDGQSRGKMRSVVVVVPPTSPPVGGSTPGTVAKKHPPTSPKRGLSPSALPGPSNRGLPPLSPTVAIAKPVEEITQVAELLGKVGDEMNRRMAEDEERSATGGELLSLPSEDEVVPETPTPSSPRAGSVAKKISDENGRGKKGVSALHRGPGITGQGCLVFNANDGTPRELSSDDEDRFGGGARDHFDPIGMCWTLLPILFFSHF

SEQ ID NO: 150143 - protein, 401 aa, Heterodera glycines
  Coding regions on vcDNA: vcDNA=SeqID_76566; Strand=+; Position=1-1206
MDPTDNEQEHGNDGNERTGGSPTTQVGAVPPSAKKGKGKPKVVETSAIQSNSGVQPGGTRNLRSNGITIRAIRDQLERASGPLADRIAEARELLEPDLNAGDKPQSAVCLSAMERGLRELVDIFKGHFDRGLAAIGDEAPELHDYLYDAFTVPLPAATRCLGLRSHPPPAELLQIAMEHLADLRTVRRTLEDVEKLSQLSSETRSGTGDSLPAGDDPASRRTPPPQQIHDPTDHQSDEWLFGRFPRRFEQLNIQEGRRAVTPVMRSVAQVAQYPVVNAGGAGANIREWVNQASDRRERTHSPRIQQAGNRPRPPGPNRSVTGDPNPCSRFRIPEQIRGRDPSVLRAARRNEATTAFETVRLQPPTFSGKPEDWTTFWSYFKRAVDDKPIPGFEKQPYGFAA

SEQ ID NO: 150144 - protein, 80 aa, Heterodera glycines
  Coding regions on vcDNA: vcDNA=SeqID_76567; Strand=-; Position=1 -108,383-517
MIYLLQLLAIAFGLFSNSLLESNVVIVSKNDKRIGKVIPPGRYKIAVWDKMKKKKPDYCDDVFIKMKNQSFLTEEALHDE

SEQ ID NO: 150145 - protein, 196 aa, Heterodera glycines
  Coding regions on vcDNA: vcDNA=SeqID_76568; Strand=-; Position=1 -291,462-761
MIAKNICGMFLFENVFSPLHKFVPSFLNECPSLRIVSFIFDDIFAEFPFDDSAITSDGQAVVKWLFTPLQNAVPKVLICTLDMDDENLASKIEAFKAAFASASSPVNFIVVMCFIPSSFADPVVPFVLTNELTREQLAFKETDKSDDCFVLVRCPIVRDASKWAKWEEEAIGWECFDQWNQILFNVDEIGDGSVNA

SEQ ID NO: 150146 - protein, 193 aa, Heterodera glycines
  Coding regions on vcDNA: vcDNA=SeqID_76569; Strand=+; Position=1-582
MRTKGENINANTVNPIVITDIQIEESSLNTAGNGVQIVQISENPLENNGSQKLNYIMVNNSKGTMGQINLSANLETINWTEIHRLFPPPKIALKAPQPEEMTLSQQPSTSNGVAEESLPSCSTIGICKNGKAFRIWDNRGRPVGIVSPSFTDSHRRPTPYFRPRQLQPVPQQPQQQQHNQQQKNIFYKINLFL

SEQ ID NO: 150147 - protein, 83 aa, Heterodera glycines
  Coding regions on vcDNA: vcDNA=SeqID_76570; Strand=+; Position=1 -141,335-443
MVHWTTKVSNGAKDGSGGAAKNIGDVAWDTNQYFSQPQSADVEMSAYLCLAHIHAAGQQRACAAHCPLADRAAQFPGRLFIHA

SEQ ID NO: 150148 - protein, 18 aa, Heterodera glycines
  Coding regions on vcDNA: vcDNA=SeqID_76571; Strand=+; Position=1-55
IRCLHLCRQRPTTGTKMI

SEQ ID NO: 150149 - protein, 155 aa, Heterodera glycines
  Coding regions on vcDNA: vcDNA=SeqID_76572; Strand=-; Position=1 -51,102-155,204-280,328-610
MTQQLPTGFGQMPPLGQVAHLVQPMLINAAEQQIPHPFNADGTHNQHFLNGCVAEVGQLLPPLCLIVVSVEHRAAQQTTAGPLPVTNCVLRTGDGHRVEASGWQAYAHVLASLSVGSAYWFINCVARARFQRLGCWFRVGVGGPNALVVPHVAPQ

SEQ ID NO: 150150 - protein, 274 aa, Heterodera glycines
  misc_feature (15)..(15): Xaa can be any naturally occurring amino acid
  Coding regions on vcDNA: vcDNA=SeqID_76573; Strand=+; Position=1 -110,174-227,282-362,447-496,1360-1557,1699-1914
  Homolog annotation: Hit_ID=CAE58703.1; Match level="QueryCoverage =86%, HitCoverage=21%, E-value=8e-47, Identity=46%"; Hit description =Hypothetical protein CBG01887 [Caenorhabditis briggsae]
ITDCKQKLMSLCHAXEQETYKPHSPWVDQSSKYRNEYTVGEPPVAPAAYTAFYTVGEPPVAPAAYTAFFDDMVATGPFASSLYSTSRLLEDMVATGPFASSLYSTSRLLERSRSRTRERRQAERRQALRSQSQARNYFRASQYPAPLRTRDYSTPPSSYITRTPTAASSFVSFIDNYGAKQYDLARSQSLHRSSVYNSNLALSRSRGGIDYYLGSGRMSRVDSYADALHSRYEWNVPSSHELYYASSPGPVGYPPLAHYHARILISRNLIIFEK

SEQ ID NO: 150151 - protein, 85 aa, Heterodera glycines
  Coding regions on vcDNA: vcDNA=SeqID_76574; Strand=+; Position=1-258
MASCGGGGGDRCAKGCDDNDPNYGDNIGMVRIMEAHSFFLLCRRPSFLYDVLCRNRFTDYCSLPFHFPFAFPFPLLKFLSSVHNA

SEQ ID NO: 150152 - protein, 29 aa, Heterodera glycines
  Coding regions on vcDNA: vcDNA=SeqID_76575; Strand=+; Position=1 -18,372-443
MGAGGGHNSINVGKILNKSKIVRNFMKTL

SEQ ID NO: 150153 - protein, 195 aa, Heterodera glycines
  Coding regions on vcDNA: vcDNA=SeqID_76576; Strand=+; Position=1-586
MSGPIQKGIINALKALDNAKSATSLLLHPDPDLSNWENAVNLEAQFDRVVKEIRTMEMQMDSLRDSSNAWIELLARLTGDDKDNGEKEYIKFDKNEKIAERYDAATTKLRDLRDLEATLSATAKLHRGRADREAKADQLANPQQQPPMPPAMAAPMTVPTFTAPLYQFQPIQLDKFFGQKRKWPEFYESLQSAIG

SEQ ID NO: 150154 - protein, 866 aa, Heterodera glycines
  Coding regions on vcDNA: vcDNA=SeqID_76577; Strand=+; Position=1-2601
  Homolog annotation: Hit_ID=CAA82797.1; Match level="QueryCoverage =74%, HitCoverage=89%, E-value=4e-50, Identity=25%"; Hit description =gag protein [Ascaris lumbricoides]
MQMDSLRDSSNAWIELLGRLIGDDKDNGEKEYVKFDKNEKIADRYDAATTKLRDLRDLEATLSAAAKLHRGRADREAKADQLANPQQQAPMLPAMAAPMTVPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQAPRTPNQRSRRPNQPMALRDMTFIASSLDEGHRHQGYVSQQHTQQAKKHCQQMRNQVQSVKKGPPYPCIFCNSNHWHDECQNVDTLNQRISIVREKKLCFKCMKPNHRASNCARPSKCYHCKCRHPTALCRDQYKAENGINTPSTSCSEEKPNANDGKRSTVIEQQQMCNAIQSKETRALLMTTKATIFNPSRPSLSMMGTIFIDPGSHRSFISSSAAEQLDLNILSTEECYLSSFGEREPKRYISDRVAIGILCPDQDRFIFNLNALKFLLNDLPVLQLNALDNDELQQKKLSLPNESRQPDILLGMDVWHQLNVQPIEQLPSGFTICQSKIGNIISGTGRIELKQPSNISFVLMVNNDESPQSSKAAQRQKNIQQKEKAELRRHQRNKLLSSIATLRSRRKRESAPISSKSIVIDLSSDSDASGIEIIQNPVRDRQAKSPNEHSTAPIPMAVQRLTPTRKSSSVAKRPAFSSSKQPKGKAANPTQTSQTNELNRKMKALSPTASGSGANHHCVATLARSSDSTTVIDKGSQQNCLNMSSATISKTPCQQHSSEKTLN

SEQ ID NO: 150155 - protein, 162 aa, Heterodera glycines
  Coding regions on vcDNA: vcDNA=SeqID_76578; Strand=+; Position=1 -135,553-906
MTSNKQRQLVHKDVKLRHQFKQKHSSMQLTARFRKQIHMSSTIEENCQYATEFCQLPDNSTLIWKSTCNGNECQTCDYEKAEVINGKFTAAYGESMATWISEDHQKTLTFAKNAPELIACDGTRIVMSEQNFGIAKEQYDDIVTTTTRWKRGIRPEQLASGK

SEQ ID NO: 150156 - protein, 165 aa, Heterodera glycines
  Coding regions on vcDNA: vcDNA=SeqID_76579; Strand=+; Position=1 -150,330-436,484-577,929-1009,1065-1130
  Homolog annotation: Hit_ID=CAE68672.1; Match level="QueryCoverage =73%, HitCoverage=37%, E-value=9e-35, Identity=58%"; Hit description =Hypothetical protein CBG14576 [Caenorhabditis briggsae]
MFLRLNCLAAILFALCCTSSTFWLGSATTDEQNKAPHVDHHKLTETQQYESGKETDPKHDHEQFLGKDEARQYEELTPEKSKERLARLVPKMDLNSDGQVDELELREHINFMQKRYVNNDVERTWKNYKEEQLKDGLLDWQRLQEFDLRKTTGGPGDFTGIRQND

SEQ ID NO: 150157 - protein, 260 aa, Heterodera glycines
  Coding regions on vcDNA: vcDNA=SeqID_76580; Strand=+; Position=1 -41,95-142,194-385,445-537,604-669,735-845,891-947
  Homolog annotation: Hit_ID=XP_312464.1; Match level="QueryCoverage =98%, HitCoverage=25%, E-value=8e-33, Identity=35%"; Hit description =ENSANGP00000021939 [Anopheles gambiae]
DLEQNQRISFFKQNKKQFPMFPYQEENKKQFPMFPYQEEKSRWDDYGEIIRPEEYIIVDSAAWDDYGEIIRPEEYIIVDSAAATQQLATVTKEKDTAGDEEEGEEQRRVAVEEWPTKCISYIAKIEILCKVEFIDFEGRSDGILCKVEFIDFEGRSDGESIKKLLSQIKPKQLVIVVIVHGTAAATRHLAQYCQGQQIGKTFTPSLGEVIDATIESHIFQVTLSDQLMSSLLFQTVKEAELSVKEAELSWLDARIANRRL

SEQ ID NO: 150158 - protein, 196 aa, Heterodera glycines
  Coding regions on vcDNA: vcDNA=SeqID_76581; Strand=-; Position=1 -57,292-823
MLCPFQIISKINAKVLSLMFRRILVNRKTVLATDPTARVLALAPPNVAVVKLVLEMQDALAAGNHVEPMLALFSGTGKLRYAKEVERISPHLLATAVEAQDFQELLQKDQDRVKVERYLDACERNPRLAQEMAVAKIVQEHKNRRLCFATLSFCEQLPALFGETTHLIIDEAGQAPYVQILNLVKPLPCLTKVLIT

SEQ ID NO: 150159 - protein, 87 aa, Heterodera glycines
  Coding regions on vcDNA: vcDNA=SeqID_76582; Strand=-; Position=1 -30,263-370,433-558
MLLKLADYFQVASLKSRCETHLINCVEIPLIDRFLLIERFGLDNLKNYFLHLNVDNFRAFFKANNEQFFPVISKEFLLALSVRLLDE

SEQ ID NO: 150160 - protein, 51 aa, Heterodera glycines
  Coding regions on vcDNA: vcDNA=SeqID_76583; Strand=-; Position=1 -30,325-450
MLLKLADYFQNYFLHLDIDNFRAFFKANNEQFFPVISKEFLLALSVRLLDE

SEQ ID NO: 150161 - protein, 51 aa, Heterodera glycines
  Coding regions on vcDNA: vcDNA=SeqID_76584; Strand=-; Position=1 -48,230-337
MTQKWLTLCCNNHKMKTPGDNHGLIGPCPDIITSEKLYYVQTLRSNTFHVP

SEQ ID NO: 150162 - protein, 223 aa, Heterodera glycines
  Coding regions on vcDNA: vcDNA=SeqID_76585; Strand=-; Position=1 -605,1489-1555
  Homolog annotation: Hit_ID=XP_232753.2; Match level="QueryCoverage =70%, HitCoverage=3%, E-value=2e-09, Identity=29%"; Hit description =similar to CUB and sushi multiple domains 2 [Rattus norvegicus]
MVVKPDHVHVLPNSVEKTDQMLMLRNSMVEKPDHVHVLPNSVEKTDQMLMLPNSMVEKPDHVHVLPNSVEKTDQMLMLRNSMVEKPDHVHVLPNSVEKTDQMLMLPNSMVEKPDHVHVLPNSVEKTDQMLMLRNSMVEKPDQVHVLPHMMVAKPDKMLMLPNSMVEKPDQVPFFPNSMVAKPGQVVTVAKKERIVLLPHSLVYIFILSKMFMHCEIPGQIKTQ

SEQ ID NO: 150163 - protein, 298 aa, Heterodera glycines
  Coding regions on vcDNA: vcDNA=SeqID_76586; Strand=+; Position=1 -204,856-1008,1108-1229,1345-1762
MDNKIGQREEEQKRQEEKKRDEECRRETEEEEEEEREEEREGEGSEGDGTNAEEMTERDAEQTQNATKDSPAEKMPSANGGKNSAINANDRKGTTAPSNGTSALTVEKYLMHLRQKEEREENRTLRSTLLDKSRVYQAQVDELTNELVRNAEMVARLQSEDLPQPKKPRKVPSSSVHTHSTRHQQQQQLLSTHQLQLNGGHSTRPQAKVPTNASLQQHAASKCGGIAHQLQQASTSATDADEICVALQHFVERNRTNQPQQQQQNGAGVVEAIMGVLKGGQGEGGTSTAQPTQPSKSM

SEQ ID NO: 150164 - protein, 231 aa, Heterodera glycines
  Coding regions on vcDNA: vcDNA=SeqID_76587; Strand=+; Position=1 -90,1128-1271,1324-1548,2062-2242,2452-2495
  Homolog annotation: Hit_ID=NP_497576.1; Match level="QueryCoverage =94%, HitCoverage=16%, E-value=8e-47, Identity=47%"; Hit description =C.Elegans Homeobox (ceh-44) [Caenorhabditis elegans] gb|AAK29942.1| C.elegans homeobox protein 44, isofor
QHHPLDPSVPSPAAASMAENGEVNGLDPTGARIDENIVKLGPRPLNTAELAAQCTRLMRGYSIGQRLFARTVMVQVSQSQGSSQGSLSELLSKPRPWHKLTDKGREAFRRIFGWISDDAAIDLLCQLSPRKVALTERLEHPNPQSLIGAGDPTQQMEHPQSRQSLAPTVAFEPSPKFASKENGSGTAPATLSATPGGGRWRHDDIPKEKIIDIYEAEAKRMEQECHLERAI

SEQ ID NO: 150165 - protein, 34 aa, Heterodera glycines
  Coding regions on vcDNA: vcDNA=SeqID_76588; Strand=-; Position=1 -36,726-794
MYKKWSKYVHKYVFLHILPFLVKYFPIEYPFGKN

SEQ ID NO: 150166 - protein, 262 aa, Heterodera glycines
  Coding regions on vcDNA: vcDNA=SeqID_76589; Strand=+; Position=1 -47,94-275,868-966,1154-1269,1311-1349,1686-1979,2391-2402
MTEIAKDGHFVSLIDHGVIKENEKYVTISELGEGNLKEKFKDLKTLISEIKAAFAHLSELVIILKEVMNALVKFHEVGIHLHFNPNNLFVFKRRNYGLGKMLIKLFVSDGFVLFDNQKKEKNQKNFMVKVKEEDIEYSTDFAAPELLQQLSNGTDEKGEVEVTPKMDIWSAGITIFEIAFSEMVGFYSTCHRTVVGELFRSTKLNLDVERPAANHLLKLKLPEESAHAGSEKWWKRYWVVIDDILIVWHKLPEIAFLAVRGL

SEQ ID NO: 150167 - protein, 95 aa, Heterodera glycines
  Coding regions on vcDNA: vcDNA=SeqID_76590; Strand=-; Position=1 -176,240-337,667-680
MGTPSDTPPAAADIKDDNNNNNKKKEVGGILNIGNTCYMGAALQSLANVTALSNFLMENENRLPNKLVDGICANDQKHFGVATTGGAIRTEALEK

SEQ ID NO: 150168 - protein, 248 aa, Heterodera glycines
  Coding regions on vcDNA: vcDNA=SeqID_76591; Strand=+; Position=1 -8,222-319,382-560,621-1082
  Homolog annotation: Hit_ID=EAA75622.1; Match level="QueryCoverage =43%, HitCoverage=65%, E-value=5e-27, Identity=55%"; Hit description =conserved hypothetical protein [Gibberella zeae PH-1] ref|XP _386153.1| conserved hypothetical protein [Gib
MAIAGCTFTALLKFPASFPFYPPTMTFLTDILHPNIDTSGKVCISILHPPGIDPLGYEQASERWNCDRTVESILVSIQLLLAEPNFNSPANVDAAVLFRSDPARYREEVRRRVEIVMAAPTQPEGQGTTQPSEGQRTQAADEQGTQPPEEQRAQPPEQQGTTQPPEQQVTTQPPEEQRAQPPEQQVTTQAAEEQGTQQPEEQGTQQPEEQGTQQPEEQGTQQPEEQGTQQPATPPPEGPQQQTDEWYM

SEQ ID NO: 150169 - protein, 112 aa, Heterodera glycines
  Coding regions on vcDNA: vcDNA=SeqID_76592; Strand=-; Position=1 -25,288-542,729-784
MHRGGGKHGRFVRPAAKPTLFLSKWPQQKEEDKRNKRRSGDSGRSSTALLLCDEKFNQRNSSGIGGGRKGRGGRRGGGNGEGGGGKAEEERKKREEKEEEMERRKSGRGGKR

SEQ ID NO: 150170 - protein, 84 aa, Heterodera glycines
  Coding regions on vcDNA: vcDNA=SeqID_76593; Strand=-; Position=1 -118,276-412
MFLVPMLLEAQQKMASGWPIYLYQIEHINSGYPSDIPVKGSSHGVELDPLFGIPIPYETENATEADKHFQRALIETITSFTKAG

SEQ ID NO: 150171 - protein, 239 aa, Heterodera glycines
  Coding regions on vcDNA: vcDNA=SeqID_76594; Strand=+; Position=1-720
MPAKPNLLSQELAELERRKMELEQMIASAKKEVPERKSRRPKKCQSSDEPAPQDEPEEKGPKAAALSDAPTTQPSHPPLGIVPPPPPSPVGSDMADLLHGHVNKWAMEREEAVHFLQKKKRDVAVPVHDALKKFNGGIKRLRTALDDVQESVGSIAAGVNELASSTSDGLVITVTLLQVEVDRQAVELRSLRRSLHPPPDVETVETLSVISSEEGAAVAEPSSAASVAKATEKGEKKKK

SEQ ID NO: 150172 - protein, 72 aa, Heterodera glycines
  Coding regions on vcDNA: vcDNA=SeqID_76595; Strand=-; Position=1 -117,695-796
MGENDDGDGTAGGAVGGMTSAAASADSALSVHDEFAGLQKELAKELKVKDGLERFLSMASVLNPKAYTPELL

SEQ ID NO: 150173 - protein, 301 aa, Heterodera glycines
  Coding regions on vcDNA: vcDNA=SeqID_76596; Strand=+; Position=1 -185,262-405,453-568,633-768,814-961,1008-1181
  Homolog annotation: Hit_ID=NP_061868.1; Match level="QueryCoverage =98%, HitCoverage=23%, E-value=7e-29, Identity=30%"; Hit description =MOV10-like 1 [Homo sapiens] emb|CAI23226.1| OTTHUMP00000028556 [Homo sapiens] gb|AAK31983.1| MOV10-like 1
MQQDEKNRILICTPSNTAADLVARRILETNILSPIQMRRYYSLGKSVDERDRGLDTIIKMENCSIYGLYDERFKIDNYAMLTKQNVRLVFATLACSAYLEEEIRVSDFFSHIFIDEAGQSIEPETLIPITRFATRNTRVVLCGDHQQLGPVVKAHFLKAYKSCHLSLMERLMTTMRAEENSFRINGQKSVYTDGRTFCQLTDSYRCHPKIIHFSSVNFYDGTLRAVNEENRKSFCDWKHLPSKNFPLLFHALTKGAEVKQLEGRSYHNEEEVEVVEKYIQLVRETDIEDTEIGAISPFKQQ

SEQ ID NO: 150174 - protein, 283 aa, Heterodera glycines
  Coding regions on vcDNA: vcDNA=SeqID_76597; Strand=+; Position=1 -109,396-776,1328-1500,1852-2040
RLNTSLTRAKELVIVVASLDFVRNLNSNPSPINIGSDSDSDSSTSESCDEDEGTVSDLSPLSSSDEEGKQFWAKQIPWRKRPSERNTLRGPKIEEMANAMSKLKTNEYTEDIQYEDLTTDPLENWPEDGGQDDGYANWNCPSKATTLLSDESKQNDSGNGYGSELEARVDKLLNANAGIGGPITDFAFNMAKEEGYSVQFVKYVLDSVDIHYRDEKLLRHMGKDVLRRKLRGAAREENWHESGPRPFDHQRALFIFLFFCRQFDEALHDSPSASSAGFHFDSV

SEQ ID NO: 150175 - protein, 108 aa, Heterodera glycines
  Coding regions on vcDNA: vcDNA=SeqID_76598; Strand=+; Position=1 -181,804-947
MPSSSADCSADRSLPSSSSVIFQQFTIDQRHFVDEDYFSLESIFATNTNICCTFESKTPPVCRAHRLQFRQSRRNPRGCPIGQLGTVATPLLHIGHVHLQAIPLNNIH

SEQ ID NO: 150176 - protein, 33 aa, Heterodera glycines
  Coding regions on vcDNA: vcDNA=SeqID_76599; Strand=+; Position=1-101
ISSFSQREVSKCRRNVSFWRPFGAVLRPPFGAH

SEQ ID NO: 150177 - protein, 179 aa, Heterodera glycines
  misc_feature (169)..(169): Xaa can be any naturally occurring amino acid
  Coding regions on vcDNA: vcDNA=SeqID_76600; Strand=+; Position=1 -119,162-297,443-597,2838-2888
  Homolog annotation: Hit_ID=CAE66640.1; Match level="QueryCoverage =93%, HitCoverage=34%, E-value=2e-36, Identity=53%"; Hit description =Hypothetical protein CBG11977 [Caenorhabditis briggsae]
SSVAQSANSGDGQQPMATIRPKIAQMSAEVVDSNPYSRLMALKRMGIVQNYEQIREKTVVVYSRLMALKRMGIVQNYEQIREKTVVVVGVGGVGSVVAEMLTRCGIGKLILFDYDKVELANMNRLFYQPHQSGQSKVAPPPSLLFPPPFFLPNQLINSPSSSMDSAEFXFGTLRNPAPK

SEQ ID NO: 150178 - protein, 124 aa, Heterodera glycines
  Coding regions on vcDNA: vcDNA=SeqID_76601; Strand=-; Position=1 -139,1395-1630
MRNDQSPNEKRSDDGEGPSAHILSLTLITHSCTHSSVVVLSPDHSNGGRLTDQSQKGPMDDIQMGKRIEQSLFGDVVEHNDDEAIRSAGEKTQIADEVESDVEGELNERIEKEGEGLEEDDKLC

SEQ ID NO: 150179 - protein, 48 aa, Heterodera glycines
  Coding regions on vcDNA: vcDNA=SeqID_76602; Strand=-; Position=1 -73,349-422
MKKSKGNDWKKLTAKSDQMMAILIGESHGVLLVDGHKFDLIGHVMPGH

SEQ ID NO: 150180 - protein, 412 aa, Heterodera glycines
  Coding regions on vcDNA: vcDNA=SeqID_76603; Strand=+; Position=1 -46,405-472,526-633,687-1004,1319-1708,1821-2129
  Homolog annotation: Hit_ID=NP_492332.1; Match level="QueryCoverage =39%, HitCoverage=43%, E-value=1e-08, Identity=31%"; Hit description =putative protein, nematode specific (1J184) [Caenorhabditis elegans] emb|CAB02108.1| Hypothetical protein
MIDLAKLAYALILLRVQPFKKGDIIWVVYRKSINWPAKVTAYYPKDKKVSYVFFPLKQKNAVFKTDPAKVQLFTLDDQMPENAPLDLEYSFEQARRILQGVPEEEIIAENVQKEEEALSQMKPKKKPLTTADALKKATTGTPKGTPRSQQKQPKIVATETKFKQGDPVIVDTPMGMWPGMFISYVKGNPSLVNYSLFPREEHSHEVVQTSGEAIMAFPPEQIEQAIEDGRSSNSEVLLAALQDVQKYMKEMGHAASPHEAVGTTSSMQSPTMDTPPPLSAEDAQPMDTSEELGKEKPKKRLKVELTPPRETKPHPRMSLNSRLSNHTGDEVVDNESHSPAVATPPVPKSKKRTAASLKQNDSGNNKSLSTLIEAAKMMEGGSSSEEHHQDGVSMPNSPAGSSGAAPLVNSSR

SEQ ID NO: 150181 - protein, 88 aa, Heterodera glycines
  Coding regions on vcDNA: vcDNA=SeqID_76604; Strand=-; Position=1-338
IIPSLPPIFDVMRVSQNNKNLFFVHSFISSHILFVIFGIRFYCIQVNNCVTKMCPFWIVPLTFSSFLSFCVQSAFVRCFSESHKSEAI

SEQ ID NO: 150182 - protein, 36 aa, Heterodera glycines
  Coding regions on vcDNA: vcDNA=SeqID_76605; Strand=+; Position=1 -48,159-221
MTENVDSEGDGDKMEVALNSIFTKKDNLISERNTRL

SEQ ID NO: 150183 - protein, 98 aa, Heterodera glycines
  Coding regions on vcDNA: vcDNA=SeqID_76606; Strand=-; Position=1 -192,449-553
LLSKHKLELERAKRKFGDNQRSLVDAKHSLDVIRQKHQATVDELGKIDLRLGKLHDELAEKHKNDQKKCFAELANEMLTKNKEDLKQLEAKKKAEAED

SEQ ID NO: 150184 - protein, 245 aa, Heterodera glycines
  Coding regions on vcDNA: vcDNA=SeqID_76607; Strand=-; Position=1 -264,317-436,678-773,1020-1274
MENEMYQNLDKIRDDPQWSLLISCFKKFASKGHGQPYDREDTFKEAFEEYRVQKMAEKSIDCNSYDELVARRVAQEQKIHKLEAAIAEAQCVSEQLEKEAADCENDIASMDRYIEEIQMVASAKERTLVREELVLLHENLNKTEARIYERQPIIFKQSAKIRSDYNAFMSRLRVICEPLFSEDELQQHLAELEQCSVEQAIVEFQRCRDDNKLTRLLNQLKAMMECQIRAVQQAEESMRVTNSKL

SEQ ID NO: 150185 - protein, 422 aa, Heterodera glycines
  Coding regions on vcDNA: vcDNA=SeqID_76608; Strand=+; Position=1 -1253,1510-1535
  Homolog annotation: Hit_ID=S08405; Match level="QueryCoverage=100%, HitCoverage=35%, E-value=1e-64, Identity=33%"; Hit description =hypothetical protein 2 - silkworm transposon mag
VADALSRVAIKWEQIEGKSREDIPFLLTVDEEIGLHRKTIEKETFEDSILSRVLSQIKASWVEPIDDDELMPYFRERDKLYLDGKIIRMGRQIIIPQKMRKRVLKMIHRAHFGIVRCKARARDLVWWPNWSEEVENYVKECHICQRNASNEPRVDPEYKWPEAKYPFERVHADLAGPIWGTNFLIIVDAYSKYPFVCQMNSTHSSAIVNYLREVFAFFGSPQCLVTDNGPQFVSSETEQFLENEGVRHLKTPIYHPSSNGQAERFVRTFKEIMGKLLEEGMSLKVAQFVFLQEYRVTRSATEGESPALRFLGRGIRTALDKIKMPPNLPEANGNGPSGEVTELEGPSRAQIKDKNLDPGDNVWVKEPSGKWAPGVLLQPKGERMWEVMLEGNTVTRTAHLDQLKSRRIGQSRHISTRASKRS

SEQ ID NO: 150186 - protein, 190 aa, Heterodera glycines
  Coding regions on vcDNA: vcDNA=SeqID_76609; Strand=+; Position=1-573
  Homolog annotation: Hit_ID=NP_499936.1; Match level="QueryCoverage =88%, HitCoverage=43%, E-value=3e-11, Identity=31%"; Hit description =putative nuclear protein (4B256) [Caenorhabditis elegans] gb|AAD14753.1| Hypothetical protein W03G1.5 [Ca
MAALVQSVDEFMAGIPVEEKEEKEQHLKSPTPEPKSPPPEQNPSENGESEETLRSEESANQPGPCHGAPPMRGRGQGGPGRRGPTMGPGQKQKRVNYLVRQLGKEFHNGPRSCQCWSCRRGKNWDGRGGRGGGGGSGRGYAGGRGGYGCAGGHEAHGHERGAHGHGRGAHGHWRGARGTYHHGGQGHHGT

SEQ ID NO: 150187 - protein, 669 aa, Heterodera glycines
  Coding regions on vcDNA: vcDNA=SeqID_76610; Strand=-; Position=1 -167,211-288,1098-1208,1252-1329,1359-1894,2018-2279,2413-2607,2913 -3086,3132-3245,3312-3389,4577-4713,4757-4834
  Homolog annotation: Hit_ID=AAO52302.1; Match level="QueryCoverage =35%, HitCoverage=21%, E-value=3e-09, Identity=22%"; Hit description =similar to Homo sapiens (Human). Dentin sialophosphoprotein precursor [Contains: Dentin phosphoprotein (De
GKAIHQCPFRAATSALCSAGVEPAKLVPKPADFSRAAEKRPRLSNACRCPQQQISGLVLRTSQECRGKCRIRFSVCSATPTAGVEPAKLVPKPADFSRAAEKRPRLSNACRCPQQQISGLVLRTSQECRGKCRIRFSVCSATPTVLDNRHFSFFSAITAHLLRRIPTKVRLRNTMFCNGAQEFPRTGNSRRKSTRPVRPAPTPPQTVLPFIFCLSNVIHLHFQLVTSFGNADHWNPPSICGELESHWDDPLPFRKPSERSLFNRRNKDQFGTRPTSTSDAKEKGDFPLPFTFFAMAFTSQVQFLANLSIPVINVVDPLMPKGSKPFACNSNETGDSFSNIGEFHAEDYNCLLDQQKKSKSFTDSTEKKKNTQRMRGVKSMVGSSSRSVDTEHGNNTERNGAKTKRRTTTKQPQSPPSAQPELNLQSLSQSQQNSREQQKSDRDSMRGSNSRSCGTEHENNSQRNGAKAKRRTTTKQPQSPPSAHNQPELNLSREQRKGDRDSMRGSNSRSGGTEHGNNSQRNGAKAKRRTTTKQPQPPPSVQPELNLQSLSQSQQTSREQQKSDRDFPTLAGLVLRTSQECRGKCRIRFSVCSATPTEPQPPPSVQPELNLQSLSQSQQTSREQQKSDRDFPTLAGAPSNKFQDLSSEHPKNAEESAEFVFPFAPQPQP

SEQ ID NO: 150188 - protein, 117 aa, Heterodera glycines
  Coding regions on vcDNA: vcDNA=SeqID_76611; Strand=-; Position=1 -69,198-260,991-1068,1110-1253
MVETGPYLFDQSFEIQGRPSMPSVKAFEKSHFSADQDLTLTDELLERICNHEIGHILSNAQNENGFFFKNIVIKSDGFTSHTSHSLPATYNDEQFLAYIDLKLGNFLRNQRENIKFL

SEQ ID NO: 150189 - protein, 30 aa, Heterodera glycines
  Coding regions on vcDNA: vcDNA=SeqID_76612; Strand=+; Position=1 -27,265-330
MEAAANPHNVLEESVAADNQHNVKIFITMF

SEQ ID NO: 150190 - protein, 85 aa, Heterodera glycines
  Coding regions on vcDNA: vcDNA=SeqID_76613; Strand=+; Position=1 -176,237-318
MQVPFELLNEWTKEKLTLTKANELDNRWIMKRCKIIGEKEEKQQNTVFIWLVAGTNCIGPLSPPPEKVEEQTGQSITKGTSSADQ

SEQ ID NO: 150191 - protein, 150 aa, Heterodera glycines
  Coding regions on vcDNA: vcDNA=SeqID_76614; Strand=+; Position=1 -197,685-939
  Homolog annotation: Hit_ID=NP_702160.1; Match level="QueryCoverage =52%, HitCoverage=13%, E-value=1e-16, Identity=43%"; Hit description =hypothetical protein PF14_0271 [Plasmodium falciparum 3D7] gb|AAN36884.1| hypothetical protein [Plasmodiu
WICNDVWMDIFPSFDHAQLGLKLALLSPRFNALVDKHFNGKSESFSADKMSDGQNNKNSDQPQKKLGCLKRTTPNSYCSNSYCSNSYCSNSYCSNSYCSNSYCSNSYCSNSYCSNSYCSNSYCSTRTAPTRTAPTHTAPTRTAPTRTAPT

SEQ ID NO: 150192 - protein, 232 aa, Heterodera glycines
  Coding regions on vcDNA: vcDNA=SeqID_76615; Strand=-; Position=1 -111,157-316,718-870,1274-1392,1892-2045
  Homolog annotation: Hit_ID=CAE62104.1; Match level="QueryCoverage =99%, HitCoverage=27%, E-value=4e-22, Identity=33%"; Hit description =Hypothetical protein CBG06138 [Caenorhabditis briggsae]
MASSASSSTKLRQPSGNHFETQNHHVNNTMEVVELSNVDNGFGEGLAIVGDQTVSLPQQHLNKSGDRKDNENGDDVMVVGQNEDAKKNGTDKANVDCILLDEEEENGTNNNDDDEIRLIEEPVPKKARPTDHPGPQPPVNRTSSAHLVLLRHRCWAQQTLATDRAKPRDQLVLRSVGPIGAVLDALLSAINTQVQKAPYAVRKLILDKQLVLPNTISMPPSHVVELLIEHDP

SEQ ID NO: 150193 - protein, 142 aa, Heterodera glycines
  Coding regions on vcDNA: vcDNA=SeqID_76616; Strand=+; Position=1 -40,677-740,1432-1510,1558-1629,1892-2032,2151-2183
  Homolog annotation: Hit_ID=CAE66466.1; Match level="QueryCoverage =60%, HitCoverage=14%, E-value=8e-10, Identity=45%"; Hit description =Hypothetical protein CBG11743 [Caenorhabditis briggsae]
MGESIRVIALIDMGPLPSTIQPEPSESNGEWTATRDASGEIFKVLVDFSDQIVVEKASVDEAFLDLTAHCEMELNSQPMEELVQKLNDEIAQLFPSTFLVNESDKQQTVIAEERLNSLKEWLSNDCRVSRQQGQAPIDETNF

SEQ ID NO: 150194 - protein, 338 aa, Heterodera glycines
  Coding regions on vcDNA: vcDNA=SeqID_76617; Strand=-; Position=1 -287,328-489,528-752,788-1130
  Homolog annotation: Hit_ID=P12258; Match level="QueryCoverage=79%, HitCoverage=40%, E-value=4e-09, Identity=23%"; Hit description =Transposable element Hobo transposase pir||A25684 hypothetical protein 108 (transposable element hobo) - fruit
MASHSDEYEIDEFWLDNIAYDDGEPRPKSKKCEIIAGIDLQSPRQRREWAESRIFRQYYDIILDGNGNLTNYVICKSCVPPAKPVTFNYAGFHNLRRHLENWHGIKFGTNDKHDKMELALVEFCVADGRPFSIIKGEGFKHFMDAYAELIIERHLQKRSVLSADLLPNERTIGRKVIETLQTKESELDKKLIDVRQSACTLSLDFSQKLGVDYAVVVIHFICKNWLRNLNHFVLHCVPWPGDIQKNRENISGFIDDVLELYAIKNCRIYYVTDEGSNLSHLGDRESHHFCLAHIISTICRRITEPYVNANLTNEKKQIVNTMNEFIKELHVFIGELRS

SEQ ID NO: 150195 - protein, 27 aa, Heterodera glycines
  Coding regions on vcDNA: vcDNA=SeqID_76618; Strand=-; Position=1-83
IFLKIHQKHALKTIKKTLLEGAVFFNT

SEQ ID NO: 150196 - protein, 182 aa, Heterodera glycines
  Coding regions on vcDNA: vcDNA=SeqID_76619; Strand=+; Position=1 -186,238-600
MRGQRLCQNSQLYLWPTICAVGRNAWPITSSLAKSGYSSAVWLKPRVGKVAKPTWRFCRKFLARPGYNRLILPLLKKGAKKMADLPEWAESNSEPSEAEDNDTARAEEAGTSAAEHGETSSRVWSWTTRMPKAGENEDKGKSQNTENRAKSEKPRKKEKQKNKDIFDQLLQDETDDEEDKWA

SEQ ID NO: 150197 - protein, 34 aa, Heterodera glycines
  Coding regions on vcDNA: vcDNA=SeqID_76620; Strand=-; Position=1-136
KKNLGTSVLYKCFSTQLKVNCRNFIHFFRLLFYN

SEQ ID NO: 150198 - protein, 55 aa, Heterodera glycines
  Coding regions on vcDNA: vcDNA=SeqID_76621; Strand=-; Position=1-200
YKKIGIVEFNSGTIHTLIKQPFLIHLQILAIKNQIYNKLVQGYIEQISIFLILFC

SEQ ID NO: 150199 - protein, 130 aa, Heterodera glycines
  Coding regions on vcDNA: vcDNA=SeqID_76622; Strand=-; Position=1 -33,84-126,404-632,727-783
  Homolog annotation: Hit_ID=NP_499618.1; Match level="QueryCoverage =99%, HitCoverage=10%, E-value=1e-43, Identity=65%"; Hit description =E1-E2 ATPase, putative E1-E2 ATPase (3N488) [Caenorhabditis elegans] emb|CAB11550.4| Hypothetical protein
PFLQRLLLVHGTWNFERSVKVTWNFERSVKVILYSFYKNICLYIIALWFAFFSAFSGVTIFERWIIAMFNVFFTAWPPIILGLFDRPLSQRMILRHPQLYQSFQQRAFSNGRFFFWVGVSLWHSLLLFFL

SEQ ID NO: 150200 - protein, 119 aa, Heterodera glycines
  Coding regions on vcDNA: vcDNA=SeqID_76623; Strand=-; Position=1 -129,369-599
MIHLVPPFADRMLAFFQIPTPQLNKQINVQTDLKPYENDPKKVGQSTIWDEYGEDCQVIKKLLHKIEQLINCKNETNCIIKLRAAPCDTVPNSNRMLCYRDLYCDKEMLKEDYDRARTL

SEQ ID NO: 150201 - protein, 157 aa, Heterodera glycines
  Coding regions on vcDNA: vcDNA=SeqID_76624; Strand=-; Position=1 -39,525-609,732-893,1389-1575
MSGGPPITTLAEARADFGRAKGQFKRAVMTLPNHSLDGTFSSVSAHFGLDSSVGVQIVHDLGLTDPAAIFEKRVDHLCEMVSEHWDVQMFGQATRYLRLHSLHYNDLAGCFRRPSTSSAQVGGAKEGGKTKDSGGQKVVAPKKKKNGGAKKSRITKK

SEQ ID NO: 150202 - protein, 67 aa, Heterodera glycines
  Coding regions on vcDNA: vcDNA=SeqID_76625; Strand=-; Position=1 -40,163-324
MALPNHSLDGTFSSLSAYFGLDSSVGVQIVHDLGLTDPAAIFEKRVDHLCEMVSEHWDVRMLGQSDS

SEQ ID NO: 150203 - protein, 49 aa, Heterodera glycines
  Coding regions on vcDNA: vcDNA=SeqID_76626; Strand=+; Position=1 -137,291-303
MCSVKFGILFLLLLTIMPFIFGNDKTNLPVEKLTARQIRSEKPINGNKA

SEQ ID NO: 150204 - protein, 137 aa, Heterodera glycines
  Coding regions on vcDNA: vcDNA=SeqID_76627; Strand=+; Position=1 -58,490-690,1080-1234
MHFNLFPLICIVIILQFKLVCLAPDSNGGQFELRIENFSKFANGPIRTIKLGQPKYIRGLHWRLNAFVNEQNGKKSLNCLIAIINSDTNWHCAVHATAEIIVGEKKIKTENFQGFVNRDEIIREWNFTEEIDVSGEF

SEQ ID NO: 150205 - protein, 207 aa, Heterodera glycines
  Coding regions on vcDNA: vcDNA=SeqID_76628; Strand=-; Position=1 -57,347-366,408-581,661-856,901-996,1036-1116
  Homolog annotation: Hit_ID=CAE68555.1; Match level="QueryCoverage =88%, HitCoverage=45%, E-value=2e-40, Identity=46%"; Hit description =Hypothetical protein CBG14388 [Caenorhabditis briggsae]
MGPKLLGTFTGGRLEEYIPKEIDNFRKLDMNGCVVTFCHNDLLAGNILLPEAHSGNIRSCSASTASNQKDIVFIEFEYASYNYRGFDFANHFIERAINYGKKTTPFYEILPKNFPTEGQMLEFMYNYEKEGCPNASEEHLQESARTMVEETAPFVPVSHLLWGIWGLFKGASPSIEEFDYTSFAKYRLVEYYKTKDALKKIEGTDDN

SEQ ID NO: 150206 - protein, 54 aa, Heterodera glycines
  Coding regions on vcDNA: vcDNA=SeqID_76629; Strand=-; Position=1 -40,96-220
MAEKRRKERNNAKLILYGRPRKTKQCSSVFSKEDFAQIGKKDGSSANERIKRIR

SEQ ID NO: 150207 - protein, 81 aa, Heterodera glycines
  Coding regions on vcDNA: vcDNA=SeqID_76630; Strand=+; Position=1 -74,133-304
ADSSKVPGGGKVVPRSAAGGGLRQRRAGGAANTGRTRTAGGGGGGGMNSGGLWRFYTEDSTGLKMFVQMILLIGPNVKSKF

SEQ ID NO: 150208 - protein, 34 aa, Heterodera glycines
  Coding regions on vcDNA: vcDNA=SeqID_76631; Strand=-; Position=1 -90,124-138
MYRWVGVQQGGELLTVYERDGEEGVLRFAQTRID

SEQ ID NO: 150209 - protein, 186 aa, Heterodera glycines
  Coding regions on vcDNA: vcDNA=SeqID_76632; Strand=-; Position=1 -145,189-483,525-645
  Homolog annotation: Hit_ID=EAA45732.2; Match level="QueryCoverage =48%, HitCoverage=17%, E-value=2e-09, Identity=37%"; Hit description =ENSANGP00000025171 [Anopheles gambiae str. PEST]
MNPFRIGLPTIEMDDNFDVNNFGQVESGIDRTFADQELSPSSNESIEKYDIWAQPKSPCGISIPSTISGDPDSDFLSKIEAELTCFKAGQRMEVNGDLFSWWNENTGRLPELSKLARMVHSIPATSVSSERLFCKAGLIFANSLRNRLSGNTVRQILIVKANLDALLLAPTNEFESDEESKEKDDF

SEQ ID NO: 150210 - protein, 155 aa, Heterodera glycines
  Coding regions on vcDNA: vcDNA=SeqID_76633; Strand=-; Position=1 -107,149-302,621-827
MADEIQQKIVQGIGPDFFSVTSDGWSQITKSPALLSVTVHHINQQFVRADFVLDVIPMTNHTGADIAEEIGNALRTNGLNPEKIICLACPTRWNSTFEMMMTFREQKNVLLTIEGERRGFGVGSSKKSRLDIVPENLPNLEITDFDFCANCALYW

SEQ ID NO: 150211 - protein, 193 aa, Heterodera glycines
  Coding regions on vcDNA: vcDNA=SeqID_76634; Strand=+; Position=1 -282,332-631
  Homolog annotation: Hit_ID=AAL78214.1; Match level="QueryCoverage =83%, HitCoverage=80%, E-value=1e-13, Identity=30%"; Hit description =putative esophageal gland cell protein Hgg-20 [Heterodera glycines]
WICNDVWMDIFPSFDRPQLGLKMALLSPRFNALVDKHFNGKSELTIWRSIEIRRKDKGPEPKLSVRIDDKFVPFPMPDDRPLPSKIRFKHLRMWYIDHSVIAFLRSNHQIFDKRGTYLHLRIQSSHTTEEQPIWDIFVREIWPIFSVNIRHLDFVNAADLDHLRLRTSTTILTDLNQLVSIDSCDLLPDSIGA

SEQ ID NO: 150212 - protein, 77 aa, Heterodera glycines
  Coding regions on vcDNA: vcDNA=SeqID_76635; Strand=+; Position=1 -187,1439-1485
MGFESDNQVHMYTFYEDSPSMGLIASTEIQPNNAKSQELADWVKGQIEGKFAAKIVHELELEVRSWPILWTGFTTKR

SEQ ID NO: 150213 - protein, 231 aa, Heterodera glycines
  Coding regions on vcDNA: vcDNA=SeqID_76636; Strand=+; Position=1-696
MKRTNASNITPPRAKRSMTPALDLDPNTVALAEQERQRTLVFIGLPESNAIRPSERVQEDREAATKILDHLEVEAQPTAVFRLGRYDPQRTTPRPLKVVMPTTTHQHMALGGWKRERARLRSLQNLNRLFVRPALTKEQLKEEYEARFRKRQQNPAPVAPAMQPRQTNVPTPVKENGPNQKEASDDISKPPEIFDQTILVCYEALKSLPPNDKIVHQIQSLEKQYPRLFNK

SEQ ID NO: 150214 - protein, 47 aa, Heterodera glycines
  Coding regions on vcDNA: vcDNA=SeqID_76637; Strand=-; Position=1 -91,1304-1356
MWRINQSLIIYITGGFYFHWTTKLKSKKKIKSALKCTKIYLHVDKAL

SEQ ID NO: 150215 - protein, 201 aa, Heterodera glycines
  Coding regions on vcDNA: vcDNA=SeqID_76638; Strand=+; Position=1 -24,100-222,672-786,1215-1319,1675-1760,1814-1966
  Homolog annotation: Hit_ID=CAE58852.1; Match level="QueryCoverage =75%, HitCoverage=42%, E-value=3e-10, Identity=29%"; Hit description =Hypothetical protein CBG02076 [Caenorhabditis briggsae]
MHLPMYIQVHYNPEHRYPLEHLVDLLAETVLGRYNFELRKNLTIDLFDSAANAAIRDGAGFIVSDRHRFQQISVGAKQARAVLAPTNEVLISLVSDDHSELLKYDASLSNHQRADFLNFLIKDKENEKESEGKAEQKGEKEEAVNTVAGYLIGIFINFMPYLKLFYRLLPLSAFCAFMRKTVKLPILCWLLTLTGAIRRER

SEQ ID NO: 150216 - protein, 69 aa, Heterodera glycines
  Coding regions on vcDNA: vcDNA=SeqID_76639; Strand=-; Position=1 -86,137-167,570-662
MRSFFFASLALVLICASTTVSKPHATVLCLPICQDQWVQLINPENPGIPGNFDTESASGPSQLKKLQIT

SEQ ID NO: 150217 - protein, 22 aa, Heterodera glycines
  Coding regions on vcDNA: vcDNA=SeqID_76640; Strand=+; Position=1 -19,429-478
MTTIPSEISMLKIEKVENLNAQ

SEQ ID NO: 150218 - protein, 68 aa, Heterodera glycines
  Coding regions on vcDNA: vcDNA=SeqID_76641; Strand=-; Position=1-204
MAKVIMGIDDQKKMAKVIIGIDDQKKMAEVIMGIDDQKKMAKVIIEIYDHKKMAKVIIVIDDQKKMAK

SEQ ID NO: 150219 - protein, 261 aa, Heterodera glycines
  Coding regions on vcDNA: vcDNA=SeqID_76642; Strand=-; Position=1 -85,130-433,486-573,627-935
  Homolog annotation: Hit_ID=NP_509807.1; Match level="QueryCoverage =61%, HitCoverage=12%, E-value=7e-51, Identity=62%"; Hit description =putative protein, with at least 2 transmembrane domains (XL442) [Caenorhabditis elegans] emb|CAA90607.1|
MQNRQAGTRSVCSPAHRWRQCYHVRVPYPLYSTSRCVSLKLLSSFRFFPTTVARLLLFLTSFKEFRLKLSERHQLKTLVNLLEPTLDPQLLCLLLQSVALVALDSSTHRNLIEMQVDDPLIQMLLPADDWYYTNHSTKFGHYVKHHAARILIYIGLGDRMHFTSKRSHRLLRPSVTYRPFATTDGDKQQQQQQQQQLNQRRRVHLRDTEDSDSGAGVQPNGDVGGGSAAENIAGTAPGAQWRGGDGKRHAGCDQRGEVIRA

SEQ ID NO: 150220 - protein, 78 aa, Heterodera glycines
  Coding regions on vcDNA: vcDNA=SeqID_76643; Strand=-; Position=1-239
LMCLVTGAVVGGAVPAGTLDGIIAGGGDVAGEGIGGAIDTGGGGGGGSSTPPKNGIAALADTTSLNNEQQQQQLLQQH

SEQ ID NO: 150221 - protein, 44 aa, Heterodera glycines
  Coding regions on vcDNA: vcDNA=SeqID_76644; Strand=+; Position=1-163
FAFRIFWRFAFRFLARKATFTPLRIGLNSQKIFKNFTYKLANFQ

SEQ ID NO: 150222 - protein, 209 aa, Heterodera glycines
  Coding regions on vcDNA: vcDNA=SeqID_76645; Strand=-; Position=1 -153,777-1031,1832-1941,2528-2638
  Homolog annotation: Hit_ID=BAA92346.1; Match level="QueryCoverage =100%, HitCoverage=61%, E-value=1e-101, Identity=76%"; Hit description=CK2 alpha subunit [Hemicentrotus pulcherrimus]
PVKKKKIKREIKILENLRGGTNVIGLLDVVKDPVSRTPALVFEYVNNTDFKQLYQTLSDYEIRYYLYELLKALEYCHSMGIMHRDVKPHNVMIDHEKRQLRLIDWGLAEFYHPRQEYNVRVASRYFKGPELLVDYQLVRIAKVLGTDELFEYLDKYQIELDPRFNDILGRSSKHNRKRWERFVHSENQHLVTPEAISFLDRLLRYDHQE

SEQ ID NO: 150223 - protein, 133 aa, Heterodera glycines
  Coding regions on vcDNA: vcDNA=SeqID_76646; Strand=+; Position=1 -77,366-505,1276-1457
  Homolog annotation: Hit_ID=NP_741936.1; Match level="QueryCoverage =95%, HitCoverage=28%, E-value=5e-52, Identity=77%"; Hit description =SERotonin/octopamine receptor subunit, Tyramine receptor (49.5 kD) (ser-2) [Caenorhabditis elegans] gb|AA
MQRLGPLELFLGTMTYLVIIGITILGNTLVILAVFSYRPLKKVQNYFIVSLAASDMMVAMLVMPLHVVKFLANGQWLLGVTVCQLFTTADILLCTSSILNLCAIAIDRYWAIHNPIAYAQKRSLKLVGGMIIM

SEQ ID NO: 150224 - protein, 130 aa, Heterodera glycines
  misc_feature (29)..(29): Xaa can be any naturally occurring amino acid
  Coding regions on vcDNA: vcDNA=SeqID_76647; Strand=+; Position=1 -162,355-580
  Homolog annotation: Hit_ID=AAS59268.1; Match level="QueryCoverage =70%, HitCoverage=28%, E-value=1e-28, Identity=62%"; Hit description =truncated TA/OA receptor [Ascaris suum] gb|AAS55869.1| tyramine/octopamine truncated receptor [Ascaris suu
LENTHFISYTSVILISGKYAFHFIYKCNXIYGKTFFISYAYFQFVFYKCILISGVWVASAVISVPPLIGWNDWTSQQLVDHCELTSDKAFVVFSACGSFFLPLLVMVIVYMKIFLSARKRIRKNRGKRFA

SEQ ID NO: 150225 - protein, 266 aa, Heterodera glycines
  Coding regions on vcDNA: vcDNA=SeqID_76648; Strand=+; Position=1 -408,517-759,1075-1221
  Homolog annotation: Hit_ID=AAS59268.1; Match level="QueryCoverage =18%, HitCoverage=15%, E-value=1e-19, Identity=87%"; Hit description =truncated TA/OA receptor [Ascaris suum] gb|AAS55869.1| tyramine/octopamine truncated receptor [Ascaris suu
MSCELADMQPKHKRSHRLPVAATSVIALASATGAQILRKRTLTKAPFPDKRGVVSVPDVVGVPIPHTVGGVNAKMPQGGGGICRLTACSASMHSSVLSSCCSVQQPQLYVPKLALYIDGIQAEEELDGDSGHGGSNKDSPENTVTVPASTVLTTAPAAISHSPAAKSHSLVPTVAAAPSMVALTSSASMMAMASGGERTPAESGTEVAAHKKATSDTEREKISVAKEKRAAKTIAVIIFVFTFCWLPFFCAYVIMPFCTSCYLHPK

SEQ ID NO: 150226 - protein, 78 aa, Heterodera glycines
  Coding regions on vcDNA: vcDNA=SeqID_76649; Strand=-; Position=1 -99,829-966
MPWLHIAHISRDISDAMAFMHGKGFFHRDLTSMSDLFSFGIILCQMIAATDADPDKGVFRTKSFGIVSSTLMHDLLTI

SEQ ID NO: 150227 - protein, 29 aa, Heterodera glycines
  Coding regions on vcDNA: vcDNA=SeqID_76650; Strand=+; Position=1-89
VGSFCGSISTGLTNFFNLICVSQRAKKNC

SEQ ID NO: 150228 - protein, 23 aa, Heterodera glycines
  Coding regions on vcDNA: vcDNA=SeqID_76651; Strand=+; Position=1 -60,707-718
MPSAITDVMTCVANNLINEAKLL

SEQ ID NO: 150229 - protein, 38 aa, Heterodera glycines; identical to SEQ ID NO: 130624
  Coding regions on vcDNA: vcDNA=SeqID_76652; Strand=-; Position=1-348

SEQ ID NO: 150230 - protein, 74 aa, Heterodera glycines
  Coding regions on vcDNA: vcDNA=SeqID_76653; Strand=-; Position=1 -87,622-759
MSFKNLPVGNLKETIGYWERKNCENGKFRRLFAFDPCGHLCACEQCAELIEKSADKKCPICRAQIVKKLRIYRP

SEQ ID NO: 150231 - protein, 228 aa, Heterodera glycines
  Coding regions on vcDNA: vcDNA=SeqID_76654; Strand=-; Position=1 -144,691-954,1430-1708
MPVDSLCEFSGDHCLIRYFESTDQWKNSATSALNHWLYDKFSWTLADKEHFFLTANFDYLIEVATKNRQNDTKISLKDANLIDLFWHNLAQSANEGQLWKRLRLVDQQQIVPIINELCKIKWHKLMKYESIEESTKHFLMIDPFCTLWPNVQQKAEHFADNARVIEAFRRWVFLPRAQLGTESAQIVHASVELFAARTGANLMDTWWKWRTNEMNIFSCIGRTVMLLL

SEQ ID NO: 150232 - protein, 70 aa, Heterodera glycines
  Coding regions on vcDNA: vcDNA=SeqID_76655; Strand=+; Position=1-215
RWFKEGHLASGTELGARKKFEGLRNEPMLSEPILMFPDMENYDEDGYPVTEEIDAHFKDPERNVVSQIFI

SEQ ID NO: 150233 - protein, 194 aa, Heterodera glycines
  Coding regions on vcDNA: vcDNA=SeqID_76656; Strand=-; Position=1 -99,163-389,488-536,614-823
  Homolog annotation: Hit_ID=AAH68338.1; Match level="QueryCoverage =74%, HitCoverage=38%, E-value=1e-09, Identity=29%"; Hit description =Unknown (protein for MGC:85638) [Danio rerio]
MPSPTPEVTFKDRSVHEIHLENGYTYVIEQNLKHFASVITVLAKFSEQILLQPTEDGLMLSASSSARSAYAKVKLCRQFFDRLRARENLGPDGEVFCRLATKSLMHIFKSAAQSSVGPVPSCSLELDPQSDFAYVHLQCLSGIRRCFVLSLREYAMVCDNVFNERQRLKNRVTAHAKMLATLLSPLDCSDVSGG

SEQ ID NO: 150234 - protein, 161 aa, Heterodera glycines
  Coding regions on vcDNA: vcDNA=SeqID_76657; Strand=+; Position=1 -40,1073-1518
MIAKLLDLVDKEKDESDDLVHLVTLFKSLIVKFIAAENEFMKRDLKIFQLKSLYFFMKQIIGEMFAFAIEIGTKMATESNTNQWFFDAIETMRRRWQKIMDKKQNSEFESIGDGTICNLYKFGKSFVQLLEKSTENEAKFEKKVQKYLEKKRITQFFASVN

SEQ ID NO: 150235 - protein, 256 aa, Heterodera glycines
  Coding regions on vcDNA: vcDNA=SeqID_76658; Strand=+; Position=1 -61,140-849
MLSHDIKLVANEKSYYQQCRNPNPGFSPRIPSRHFFFEKEKFWTFGQEFECQKTCKSGPGDVHLCDIPVWFRYIYAYNMFNYKINVVNNVVQINMPNWNLPYFVFLDDPNELIDQKSNELLVYEHHSKQKCFVTQDYKFDKALPKCDPITLYELIKMTKIIVEMQNDQIWISPKDPEILKIIVKFLNYFDIEKTITERMAFSAEGNYCILAQFVMDLLETANGANYLPDIDIIEIFVVQTKEWCTDQRWELKKNFN

SEQ ID NO: 150236 - protein, 79 aa, Heterodera glycines
  Coding regions on vcDNA: vcDNA=SeqID_76659; Strand=-; Position=1-377
LRISNFIFENFAVDNCCYNHDVCYINKYQKRYDCDIKFCNCLNEYPNCFLTKVCSPTHILNILFFRIYYAGQFIFFENF

SEQ ID NO: 150237 - protein, 237 aa, Heterodera glycines
  Coding regions on vcDNA: vcDNA=SeqID_76660; Strand=+; Position=1 -66,137-383,708-818,1118-1328,1508-1553
  Homolog annotation: Hit_ID=CAE64445.1; Match level="QueryCoverage =99%, HitCoverage=39%, E-value=2e-47, Identity=42%"; Hit description =Hypothetical protein CBG09152 [Caenorhabditis briggsae]
KTLGLFHPPQLRLLRMPSENDSNELDERVYSLAFPLKRNELDERVYSLAFPLKRTDKMDADSCGEPSIIDTFAEDDAEGGESLAEKMRQAEVQKTLFAKCKFFLNREVPKEALAFVIRSGGGFVCWDGCAPNSVDEHSEQITHQIVDRKVEKTNINRVYVQPQWVFDCFNARRILPPAKYAPMATLPPHLSPFVDARAGAYIPLERIEHAKQQNGTGQSLTTKIPKNWHKNFLKNSE

SEQ ID NO: 150238 - protein, 71 aa, Heterodera glycines
  Coding regions on vcDNA: vcDNA=SeqID_76661; Strand=+; Position=1 -192,461-484
MIRRGIKVIMRGTTVIRRGTTAIRRGTTAIRRVIRRGSTVIRSGTTVIRRGTTAIRRGTTTVEKEFFNKSK

SEQ ID NO: 150239 - protein, 461 aa, Heterodera glycines
  misc_feature (458)..(458): Xaa can be any naturally occurring amino acid
  Coding regions on vcDNA: vcDNA=SeqID_76662; Strand=+; Position=1 -177,230-354,405-670,721-995,1298-1419,1466-1690,3287-3337
  Homolog annotation: Hit_ID=NP_508993.2; Match level="QueryCoverage =98%, HitCoverage=55%, E-value=1e-79, Identity=38%"; Hit description =fatty ligase long (79.9 kD) (XG556) [Caenorhabditis elegans] gb|AAA80409.2| Hypothetical protein C46F4.2
VTGGKRIEQELAEFDLPFYIVALAFFLKAFFRLYDLLVFIPFKLFADPELKKERSRERKAMPIDGKAMPIDGKPTSSWRHVDTSTALYTELFEGCPTLGKIWDKAAQLHRGHNCMLHRGHNCMGTRDILNVVEEQQPDGKAFQKLALGKYNWMNYEHVDEVIVEVASGLSNLGIVQGQKVVIFSETRKEWMISAIACFKLGLPIVTVYPTLGDEAIAFALAECDAVIVTVYPTLGDEAIAFALAECDAVLAFTSRPLLSKVFASVKDCPQLKRVVYFSELHALAEVAEKAPDAIKEAFKSIGRELYSFNALKALGHSQPDDLAMIMYTSGTTGKPKGVLLSHRNIIATASGQSAVISVSTSDTIIGYLPLAHITSDTIIGYLPLAHILEVCAEIICLSKGCRVGYSSPSTLHDRAVKIKRGTTGDCVELKPTLIACIKVGHDAIFKKVMARRNSKTQXFEL

SEQ ID NO: 150240 - protein, 41 aa, Heterodera glycines
  Coding regions on vcDNA: vcDNA=SeqID_76663; Strand=-; Position=1-208
ELLMLFDSSMCLLLICKISKILVKYQKSNGQKELKNPVIRT

SEQ ID NO: 150241 - protein, 193 aa, Heterodera glycines
  Coding regions on vcDNA: vcDNA=SeqID_76664; Strand=-; Position=1 -66,179-330,495-724,843-976
  Homolog annotation: Hit_ID=CAC21848.1; Match level="QueryCoverage =80%, HitCoverage=78%, E-value=4e-14, Identity=35%"; Hit description =hypothetical protein [Globodera rostochiensis]
MENDQKNILEKVSELEKQTQKKGFFKFQQNCWDANFCHDNLEIIGDKSLIVHHKGNGNGIFKIYIKIQFPLKSRGIITFGFAVKQQTKLDESIRWEKGTYAFDNYGNIRINGKGNESNAQYSYGVGDTVGIGVHLATRQIIFTKNGLRLDTSDFLVAPSFADGSLYPFVSLFGSGDQIEANFGPNFKFDLATL

SEQ ID NO: 150242 - protein, 105 aa, Heterodera glycines
  Coding regions on vcDNA: vcDNA=SeqID_76665; Strand=+; Position=1-378
LRISNFIFENFAVDNCCYNHDVCYINKYQKRYDCDIKFCNCLNEYPNCFLTKVCSPTHILNILFFRIYYAGQFIFLENVLKKDKNNYFILPSIDMHMYFKFFIVM

SEQ ID NO: 150243 - protein, 138 aa, Heterodera glycines
  Coding regions on vcDNA: vcDNA=SeqID_76666; Strand=-; Position=1 -52,136-264,471-551,642-796
MSSLNTFSSADEFSPLQPIFPNLSTSEEMSVLIARIAELNRAQTMEPSVASSEVFGQDGYGMNDDQFSLEEEEGKEQQEDRKTPTKDVSEDHLKAILERIGEMEKQQQQQTKGEGNLTKMKFSGFSFVTAQLNIFRIL

SEQ ID NO: 150244 - protein, 35 aa, Heterodera glycines
  Coding regions on vcDNA: vcDNA=SeqID_76667; Strand=-; Position=1-108
AAEERFLQSQNDQKKILERIFSEMEKEQKQLQTKG

SEQ ID NO: 150245 - protein, 344 aa, Heterodera glycines
  Coding regions on vcDNA: vcDNA=SeqID_76668; Strand=+; Position=1 -585,631-943,1104-1183,1233-1289
  Homolog annotation: Hit_ID=AAA45903.1; Match level="QueryCoverage =25%, HitCoverage=17%, E-value=1e-10, Identity=43%"; Hit description =nuclear protein EBNA2
MNVGDCFCGEALYPLPGEPIDLTRQVVQLPCECAPFHIGCIAASLIRSIQLQPNGQRRGTCPFCRRPSLTEESLLQINGNKLVKYQMQIMLCSINLTLASKVGPLPPPQPLQPPLPPPPPPLPPPPLPPPPQEPPVHIDPPVPLEEMQPQQRRRQIAAIICSRRSNEGNGRELRIHWHSAPYRNDTWEPEQHIRDQAPLIYALWHERHDNGETPSHDYVFPLRPAPWMTTIRAGRDLPEVEFAHSTARRRLFQEANGMMIVQCNMEDHIWNINPVVNGEQHAQPAQAAQEDVAADIEILVVQQQQQAAEAEQPAYEHVRQRHKRGKNFCGAERRRRRFNQRAQN

SEQ ID NO: 150246 - protein, 123 aa, Heterodera glycines
  Coding regions on vcDNA: vcDNA=SeqID_76669; Strand=+; Position=1 -126,166-411
MNNHNNIDPLILDGISSAINSFDTEARNQIMQEQLRIFFNSQPLPTIGSRLNAVYSQIVDIRAQANITIAPGYLQHSIQQIENHLADSLLFLLEWLHDEQMLAEEIVNSDEILSDENLPEFDE

SEQ ID NO: 150247 - protein, 90 aa, Heterodera glycines
  Coding regions on vcDNA: vcDNA=SeqID_76670; Strand=-; Position=1 -85,386-573
MRIEQQISCTIGIARDRIYEWKRELGMNLIQKYTKEEREKFVQMFLMIKKKAIEKYPHLKVTKIEEKIAEKIGVNVETLRGMKRRQGFYG

SEQ ID NO: 150248 - protein, 165 aa, Heterodera glycines
  Coding regions on vcDNA: vcDNA=SeqID_76671; Strand=-; Position=1-496
MFFLFFLIFSANATGPTNYYNKTSDYTDYIGNNIYQAFHLEQELDKSDQNSQNDQNGDKMFSNLTESDQVQTDENSTEFEPMEEENSPNFLRHNDADYGIRLNVEDNYDLCRQFVLQFDAMKAAFLKTHKNPERKKLMRIEQQISCTIGIARDRIYEWKRELGMN

SEQ ID NO: 150249 - protein, 232 aa, Heterodera glycines
  Coding regions on vcDNA: vcDNA=SeqID_76672; Strand=-; Position=1 -493,557-762
MLMKLFISLFSSVFLFMPSFSTKLWTNTETDSLIDSSNRSVDDANLGNVLPSENDDAFVSILIKTDQKQIDQFLEEIYDECGEKKEKNLEIINKILKIRRKNDKKSLKTEEDEQKIKIVHQFIEMQNEFDENGKRKYENVNEIAKIIGVTHSRIYHWIDKYGLSHLKKDIQNDRRIAIVHQFFAMQKELDENGQPKYQNVNEISKKLGVYSSTIIYRWMHKFGLSRKNLFLI

SEQ ID NO: 150250 - protein, 135 aa, Heterodera glycines
  Coding regions on vcDNA: vcDNA=SeqID_76673; Strand=+; Position=1 -188,1978-2125,2190-2259
MPPSDLNASIAKVQNDFALKLLREFAAFYGSASACISPPAVAVTLALTLSGAKDKTSDQLSQVSNSWQCNSDEASMYLALPKERFGLANFLANLTVDSLFEMAQKCRKVKLNVAVPKIKLEQTVELNEPLKKLGL

SEQ ID NO: 150251 - protein, 40 aa, Heterodera glycines
  Coding regions on vcDNA: vcDNA=SeqID_76674; Strand=+; Position=1 -107,410-425
MFDGYFPLLTVFNLASNWHFFRHVSMCWWTKFQTFRILKW

SEQ ID NO: 150252 - protein, 118 aa, Heterodera glycines
  Coding regions on vcDNA: vcDNA=SeqID_76675; Strand=+; Position=1-354
  Homolog annotation: Hit_ID=NP_494142.1; Match level="QueryCoverage =83%, HitCoverage=8%, E-value=7e-09, Identity=32%"; Hit description =predicted CDS, putative endoplasmic reticulum protein of ancient origin (2C256) [Caenorhabditis elegans] g
MLHNTVIEVIDRVCKEMAIRQHKDLLFGGKTVIFSGDFKQSLPVVPHEGLTAQVTACFQTSPLFGQFTTMKLTINQRLGQGQQVYLQMCRQIGLGETGEHFWIPPQFLVKSKEELIDY

SEQ ID NO: 150253 - protein, 28 aa, Heterodera glycines
  Coding regions on vcDNA: vcDNA=SeqID_76676; Strand=-; Position=1 -69,138-155
MSSLGHHRSRDRERNVEARSESAAFAVK

SEQ ID NO: 150254 - protein, 92 aa, Heterodera glycines
  Coding regions on vcDNA: vcDNA=SeqID_76677; Strand=-; Position=1 -111,195-362
PKNYNITGLVDRSLQIPISKLRSVFLAYAQARLFDLEDFANCCLSYIDKNADTVFKSDEFFAEIDEKNCLKIANQWRNFNLGSINFSVMLPP

SEQ ID NO: 150255 - protein, 259 aa, Heterodera glycines
  Coding regions on vcDNA: vcDNA=SeqID_76678; Strand=-; Position=1 -47,94-369,875-1328
  Homolog annotation: Hit_ID=AAL78214.1; Match level="QueryCoverage =54%, HitCoverage=75%, E-value=8e-09, Identity=28%"; Hit description =putative esophageal gland cell protein Hgg-20 [Heterodera glycines]
MSDIQKESEEKMAKAIFISGDGWLAVFDLLPPSQLGLGIAMVSHRFDFYVDEHFKTRKWALKFLRIRRKIGENGTKEMEIANYDGKPMPIPNIQLPRKVIGFKCIKITFIDSNAIAFLHRFRPLFASSRIYLSIYFKSDRILELLHNILPIIGKNIYGMELITEPFQRLRQIVPSLFFTECPSLRFVFPTFDDLFAEFPCDDSAMASRGQALAKWLFTPHPDDVPKVFKCAVQEFVAGRNVPLNVEGRNLPLKIEAFKT

SEQ ID NO: 150256 - protein, 37 aa, Heterodera glycines
  Coding regions on vcDNA: vcDNA=SeqID_76679; Strand=+; Position=1-119
KGGGPFVLQNFFNIKNHANLLSGVLKVANHESEMYFD

SEQ ID NO: 150257 - protein, 384 aa, Heterodera glycines
  Coding regions on vcDNA: vcDNA=SeqID_76680; Strand=+; Position=1 -71,237-320,368-662,744-1160,1400-1686
MSSKMILYVLRIPVMPEGTECGRNLYGVPMLVGCCAILWMFWDRFKKPKKKIFISADAWLSVFELLKRSQLGLGIALVSHQFDAMVDENFKTRRWALKSFEIWCDDGEDGTTEMAILNSTKKLVGSYRIQVVHLFEGKSLPIPQVQLPRKLHRPQCHRFSQPFSSAFRRLPNLAIQTNNDRILELIVHNILPILEKHLRGLELSFDVFHRLRQFVPSILNDFPFLRIVSVYASDLFTEFPANDNAMASDGQAMAKWLFTAHPNNMPNVLRCSLNKEDGNWASRIEAFKAAFASASSSVNFIVVLWFPQSFADSVVLFDLTNELTHEQLALKRTVFNTRFLLIRSPIVRDESKWTKWEEEAIGWEFFDQWNRIDIEINDEEHIGD

SEQ ID NO: 150258 - protein, 394 aa, Heterodera glycines
  Coding regions on vcDNA: vcDNA=SeqID_76681; Strand=+; Position=1 -442,507-969,1020-1298
MQKPTPSNRPNSSVSKTLACGLEKIVNLSGNEPLSVPVLADRSDPLGLKSVQPDALPMESAEGTKEVEIMEVDEMSGEKGKRDEMGKEKVKSGGMEEEEESEGSESELLGEGGFDNLQLNPSLRAGNKAVEKEDKGKPYLVAQVRSDASSTTPEPIEIGDLFRLRKCEWTKSETGWEERGDWLYEVTGRLNYQATATDVSQLRQRILTEAVGILVDVQRARDRHVKVAMVSAPELSCVMRTYRRHFPADFTDTTSATAPLSVFNFGRSTVRHGCCIHSSLRMFCRLILVKKEAMNCSFITQTAELSWAKVQLGEKVMAAAVAAQSFDVKADLRKHTLFVEPVVINEISTRSVIIQFVMPVPSIEELTELCKIWEVDLAVGCKVNPATKAKPCAH

SEQ ID NO: 150259 - protein, 56 aa, Heterodera glycines
  Coding regions on vcDNA: vcDNA=SeqID_76682; Strand=+; Position=1-173
DQQSPSNQQTFFVSSAAQSLNAGKQPDKMPSKHKFYEYYTLGCISMRTEVAKEAIN

SEQ ID NO: 150260 - protein, 124 aa, Heterodera glycines
  Coding regions on vcDNA: vcDNA=SeqID_76683; Strand=+; Position=1-377
VYLFNNVRNTHNNDIGSQQEQQGHQQQQHQHGEQRRRPPNGGGGGMAEESDDEMMMVVVSNNNNNGNDHDQQQRRMTTMMMVNGSGGRNDDEDDDGGGGDEDEDEDDGFYAIDLGQPIDQQQQQ

SEQ ID NO: 150261 - protein, 196 aa, Heterodera glycines
  misc_feature (17)..(17): Xaa can be any naturally occurring amino acid
  Coding regions on vcDNA: vcDNA=SeqID_76684; Strand=-; Position=1 -98,417-559,612-697,1055-1167,1243-1358
  Homolog annotation: Hit_ID=NP_493381.1; Match level="QueryCoverage =88%, HitCoverage=95%, E-value=4e-67, Identity=70%"; Hit description =ubiquitin conjugating enzyme (19.1 kD) (ubc-14) [Caenorhabditis elegans] emb|CAB60431.1| Hypothetical pro
LKFLKIYLIILFKIGKXNMAGVALRRLLTEYRQLCHNPPEGIVAGPADEENFFEWHCLISGPEGTCFEYGIFPAKLTFSEDYPLSPPKMQFLDYPLSPPKMQFLCDIFHPNIYADGKVCISILHTPGDDPTGYETSAERWSPVQSVEKILISVVSMLAENDESAANVNAAKMWRDNRAQFERIAHKLVRTTLVKQG

SEQ ID NO: 150262 - protein, 89 aa, Heterodera glycines
  Coding regions on vcDNA: vcDNA=SeqID_76685; Strand=-; Position=1 -165,1216-1320
MARYRQRGHHRPSEKQQQNHGHILDKDDANTSHFRHSIQQQFQEDENGVEFFATTALFVFNGLVLLRLALLLNGGNLKEAIVTVYMHCW

SEQ ID NO: 150263 - protein, 49 aa, Heterodera glycines
  Coding regions on vcDNA: vcDNA=SeqID_76686; Strand=+; Position=1-147
AIANGAIIVRPKSSSKTMATFWTKMTPTLPISVTQFNSNSKKMKMVWNF

SEQ ID NO: 150264 - protein, 301 aa, Heterodera glycines
  Coding regions on vcDNA: vcDNA=SeqID_76687; Strand=+; Position=1 -236,659-824,973-1048,1096-1138,1186-1572
QYTDNLNIAAPGVVTQHVCKASNLNQFQLSQINSLHPDTGVVGVYLSTEGTKVLPFVKAAAQGLREMASKPISDELLQAASPTLRQSPYLAGEVHQAGPTDLAHVALVGHGAKLTDEKAVAIQAVLCAAIGQTRQYTDNLNMAAPGVVSQHVFNTLNHQSVRLFSTTHTVDLMDFPVLEERVERVRNELKVEAAEKVAEIVKVNAGVVKEAATFANSTQRSVYTGVTAVVGISLTLFGVLLSLLWGLFGRVGSVEANLSALKVDVDARFEKLTDSVDRRFDRMERGINRLLTKNGSGGIDD

SEQ ID NO: 150265 - protein, 230 aa, Heterodera glycines
  Coding regions on vcDNA: vcDNA=SeqID_76688; Strand=+; Position=1 -349,608-727,789-943,1025-1089
  Homolog annotation: Hit_ID=NP_500157.2; Match level="QueryCoverage =87%, HitCoverage=14%, E-value=3e-40, Identity=44%"; Hit description =cleavage polyadenylation specific factor 1 160kDa (4C774) [Caenorhabditis elegans] gb|AAF36067.2| Hypothe
KWKTIARFLIWYELNLVLSACVRYDTVAILAVSMNIKDRVHAVVWHFDGLPMTVARCMPIRVPIGGVCLFGANEIVYLNQSVPPRGVSLNSCANEFSRFPLNDQQQLRLCLGFFCSVDSPPNDLVVVLRNGDLYILTLETDQTSMVQGIRLTKAFETSIPCCLTVCSHNFLFVGSRLGDSKLLRFSAVEKRRNSMSSDIGTKQLTNDVLVLFDEDDIHLYGKEFCNSFHI

SEQ ID NO: 150266 - protein, 49 aa, Heterodera glycines
  Coding regions on vcDNA: vcDNA=SeqID_76689; Strand=+; Position=1 -28,197-318
MSYYWSLVYFAKETKRQPKCQYYKRNIRGLEDLDNGQSASAKPVDGTEI

SEQ ID NO: 150267 - protein, 83 aa, Heterodera glycines
  Coding regions on vcDNA: vcDNA=SeqID_76690; Strand=-; Position=1-252
  Homolog annotation: Hit_ID=CAD41947.1; Match level="QueryCoverage =87%, HitCoverage=17%, E-value=4e-09, Identity=47%"; Hit description =glutamine-2-deoxy-scyllo-inosose aminotransferase [Bacillus circulans] dbj|BAC41204.1| BtrS [Bacillus circ
VAVPCCNGFTSLVLALRSANIGPGADVLMPSITFVAVSNAVLNVGANPVFVDSADEWDYNPSWSLLLRAATQKTRHEKILETF

SEQ ID NO: 150268 - protein, 113 aa, Heterodera glycines
  Coding regions on vcDNA: vcDNA=SeqID_76691; Strand=-; Position=1 -121,163-383
MSHENVGNKILVFISGGSKQYSIKFQNESDGQVWYKTKIRGITFNNKNKFKHEDFKEMVLNYVDEKRKYFNYDKFGPSRDSKILSQKMTKEYKPVQKKGIIDENFDIIPYGFW

SEQ ID NO: 150269 - protein, 93 aa, Heterodera glycines
  Coding regions on vcDNA: vcDNA=SeqID_76692; Strand=-; Position=1 -94,134-261,891-950
MEDYYPDSMKKDEFEKFQKRYKENNDTPFLLEDQLKIYCGQDTEILLKALLAMRKIFIEITMDELSPNGFDVFKECDVKRMINPRDKENIMLK

SEQ ID NO: 150270 - protein, 121 aa, Heterodera glycines
  Coding regions on vcDNA: vcDNA=SeqID_76693; Strand=+; Position=1 -189,554-730
MLNFDSLLLILFIFYFQIPFSLSVDNECRGVPTDQMAPLKYASDQWGKPMEIRFADDSKPRFNIRFGFTTEMNENLPKNKCVLIKCFDEFTEKNYFNVLKIAEKLNENNSTNEHIINLIDL

SEQ ID NO: 150271 - protein, 91 aa, Heterodera glycines
  Coding regions on vcDNA: vcDNA=SeqID_76694; Strand=+; Position=1 -243,1188-1220
MDIWSAGITIFEITLTKMLGHFEAWHKVSLVGELFRNAKLNPSDAIFISAGSNVWWQRYWQVICAILSVWDEMPTIAFLLGKYVSIEPQKR

SEQ ID NO: 150272 - protein, 265 aa, Heterodera glycines
  Coding regions on vcDNA: vcDNA=SeqID_76695; Strand=+; Position=1 -457,639-979
  Homolog annotation: Hit_ID=AAD34306.1; Match level="QueryCoverage =96%, HitCoverage=83%, E-value=4e-41, Identity=37%"; Hit description =transposase homolog [Haemonchus contortus]
MIPLQNMHRRPKTGRTPKTTERQRRQLVRLVKSNPKLTAADVRRHSADALGVQISHSTAQCILRKQNLNARRPARKPLLKECHRMARLNFARAHSHWTVADWRRVIWSNESKFNLFNPDGAIHVRRPPGNRFDPKYTRGTMKFGGGGGVMVWARWSGHPHGATADGSHSTSPWRSASAFAGLISLEWSSPASSPPLSTDLSPIENLWHFVKRKIAGRHFQSKPQLWQAVLEAWNSIPFDTIDNLISSMPRRIESVIKSRGAPTKY

SEQ ID NO: 150273 - protein, 37 aa, Heterodera glycines
  Coding regions on vcDNA: vcDNA=SeqID_76696; Strand=-; Position=1-115
IVVMIFGHAIVMMTVVMPVVMTLVLFAMIFVANLATN

SEQ ID NO: 150274 - protein, 123 aa, Heterodera glycines
  Coding regions on vcDNA: vcDNA=SeqID_76697; Strand=-; Position=1-371
MNTKNEKASSIFLEASKKETERSWREVVVLAEEIEEYVKSGRGALNRTIKTREKAPYASGVRDLFLKLSDSIWEIYTILDKVNSESDKAESARREFERLKSFDQASKLEERAMSSLIESTRLH

SEQ ID NO: 150275 - protein, 66 aa, Heterodera glycines
  Coding regions on vcDNA: vcDNA=SeqID_76698; Strand=-; Position=1 -186,230-244
MTVYLYCCALSDPVIIPGRPLGQVTADVVFIEFMRRQQSYQDVNLLEERISVEMTTVFRATAKMNI

SEQ ID NO: 150276 - protein, 333 aa, Heterodera glycines
  Coding regions on vcDNA: vcDNA=SeqID_76699; Strand=-; Position=1 -174,437-648,696-838,877-1001,1052-1103,1147-1444
  Homolog annotation: Hit_ID=NP_001004509.1; Match level="QueryCoverage= 64%, HitCoverage=16%, E-value=1e-21, Identity=29%"; Hit description =si:busm1-180o5.3 [Danio rerio] emb|CAD60788.1| novel protein similar to DNA polymerases [Danio rerio]
EQNDEEVFDGVSDKGPINPRDAYAGGRTMPFCLYAKATDEVEIAMFDIISLYPFVNYGPIIMNNLTANCSKVIRIFLKITVEASGWPSDVKNEDEKRAFIEIYKAKYDISLDYDQIAFNSGLGMIAKLGLNSLWGKFSMRNTLSSTKIVNSMEECAEMVKDDTIEFRHRLCWMKGLEHKVSNIVLSLWTTSAARIKLYEYIEQVYKEKMCKPLYCDTAFAHPKGKCPLKEGKFLGEMTREYSDSDILEYVSAGPKQYALKLRRKKDGVIWYKTKIRGFTLNKDNRVDYEEFKSMVLGYKEGVKKVFRYPEKIGPTRDSRMLDQYLNVLLFGYY

SEQ ID NO: 150277 - protein, 27 aa, Heterodera glycines
  Coding regions on vcDNA: vcDNA=SeqID_76700; Strand=-; Position=1 -70,385-398
MTIISSFLLMGVNFDKLIFMSFLVYLN

SEQ ID NO: 150278 - protein, 920 aa, Heterodera glycines
  Coding regions on vcDNA: vcDNA=SeqID_76701; Strand=+; Position=1 -139,267-395,448-579,629-716,891-1410,1523-2593,2715-2933,3246-3707
  Homolog annotation: Hit_ID=S50755; Match level="QueryCoverage=19%, HitCoverage=43%, E-value=4e-17, Identity=35%"; Hit description =hypothetical protein VSP-3 - Chlamydomonas reinhardtii gb|AAB53953.1| amino acid feature: Rod protein domain,
MIETPGLAKKARHFKIQDPSTRIALIDQILKQISDFEFDGVLLDFTGINLSMDQIGKHLVDFLGDFLLRNAQEYINRSKMNKDAKKLIITVRIDHDEIDHIQTEAFSRLNLMELISFTGVRTESDQAELVEKLEDKLSVDRKVITDKICEVQSPSRRFKRGAGNKRSPPPSPKAKAGAHGSPKSPKQAKHGSPKSSLSKAKLGTSKSSPSMTKHGSPKSTPSNAKIGSPKSSLSNAKHGSPKSSPSKAKPGSPKSPSKAKPGSPKSPSKAKPGSPKSPSKAKPGSPKSPSKAKPGSPKSSPSKKGHVSPNVSPSKGKSPQKLLSPKAMLQTHKSAPQSVIIKFEHQQRHDPTTKLSPMNANFRAKHSPIMAQTHFDLNHTRNRPLHKHWSTNMPGSAYADGQMSPLRASSSIVNIVELHRLPTPPPRHGLNEQQQSRIVPMKPCFSRSKSELPAKVLSSPASAINAKNWQNLAHSSVSSDGSDDFNFRMKHHQYQHSPAVPINSLAKSQSYVTLPTSPPPRFNASPSADQQKKHFVAMPSSPSYPLPVPSPNTGKMPQFLPMADKSYFAYPKSSRTANRSSGSPLLGPKPKTLIIVRDSFPLTSPSKSKSASAVDYQHRFEQFLSPIKSKNAAAVYHPQPLPLPPNMPSTSSTPIKIGQQHSSVIPTRIGHHYPSSPNRIGHHNLPQSISKTQPALAHILAHHSPHLPVGSELSPAKSLDSHHQRQMPLFAGKKYGQNHQSPHMSPTKLSNGNVSPPQSPSHRLQQIIKRHSQTKDLSREKVQRQQQSPLLQHPSIRALIGLPNSPADDQNPPPPFTPEQHALLMDTVLRPPSGLPFESPRSAPSPLELSEEQRDKLIDAIQGRPQPGLPFEDEAEHEGLHPAHRVNSAHLEHVLDAIFRKPPGLPFEDDEEEEHSSTNM

SEQ ID NO: 150279 - protein, 58 aa, Heterodera glycines
  Coding regions on vcDNA: vcDNA=SeqID_76702; Strand=-; Position=1 -13,63-226
MGNNGSFERIVEEQQPPTTPVPHSRKLLRALWKERIFIVLVLIFATLVVQYLYWMKTL

SEQ ID NO: 150280 - protein, 72 aa, Heterodera glycines
  Coding regions on vcDNA: vcDNA=SeqID_76703; Strand=-; Position=1-407
NFHIKNFQIFFFKIFFLNFCGDILRRTPIHEQGVRQSDPHTSDVWRRGGGGGCARTNFSYVGPQYSPATTFF

SEQ ID NO: 150281 - protein, 72 aa, Heterodera glycines; identical to SEQ ID NO: 143389
  Coding regions on vcDNA: vcDNA=SeqID_76704; Strand=-; Position=1 -30,306-494

SEQ ID NO: 150282 - protein, 50 aa, Heterodera glycines
  Coding regions on vcDNA: vcDNA=SeqID_76705; Strand=-; Position=1 -144,469-477
MGRPQITHKTPSKAQQRLRFAGQCLVSSVRSVDGTLIGLWTLDLMGRKLD

SEQ ID NO: 150283 - protein, 161 aa, Heterodera glycines
  Coding regions on vcDNA: vcDNA=SeqID_76706; Strand=-; Position=1 -83,235-293,479-547,591-690,852-953,1004-1077
AYVCSNSAYVGCPGRVSTQFAGPFVCWEARREAIDGLQVTHDSNEFMACKEELMAIKEGCRQFDSKYKPKFVMIIGTKRHFKKFFIEEEPKEGGRPFSKNLYPGDWQTGGICHVGERNRCQNGRTAGTDNGTFVFPSDCQHGGLNARARVPSGRIGQAREK

SEQ ID NO: 150284 - protein, 90 aa, Heterodera glycines
  Coding regions on vcDNA: vcDNA=SeqID_76707; Strand=-; Position=1 -63,140-349
MGRDKGIRMAEPEIVSFDSPENSDQEWMAMFERCTVNRIQFILLVDERRKDTHGLLKLSEAIHKVTTQHITLEKALVSVNTQFLLFICKS

SEQ ID NO: 150285 - protein, 389 aa, Heterodera glycines
  Coding regions on vcDNA: vcDNA=SeqID_76708; Strand=+; Position=1 -82,138-195,260-314,398-624,853-1136,1223-1310,1650-2025
  Homolog annotation: Hit_ID=C88651; Match level="QueryCoverage=88%, HitCoverage=92%, E-value=1e-47, Identity=36%"; Hit description =protein B0212.4 [imported] - Caenorhabditis elegans
MVRQAHKISRDKGQPSFLSSTVVLNTELAKLALSCLYLTFSYGSFTKFCVEISAAFFKNKRETLKCNFTFLFFCLSQIPPFLICLFFFVKITYQLRILTTALLSIVLLRRVFSRTQWGALCISLFGVCLVQFASSTTSGKGNAGGALSAGQKVHDEQLLGLLTIIIMCWTSAFAGLFHFIIIKIIFYKIYFEGVYLEGVLKQSSCDIWTQNIRLSVITLPFAFMTVVNDSKSIQKNGFFAGWNWLLWIVLFSAAASGILVAVVMKYADNIKKSYCQSVALGGTALLSIVIGDSQFSVLLLVGVSLVIASVFLYTLNPPPRVKPSTPEVPAHHPQDDDIDGLEEQQFSTDDDDDETNNGSNRIVELKLDDIKRIGREAPADNTFLSESGD

SEQ ID NO: 150286 - protein, 489 aa, Heterodera glycines
  misc_feature (8)..(8): Xaa can be any naturally occurring amino acid
  misc_feature (18)..(18): Xaa can be any naturally occurring amino acid
  misc_feature (411)..(411): Xaa can be any naturally occurring amino acid
  Coding regions on vcDNA: vcDNA=SeqID_76709; Strand=-; Position=1 -82,128-187,229-260,311-405,605-721,990-1080,1313-1471,1521-1583,1638- 1736,2161-2397,2583-2762
  Homolog annotation: Hit_ID=NP_956421.1; Match level="QueryCoverage =89%, HitCoverage=81%, E-value=7e-89, Identity=42%"; Hit description =similar to molybdenum cofactor synthesis 3 [Danio rerio] gb|AAH42324.1| Similar to molybdenum cofactor sy
FRCVTYSXFLFLFKTKIXRQERIRETKVLIIGAGGLGCPVSMYLVAAGRETKVLIIGAGGLGCPVSMYLVAAGIGRLGIVIGRLGIVDHDVVSIDNLHRQTMHDQKRVGQVVSIDNLHRQTMHDQKRVGQSKADSLKESLSRINNEANVVAYNVLLTSKNVLQLFRDYDIVADCSDNVATRYLINDACVLSGKPLVYGSALGWEGQFTVYNFKNCPCFRCIFPDPPSPEHVMSCSEAGVLGPVVGVIGSLQALEIIKIAVSGKCSFAGNLWMFDGFEGISKSFAGNLWMFDGFEGISKRISLREKMSNCAICSENPRITEREKMSNCAICSENPRITELQDYQKFCRSDPSDKVRSLCLLSAEQRVSPTEYLNLRNKSGSFILLDVRPPTEFEICHLPEAESLLFQMKNKXIYLLTINRFSLGGIEKSKNNICPCSVFVVCHHGNDSQSACHLHKQLSEAGIGDRFIVRDIVGGMDGWALEVDADFPRY

SEQ ID NO: 150287 - protein, 214 aa, Heterodera glycines
  Coding regions on vcDNA: vcDNA=SeqID_76710; Strand=+; Position=1 -160,215-699
  Homolog annotation: Hit_ID=NP_500105.1; Match level="QueryCoverage =95%, HitCoverage=59%, E-value=1e-23, Identity=36%"; Hit description =CEll Death abnormality CED-2, cell-corpse engulfment and cell migration protein, an adaptor protein simil
MASFNPFAWESFFFGKLDRSEAERMLAPCEPGTFLIRESSTAQDCYSICVKGCGVGDHSNHFLIEKLVTNESGGAPLYRVIQKIYESYIIDLKLNSQISTLQFADMHSLLNHFKVFALEPVPIKLIKPLEKPFLEKVMAKYKFESERISDLSFERGEQLEILGKPEQGWWLARSAGREGHIKSESKIIFFARNCLGETGMIPANRVKPVIILFL

SEQ ID NO: 150288 - protein, 107 aa, Heterodera glycines
  Coding regions on vcDNA: vcDNA=SeqID_76711; Strand=+; Position=1 -156,941-1108
MSDDYFRTQCDDCDDALSVLNPSSTNSSSNGCGSAGNRSSAHSVGDQQLHGERGQFLYLQEILSNGMCRGTNESGKVGLFPITYVEAANIEPSESPWNISANANPNC

SEQ ID NO: 150289 - protein, 73 aa, Heterodera glycines
  Coding regions on vcDNA: vcDNA=SeqID_76712; Strand=-; Position=1 -147,451-525
MHEPYLGLLYLMRQNFDCAKFEENLESILVIECEKYRNYLDILYEYLFKANRGYIGLSNDTNNVGFGWQRKKL

SEQ ID NO: 150290 - protein, 113 aa, Heterodera glycines
  Coding regions on vcDNA: vcDNA=SeqID_76713; Strand=+; Position=1 -240,465-566
  Homolog annotation: Hit_ID=NP_741320.1; Match level="QueryCoverage =92%, HitCoverage=38%, E-value=3e-10, Identity=35%"; Hit description =SET domain mariner transposase fusion gene (27.1 kD) (4C373) [Caenorhabditis elegans] gb|AAK68462.1| Hypo
MPMDFEYIVANVAGPGTDSAFLDEDFEGCNCTDGQCCTSAAGGCSCLPGKRDNYNPITGKWIDQGGTDQRQGVPHLECHQNCVCAWEPDKCANRQVQFGVRQPIRVSVDNLQN

SEQ ID NO: 150291 - protein, 27 aa, Heterodera glycines
  Coding regions on vcDNA: vcDNA=SeqID_76714; Strand=+; Position=1-83
MHRSHQSHGIIMGIRENDMSGDAKSDR

SEQ ID NO: 150292 - protein, 275 aa, Heterodera glycines
  Coding regions on vcDNA: vcDNA=SeqID_76715; Strand=+; Position=1 -188,239-878
MYKFSSEVKENTAFLKKLVSTRSEQKKNELIENATADQILAIVEICANILSFSFKLTNKQKRRENGKKKDTTGEWYSPGSCLDTCPEFFSPTFIRKNNIMKFAKKMLMIPEAEYLALRIAMNWLYKERRTVKGILENRPQKVVIENHVPGPNAAPYLGLNNQSKPQETDEPRKIIIPRKRLKEQTPDPESDNDTLEELTPEPQTPSTLKTPVPTKTIIHPTLLNGFFRYVKENKDLFKITAAGKVQSNIDTEGSNSKRHWLINQKSCGDVEGKRQ

SEQ ID NO: 150293 - protein, 60 aa, Heterodera glycines
  Coding regions on vcDNA: vcDNA=SeqID_76716; Strand=+; Position=1 -158,501-525
VFLIALSKDMRVQFMRTIRKTVFFCNGNTAAAATATAALQTVADSYQYSNRIRSVFMLLK

SEQ ID NO: 150294 - protein, 81 aa, Heterodera glycines
  Coding regions on vcDNA: vcDNA=SeqID_76717; Strand=-; Position=1 -150,332-427
MSKQFLLFALLLLLLPMDTLQECSWDGNLCTGSCSTGCEQLSQANCACAKRRKSKEKQKQQQKNKSVECDEDEKWIIILIK

SEQ ID NO: 150295 - protein, 28 aa, Heterodera glycines
  Coding regions on vcDNA: vcDNA=SeqID_76718; Strand=+; Position=1-84
MNFVERFVNFINDLYDWLYLNNVMASYE

SEQ ID NO: 150296 - protein, 681 aa, Heterodera glycines
  Coding regions on vcDNA: vcDNA=SeqID_76719; Strand=-; Position=1 -841,900-1029,1096-1254,1791-1846,2304-2689,2886-3099,3179-3437
MAKKCRDEAKCDEIIQLKNAIRNLVGHSLFLELERQNALALSFGNCNCQQQKLKMTYFAITDIVDDAQLSSEYTKMFLENATDAKTAETALSMRFCFAKIIELFSTIYSHYKLHLPNSEVSNIIRTFFVLSVQKWVLKLPNVLIEIADRSSSTMALLLVHDWLAQLSSECNEMPQMGGKAQKMATTRALLNWAKKDALREIRAQFYEQHTQNMVRLYESGAHNRNAFSHFLEQCQLDGRGDKFRVRQFYANGGGWKSGEKDEEYDRLVSKHPKVKQMLRIELNDEEIMEIQIRNYLKYMDVQTEQQNQMTRLKYLLNILVFYQCFKKNAPLLRPSADGKSEQLDNHLAELELLMNGAREALSVDELLQNETQLILVFAFPLSSSSSSSQSSSAENDGEEGSVCSDEILMRLYKAILVEKVPSESAKWQIGIDSLYFQHKTTVLNSIKEIELLAMSSKVKDHTSVDKLAQLKAEVAGLELFSPLKDDDEKMRKICWMKMFFKLFVGVTTKGGEAAQKRGALTTLSKLDPSANDLVEKDCENLPYLREYFKMFLSDSHNIGVVGTFSVLQLLAQFSELVPFINNNPIPFGSIQSSENPQSNEDKEMRNLYKAYLTEDDLAKIGKYEAIIGVKYLLDVAKKNEEKDRPKLKEWHKIRMAKVRAQTMATLKMLDIYADSAEQLFR

SEQ ID NO: 150297 - protein, 185 aa, Heterodera glycines
  Coding regions on vcDNA: vcDNA=SeqID_76720; Strand=-; Position=1 -291,417-683
MIATNICAIQLSAAIFRYLRTFVPSILDDFPSLRIINAYYDGFFAEFPCDDSAAASDGQALAKWLFTPRPDDVPKVFKCLLRWDDGHFESRIEDFKAAFANASSPVNFIAVIRFPPPFANSVVLFDLTNELTREQLTFKWMDDIGRFLLIRCPIVRDESKWAKWEKEAIGWNFMDQWNRIDIRVS

SEQ ID NO: 150298 - protein, 108 aa, Heterodera glycines
  Coding regions on vcDNA: vcDNA=SeqID_76721; Strand=-; Position=1 -47,100-379
MSDRRKEAEEKMAKAIFISADCWLCVFDLLPPSQLGLGIAMISHRFDFYVDEHFKTRKWSLKSIELLPKYEADGTKEMKIVNYDGKEMSIPQNPLPKKVVGFKAILIR

SEQ ID NO: 150299 - protein, 78 aa, Heterodera glycines
  Coding regions on vcDNA: vcDNA=SeqID_76722; Strand=+; Position=1 -135,416-517
MRNLAGGEKGGTKLPPELPRSVADGCSAAFAFGTGTLMAFHCHCRLIIEKYFKIDFTMNKNTNSYNLNYNELNRPFWN

SEQ ID NO: 150300 - protein, 272 aa, Heterodera glycines
  Coding regions on vcDNA: vcDNA=SeqID_76723; Strand=-; Position=1 -90,151-279,474-593,641-678,1259-1389,1497-1807
  Homolog annotation: Hit_ID=NP_501844.1; Match level="QueryCoverage =75%, HitCoverage=64%, E-value=3e-37, Identity=52%"; Hit description =glutamate transporter GLT1 (58.5 kD) (4K897) [Caenorhabditis elegans] emb|CAA93084.1| Hypothetical protei
MPPLNVTLRWLISTTNQTTVQTTNEPLMKPILEYTNEVNVLGLIVFCTGFGVILSILGEQARLMTNFFIVLDAALAMYVVTVICGLMIHSLLTLPLLYYAITRQSPFEFMTGMLQAIATAFGTASRDRIRTSVNVLGDGFGCGIVSHMTKERLIESDNVDLIRQLKTDIELLNAPTTSPGSALLTPNASTRTRESAAQGTAKRTQNNAQQQQLQIPNAKNSPSFFVFPSPAAQTKNFQKTQREGRKSSSVSAAENGQVKGEAIWGNKQNTTR

SEQ ID NO: 150301 - protein, 370 aa, Heterodera glycines
  Coding regions on vcDNA: vcDNA=SeqID_76724; Strand=-; Position=1 -168,880-1041,1854-1952,2455-2537,2574-2669,3189-3304,3366-3496,3838 -3950,4190-4206
  Homolog annotation: Hit_ID=NP_506859.2; Match level="QueryCoverage =86%, HitCoverage=8%, E-value=4e-65, Identity=41%"; Hit description =speract/scavenger receptor (5P989) [Caenorhabditis elegans] emb|CAB03852.2| Hypothetical protein C06B8.7 [
SRRDFGGEISAARFRRRDFGGEISAARFRRRDFVPSPNYANSLSPNMNAFQKCGFQVIRRAPVLQNVNVTNSSMHALQLLHPSNNIVLSRLNISDNRGIGVNILATTLQSTGHSSRVPYGPITIPYHVPGMLNICSMSKQVKVSGRVLLYYKYDSYPVDCVKVFSSSWSRLGFRLLQANFYQGPAGVPRPDASSSWSRLGFRLLQANFYQGPAGVPRPDALHIYAGTKFFSSNLLRIFNASSDLSGSVATQNPFLGIHLRATAADGDYGFLAEVAVLPTADQHQAFLAEVAVLPTADQHQAGGEISLRVSRLLNNDRGALRYGNIGEMGPNVIIEQCVMDKNGYHLYGNISTSLQAAELHLHNTIFFILI

SEQ ID NO: 150302 - protein, 85 aa, Heterodera glycines
  Coding regions on vcDNA: vcDNA=SeqID_76725; Strand=-; Position=1 -121,637-771
  Homolog annotation: Hit_ID=NP_506859.2; Match level="QueryCoverage =98%, HitCoverage=2%, E-value=2e-25, Identity=61%"; Hit description =speract/scavenger receptor (5P989) [Caenorhabditis elegans] emb|CAB03852.2| Hypothetical protein C06B8.7 [
VVCRELGFGPQNAYSWLTPQWDYNPQLRILKTYMEPRECRGFECRLESCALRLTATLSDWQCINSEQFNYVHCGPEGRLFRKKIF

SEQ ID NO: 150303 - protein, 265 aa, Heterodera glycines
  Coding regions on vcDNA: vcDNA=SeqID_76726; Strand=-; Position=1 -84,214-450,516-753,801-1039
  Homolog annotation: Hit_ID=AAC47437.1; Match level="QueryCoverage =99%, HitCoverage=99%, E-value=1e-112, Identity=62%"; Hit description= COL-1
MADFEGRVKAYRFVAYTTVSFSIISLLSHNAKDIWSEVSQLKGMPLLVAGNRTARSAYGSCQECCSGGAQGQPGQPGQPGRPGNPGAPGSPGQPGQTPQTPCEQVHPPPCTPCPGGQPGNNGPPGPPGAPGAPGQPGTGGGQPQPGEPGPPGPNGQPGQPGQPGAPGQPGQPASPPPTEPAPAGPPGEAGAPGQPGQPGAPGQPGAAGQPGPKGPPGGPGQPGNGGAPGQPGQPGQPGNPGERGICPKYCAVDGGVFFEDGTRRR

SEQ ID NO: 150304 - protein, 193 aa, Heterodera glycines
  Coding regions on vcDNA: vcDNA=SeqID_76727; Strand=-; Position=1-580
  Homolog annotation: Hit_ID=CAE59861.1; Match level="QueryCoverage =53%, HitCoverage=15%, E-value=4e-12, Identity=41%"; Hit description =Hypothetical protein CBG03336 [Caenorhabditis briggsae]
MNSPNLTVFKPNDQLINSLIAFMLQKSHGLIQAENELDIVKRKCVINEDYRRHVAILEVHTREEEIERETAKAVAEIKKKVANLSETRCPTVVTTAISSTSTVSAAINTTPEISTTPKVATAINTTPIVAMAINTTPEISTTQKVTTAISTIPAISTTQKVATAISTTPTVATAINTTPAISTTSKIATTIST

SEQ ID NO: 150305 - protein, 469 aa, Heterodera glycines
  Coding regions on vcDNA: vcDNA=SeqID_76728; Strand=-; Position=1 -757,989-1363,1610-1884
  Homolog annotation: Hit_ID=EAA68994.1; Match level="QueryCoverage =65%, HitCoverage=42%, E-value=6e-11, Identity=22%"; Hit description =hypothetical protein FG01697.1 [Gibberella zeae PH-1] ref|XP _381873.1| hypothetical protein FG01697.1 [Gib
MDQHDNNNDLSDQHDEVKQNDDHEDGGDAECDQQMVDNSVALHNAPSSPVKKHGKANGNGAVAVANDEEEEEQKVVVVQQQQQQQIGEDGQQNRHVHGDDDNDGVGDDQSFLTNVLRRSTRKRTKRDNGSSTTTIIHYADQMEEDEEEENNEQDSLADHREEAAFAVPLLPRNGPKKRSSPKKMAKKRGRPTKLEAIIRSMELAMNANGARRKGGKTVAMKKGGRKMKTKAQEEDEEEWPRRKRSYTRRKSKVDRDEEEEKDDEDKKESQSCSNSIVPPAEEVLPVEVKEEEKPNDEAIANDEIEVIMKGMERHFHRKRGRPKKKALLASPTAATVNPQQQQQQKCQPQQQPQQHQQQQHASGGPSSRYTTAHPVTAACSSTFVCFMCTAVEKDFDSFGRHLRSHPEQWKQCTVCPQNSNNKMEEDQQQMEEDQKQQQQQENKPKKRRNFDHPVHFLKHLIEFHMNFQQ

SEQ ID NO: 150306 - protein, 121 aa, Heterodera glycines
  Coding regions on vcDNA: vcDNA=SeqID_76729; Strand=-; Position=1-364
MSEFESECSGTAKLNQLGPVEISADTLYTTLVVHAVEHHDGGAQEMPSKNKNNANTDGTTIDGGGQRRQIVDEEEELKEEPMDVRRGQTQTMEADEEGGQCCNEAEKSGGTASSLDKTSDG

SEQ ID NO: 150307 - protein, 184 aa, Heterodera glycines
  Coding regions on vcDNA: vcDNA=SeqID_76730; Strand=+; Position=1 -442,851-963
  Homolog annotation: Hit_ID=EAL47145.1; Match level="QueryCoverage =78%, HitCoverage=68%, E-value=6e-16, Identity=33%"; Hit description =transcription initiation factor TFIID, putative [Entamoeba histolytica HM-1:IMSS]
MQKPIIVNIIALANLGTGIKLNSLTITECEFKYNPRKFNASVIKCISPIKATALLWESGKMICLGTKSLIDCENAIKIFIEIIKGSGCPGASYTGHTIENIVSTFKFGHEIELNEFRKNRRAFYEPEIFCGLNFKRGKSMTALIFWTGSENHIKISGFEKIPQKVWDQKKGINFLESKECASIP

SEQ ID NO: 150308 - protein, 121 aa, Heterodera glycines
  Coding regions on vcDNA: vcDNA=SeqID_76731; Strand=+; Position=1 -201,1463-1579,2888-2935
MSIYSGGLLTDVIAADDGPNATGGQALAKWLHIRRKDGHPKRLACRCDDVSAAKEWVSNFKQVVASGAFLCATNCARYTITLDTSAPIEPFELVNEQTKEKLTLNQLSSLKKAKAWVPCWT

SEQ ID NO: 150309 - protein, 169 aa, Heterodera glycines
  Coding regions on vcDNA: vcDNA=SeqID_76732; Strand=+; Position=1-507
FMGIPDTLVSAERRLQMGDTVVVSKFEWKEGFERLSYDLNPVDSLRSWLVQGRINVQAVAIEVEVIKLVIGSFQPGFVTNLKRYRGGDFRSATVISAQMLRPQTIYARQLTEISPGRIMLNQLLYLNLAKITSPQEWWMGENYILPLVTPFLKGNEIRSHGKTVVIGAK

SEQ ID NO: 150310 - protein, 343 aa, Heterodera glycines
  Coding regions on vcDNA: vcDNA=SeqID_76733; Strand=-; Position=1 -111,739-1668
  Homolog annotation: Hit_ID=NP_500013.1; Match level="QueryCoverage =95%, HitCoverage=22%, E-value=8e-57, Identity=38%"; Hit description =predicted CDS, polyprotein family member (4B673) [Caenorhabditis elegans] gb|AAC02594.1| Hypothetical pro
SVRAQENITVKEVLDLDELEDIAEFPICLSLSIDQRLLSNCYLKFGGCTELVSDDATAFTSEFFREFCSLLYINKKYAVPHWSQGNAATERTFRTFNNILSKYVTKEQPDFDEFLDYANFCYNTSVHSTTHETPYFLMFGRDPIFCIDQIIDPRIREPIAFTDETEFKQKLVTSLRRAWKITAELHAEAQEKMKIQYDKTMRTPNLKIGDRVLLRNYDGKRNTSKKFHFPWKGAFRIIEIEGIYATITSCNSPQANPRRVHINQLKKCYENLGPACTSPRLSDALAELEADEIHNLPGHSHPTDIPKHSSSLDRESDDEIPANEPNIDNNEVETSLTPPKYGL

SEQ ID NO: 150311 - protein, 1111 aa, Heterodera glycines
  Coding regions on vcDNA: vcDNA=SeqID_76734; Strand=-; Position=1 -3016,3218-3539
TFVLIQAILILMVKKRSAHRRNENMAASNAAVGGKEVASATPIIESLEVASATEQIELIETETIPQNLESFEVASATQKGLIMETAFAVEKVIETDKTRGISAGLEEEFERGMELGEGQYVERNTENIEMETIQDFTATQFSNVSWSEPCAIASPVPMSPNEEHGTEGGVLKYLVCQTDVKSVVGGKLSGQGPFFMGIPDTLVSAERRLQMGDTVVVSKFEWKEGFERLSYDLNPVDSLRSWLVQGRINVQAVAIEVEVIKLVIGSFQPGFVTNLKRYRGGDFRSATVISAQMLRPQTIYARQLTEISPGRIMLNQLLYLNLAKITSPQEWWMGENYILPLVTPFLKGNEIRSHGKTVVIGAKESLDSFCFPFNQFSVRLMGAAAAVQRSFEMEKLAKQTVNVQLVWQRPEVRPDEAQTNLKKAQRVSFEWLINNKSAVADFLEAWEEDTPVEAKVARDSKAQCCAVGRVIELSVNETAPGNFLMNVKMFLSYRAKKGYDRGWEDWESILDERESNVIPIPNYGGLPFREQAFELSVPSDIAEGQYPVSKILKILMGMGKDGAEQRPTVRLSSNEIAVGKLNEDQRITHGLFLDDESRVIFMQAPAGTGKSVSVAACIASVLKKDRDAAILAVSPLNVAVCELVKDTMESLSEKVAMLALFSGQGKGRYMDRIRPLGDNLLVEAVQRDGNVPSAEGTEPKKWSDNKTFKQYVDDFNTAPRRARERTTTAALLKQTKYRVYFMTLALAEELALDLGNVTKQQLRVHLPSQMTVIRGKFGFESILEVLETAKGIDRTVLSKCYRSHSAIVRCLDAGVYSPAGDRLVPGRPDVEMSSFLNYMGPRIVAENCPIILIHQKSSTQMESISFSSHNPEQRETALGFLGIIQGTFPGLIQVVCFYQAERKHMVSEIERRRWPNVKVSTVDSIQSQEAELVLVITTRSAAGRSSEADTGKEFWADCARTTVALSRPKFGLVIIGDLSLIWHKGTVWRRFIDETLKMTVAVTPEPFAAQANVFPPISSGHAQPPAFSHGMMIIDTSVRPPPINMIAGHTMPMPSNCPGPSTRMAPYPPQYLPSYAEAAQQAPSNSNSNRRIDVKCYRCGKIGHFSKRCRT

SEQ ID NO: 150312 - protein, 59 aa, Heterodera glycines
  Coding regions on vcDNA: vcDNA=SeqID_76735; Strand=+; Position=1 -3,634-810
MGFPEHETQQAVGPSPVSRLSGGGGTPIATGELRQRQIGSAELQQPTTAPAILGLNTNV

SEQ ID NO: 150313 - protein, 253 aa, Heterodera glycines
  Coding regions on vcDNA: vcDNA=SeqID_76736; Strand=-; Position=1 -76,285-970
  Homolog annotation: Hit_ID=CAE56519.1; Match level="QueryCoverage =84%, HitCoverage=34%, E-value=1e-22, Identity=47%"; Hit description =Hypothetical protein CBG24242 [Caenorhabditis briggsae]
MLFHPSRQSIAPIFVKVTRSVTSRVAALVQLVDAPEPLSPDDGLVVVDDELLVDVLAEEVVLGVVDVLVDEVVLDVDDVLVDEVVLDVVEVLVDEVVVGVVDVLVEEVVVGVVDVLVDEVVVGVVDVLVEEVVVGVVDVLVEEVVVGVVEVLVEEVVVGVVDVLVEEVVVGVVDVLVDEVVVGVVDVDVLVEEVVVLGVVDVLVEDVVVGVVDVLVELVVLVLVLLVDVVVVSSCPKTATSFDALNSKRRHTV

SEQ ID NO: 150314 - protein, 553 aa, Heterodera glycines
  Coding regions on vcDNA: vcDNA=SeqID_76737; Strand=-; Position=1 -195,246-614,677-938,1025-1097,1143-1462,2708-2800,2846-3000,3045-3239
  Homolog annotation: Hit_ID=NP_502997.1; Match level="QueryCoverage =26%, HitCoverage=32%, E-value=7e-29, Identity=50%"; Hit description =insulin-like (49.3 kD) (4R792) [Caenorhabditis elegans] emb|CAB55167.1| Hypothetical protein Y116A8A.9 [C
MAYSPVVDTHPFVPSPPQRFLGASLGGGVQPPSKPSIGHQSQVKNSRGKPPPPPTPPTVINQQKEQSPPVPTAASSVASPQQRQSVLTAVSSVASPPPPPPPPPPPPLFQSKPTLPDNSWPSTSTESKASFVDPTNNKRSDLLQQIQQGTKLKKVGPPSTERTPVPTNAPTLRDNMMEQIKQGTTLKHIDQSDVENSRCSAGGSAQEIGVLTGALAKALEEQSRHAMYSIENSALASPTSSTSMSSTTFSTSARSPVKLQFKSLDKALPTNPWESELDAFLELCGQSAVFSWNEFEDSTCSFDKWSKIGEGAFGEVFKGLLENAFIALKVFLFFFFALFQIFSKVIPFAVNEEQCSKLVNGDYLKPAKFIFNELFITNELTKLSEDTGSGFVTPSFTQLRMSKIVRAGDADDIDAILKDFELETNEANKKAAKKRGKGGASGQSTEKHAENEADGAVEKAEEAQDWTAAINALKPIDQQFTDHKYPQGQICEYRSDKDDRTAINRMTSEEKKALDSSYEEIYNDFRRAAESHRQTRKYVKSWIKPGMKLIDIW

SEQ ID NO: 150315 - protein, 114 aa, Heterodera glycines
  Coding regions on vcDNA: vcDNA=SeqID_76738; Strand=-; Position=1 -46,279-399,465-570,634-702
  Homolog annotation: Hit_ID=CAE68849.1; Match level="QueryCoverage =69%, HitCoverage=17%, E-value=7e-12, Identity=46%"; Hit description =Hypothetical protein CBG14811 [Caenorhabditis briggsae] emb|CAE68833.1| Hypothetical protein CBG14794 [Cae
MALAHFVLIDDCDGGGRTMPDHVDWKSVKPTHSSVSFFYILFKLFNLGSALVQLCLINYFMVPANYTYWGFDVLADLVAGRDWSRSRLFPRVTFCDFKIRQPAQHLPAHRFHPP

SEQ ID NO: 150316 - protein, 600 aa, Heterodera glycines
  Coding regions on vcDNA: vcDNA=SeqID_76739; Strand=+; Position=1 -76,122-366,423-734,852-956,1004-1108,1163-1295,1340-1437,1500 -1694,1775-1868,1921-2078,2280-2439,2526-2647
MSLYLLAQLSYGITLVFQAHVNYLITDLESAIKSFARFPEENKREKTPRKSTGRKRRLAELDGVVEAVMAVPRGMEQEDMEEEDDEGAKRRRISAPRKASKLDLADPSAYVDQQLPAARDVNDQSMLMDESSRLDDMFMDQTVQPALPPPDWVAEPNDSLPFGESAEGVRRSSQQKVSMMSILMGEDTLMEEVGKTVTVAPNLSALQPPVEDLELELPMEMTRDPIYKKRSTDEQQSIDVVADSDDRLQLDALPDIDHQPKSAHPKKRKRLLVDEQLQLGNQEMIDRFNNYGDLLRTRDDLHREIIQPDKPTLSQLLDPRPYHIKALNPELFPLFDTVRAEHRERPLTFDEAQAMTFEDMQKRRLEFDLQSWHSNDEPTPLRQRVEESFGDAGGEQRREETQGKEKVSVSDALVETADKEKEGTAELAAHRPSSVLEGEAMRRDTTGEGNRRITDYSFGQLGNEFIMADLDRTQPPPMDEIVADTELMQESVVTKEHSSMGPLDEQSKKRGCNPDDASLSRLNRGGVASFEELLKSESFGETKRLPITRAVVARKFFALLNLLKHRMVKVRQRKPYGEILIRARNLENDGEQPSFTEHLQ

SEQ ID NO: 150317 - protein, 213 aa, Heterodera glycines
  Coding regions on vcDNA: vcDNA=SeqID_76740; Strand=-; Position=1-642
MPKIISDFFLQQALFVAAFSVASAEQTVTPGRHDDSLGHRCNYSGPGHCPSGDPKGQNAKLFCLFRSPSPDQSSVIALPFSQGSPVSTPNAFVAASSVAIAPRASSAKAISFACERNAPRGTPNVARIVPRQCQANREEAVNDALVFQICIDHSECPSDGWGCVLLKCRRVGQCANFLWLLVNGCFDAPPPLRLQNAVPAPIVPPIGHVWSGF

SEQ ID NO: 150318 - protein, 105 aa, Heterodera glycines
  Coding regions on vcDNA: vcDNA=SeqID_76741; Strand=-; Position=1 -76,134-237,358-495
  Homolog annotation: Hit_ID=CAE58624.1; Match level="QueryCoverage =83%, HitCoverage=12%, E-value=7e-15, Identity=51%"; Hit description =Hypothetical protein CBG01792 [Caenorhabditis briggsae]
MYYYDSIGSFVSFLFRIAHLFTYGAKYYSYLVARAGASLIYERLFADDPLSGRNGLKWAKVQSHGGEHPSDVLMAMALDSPEGKAPTAAELVAALDRHSSAENAM

SEQ ID NO: 150319 - protein, 112 aa, Heterodera glycines
  Coding regions on vcDNA: vcDNA=SeqID_76742; Strand=-; Position=1 -132,530-736
MRFSAPRQVLKYFYKRTNAFWDKSMLHKERVAYGKLRLKLYGALDHVQTVLIFEGQIVGECARNAGGTSDGIVRKVSLMRGTSNEEEEEEEEKRRSQKNGTLKANREQSHIL

SEQ ID NO: 150320 - protein, 229 aa, Heterodera glycines
  Coding regions on vcDNA: vcDNA=SeqID_76743; Strand=-; Position=1 -350,637-749,870-1096
MSSNNALTEMMRREKKKLLGNVDVQDPLAFVIPATLREKRGEDIVLYDSRNVRHGEILCDFEKAEMAAVRAVFPTALIKCCMFHYGQSLYRNFKRLGLVHLYGEKTEYGEAVRNTFSCTRDNNFDHQFGTQLCGYTNTVRHRLTGTINSYVANHSWEDEIVRAPHFPIPLWNMHSQATSAIARTNNGLEATHLHFMVFKLTFPSSPYMIRNLCSFLIQLINSNPYFQML

SEQ ID NO: 150321 - protein, 81 aa, Heterodera glycines
  Coding regions on vcDNA: vcDNA=SeqID_76744; Strand=-; Position=1-244
MENRNFQCPSKFSIDYILSIPAKKPRHGVQAGAGPSSAKPAKDYVKKLENSLEHVPRFQYVKAKSKFSIEDVPANPEGLLA

SEQ ID NO: 150322 - protein, 67 aa, Heterodera glycines
  Coding regions on vcDNA: vcDNA=SeqID_76745; Strand=+; Position=1 -100,271-374
MPKMNKRLPHELIWEIVAAIPIMYLFGGVSKKPDRSCSKFREALCTEEVTVRRIVHPIWIHTIWFRK

SEQ ID NO: 150323 - protein, 130 aa, Heterodera glycines
  Coding regions on vcDNA: vcDNA=SeqID_76746; Strand=-; Position=1 -86,645-846,1587-1688
  Homolog annotation: Hit_ID=NP_508475.1; Match level="QueryCoverage =58%, HitCoverage=10%, E-value=1e-11, Identity=48%"; Hit description =putative protein, with 2 coiled coil-4 domains, of fungal and metazoan origin (XD302) [Caenorhabditis ele
MALEIERRRNREMTTGATQTDHLVGSTVLNLPKFFINFIKIIAPQFCTFNQQRNESDEAELDAQLKRAALAHAEHLERVIRTQKQIHDMETQQIVQETIAIERDKFGKQIDNGLVKLAAIEEMLKSRATK

SEQ ID NO: 150324 - protein, 176 aa, Heterodera glycines
  Coding regions on vcDNA: vcDNA=SeqID_76747; Strand=-; Position=1-530
MSAHSHVKERLFPAATQPAPAIVQPAAAAVVPPASVVVLPAAAEAPPADVEIELDIDGEQLTNFPAQQHPQQLFPAQQQQPQQLFPAQHQQQLLLPPRPMISQIVDNAVSVLQMHFHNMSPLRPAFPPFFINSPFPRLQGALELPSLQFGQQHAFAPPPAPALQIVPFDDAPTPQP

SEQ ID NO: 150325 - protein, 110 aa, Heterodera glycines
  Coding regions on vcDNA: vcDNA=SeqID_76748; Strand=-; Position=1 -70,286-548
MVEVRRHRKRSPNGKTKRMPKQETEKRRKVSDQGPHSASVGRAPSINVPKNNAIACGDGTSVASPLGPFGDLLKNALRFNIKVNNGEGGRNEMAVFQKMILEIKNFKFPN

SEQ ID NO: 150326 - protein, 130 aa, Heterodera glycines
  Coding regions on vcDNA: vcDNA=SeqID_76749; Strand=-; Position=1 -158,556-790
  Homolog annotation: Hit_ID=NP_492644.2; Match level="QueryCoverage =69%, HitCoverage=19%, E-value=1e-33, Identity=77%"; Hit description =CEM Fate Inhibitor CFI-1, ARID DNA binding protein (51.8 kD) (cfi-1) [Caenorhabditis elegans] gb|AAL93258
MAKQVLDLYELYRLVVHHGGLVEVINKKLWREIAKGLNLPTSITSAAFTLRTQYDKYLYDYECKIHKFSDRAALEAAIDANKREGRRNPPPPGAAGVTSNSAGATPAGAQHHNGSNNHNNNSHHQHNYSG

SEQ ID NO: 150327 - protein, 211 aa, Heterodera glycines
  Coding regions on vcDNA: vcDNA=SeqID_76750; Strand=+; Position=1 -105,382-912
  Homolog annotation: Hit_ID=CAE64333.1; Match level="QueryCoverage =94%, HitCoverage=13%, E-value=1e-17, Identity=29%"; Hit description =Hypothetical protein CBG09016 [Caenorhabditis briggsae]
MAIEAYETAMRRAPKDHQLAEKIGNAYVKCHLYNKAITFYEAAVKSGRHNLRIRFAEQLFQLGNLEKCKKVLKEMLEEQGEPMGSKKSNSNFGVSFGKMKNSKNKEIAPMREHVAYLMLMSRLHIEQNDLEQSCKDLQRARQLQLKVIARGTVASTRDGIVNMAEEKQLAAKLAHSRGHITADRYPPKMPLQHLSTDCRNACQQAGLEQVN

SEQ ID NO: 150328 - protein, 115 aa, Heterodera glycines
  Coding regions on vcDNA: vcDNA=SeqID_76751; Strand=+; Position=1 -83,432-480,903-1118
MIEICLNPDNEIMGADLGEQQQQLSPEDAHEANESYKAADRFFQEDDANLSAGAILGTARALLMAQTDAKGKGAAQENGWGMRGIWRRRNICSNVKIWENEKGMVKRRDSRPRLW

SEQ ID NO: 150329 - protein, 87 aa, Heterodera glycines
  Coding regions on vcDNA: vcDNA=SeqID_76752; Strand=-; Position=1 -117,447-593
NDSTTASAKATQTDAHALLVGHGATSAGSSGLSLISQEETLSLLAIIEDALDETIDRQSRIKTNEFIASTARKQANNQSITNQIRAF

SEQ ID NO: 150330 - protein, 125 aa, Heterodera glycines
  Coding regions on vcDNA: vcDNA=SeqID_76753; Strand=+; Position=1 -54,666-810,2384-2560
IVAKEAEQNDDDQPSPITKADEEIRVLEKVIADAQKVIADATARLEYWKEHRSTMVSFFYIFHFYPIGLAHADAALSAQCGARPVSARPTCAVARPASAGAATALCHCARTAPLAAVAARRSTTV

SEQ ID NO: 150331 - protein, 88 aa, Heterodera glycines
  Coding regions on vcDNA: vcDNA=SeqID_76754; Strand=+; Position=1 -263,420-423
MAQKPNLNLFFSEHQPPAICEAAQTLRDAFIKWLLCQRLKMCAVKMFMRLEDDEIDARPLQPPQNGAQGQLLLSSTAGDLTQYKTLLR

SEQ ID NO: 150332 - protein, 133 aa, Heterodera glycines
  Coding regions on vcDNA: vcDNA=SeqID_76755; Strand=+; Position=1-401
MKLFDEKEMRSLSSTQHYMKVLRSFISFLETTFGRNQTDLNHVGPLLSGMTIIKYRIRGIKSRAIAEREQARRTSTKQQTNPQHIPSYGTVMALINHPQINAAHTNFRNKYIHGASAAETDDEWPTYEEFKFI

SEQ ID NO: 150333 - protein, 202 aa, Heterodera glycines
  Coding regions on vcDNA: vcDNA=SeqID_76756; Strand=+; Position=1 -238,376-746
MNAEDNNNPSPTDPEHDISNNDDGTASVVDKHDLIWRTKELFEYISKRAAAGRLTTASRQGKVTLGREFFEEELENIDKECHGIYLNKTAAEAAKDWNGNMKHRHAASWATAMRGTFSIGAHEENATSDHRVAMRELTKRRAAAATEKMEIEAKSAAIKSQLSIENAKLGLLLKKQRLAKGHGTYHKDVIKYLASTATTSKR

SEQ ID NO: 150334 - protein, 102 aa, Heterodera glycines
  Coding regions on vcDNA: vcDNA=SeqID_76757; Strand=+; Position=1-309
MRELEQSGNCGVLVKLKITGRFLWQMPDVRAEECLEEISDNDDSHVRDEASRHLPKPSLPSASAVFRRSFVDGGNENSEEFGIFKRGFLGEGDENSEVIFID

SEQ ID NO: 150335 - protein, 102 aa, Heterodera glycines
  Coding regions on vcDNA: vcDNA=SeqID_76758; Strand=+; Position=1 -252,805-861
MLNLNERRYNCGSAIADWTIADDSCGPYFCGRQLRTVLLRTGQLRTVLLRTTVADRTFADDSCGPYFCGRQLRTVLLLKKLTGRANSVYLGLSNDTKIVGFR

SEQ ID NO: 150336 - protein, 236 aa, Heterodera glycines
  Coding regions on vcDNA: vcDNA=SeqID_76759; Strand=-; Position=1 -75,873-956,1209-1256,1373-1876
  Homolog annotation: Hit_ID=DAA01153.1; Match level="QueryCoverage =50%, HitCoverage=9%, E-value=8e-18, Identity=42%"; Hit description =TPA: RTl1 [Mus musculus] ref|NP_908998.1| retrotransposon-like 1 [Mus musculus]
MPPLQSFLASIGRVASTALSTRVQRLIGKTATELPEIVTEKMDRIYVKLEQQQSLLSATIDEKMAKHEVSLLIATDQRIVHFLLLAFLLIAAVCLTLLLIKAIVDQFLKQKFEQNNNTTDGEEEKRTEEKEETEENGKGGEKGRRGEESTLGENDGEEEEEEEKKQNGKGREGGEKGGRKEEQILEENDGEEEEEEEEEKEGNKREEFVREENEENEKEEEDGTEALLEEFAHLQL

SEQ ID NO: 150337 - protein, 34 aa, Heterodera glycines
  Coding regions on vcDNA: vcDNA=SeqID_76760; Strand=-; Position=1 -45,106-165
MIIFLLTLLFGLVFVALKNWNPTNYKVVKPYKVN

SEQ ID NO: 150338 - protein, 248 aa, Heterodera glycines
  Coding regions on vcDNA: vcDNA=SeqID_76761; Strand=+; Position=1 -106,261-777,1549-1637,1717-1750
  Homolog annotation: Hit_ID=AAC57158.1; Match level="QueryCoverage =74%, HitCoverage=56%, E-value=2e-19, Identity=24%"; Hit description =ORF 73; extensive acidic domains, potential leucine zipper; immediate early protein homolog [Human herpesv
ICEKQMSRKRKTAAEEQRNKRKKRSDRKKENGKEMLYCRHPPRAILEKHQRREQQQNAVNDQQQQQNEQQQQNGHNEQQFDEQQHEQNDGDEQQQQNQNDGGEQQHAEQHQPNNNNNNSLIFEEEEEEEMTNADEEEQQSGIEADESTHEQQQPEEEEDGNEGEHHQHGNDQQQREEEVREGQYELDRAYACYTHSNGQRAFYVKWTLAHKWNTGAAKASEHDILWAADTDKRTRQTAEKQLRAFIDK

SEQ ID NO: 150339 - protein, 86 aa, Heterodera glycines
  Coding regions on vcDNA: vcDNA=SeqID_76762; Strand=-; Position=1 -142,520-638
MENECDNERARTQKTTRSENVTCDCSLGNKGVDWANALNTPPPITKKRQGCVGGWLDAKGYGQTIKIYCFDGYEICYAARCFKVMF

SEQ ID NO: 150340 - protein, 23 aa, Heterodera glycines
  Coding regions on vcDNA: vcDNA=SeqID_76763; Strand=+; Position=1-70
GGLFFNILRKGDIIGDRAFNGDR

SEQ ID NO: 150341 - protein, 143 aa, Heterodera glycines
  Coding regions on vcDNA: vcDNA=SeqID_76764; Strand=+; Position=1-434
ANQELAAQFFAENVKPRFKFAGEDEEIAVNLFDLTRSLIGIWKFYFNSKEGKKYKWKLSNLFKYSFEPILLNENEFKKNEEGMDGRNKTAAESSSQSLAANEQTGNADNDLLKLMEDKFKNLVKKMAKIAQKMNKTWRTSIYF

SEQ ID NO: 150342 - protein, 79 aa, Heterodera glycines
  Coding regions on vcDNA: vcDNA=SeqID_76765; Strand=-; Position=1 -155,515-599
MTSALILGAVAFGAFTHLGAHEWVAIVMVLGIVGFAVFFLIGLFFCFSCCFRKAAEKVALKEVISSTPPAVIVITYNPI

SEQ ID NO: 150343 - protein, 271 aa, Heterodera glycines
  Coding regions on vcDNA: vcDNA=SeqID_76766; Strand=+; Position=1 -134,185-599,659-925
MGICHKIGENGTKKMQIDDADGNPLPIPRNPLPNKVIGFRRIQINYIDQNVIEFLHRFHRLFPICSTTMNITTENVRILDYFLLHIWPMFCDSMHLMLLNTILFRRFRQLAPSSLSDCPSLRVVWLDDGTFPEFPPDDSAMASDGQAVTKWVLTPRPDGQPKLLKSPVNSPDQWSSTMEQFKAEFSNASSPVSFSINFLPSSPLDSAVPFDLINQATGEQLTLEQYANGFWLSRCPIGWDEMKWDNVWKELIDARTNPIDIVIKDGGYDDG

SEQ ID NO: 150344 - protein, 43 aa, Heterodera glycines
  Coding regions on vcDNA: vcDNA=SeqID_76767; Strand=-; Position=1 -12,93-212
MGVWHLFICISGQVAKPSDFIISRLGSIPHWDRIFFIFSLPLF

SEQ ID NO: 150345 - protein, 120 aa, Heterodera glycines
  Coding regions on vcDNA: vcDNA=SeqID_76768; Strand=-; Position=1 -44,316-459,593-632,682-769,828-871
  Homolog annotation: Hit_ID=XP_313819.1; Match level="QueryCoverage =82%, HitCoverage=34%, E-value=6e-27, Identity=59%"; Hit description =ENSANGP00000003967 [Anopheles gambiae]
MNLTSIQPIPNLYKRTGNYSDNLSVDELWRAKHLYDSAFHPDTGEKVLLLGRMSARVPVVTLMSTPAVFGWQFVNQTFNAITNYSNRSGDALSNSQLLQAYVMATGGATGVALGLDRAVT

SEQ ID NO: 150346 - protein, 74 aa, Heterodera glycines
  Coding regions on vcDNA: vcDNA=SeqID_76769; Strand=-; Position=1 -77,597-744
MGKCPPNFGRIMVLFFVQNMNKTLKNYYGVAQSSLECYLRSTNYTFMRLDLTEDIRAKKYCVQHKQVLYSKCLG

SEQ ID NO: 150347 - protein, 117 aa, Heterodera glycines
  Coding regions on vcDNA: vcDNA=SeqID_76770; Strand=-; Position=1 -293,440-500
MKMMRKMKPTFVYLAIIGSFSTILCLITLFHQYRPLRISSVEENKNSNKKLLYTLPNAMTIGPKTPYLKRENMGKCPPNFGRIMVLVFVQNMNKTLEKKFDFFLFINLKKNIFYKFV

SEQ ID NO: 150348 - protein, 44 aa, Heterodera glycines
  Coding regions on vcDNA: vcDNA=SeqID_76771; Strand=-; Position=1 -111,404-427
MPPIWVSLMPFATVAFANCVNIPVMRRKCGKLQLVKTHFIFLRP

SEQ ID NO: 150349 - protein, 21 aa, Heterodera glycines
  Coding regions on vcDNA: vcDNA=SeqID_76772; Strand=+; Position=1-65
MAYSYASDKDLRFIILKLKSQ

SEQ ID NO: 150350 - protein, 76 aa, Heterodera glycines
  Coding regions on vcDNA: vcDNA=SeqID_76773; Strand=-; Position=1 -30,387-492,725-819
MLILLLLHSRRLHAELSETIDRFTEENSLLGYMNDQLTEQLEPLTAAPRPAERWFVIPFVPLKSLSVLSLTTQHEK

SEQ ID NO: 150351 - protein, 255 aa, Heterodera glycines
  Coding regions on vcDNA: vcDNA=SeqID_76774; Strand=+; Position=1 -54,223-426,679-797,1129-1372,1662-1807
  Homolog annotation: Hit_ID=CAE60037.1; Match level="QueryCoverage =95%, HitCoverage=83%, E-value=1e-21, Identity=29%"; Hit description =Hypothetical protein CBG03546 [Caenorhabditis briggsae]
MGSLAVQPPSGVTRNLTEVFVFLRNNAQQEHLVELNSQQRVNLDTGKKELPFAHCFCYCILRLDDKMCLIAIDEGKSVGFGGGKIQKQLTDLDFSDDKGASAEAGKVAELTEELTAMFGHSKRLINQSAFLRQLDSRTANLDTFVLKSSTNVVPTAASVCAGDSGTTDGAMTSCTRDADKQQQEELTIDQIQYIMQNEHVSKEREQEVLKISKSILELHSMFKDIASMIIDQGTILDRIDYNVEQSASRITSAFK

SEQ ID NO: 150352 - protein, 49 aa, Heterodera glycines
  Coding regions on vcDNA: vcDNA=SeqID_76775; Strand=+; Position=1-150
VICGCIRGALEALHMEVQAVLVSDVPEPTELRIKVHRVLQESIPAGDEP

SEQ ID NO: 150353 - protein, 256 aa, Heterodera glycines
  Coding regions on vcDNA: vcDNA=SeqID_76776; Strand=-; Position=1 -187,506-1089
MKCDWPTQPLDGYLLHCARDNGIPLLDGRNLDMKRIIAMRDIKELTESHGILMCTLEPLRRQENYELYEGQGSNSYSSTSFNNYENNQYFSDRECANELLSPEINDNELSRSYERIKPTFFDKEMRGVHERTASRRLRSSYEDQAHRESYEETENRRNRLVTYYDNDESPNNYSRRERQRYNDAPHQPEYNEEIQQNSPITYDGRESERDALANYQPTGYDETQQNSARSQSQGRIRERPTHNEKEVPKQTKNRRG

SEQ ID NO: 150354 - protein, 21 aa, Heterodera glycines
  Coding regions on vcDNA: vcDNA=SeqID_76777; Strand=-; Position=1-64
FLLHFCYEIYGKRPKYVLKFE

SEQ ID NO: 150355 - protein, 98 aa, Heterodera glycines
  Coding regions on vcDNA: vcDNA=SeqID_76778; Strand=+; Position=1 -12,484-767
MDARLGSKAFEEDCNESNDANATNGSVPQQATDHETEKTGVIPMTLDKKAENSEDNDADSMATEQMQENSEDNDADSMATEQMPENSDEEYSMASEQM

SEQ ID NO: 150356 - protein, 41 aa, Heterodera glycines; identical to SEQ ID NO: 139690
  Coding regions on vcDNA: vcDNA=SeqID_76779; Strand=+; Position=1-170

SEQ ID NO: 150357 - protein, 85 aa, Heterodera glycines
  Coding regions on vcDNA: vcDNA=SeqID_76780; Strand=-; Position=1 -46,691-902
MIATVGSNCADGQGSGLKGIGLDLYFLKKLDPNMKISEYRAQSYGKYKPGPNLISTLCQVDTLYRLSTTVGRSIGMEPQNKAMQI

SEQ ID NO: 150358 - protein, 54 aa, Heterodera glycines
  Coding regions on vcDNA: vcDNA=SeqID_76781; Strand=+; Position=1-163
MALLCAAEPDCMVPIGQTKACIYTPTAPNLTCHRQDQSLAEILRYNMEYRQQIE

SEQ ID NO: 150359 - protein, 126 aa, Heterodera glycines
  Coding regions on vcDNA: vcDNA=SeqID_76782; Strand=+; Position=1-381
MVYTLKMNDSRIIRGKKFNCSLTWLLERYKLSDKYAIKEKIEVCFLIYFYYIFINFNHFYVKYPGHPKFVFVTAANDFYYPFIRTVIANVKENFGCKQKIIAYDLGTVTKNKEWVKNSFIYFKINN

SEQ ID NO: 150360 - protein, 102 aa, Heterodera glycines
  Coding regions on vcDNA: vcDNA=SeqID_76783; Strand=-; Position=1 -68,121-361
MALKGHNQSDHCTTEANANAETGLRTARSDRVALRKRRFIGDLIDIGKFTFDTGCKLFHTAICDLGKKRKREAVYGKNEPAPNPLTSSKSCRAPLLTSLWKR

SEQ ID NO: 150361 - protein, 61 aa, Heterodera glycines
  Coding regions on vcDNA: vcDNA=SeqID_76784; Strand=-; Position=1 -73,324-433
MLSFIYSDDLSELDGDNAMAVLYAAKKYGIDRLVSPCLQIPIPKLSNVFLAFCQARLFDLE

SEQ ID NO: 150362 - protein, 94 aa, Heterodera glycines
  Coding regions on vcDNA: vcDNA=SeqID_76785; Strand=-; Position=1 -87,173-266,1051-1154
MSSSSKQGNPIERMKHLVSSGEDADIQFLLLPAHKLILKHASEVFEAMFRFDSQKEKTENGFILGIWCPVFRCPIYQSTIGINDVPSVLLPNKI

SEQ ID NO: 150363 - protein, 662 aa, Heterodera glycines
  Coding regions on vcDNA: vcDNA=SeqID_76786; Strand=-; Position=1 -792,943-2140
  Homolog annotation: Hit_ID=XP_320889.1; Match level="QueryCoverage =97%, HitCoverage=83%, E-value=1e-106, Identity=33%"; Hit description= ENSANGP00000012033 [Anopheles gambiae] ref|XP_313651.1| ENSANGP00000013044 [Anopheles gambiae] ref|XP_31
TAWKCSASEQQPQQSNLASSIDARISKFYYDAESGNTFEQWFKRFGTLIEDDGKDLPEATKVRLLLGKLSDEDYNKYRDSVSPTQPDQISWADTLDKLKSLYAETRSLFVRRYECFKIRQQPNQDITSLIAQINASCENANLSLTKEQLKCIILVIALRDEHHDLRQKCLKMLEDGQKNGTDITLKQIEEELRTIQMVKESALSLMAQPAATNAIHTRPQQWKDSKGKSKPFVKTEQRSHNQQNCSKNVDKGKHRQPTDPCPALNTTCTEVGTADHWYWRILITVNGVKIRINVDTGAQATIITSKTWCKIGKPKLSPADIEARNCNGEAVPIKGKFFGIVSMGNDEPKMLTAYVSDAIKHDLLGMPWIVALEVIPREIMFQEVNTKPTIIQKEAMPKAKVIQDEKSLISALQKDFSDVFSNELGHCTKAKAHLILKSDAKPVFCKARPIPHGATEAVNAELDRLQQLGAIKPIKFSHWAAPILAVKKKNGKTRVCIDFSTGLNNARELNRHPLPRPDDIYAALNGAAYFSNLDLSDAYLQMELDEQSKQLCALSTHRGLFQCQRLPFGVKSAPSIFQHLMDQICSGIPGVFAYLDDGLIASKTLEEHVSALYQLFARFNEYGLHIQLEKCKFLQKELLFLGHIMSSERIHPDPEQSEFIRK

SEQ ID NO: 150364 - protein, 81 aa, Heterodera glycines
  Coding regions on vcDNA: vcDNA=SeqID_76787; Strand=-; Position=1 -199,369-415
MYADPAGSRTKIKFADPVAGLEFKIFCRTGSGRINPANPAFSKKCRIADWDPAKSCAGSGPAPGSSEIHKFFGENLLQNRL

SEQ ID NO: 150365 - protein, 72 aa, Heterodera glycines
  Coding regions on vcDNA: vcDNA=SeqID_76788; Strand=-; Position=1 -133,182-267
  Homolog annotation: Hit_ID=CAE62038.1; Match level="QueryCoverage =98%, HitCoverage=4%, E-value=1e-31, Identity=83%"; Hit description =Hypothetical protein CBG06054 [Caenorhabditis briggsae]
MVLNPSVARCNLPKIYDWGTKTVYFQPQTGKAMDEKAYVGYIYFVPPTLDPMRLDIGNIYDWFTNPLPYQVI

SEQ ID NO: 150366 - protein, 32 aa, Heterodera glycines
  Coding regions on vcDNA: vcDNA=SeqID_76789; Strand=-; Position=1-98
MNTSSSVRTRRPSSRSPLHSSPTVQAEPKKPC

SEQ ID NO: 150367 - protein, 35 aa, Heterodera glycines
  Coding regions on vcDNA: vcDNA=SeqID_76790; Strand=+; Position=1-105
CVPICRLKLGRLLLLHRQICVGITTMPNENTEKRW

SEQ ID NO: 150368 - protein, 56 aa, Heterodera glycines
  Coding regions on vcDNA: vcDNA=SeqID_76791; Strand=-; Position=1 -98,197-269
MNTSSSVRTRRPSSRSPLHSSPTVQAEPKKPCRIYNMYCGIIIALSVCAVVYFYVY

SEQ ID NO: 150369 - protein, 46 aa, Heterodera glycines
  Coding regions on vcDNA: vcDNA=SeqID_76792; Strand=-; Position=1 -32,427-535
MALLAFMGHAGFVAQSQTSSQSVTVTPLNTMIENMRVTEIRHGNQK

SEQ ID NO: 150370 - protein, 78 aa, Heterodera glycines
  Coding regions on vcDNA: vcDNA=SeqID_76793; Strand=-; Position=1 -190,242-288
MFNFKVLLFLFPLLSFITYGAILPNYEATAKNGPNETPKFQNNDLIGDKFMKCCKDNEISCSEVCTYPPPAFSFSEQW

SEQ ID NO: 150371 - protein, 26 aa, Heterodera glycines
  Coding regions on vcDNA: vcDNA=SeqID_76794; Strand=+; Position=1 -31,348-397
MRAKDISTSVGDIGYTLELRIPINLQ

SEQ ID NO: 150372 - protein, 77 aa, Heterodera glycines
  Coding regions on vcDNA: vcDNA=SeqID_76795; Strand=+; Position=1 -63,395-565
MYYAEAELCANRQFGGMREQRLFVVRLANKWWSRGLYVKDKARGELCRLRMECRSVLRGQSMCRRAVHKGKNDGQRE

SEQ ID NO: 150373 - protein, 32 aa, Heterodera glycines
  Coding regions on vcDNA: vcDNA=SeqID_76796; Strand=-; Position=1-101
YIGAMDVGLPYQLLKLLFFKKDTKTGITPFRD

SEQ ID NO: 150374 - protein, 57 aa, Heterodera glycines
  Coding regions on vcDNA: vcDNA=SeqID_76797; Strand=+; Position=1 -220,260-363
KSHFGDFVTKIVKNHYFGVLSLFFTISTFFGKFLNKNAIKPKNTPLRIDKKNFKKHS

SEQ ID NO: 150375 - protein, 256 aa, Heterodera glycines
  Coding regions on vcDNA: vcDNA=SeqID_76798; Strand=-; Position=1 -74,248-281,556-629,976-1013,1158-1307,1366-1501,1816-2080
MDKGNLWIVPGFTILVFAGLWTTKLSKIALEESVCRSGSIYDLSGTTLDDDAQRHCQTAKSGFYGFGRPLCSSCINFNNVVNASQNVLMDNDGIMEVDTDKLDERIPTIADNFKVATYSRAFAGFIFFELSLVFAPIVLLMFVLPLMVGAGYRTWGLDVARAWWERKEWHGTTLTPVLGAVDEHQQQRLFQRPLRDWERSPPRIPLIPRITYCDYNYVSLGNTHTLTYRCYLDANWHERTALFTWWTKYGGLINGN

SEQ ID NO: 150376 - protein, 130 aa, Heterodera glycines
  Coding regions on vcDNA: vcDNA=SeqID_76799; Strand=+; Position=1 -230,761-923
MDDEENILQKIYLEFYFDRKMFGDPNAIILYVNQPDLFPVCHFEQLQFVMFQVEKLAKQDGNHVLVRRASFIELRKRLRLDEAGDYSLYFDGTKRVALVHMAYGYLPEHYPEKDFDLRVMMERSTAIVKI

SEQ ID NO: 150377 - protein, 42 aa, Heterodera glycines
  Coding regions on vcDNA: vcDNA=SeqID_76800; Strand=-; Position=1 -63,118-183
MCFEFWPPVEGRWGRNVPMCRRTPVGFSSFRQVEDEGLATAK

SEQ ID NO: 150378 - protein, 53 aa, Heterodera glycines
  Coding regions on vcDNA: vcDNA=SeqID_76801; Strand=-; Position=1-184
FHKKIMNPCTIGSIFHMFFKMLTIRQNIANFFTANHFFKFNFPFKQKLLHELT

SEQ ID NO: 150379 - protein, 131 aa, Heterodera glycines
  Coding regions on vcDNA: vcDNA=SeqID_76802; Strand=+; Position=1 -101,168-267,309-503
MDTQRKEIETFGMQPFHAIVTPANTTIWLKCSQCLHPDDTEELEDVWKPSPSVIGRKIQQFLKKIREKIIRSKSPYAKSRRVNLATYCWQKLGNINEKDTSKKKWVTIKSPTFQKTGGRDNQTEVTKFVEE

SEQ ID NO: 150380 - protein, 108 aa, Heterodera glycines
  Coding regions on vcDNA: vcDNA=SeqID_76803; Strand=+; Position=1 -187,243-382
KAVLEEVATRLEEHKGDETSVESQAEEVTSTTLQRGLLQHEVGGMEAQQMVVGEQAQCPSAEGVPHAFLCAGCQFRADCANLLRAIGALLKDFGSAASVDGGRNNGTT

SEQ ID NO: 150381 - protein, 25 aa, Heterodera glycines
  Coding regions on vcDNA: vcDNA=SeqID_76804; Strand=+; Position=1-75
TCTCCVVVKLSTFHNFSPGFNSPLG

SEQ ID NO: 150382 - protein, 388 aa, Heterodera glycines
  Coding regions on vcDNA: vcDNA=SeqID_76805; Strand=+; Position=1 -148,1402-1435,1484-1622,1747-1964,2007-2364,2501-2582,2631-2817
MHEREFRFEAILAPKIEEEEVQALVGTEGLVDGLVRFGRNGTVLAYGPTDTPAERRESLVGCPSPSEEQLPPTGFTPTRWKCFDARRKGRGGRKGRTQLRIRRHWEYGHSFSLSPSIPPLLNNSNSLPGGRSRPSNAPPANNESNAATPKVPKLPRLGTSLFDSLRDQHLANSERQHRLRAAAASEFRTLRIGIGTEGEEGHSEGMRSAANARGDGERAKVRKGGGESADGSGGQRATDERIGRHSAQIGESFETGRANAAANGGANEVKPNQSRSERTKVISQFQRVGQRPAAIANRRKQENQLKRIKQYERIVDRLIGADKNLEGEERAKLHREYRLLRSQLDRMLPVDNGLPSWNTQILAERNAKAGPSKNEKPRLRQSESISLN

SEQ ID NO: 150383 - protein, 28 aa, Heterodera glycines
  Coding regions on vcDNA: vcDNA=SeqID_76806; Strand=-; Position=1-86
NQFHIILEFLRGISRNYRMNPRISVNFY

SEQ ID NO: 150384 - protein, 800 aa, Heterodera glycines
  misc_feature (717)..(717): Xaa can be any naturally occurring amino acid
  misc_feature (797)..(797): Xaa can be any naturally occurring amino acid
  Coding regions on vcDNA: vcDNA=SeqID_76807; Strand=+; Position=1 -172,282-454,578-649,699-840,1056-1130,1173-1217,1277-1497,1598 -1798,1846-1892,2067-2284,2447-2514,2557-2697,2745-2900,2953 -3098,3151-3223,3291-3465,4531-4565
  Homolog annotation: Hit_ID=CAE63213.1; Match level="QueryCoverage =98%, HitCoverage=63%, E-value=1e-132, Identity=30%"; Hit description= Hypothetical protein CBG07570 [Caenorhabditis briggsae]
LSPPPSFRHFFRRLSDNPWHCDCRLRWLKRLIAPQIRCYRPTHLFGRPLNQISSQAVKCRGGGGRRDRTTQVWPLRCPPGCVCTESAPDAVVVDCHDRLLRAVPQRLPPNTVELDLSKNAIERVEPAAFAGLGRLSSLMLFSNNLTDLPERVFDMLFSNNLTDLPERVFDGIGNSLQVLLMNGNQLECLRNEVFRGLNQLKLLSLYDNKIRSISQATFAPFALSLQTLHLARNPLICDCNLTLHLARNPLICDCNLVWMVWMALLLVDRPVETSGARCHSPKRVAQRRIATLSADRFRCVGSERLVTQRAGQCEVDRECPEECQCRGTTVDCSSLHLSSLPAAFPRFTTSLLLRSNRLSPRGSLLPNADLPNLVHLDLSDNQINALPPDFLSSVPSLRELDLSENSLRQFSAHDLSENSLRQFSAHSLDLVISLSFRSLRQNPLNSLDGPVFEQRTSRFGWVGTFICDCQLRPLIRRLRKGKIWTNEWEEEEFGGPRCAGIPGGQCSTEGEFCPSGCSCVRPVVRCSGLVVRCSGLGLSRVPIGIPEDTTELFLDNNRIEHLSGDSFARFPQLIKLDLSHNDLSHNLLRHIPSGTFVHLSVLSTLILAFNRIQCLHNGAFDGLSQLRVLSLHQNDLSQLSEATFAPLSNDLSQLSEATFAPLSNLSHIALSANPFWCDCQMNWAIRWVRSKFIEPGIAKCEGPLHIAKCEGPLHRKXLIFFQIQFNFYGSSPSSPPPPISVLSKCRPCLDRSLCANLALCHSLENGKFRCECPLGFHGTFCEHPMENCDTSRMMSNXPCR

SEQ ID NO: 150385 - protein, 29 aa, Heterodera glycines
  Coding regions on vcDNA: vcDNA=SeqID_76808; Strand=-; Position=1 -37,214-266
MVVQLTFLISIKETVCQRFKMAERKPLQN

SEQ ID NO: 150386 - protein, 24 aa, Heterodera glycines
  Coding regions on vcDNA: vcDNA=SeqID_76809; Strand=+; Position=1-74
FRSILAISSLISLSVCKTNLSSGD

SEQ ID NO: 150387 - protein, 103 aa, Heterodera glycines
  Coding regions on vcDNA: vcDNA=SeqID_76810; Strand=+; Position=1-314
NDKADKKREKGEGVGDSVDGIFCSRPPPATAFAVFVTSVEKNSTKNEEKAAKTLQIDWMDEVKRRENDGENLAKCHNDGKNDGAEVLDGQINEHLAKANSKKG

SEQ ID NO: 150388 - protein, 366 aa, Heterodera glycines
  Coding regions on vcDNA: vcDNA=SeqID_76811; Strand=-; Position=1 -33,798-931,976-1134,1192-1366,1451-1516,1684-1874,1924-2158
  Homolog annotation: Hit_ID=CAE64539.1; Match level="QueryCoverage =95%, HitCoverage=72%, E-value=5e-78, Identity=47%"; Hit description =Hypothetical protein CBG09282 [Caenorhabditis briggsae]
YIKFVFFHSGFQVTLICMGFFQERIVTRGYPHRTEPKRTDFFRDTQFLVFSNRIVALALSGAYLFVTRKVALALSGAYLFVTRKAQPPHVAPLYLHSFSSFSNVIASWCQYEALKYVSFPAQTVCTVCKASKIVPTMLMGILLRGQRYSTSQYAFALTLVLGTSVFFLATSSDSSHFTSARGTFSGFLLMLGYLLFDAFTPNWQKTVRSSPHHFLSIQMMFCVNAFSVLICLVPLLQQWTLPSSVHFLFVHESVLVDCLFLSLGSSLGQVFIYLTIQNFGPVVLSVIMVFIYLTIQNFGPVVLSVIMTLRQIFSIILSSLYFVHPINLQGFCGLFLVFGAIFFDACNKHSKAVAGGGREQKMPSTE

SEQ ID NO: 150389 - protein, 108 aa, Heterodera glycines
  Coding regions on vcDNA: vcDNA=SeqID_76812; Strand=-; Position=1 -149,594-768
  Homolog annotation: Hit_ID=CAE72242.1; Match level="QueryCoverage =46%, HitCoverage=16%, E-value=1e-12, Identity=72%"; Hit description =Hypothetical protein CBG19360 [Caenorhabditis briggsae]
MQSDEDIGRMVASVPVAIGSAMEVFAEKLLLAAAESVQHSSTKTLSPMHINGGESQANPIAKKGGESEEQGQSVPDFHSFPIFPLKAAAVVQITAEQLLREAKERELE

SEQ ID NO: 150390 - protein, 75 aa, Heterodera glycines
  Coding regions on vcDNA: vcDNA=SeqID_76813; Strand=-; Position=1 -107,712-832
  Homolog annotation: Hit_ID=CAE71933.1; Match level="QueryCoverage =72%, HitCoverage=16%, E-value=2e-09, Identity=53%"; Hit description =Hypothetical protein CBG18997 [Caenorhabditis briggsae]
MAVSCWLADKMICDLWLQLGTPYLHAIWHLLAAYAGCYRIAFLFSAKNIYKMNKGRFGASPSFWTVNFFTVNQIQ

SEQ ID NO: 150391 - protein, 49 aa, Heterodera glycines
  Coding regions on vcDNA: vcDNA=SeqID_76814; Strand=+; Position=1 -108,247-288
MAQGNEEAIKTNAFTRRFNKTENGHRNGQKNDGQTKLTPKFLLNAFLKN

SEQ ID NO: 150392 - protein, 146 aa, Heterodera glycines
  Coding regions on vcDNA: vcDNA=SeqID_76815; Strand=+; Position=1 -261,520-699
MFLEQFARHHIVVEQHRRVRHQTRGHHVQKEQFVHQLAEQRKGGVVISRREPIKCEKSVGTNGHGVHPAEKGPQADDVQQGQQQQRKPIILKKGRNIEKITTTHSATNGTILYLLSDSDSHQGMPDSKANQWSIKVTNCQLSDKTF

SEQ ID NO: 150393 - protein, 150 aa, Heterodera glycines
  Coding regions on vcDNA: vcDNA=SeqID_76816; Strand=-; Position=1 -104,392-633,1385-1502
  Homolog annotation: Hit_ID=NP_504697.2; Match level="QueryCoverage =96%, HitCoverage=53%, E-value=2e-38, Identity=52%"; Hit description =putative protein, with at least 4 transmembrane domains, of eukaryotic origin (5H174) [Caenorhabditis ele
QFVTLMDHWFAFESGMPWCESLYKYKIVPFVAEFANTISNLPLLLLPLLNVVRLWPFLSRVNPVAICPHAFLALNGLASAYYHATLSLFGQLVDELFLLHMMTTCLVAYTPVLRFFPTKFFSPLGLIRLAVILLSVSVSVLGFIDPAVNA

SEQ ID NO: 150394 - protein, 95 aa, Heterodera glycines
  Coding regions on vcDNA: vcDNA=SeqID_76817; Strand=+; Position=1 -140,319-466
MLFLPLLLVLLLPLYSSVFVQSVSQRRPVRITPFLYSDALNIAAAGGSVAPLKKENAMFDVPTKFGWDSQTMRQITPFLYSSVNSGQQQERKRFE

SEQ ID NO: 150395 - protein, 436 aa, Heterodera glycines
  Coding regions on vcDNA: vcDNA=SeqID_76818; Strand=-; Position=1 -93,296-481,631-839,903-1134,1216-1468,1897-2013,2309-2526
  Homolog annotation: Hit_ID=S05697; Match level="QueryCoverage=80%, HitCoverage=25%, E-value=9e-75, Identity=32%"; Hit description =myosin heavy chain C [similarity] - Caenorhabditis elegans
MASDIQMMHLKRAFDWYEEMKSQLEIIRFKKQALENESVEVNSRLANEESRAIELQKERKRTEAECESLRKNITDMDVGMRKLEAEKQAKDNQLRTLADELHKQELTESKLAKERKQQQELAAKLQNDLQMEAERNAAEKAHRQKLQQTLEVAKVSNSFNGTPRVENEMDRERRARAEQEKARRKFEGEVRIARENLDEMGKQRQDMETSLKRKEADLFALSVRFEEAQSQGAKLQRQAQEMDARCKEMEAELEAERQARARSERGRGEIQYEADELQERLEQQAQATQSQIEANKKKDAEVAKLRREIDQLKLTFESQATALKKKGASGCTELHEQIDQVQRMKNKAEKERIAMQRQLEMQQRVAILQAAPAGRVRRVRAPSGGLGVAVDRYRTPQVAILCPSGGVEACRNGGTAREAGTEHAREEPAARVGAAQ

SEQ ID NO: 150396 - protein, 287 aa, Heterodera glycines
  Coding regions on vcDNA: vcDNA=SeqID_76819; Strand=+; Position=1 -62,394-582,794-1040,1083-1222,1270-1495
MENAEIKSQRKNKKLEHEGCLFEFKLVKRVRHEIELPPPVPVTLQELELPEQYRIYKRTEETQELFLLADSGTYTDQNREGQQRRDKWVFPVLHCLLTCKSQSTYDRMFDMVRHRWPTFWPTNASMDFEQAMVNAFRAKHPQCSINFCLFHLVRNMKARLTDEQTHRFKTDAAFARAAKMVTSLAFVPLADLTPALAALEDYLPNELEGVLDWFVINYVGRLRNNGTRTRPLFRPEEWSVYERTMNGTTAQTTSPKRTIARCNMRSESDKHTRQYGNSSTFCVSTKK

SEQ ID NO: 150397 - protein, 60 aa, Heterodera glycines
  Coding regions on vcDNA: vcDNA=SeqID_76820; Strand=-; Position=1-277
NERDLIDPFIFNFQSLINSWAGMFLFCRCRRRWHRFLLNCRCQTSVLFNAAAVSRAGNYC

SEQ ID NO: 150398 - protein, 138 aa, Heterodera glycines
  Coding regions on vcDNA: vcDNA=SeqID_76821; Strand=-; Position=1 -113,194-305,631-798
  Homolog annotation: Hit_ID=CAE64843.1; Match level="QueryCoverage =94%, HitCoverage=30%, E-value=2e-48, Identity=69%"; Hit description =Hypothetical protein CBG09639 [Caenorhabditis briggsae]
ITNKLKKKILIAFSLWGLMDDSQKEYFTGWIKWCEIGTQYIPLSFGTQYIPLSFLLGFFVAVVVARWWEQFNWISWPDKFMMCVSTCLPGRENLETRRTLARWTSLQSAIAWTGISVRTLKRFPTERHLVESKLMTEE

SEQ ID NO: 150399 - protein, 110 aa, Heterodera glycines
  Coding regions on vcDNA: vcDNA=SeqID_76822; Strand=-; Position=1 -102,144-371
MDIWSAGITIYEIIFSNYFVIETNSMTINQGDLWPNLANKMTKIGELYRSAKLFENPSAVTQQLFAKLDLPNGNWNPGRKDWWTRYSGVILNILDIWGTHGMPEIACLLG

SEQ ID NO: 150400 - protein, 181 aa, Heterodera glycines
  Coding regions on vcDNA: vcDNA=SeqID_76823; Strand=+; Position=1 -98,300-354,556-948
MHTLIPLPPVALTPAEIILSKILFNMPADGSWKRSIKKCDDQRIWINLSSSDIVPNLAIKGRLPLLFKDIVPNLAIKGRLPLLFKDIVPNLAIKGRLPLLFKDIMPNLAIKGRLPLLFKDIVPNLAIKGRLPLLFKDIMPNLAIKGRLPLLFKDIVPNLAIKSPLSNLLMIFFIFMAKFKF

SEQ ID NO: 150401 - protein, 21 aa, Heterodera glycines
  Coding regions on vcDNA: vcDNA=SeqID_76824; Strand=+; Position=1 -62,727-730
MVKQHQQEQRRKLAMLREVES

SEQ ID NO: 150402 - protein, 106 aa, Heterodera glycines
  Coding regions on vcDNA: vcDNA=SeqID_76825; Strand=+; Position=1-319
MPIANSALYAKMDQCDCAMFADCPLGKTRATPAQRCRHSATPRHTKKRHTVGAAQSTPWTRTEMPQAASSEDIDDANEDDYHDEKSVPSLSCQCRKRQCPECAKHA

SEQ ID NO: 150403 - protein, 231 aa, Heterodera glycines
  Coding regions on vcDNA: vcDNA=SeqID_76826; Strand=-; Position=1-696
MKRTNASNITPPRAKRSMAPAQDLDPNAVALAEQERQRTLVFIGLPESNAIRPSERVQEDREAATKILDHLEVEAQPTAVFRLGRYDPQRTTPRPLKVVMPTTTHQHMALGGWKRERARLRSQQNLARLFVRPALTKEQLKEEYEARVRKRQQNPAPVAPAMQPRQTNVPTPVKENAPNQKEASDDISKPLEVFDQTILVCYEALKSLPPNDKIVHQIQSLEKQYPRLFNK

SEQ ID NO: 150404 - protein, 86 aa, Heterodera glycines
  Coding regions on vcDNA: vcDNA=SeqID_76827; Strand=-; Position=1 -136,201-325
MIITFFQQNGETLPPPPTQFTMVGGVPVALSPAQTAAAAGVQFVPKNDSKYETLASLDANIFVKLTCIGFEPGTPLLVTSTYICIN

SEQ ID NO: 150405 - protein, 305 aa, Heterodera glycines
  Coding regions on vcDNA: vcDNA=SeqID_76828; Strand=-; Position=1 -581,637-715,775-828,884-1089
  Homolog annotation: Hit_ID=AAS52662.1; Match level="QueryCoverage =50%, HitCoverage=36%, E-value=2e-21, Identity=42%"; Hit description =AEL023Cp [Ashbya gossypii ATCC 10895] ref|NP_984838.1| AEL023Cp [Eremothecium gossypii]
QVSSNQMSDEPPPPAAPETPKEPPTQAQEVPPPAAPETTKEAPTQASEVPPPAAPETPKEPPTQASEVPPPAAPETTKEAPTQVQEVPPPAAPETKEAPTQASEVPPPAAPETTKEAPTQAQEVPPPAAPETTKEAPTQAQEVPPPAPTRLQPRSAPINSFKDVRPVLREMLDQLHHPIIDTVERQTGMDREQLFFTVVALLTFYLLFGSYNMFVSNVLVKSYPFYQSVMTIRSQSKTDDTQWLAYWCAFALFSLVDHFIAPFGLYLLLKTAVLVYMLLPQTYGAHNCFVNYVQPMMERFAERRV

SEQ ID NO: 150406 - protein, 102 aa, Heterodera glycines
  Coding regions on vcDNA: vcDNA=SeqID_76829; Strand=+; Position=1 -146,496-658
MRHHQLRTRKNKSEAFVFGLKVGNLIENYEKLSKVFGTRTKKTSDGGALVWTFEQKQCKMAFGRDNDAEIHDVITDLGLQVEGYAEKLKDYENMEDSSMDVA

SEQ ID NO: 150407 - protein, 17 aa, Heterodera glycines
  Coding regions on vcDNA: vcDNA=SeqID_76830; Strand=+; Position=1-53
QKLRVHTIGGDGKNECE

SEQ ID NO: 150408 - protein, 111 aa, Heterodera glycines
  Coding regions on vcDNA: vcDNA=SeqID_76831; Strand=-; Position=1 -82,183-436
MRRALNLNIDYTASDYLAIIQIYNMIKYFNLLIFLRNYSNQPIKAVENHVGEIAAKFDNLKHYFVLLPIANRGIKALFTAKRNVILSKMQCKQTEMASFVKKFKMEQSAKR

SEQ ID NO: 150409 - protein, 39 aa, Heterodera glycines
  Coding regions on vcDNA: vcDNA=SeqID_76832; Strand=+; Position=1 -87,865-897
MEVERRNSSKRLLLGNNQSKTPEALCVVKLDGNGAIYCY

SEQ ID NO: 150410 - protein, 210 aa, Heterodera glycines
  Coding regions on vcDNA: vcDNA=SeqID_76833; Strand=+; Position=1 -97,1079-1354,1405-1666
  Homolog annotation: Hit_ID=AAL78214.1; Match level="QueryCoverage =70%, HitCoverage=75%, E-value=1e-12, Identity=31%"; Hit description =putative esophageal gland cell protein Hgg-20 [Heterodera glycines]
KSDYDYPIPIMAQNPINCDSDYDYDSDSAHPCWICNDVWMDIFPTFDHAQLGLKLALLSPRFNALVDKHFDGKSELTIWRTIEISKCIGTKPKLSVRMDDKFVEFPLPDRPLPSKIRFKHLHIDYIDHSVIAFLRSNHQIFDKRGTNLDLWIPSPHTTDGQRIWDVFVREIWPIFSENIRHLGFTGADHLDNLMVALSEKRWTTQAIALR

SEQ ID NO: 150411 - protein, 287 aa, Heterodera glycines
  Coding regions on vcDNA: vcDNA=SeqID_76834; Strand=-; Position=1 -105,335-423,653-863,1224-1325,1404-1552,1938-2106,2165-2203
  Homolog annotation: Hit_ID=NP_741904.1; Match level="QueryCoverage =96%, HitCoverage=47%, E-value=9e-31, Identity=30%"; Hit description =tweety (XL991) [Caenorhabditis elegans] emb|CAD44123.1| Hypothetical protein F42E11.2c [Caenorhabditis el
SPCHSVRTFTAARSAILLATLLWVDIFFVGLMPLMWVAQCCLAHRSGTPNRTSRTRIGRLSCALFLVSVLCFALMGACLYGNEHVNKSVRESTGALAHVANAFRVAMETVLFKFWGNEVIPGQKVLYLETFTLHFTHKLNESQWHLSRHIDQLTLLIEQKSKDVINQTTMIREADSLLTELSDKVDELKQRLGRTLAILADTQFLEAAKRKGERVELERWLLCLLLPLIMLSVLFAGVIAFCRQSRKGAIIFSGLGLVIFLVTWLLFSAAFPLTVRVFCNRLSDLCI

SEQ ID NO: 150412 - protein, 248 aa, Heterodera glycines
  Coding regions on vcDNA: vcDNA=SeqID_76835; Strand=-; Position=1 -157,210-495,545-848
  Homolog annotation: Hit_ID=NP_001004509.1; Match level="QueryCoverage= 76%, HitCoverage=11%, E-value=9e-10, Identity=27%"; Hit description =si:busm1-180o5.3 [Danio rerio] emb|CAD60788.1| novel protein similar to DNA polymerases [Danio rerio]
MDRVVVRKKAEFAKAPSTNCLPIAIFVTSYARLHLYDYMEQVLRLGHKLLYCDTDSIYYVTNNGRQQVPEGEALGQMKREHCSRRIYEFVSGGPKNYGFRHCDRINGEDERAELKVRSFRLSYSAQQLLNFESMKRIVLAHYNIDGQIDDVLDMEGVHVVPGSNASIRIEFPQIGRTPCSDLYTYDAHKDYQPHYVKGRIRPSMETVPFGFREAQTVQEQAEHHQRQLNDFDDNLLIVNLPGCSNWNQ

SEQ ID NO: 150413 - protein, 518 aa, Heterodera glycines
  Coding regions on vcDNA: vcDNA=SeqID_76836; Strand=-; Position=1-1557
  Homolog annotation: Hit_ID=NP_507780.1; Match level="QueryCoverage =72%, HitCoverage=24%, E-value=9e-29, Identity=28%"; Hit description =predicted CDS, DNA polymerase type B, organellar and viral family member (5T899) [Caenorhabditis elegans]
MRRRRRRRGQQQQQQNNNNDDEDDDDDNDGNEEGDDDHGHDADNEEEEEVGTNRSVRLCFFDAETSQDLPLQLRTKVVQKHVPMLIIAEIICEACINEGISVHSGVGQYANGCVCGPPAGPRGRRWCSPPFLNAPEDDNALPANVHYNPRRLFFHSFDDATNNDPVDDFINFLTGSGPHGVKTICLSHNGGKYDIHLILEALHRRNLPPKRICTTGLKIFSMTLKGNHQRHVIFKDSLNYFFCELDALPRTFGLNAEVATAKPFFPYLFIRRENLHQRLHGLPGKEFYQPDHMKASKRDSFMSWWEVENRSARFQLREQLILYCMNDVAILRESVLQFRQIIAENTRGLDPFKISSTAAGLALATLRRCFLPMNKLVNAPEGGYLRGRRASAESARYIRYYEMTHPGVHVRSAQWSIGEANVEDTGYRLDGLVTREPPQRNLAIEYMGCFYHGKKKVALFNRTKKKCLKVAPSVTLTTDNKNWQVEGQPKTCMNEPRGGYLNCRISMALSWKLSGDAK

SEQ ID NO: 150414 - protein, 237 aa, Heterodera glycines
  Coding regions on vcDNA: vcDNA=SeqID_76837; Strand=+; Position=1 -115,583-930,1570-1808,2286-2297
MNYSDSPSRRASAVANCLPSPSIMELAKSAGLLSLNPSDLVFESSVLGIAYYDFVLSVSEVEYAPAPSAGAEHEQQKNEKSPNKKALAKRRVHETGSAPLNGTPTMGGAGANAAPIQRKRCQTMEKEKGGRSLVAMLQKQRTEMQLVNNKSNNTKSSSLLPSFEKGSMGEIQEKCEIEEAEKNSSNTTRTPSKSPSIERKNNKNNCNNTLYRIFLAKFDAHTNVQWFESVLVPRRYF

SEQ ID NO: 150415 - protein, 26 aa, Heterodera glycines
  Coding regions on vcDNA: vcDNA=SeqID_76838; Strand=-; Position=1 -41,183-222
MNYYVNGKHRHSNGEDTRGPELGFQY

SEQ ID NO: 150416 - protein, 100 aa, Heterodera glycines
  Coding regions on vcDNA: vcDNA=SeqID_76839; Strand=-; Position=1-303
MPKNQKSKRFSKKSSSASAALSSPPALLDISALPNPVYEDISSPEGSVITGAVVANTIVSTIEPNLDNAVLTTLSPEDVDRIFADDPGMAEEVGRTDRGS

SEQ ID NO: 150417 - protein, 85 aa, Heterodera glycines
  Coding regions on vcDNA: vcDNA=SeqID_76840; Strand=-; Position=1-258
MGPPCTSPKTPNDEQIVPEKLAVDDEEEVQSNEPSEADNSNQESSESTVTNRQNVTNQTVADISGDKRYSLRNRLAITKPKRFTE

SEQ ID NO: 150418 - protein, 46 aa, Heterodera glycines
  Coding regions on vcDNA: vcDNA=SeqID_76841; Strand=+; Position=1 -91,1006-1055
MFIRNMIFIDHLMSRLLKIITIDGNFTSYRATRILEMYKNKENNKR

SEQ ID NO: 150419 - protein, 62 aa, Heterodera glycines
  Coding regions on vcDNA: vcDNA=SeqID_76842; Strand=-; Position=1 -125,1629-1692
MEYVLKLRGLTLNYDVINNQGFRYKNSKSNVMLKQERLNQLMEENSLIKNKNTNTWKITVRE

SEQ ID NO: 150420 - protein, 68 aa, Heterodera glycines
  Coding regions on vcDNA: vcDNA=SeqID_76843; Strand=-; Position=1 -114,239-331
MAEQSAFQSKLMLLRLKKVTHLPIDTDIKGNGEKEAEFPLTDFTSIMMYSILENIWDNRSIDVMAIED

SEQ ID NO: 150421 - protein, 63 aa, Heterodera glycines; identical to SEQ ID NO: 130392
  Coding regions on vcDNA: vcDNA=SeqID_76844; Strand=+; Position=1 -97,316-410

SEQ ID NO: 150422 - protein, 27 aa, Heterodera glycines
  Coding regions on vcDNA: vcDNA=SeqID_76845; Strand=-; Position=1 -58,784-809
MSWRETFCLCLLGDHENEKKKSEWKMD

SEQ ID NO: 150423 - protein, 188 aa, Heterodera glycines
  Coding regions on vcDNA: vcDNA=SeqID_76846; Strand=+; Position=1 -153,682-776,842-1032,1150-1277
IHLTDGGGGFKEAQLHTLAQCHANNGPKQTANKPYGIEFRLPREGEICDDGYNLSAGQHKFSVLFALNQTAVPFTRFSSVKNDFDGSAMQNDFLRSNGPSFLSDYADLWLLGLDMLPMAHQTEQQREQLKMKLFISRSSKCSMEAWLFRSNLIPLKFVQASHSLVPSDPKMQFNGSLCKPNPTEDVYE

SEQ ID NO: 150424 - protein, 52 aa, Heterodera glycines
  Coding regions on vcDNA: vcDNA=SeqID_76847; Strand=-; Position=1 -61,486-583
MVHIKSIMKKEIVLAIEKVISAHHPYPCYDEVRKVQVIKLKANDYLKKLKAK

SEQ ID NO: 150425 - protein, 101 aa, Heterodera glycines
  Coding regions on vcDNA: vcDNA=SeqID_76848; Strand=+; Position=1 -298,468-475
MMTLLEQLPGGGVVTATESPHQIGHLHHHHQQPQQQLKAQSASSNGPSNNSAAGSGHGQSPGGGILLSATSTPDGTLMPAGTTDHQTAGGHQNVAHMGAGP

SEQ ID NO: 150426 - protein, 91 aa, Heterodera glycines
  Coding regions on vcDNA: vcDNA=SeqID_76849; Strand=+; Position=1 -84,660-851
MCSPGSSSNSATSSSLYNNNNQQHQQQQNFALSITNNQQHHNNNMEQHQHHQQHNHGNSRPSAGGGGGGHHHNHTREKKNNQEERVKRPMK

SEQ ID NO: 150427 - protein, 106 aa, Heterodera glycines
  Coding regions on vcDNA: vcDNA=SeqID_76850; Strand=+; Position=1 -138,572-754
  Homolog annotation: Hit_ID=NP_005625.2; Match level="QueryCoverage =82%, HitCoverage=22%, E-value=5e-15, Identity=47%"; Hit description =SRY (sex determining region Y)-box 3 [Homo sapiens] gb|AAF73059.1| sex determining region Y box 3 [Homo s
MAVENPKMHNSEISKRLGEEWKKLEELEKRPFIDEAKRLRNEHMQVNFKTGNFTGPSGLQIQAQTEGQAATAPTAAQQPSPAAQQQQSSCQEKWCQQSATPKSSSS

SEQ ID NO: 150428 - protein, 104 aa, Heterodera glycines
  Coding regions on vcDNA: vcDNA=SeqID_76851; Strand=-; Position=1 -93,148-369
MSEYGKNCIQIICNTCTPVLASFPSKDATKKVIKRLRRDENAPRVEPLNLEQLEIPNTYRVYKRTEIDEEQFLLADTGVFQIHGQNGPQPKISFKPLNDGHLHY

SEQ ID NO: 150429 - protein, 94 aa, Heterodera glycines
  Coding regions on vcDNA: vcDNA=SeqID_76852; Strand=-; Position=1-282
MNYMKAKAPIRIHRLHLITMRIINTFRIENAPTSFYHQKEMITNCQEVMNESNQNFSIRKCGEYMREQLREDSGAPMKTKLTAKVMKKRKTDAK

SEQ ID NO: 150430 - protein, 136 aa, Heterodera glycines
  Coding regions on vcDNA: vcDNA=SeqID_76853; Strand=-; Position=1-411
MTPLNSFIFITIFAPFSGIFLFGQSPGCDQNTFVSNLASILHCMGVRYPILVHMENSTRAKLDLNALKKMKCDWPTQPLDGYLLHCARDNGIPLLDGRNLDMKRIIAMRDIKELTESHGILMCTLEPLRRQGLKRE

SEQ ID NO: 150431 - protein, 283 aa, Heterodera glycines
  misc_feature (111)..(111): Xaa can be any naturally occurring amino acid
  misc_feature (115)..(115): Xaa can be any naturally occurring amino acid
  Coding regions on vcDNA: vcDNA=SeqID_76854; Strand=-; Position=1 -501,542-852
  Homolog annotation: Hit_ID=CAE73973.1; Match level="QueryCoverage =98%, HitCoverage=32%, E-value=6e-48, Identity=49%"; Hit description =Hypothetical protein CBG21601 [Caenorhabditis briggsae]
VCAASVALTGRRKSAPQMSAPQMSAPQVSAPQMSAPHMSAPQMSAPQMSAPHMSAPQMSAPQMSAPQMSAPHMSAPQMSAPQMSAPQMSAPQMSAPQMSAPQVSAPQVSLXLAPXMSATQMSAPQMSAPHMSAPQMSAPQMSAPQMSAPQMSAPQMSAPQVSAPQVSAPQMSAPHMSAPQSAPQMSAPHMSAPQMSAPQMSAPQMSAPQVSAPQMSAPHMSAPQMSKPQMSAPHMSAPQMSAPQMSALQMSAQMSAPHMSAPQMSAPQMSALQMSAPQMSAPP

SEQ ID NO: 150432 - protein, 106 aa, Heterodera glycines
  Coding regions on vcDNA: vcDNA=SeqID_76855; Strand=+; Position=1 -26,247-541
MYNRRMRKIWICNDVWVDIFPFFDRPQLGLKLAMLSPRFDALVDKYFDNKKELTIWKSITICKDMNTDEPVLDIISKAMPWPLPLPERPLPKNIRINYLQIKYLLI

SEQ ID NO: 150433 - protein, 84 aa, Heterodera glycines
  Coding regions on vcDNA: vcDNA=SeqID_76856; Strand=-; Position=1-252
MDTGGERSSKHLMPNGEDNEQQQQQKMPKVVEVEKFPAAVDSSPSVAADNLVEGQNDHQQQDNNEHLDRVIITDTMNELVEVMD

SEQ ID NO: 150434 - protein, 117 aa, Heterodera glycines
  Coding regions on vcDNA: vcDNA=SeqID_76857; Strand=-; Position=1 -84,418-687
MPKRCKKKDGTLREAQSAKVEQSLRELKQMLSDLCKSDRRLRRKLRAAAQRQQNHHSSSSSSANSDNEFLDEEEVGSEEEEEANGYENNGEMRGGSEEDEGREEQTDEEEEEEEHAK

SEQ ID NO: 150435 - protein, 78 aa, Heterodera glycines
  Coding regions on vcDNA: vcDNA=SeqID_76858; Strand=-; Position=1 -195,263-304
MNETTTIPGVHNRKFANQKRRTPNTTEDEERRKKERKRKGRKRRDTSEDSEEEDEEWHESGRREEEVLFWVFGFSSSG

SEQ ID NO: 150436 - protein, 90 aa, Heterodera glycines
  Coding regions on vcDNA: vcDNA=SeqID_76859; Strand=-; Position=1 -195,351-438
MEVVPGRCCHFSLFCLALPERLLTDAFQFVRRRYPAATAGGRGPTDASVDDGDEPTAAAEGTCPSPSPTPSRRIHANTGHAQPTAAATTG

SEQ ID NO: 150437 - protein, 69 aa, Heterodera glycines
  Coding regions on vcDNA: vcDNA=SeqID_76860; Strand=-; Position=1 -18,143-334
MRFILLSKDPSNSRNSGRDHNFFEGLYFEGEIPRGFVLLLIWKILKAEEKSLVLQLVFGNLWINNQNFL

SEQ ID NO: 150438 - protein, 26 aa, Heterodera glycines
  Coding regions on vcDNA: vcDNA=SeqID_76861; Strand=+; Position=1 -39,166-207
MISTEIELPMPQRCILGCPDHDEGVI

SEQ ID NO: 150439 - protein, 160 aa, Heterodera glycines
  Coding regions on vcDNA: vcDNA=SeqID_76862; Strand=+; Position=1 -95,934-1321
MRPARNIKVLFCRTTLQKPISNVSMLFTRKFLEITVTLDKKDIANKRAVPPKSVVSASDDLSNSDKRVKKPKAAERVAKDDYDEKDDLGEEVLCPDKCVRKEDVEEKIDEGQRHFGTFTLPGVLLQRKCRAFFALEEPTGKFLKVQLKVEHKWADTSRGN

SEQ ID NO: 150440 - protein, 395 aa, Heterodera glycines
  Coding regions on vcDNA: vcDNA=SeqID_76863; Strand=-; Position=1 -160,238-395,512-838,887-1198,1399-1629
  Homolog annotation: Hit_ID=NP_508033.2; Match level="QueryCoverage =95%, HitCoverage=9%, E-value=2e-24, Identity=26%"; Hit description =putative protein, with at least 9 transmembrane domains, 2 coiled coil-4 domains, of bilaterial origin (5V
MPKIALGTRADSGESERQSSPDTPLGICLDPHEANYLDVAVLRCLLIRNWAEEGTFWAVQYLLGRLIAMRQHRCTHEGTFRSRFNSDSATIPTRKTSKTEAATIDTKGYLTWADLQEHNGATFSGGTKRTDKMQPKDTREERTDEAVAGRTGKGVAFERDEMQLQQRSKSDGKQQQRERQQTLGAERTAERRRRISLSAMPSDGVAMLPGTTSGSMPRPSISSPRRMQRASSIPASFPRLTELLQGFASTCNSPAMQQRRRHEQIAPEKTESKRKNSHFFTEAIGAASFIEPNGHLSFPIVLKVLGTLMERCCVVRVSEVVLTGCDTFLNMPGSDAAELFPKVLHIVLRISLQLGCSNGCNEGVHTPQAEFLRIKVRNLIAQMHRTKSVFGDKMA

SEQ ID NO: 150441 - protein, 270 aa, Heterodera glycines
  misc_feature (116)..(116): Xaa can be any naturally occurring amino acid
  Coding regions on vcDNA: vcDNA=SeqID_76864; Strand=-; Position=1 -22,70-189,250-423,786-979,1034-1118,1209-1270,1461-1503
  Homolog annotation: Hit_ID=CAE61629.1; Match level="QueryCoverage =96%, HitCoverage=7%, E-value=4e-57, Identity=45%"; Hit description =Hypothetical protein CBG05555 [Caenorhabditis briggsae]
LQDASCMTFERVIVQNILHTFERVIVQNILHGISPSLSDAIGSVSRWSLVRAAFPHIVQCCAALLTERCAECCAALLTERCAEEEDVPMSGSLVKSLYILHWLLIDAAAECNENKXVKLTQSKILITFHVSSVQLFVYLLAPLFDIVREDEIKGHYRLESGVRLWQCLWQSRLPELICFCAPVKQRRSQMPQMNILRLLGILRLLGFSTAAEQGIYIGDNKPSASLSSLIPPPKPPLIPPPKPPRTDAKVLKELEEEEEEEEPLSPDFLP

SEQ ID NO: 150442 - protein, 196 aa, Heterodera glycines
  Coding regions on vcDNA: vcDNA=SeqID_76865; Strand=+; Position=1 -206,1237-1621
MSPNDMSRTNYAVVSRCRIGKTSAVHNQIGAFNSGINILSVNLVPYSVNDHPAVLALASLCPIFWSMTRGVAQYCAHLAKNVAQYCAHLAKNVAQYCAHLAKNVAQHYLHLSSGVAQHCAHLAKNVAQHYLHLSSGVAQHCVHLAMAATKGLYRIVMLESLDVIWPRLDSWKRSPAWFLGSRSEARGQFLNREKFS

SEQ ID NO: 150443 - protein, 114 aa, Heterodera glycines
  Coding regions on vcDNA: vcDNA=SeqID_76866; Strand=-; Position=1 -222,371-493
  Homolog annotation: Hit_ID=NP_492550.1; Match level="QueryCoverage =76%, HitCoverage=36%, E-value=1e-15, Identity=46%"; Hit description =putative protein, with 2 coiled coil-4 domains (1K190) [Caenorhabditis elegans] emb|CAB03171.1| Hypotheti
MEPSLLRYFCPRQFRRLATTSFCTLSPRHRIIAEGGMPPLEYEFEREKWAMGERFGRYGLRGGVDISKLWPTVEEIEEVKAVRRFRTAKEAQHIAKMESVLELKKSKITSISKQ

SEQ ID NO: 150444 - protein, 285 aa, Heterodera glycines
  Coding regions on vcDNA: vcDNA=SeqID_76867; Strand=-; Position=1 -95,191-280,522-611,814-931,1818-1988,2104-2223,2485-2631,2749-2775
  Homolog annotation: Hit_ID=XP_395280.1; Match level="QueryCoverage =93%, HitCoverage=60%, E-value=1e-64, Identity=46%"; Hit description =similar to ENSANGP00000011712 [Apis mellifera]
MALYVALAGIQPSWCLPVQIDVGTDNQSLLNDPFYIGLRRNRVRGEEYDQLIDNFMNACRKKYGQNVLVQFEDFGNKNAYRLLERYQDEYCMFNDDIQGTASVVVAGLLACTRVTKLRMRDTKYVFFGAGGGTALFASGSPFKNVELGGKVYKPGQGNNAYIFPGIALGVILFKVSTIDNKLFLMAARMVAESVTEKSLADGRVFPRLKEIREISIRIAMRVAEECYRDGTAKLYPEPTDKEMFIRSQIYSVEYGELINETYDWPSHDMKHGFPVPVVRRDSMDD

SEQ ID NO: 150445 - protein, 131 aa, Heterodera glycines
  Coding regions on vcDNA: vcDNA=SeqID_76868; Strand=-; Position=1 -111,340-498,754-818,875-934
  Homolog annotation: Hit_ID=NP_496968.1; Match level="QueryCoverage =96%, HitCoverage=20%, E-value=7e-57, Identity=80%"; Hit description =malic enzyme nadp-dependent (2O518) [Caenorhabditis elegans] emb|CAB54452.1| Hypothetical protein Y48B6A.
MLGLDPEQLRLYKLYRPERLTPSVRGVDLLKNPGLNKGMAFTLYERQYLGVHGLLPPAFMTSEQQEYRVITKLRKQPDDLARYIQLDGLQDRNEKLFYRVLCENLKELMPIVYTPTVGLACQKYGLIYRNP

SEQ ID NO: 150446 - protein, 105 aa, Heterodera glycines
  Coding regions on vcDNA: vcDNA=SeqID_76869; Strand=-; Position=1 -87,249-339,712-752,964-1061
MDNDANILETEFCRSVIRSCAKLAYEHAQDIIDNPKKQFAIAEMPPIHCDRKIRDIKQGAQRCQLSGGRVHVAVDKCALLGIKINSISSKTLADSLKVYEHREEY

SEQ ID NO: 150447 - protein, 249 aa, Heterodera glycines
  Coding regions on vcDNA: vcDNA=SeqID_76870; Strand=+; Position=1-752
  Homolog annotation: Hit_ID=CAD26968.1; Match level="QueryCoverage =94%, HitCoverage=69%, E-value=1e-56, Identity=43%"; Hit description =transposase [Meloidogyne chitwoodi]
EFGVHQTTVLNYLHQLGFINKKGAEVPHALTQQQKHQRVVTCTELLARLSAGMQLSQLITCDEKWVYLNNKTAQKQWLKPNELGEPTPRRLQHAPKVLLCVWWCSSGLARYELVPAGQTINADIYQQQLQRVHDQIRRPPFSAKFRGGVFLLHDNARPHVAFSTQQKIEQLRWAVLPHPPYSPDISPCDYYLFRSMEHFLRGKEFADQNEVENALDDFFGSKNDQFYKKGIEICPNDGGGSLIKMYIID

SEQ ID NO: 150448 - protein, 317 aa, Heterodera glycines
  Coding regions on vcDNA: vcDNA=SeqID_76871; Strand=+; Position=1 -52,389-532,586-695,1201-1339,1387-1895
MSCNSKPSAECLADRMKPAWEVINSSNPIVVSDVEVVPFKIMLSYIYTDQSHGINGDNAIAVLHAAKKYRVNGLVKLCTNVTISELSDVFFALAQAKLLEDEALLWADEKCRQNGIDCSGDNRRAVLGPALFQIRFPLIPKEDFSEQIVPSGVLTNDEMFAVLLYHSSREIATECQAPSELKFATIRRNYICKRTFLVKIEQFSALPRASDKNYEPIDSAVVDIKGIRWQLDYSFFLFQVNKKSGYFRLSLTCNQNEKGNTQLRNLKVINCAITNTIKLPIGSAIVGQSHEQWHNKKRAKNALSGREMTFFVAAGQT

SEQ ID NO: 150449 - protein, 70 aa, Heterodera glycines
  Coding regions on vcDNA: vcDNA=SeqID_76872; Strand=-; Position=1 -30,432-523,619-706
  Homolog annotation: Hit_ID=NP_492020.1; Match level="QueryCoverage =98%, HitCoverage=7%, E-value=1e-25, Identity=73%"; Hit description =tissue factor pathway inhibitor precursor family member (100.0 kD) (1H712) [Caenorhabditis elegans] emb|CA
NAPHSMAQLYCPPQLVPVPGEGAIPYRYCSPSAPINDGIQGCGINRHCQYSTTLERYICYGLESNVRLPN

SEQ ID NO: 150450 - protein, 98 aa, Heterodera glycines
  Coding regions on vcDNA: vcDNA=SeqID_76873; Strand=+; Position=1 -68,133-361
MSTEISNSKLVLMILMTHLPTFHDQRHKQSSDAFAGDHFVGQCRRLSDQSERLSVGLLLPATARLLCPRLAIHFHFRLSAEHLLSRQRTDSFCEQVEN

SEQ ID NO: 150451 - protein, 21 aa, Heterodera glycines
  Coding regions on vcDNA: vcDNA=SeqID_76874; Strand=+; Position=1 -3,305-367
MKKKGWPAETRGVSEPNFVGG

SEQ ID NO: 150452 - protein, 47 aa, Heterodera glycines
  Coding regions on vcDNA: vcDNA=SeqID_76875; Strand=+; Position=1 -28,409-524
MPLEKKKKRGAKKCLHQRMARQIFGGHGKGVGTEANSAAKSIDRAKV

SEQ ID NO: 150453 - protein, 90 aa, Heterodera glycines
  Coding regions on vcDNA: vcDNA=SeqID_76876; Strand=-; Position=1 -71,1431-1632
MGNGIGRNEKNGFKVGRYGMFGVRTYFICELCDQKWICRENGFTDRLYPCVCVTRVRHLVDAPLGVLSEQQTCALVHQQRGDRTELTLFE

SEQ ID NO: 150454 - protein, 303 aa, Heterodera glycines
  misc_feature (93)..(93): Xaa can be any naturally occurring amino acid
  misc_feature (123)..(123): Xaa can be any naturally occurring amino acid
  misc_feature (131)..(131): Xaa can be any naturally occurring amino acid
  Coding regions on vcDNA: vcDNA=SeqID_76877; Strand=+; Position=1 -128,292-669,723-792,836-1095
  Homolog annotation: Hit_ID=NP_499471.1; Match level="QueryCoverage =92%, HitCoverage=91%, E-value=3e-38, Identity=38%"; Hit description =nematode-specific EB region containing protein (26.0 kD) (3M517) [Caenorhabditis elegans] emb|CAA21043.2|
LPPPLIISSFARLSSLHFPINWASSAIAFLCSFPSLFPPTVCVSTRTALVLSLSMPPPPSRTYRTPNIPYLPTLNPFFSFLPIPFPIFRIPAXAPPAPLRIHFPLLFSYGPCAPAHGPVGWYXKCLVVCLXSAPPIAALPPPPLAPVPPPPPAPAGRLIPQALPGAPCEPGVECTGGSALPGAPCEPGVECTGGSVCSMGICLCPPELVQEGTVCVSRTIYLCPPELVQEGTVCVSRTIYGVVPPPGGPPPLPAAPAYAPPPPAPVVQFAPAPCVPAFPMAAAPPPLPACPPPFRAACVARRS

SEQ ID NO: 150455 - protein, 193 aa, Heterodera glycines
  Coding regions on vcDNA: vcDNA=SeqID_76878; Strand=+; Position=1 -107,171-646
  Homolog annotation: Hit_ID=C88618; Match level="QueryCoverage=96%, HitCoverage=25%, E-value=2e-38, Identity=41%"; Hit description =protein ZK520.4 [imported] - Caenorhabditis elegans
TLPKIEQLCSELLVNEQLEKISLMSREVVQREMMHDLQNMYILLKPLSNALPVLMQEFEIYIQKSGMNCMEMTINEPAEFVSNIQLLHEKFTQMISTIFNGDNEFVAGLERAIQSVVNHRDDPKQPPKISEKLNRYIDSLMRTNSKRGKSEQELDALLSKAILIFRFIDDKDLFQKFYSKMLSNRLVFEIKLP

SEQ ID NO: 150456 - protein, 69 aa, Heterodera glycines
  Coding regions on vcDNA: vcDNA=SeqID_76879; Strand=-; Position=1 -152,789-846
MTRKSKNMLIFMDLVLLHFLTFCHGFGSARPVVNYFDFFPNNKYYSPSIFWLLLNFLNFLCLMIISLIF

SEQ ID NO: 150457 - protein, 150 aa, Heterodera glycines
  Coding regions on vcDNA: vcDNA=SeqID_76880; Strand=+; Position=1 -97,1262-1304,1357-1418,1464-1560,1608-1762
SQKHHRSSSMFDQKCSLTSNANGLPNSHKKINPILRHWSLVLPLIMFMRKTHWSPAKRRCIDAKFFESNNRGEWNFNGNHARRLLCGRGNFKLENMFKRFFSIAPQFHRAQSDCEALLQVCLSYGMDFVKFVDRNCSSFPDCFYTSSKKT

SEQ ID NO: 150458 - protein, 131 aa, Heterodera glycines
  Coding regions on vcDNA: vcDNA=SeqID_76881; Strand=-; Position=1-396
MNNFGQQISQNPCRRRGKLATEPHSPIVLDEIAGQWRKTKQILGAIRLKNQRSHPLEHVLQFEIATSAQQPPGMVTIEIPFTAIVAPKRKQSISECLNFHGLKKFGVNAAAFGRRPMRFAHELYRVNIATE

SEQ ID NO: 150459 - protein, 270 aa, Heterodera glycines
  Coding regions on vcDNA: vcDNA=SeqID_76882; Strand=+; Position=1 -244,275-634,681-889
  Homolog annotation: Hit_ID=CAE71936.1; Match level="QueryCoverage =55%, HitCoverage=38%, E-value=2e-13, Identity=32%"; Hit description =Hypothetical protein CBG19000 [Caenorhabditis briggsae]
MPTDGNRFPKITEMAYMSVPRVLFLEGTEQMSARHLSSMSQDGEESIEPVQVVTNVHVRQLNPQLNDKERFKYEELQRKVPTVCCPGVLLKQSDLTCKCTFAQEWPGVVHLLQTVPKPACLVAHNGLNFDFRILCHELRKSDLFRTHPIPEQVTLKIDWVFWLQLLFNQVYFLDTLSCFYELEKEYNREIELTMENVDWTLVLSQFQPNSETVVATAEIEETVQQNGTASEGTQNSNGHKSTTVLHRLFDQKCSLTSNANGLPNSHKKIK

SEQ ID NO: 150460 - protein, 72 aa, Heterodera glycines
  Coding regions on vcDNA: vcDNA=SeqID_76883; Strand=-; Position=1 -153,213-278
MLNRLSLDDDFTLRLDDIYTVGVVHFKNLFPSNPSPQVITARRIVERSKAISTPTVAQDLASTKKIQQVGIA

SEQ ID NO: 150461 - protein, 65 aa, Heterodera glycines
  Coding regions on vcDNA: vcDNA=SeqID_76884; Strand=-; Position=1 -41,487-643
MSEQHMAIGIYEAWKSYRDPNAIVLMVSNKFSRWHEFIQIDLLIEEISKKKIKIIYLSLFECAEK

SEQ ID NO: 150462 - protein, 71 aa, Heterodera glycines
  Coding regions on vcDNA: vcDNA=SeqID_76885; Strand=-; Position=1-360
KKNKIIIYRVGELNFRRRKKYGRHNHQATDAHIGFTFFENDIEKAKRKSFISRPEASFSKNKKKFIIQRGG

SEQ ID NO: 150463 - protein, 204 aa, Heterodera glycines
  Coding regions on vcDNA: vcDNA=SeqID_76886; Strand=-; Position=1 -127,282-354,437-530,575-637,702-822
  Homolog annotation: Hit_ID=CAE68730.1; Match level="QueryCoverage =94%, HitCoverage=48%, E-value=7e-54, Identity=59%"; Hit description =Hypothetical protein CBG14656 [Caenorhabditis briggsae]
PPPPFAADFDDTSSMVCQWMFWLLSWLLLLFTFPVSVCFCIKIVKEYERAVIFRLGRLIGGGAKGPGLFWVLFWVMPCIESFVRVDLRTVSFSVPPQEILTRDSVTVSVDAVVYYRILNADSVTVSVDAVVYYRILNATISVANVENAHHSTRLLAQVANVENAHHSTRLLAQTTMRNMLGMRTLSEILSDRDAIALNLTQIIK

SEQ ID NO: 150464 - protein, 76 aa, Heterodera glycines
  Coding regions on vcDNA: vcDNA=SeqID_76887; Strand=+; Position=1 -68,256-419
MNENRERFYEPGMTQADVAKAAGEEWRRLPESEKAKWGQRSAEERGRQGGQGERRKGHGFGMIKTVPFSDVEEEEQ

SEQ ID NO: 150465 - protein, 42 aa, Heterodera glycines
  Coding regions on vcDNA: vcDNA=SeqID_76888; Strand=-; Position=1-129
PPLKEAPETDWSCHLCVKEFGAEASIAKATKSTEDGTSSPAK

SEQ ID NO: 150466 - protein, 309 aa, Heterodera glycines
  Coding regions on vcDNA: vcDNA=SeqID_76889; Strand=-; Position=1 -23,240-356,460-541,710-1074,1451-1793
  Homolog annotation: Hit_ID=NP_492722.1; Match level="QueryCoverage =79%, HitCoverage=57%, E-value=2e-15, Identity=32%"; Hit description =homocysteine-inducible endoplasmic reticulum stress-inducible ubiquitin-like domain member 1 (1K977) [Cae
MPEFQLHGGGGQPNSSSNVPLQQQYFATFHPPQQQSYEAWMSAYQNYMNQMAAAQFYQQQPYTSAAHMAQQQQQAYAFFGGQMPPTVQHHHHQQLFATPMVPPPPHFGQAQQNHNNMMMMAVPHQQHQHQQQQQRADEAPAMVQQQQQQQRMVGGGGVGEAAAAAGAGADLLDIVYKSVRFALLAMVLYVYASLERFFLVLAVVAFFWFVHRRRNQQQQRDNAAAAHENGAIANVLPPQHALPQQNQRPNDNNTEADGPPAATEAEDTTSTASASVPHQPSAWNVFFTVVQSFFTSLVPNPMPAPLDIN

SEQ ID NO: 150467 - protein, 63 aa, Heterodera glycines
  Coding regions on vcDNA: vcDNA=SeqID_76890; Strand=-; Position=1-486
VDQRNVGKGDGVRPFGRRVKHRHGIIGGFLYIRQNGSIIVIFRCGNYTFFAFLRIKQFPLINR

SEQ ID NO: 150468 - protein, 80 aa, Heterodera glycines
  Coding regions on vcDNA: vcDNA=SeqID_76891; Strand=-; Position=1 -62,665-845
MIHRFVQEKCNNSIKGVQQNFVLQLKTHLAEECVTKPDPSRQRLIYAGRCLDNEQKVREVLAQRRDGIVRNEVAEKQVTH

SEQ ID NO: 150469 - protein, 61 aa, Heterodera glycines
  Coding regions on vcDNA: vcDNA=SeqID_76892; Strand=-; Position=1 -171,532-546
MPWHFGTWHTHSDNSYPAFINIVGHVLIVEGICATVYVDIYVRCNSWAFTVIWLAIMKLPI

SEQ ID NO: 150470 - protein, 84 aa, Heterodera glycines
  Coding regions on vcDNA: vcDNA=SeqID_76893; Strand=-; Position=1 -78,279-455
  Homolog annotation: Hit_ID=CAE67381.1; Match level="QueryCoverage =75%, HitCoverage=14%, E-value=6e-14, Identity=57%"; Hit description =Hypothetical protein CBG12864 [Caenorhabditis briggsae]
MFTVIFAEGLFGGASYVNTFDRIHKTAPKELREFSLSIVAASDSFGVTIAGFSAILLHNHICMLYGTHLYIENNTTYGKRDYRK

SEQ ID NO: 150471 - protein, 173 aa, Heterodera glycines
  Coding regions on vcDNA: vcDNA=SeqID_76894; Strand=+; Position=1 -141,312-692
  Homolog annotation: Hit_ID=XP_395043.1; Match level="QueryCoverage =58%, HitCoverage=17%, E-value=4e-19, Identity=49%"; Hit description =similar to Ubiquitin specific protease 14 [Apis mellifera]
MLSLNFCEKQNWQMQGLQQREFKPSEFLPNTFSDDIGSNNSGFYELKFGVSFYFDWSIQLSDSTNITRFIFKCLITHQGRSSNSGHYVAWVRVGDDDQKPNTTKWVVCDDNNISPVSEEEILKLSGGGDWHCNDMELIAFSHSHTLRCLCSYLRTQKDSEALRAERRVKFDVD

SEQ ID NO: 150472 - protein, 316 aa, Heterodera glycines
  Coding regions on vcDNA: vcDNA=SeqID_76895; Strand=+; Position=1 -144,212-413,457-532,617-800,850-1005,1050-1181,1220-1274
  Homolog annotation: Hit_ID=NP_500239.1; Match level="QueryCoverage =72%, HitCoverage=40%, E-value=6e-11, Identity=27%"; Hit description =resistance to Inhibitors of Cholinesterase RIC-8, synembryn, interacts with GOA-1 to regulate centrosome
MTQKELTAELIEQWGREPNAHQKLLFLNEMTQSFPNGTFPLIGIDRKKLFLSHLFDTWALASEQIRLQQLHFLRIILRDKNTVDLDCYISILTLLSRLAKLSADYFEECKSEPIEIVLESEKCLINLLFNSAKARDFFCTQKKPFDRLMSRIRSVIAVFDGSNSLFVGFDYLSEWSFVQVEELLLYDLKIAFITTALVQQLRNECVNDTDKTVVFLSVIICSLDKMSPPMATKCVNEALNTLFNVYHDSKVFELETAKKCADECARIVKSAHLDLGTKQNAVNLLSVLTSALPSLCPKVDTKGAYEGFAAKDGYDI

SEQ ID NO: 150473 - protein, 125 aa, Heterodera glycines
  Coding regions on vcDNA: vcDNA=SeqID_76896; Strand=+; Position=1 -102,190-285,336-425
  Homolog annotation: Hit_ID=NP_505381.1; Match level="QueryCoverage =76%, HitCoverage=26%, E-value=1e-25, Identity=63%"; Hit description =rhodopsin-like GPCR superfamily (5J675) [Caenorhabditis elegans] pir||B89153 protein C24B5.1 [imported] -
LTRSLLVVTTVFIVLNLPNYVYRISIQFFVISEQSSFQINLSFSSFQINLSFAAHVLLYTHHAILFYIYIFNSPQMRKRLIPTALKLLECYCLKPMRKRLIPTALKLLECYCLKPRHLNDFSDNL

SEQ ID NO: 150474 - protein, 103 aa, Heterodera glycines
  Coding regions on vcDNA: vcDNA=SeqID_76897; Strand=-; Position=1 -103,357-472,515-608
  Homolog annotation: Hit_ID=XP_315051.1; Match level="QueryCoverage =95%, HitCoverage=30%, E-value=4e-11, Identity=28%"; Hit description =ENSANGP00000010862 [Anopheles gambiae]
KSLESEPKLIELLQKFCKSQFGVCLDILHELRDQMESELVTLIERGQLKAKIDSYNKVLHAKFSDNRTDTYDRIMALRKQFDHRINAILLRAAILNHRIYEQK

SEQ ID NO: 150475 - protein, 194 aa, Heterodera glycines
  Coding regions on vcDNA: vcDNA=SeqID_76898; Strand=-; Position=1 -296,921-1209
MLKRQLKLMLVFCCLSACLGMIRKSPPWATGKSNATVPDDENTVATPSKKVKKPEQIKPSFSKVPVEVKIRVNIFCNEPIHVYVAAGDYGKTKQKHTVGRHDIDKTLDASDETKAQPFKDNGRLFVTPEKMEKIFFEMCERFWSSENYHEQKANCLDFVFNFVNTLCEGNAPKKTVNLRKGTDISSTGTACQCK

SEQ ID NO: 150476 - protein, 26 aa, Heterodera glycines
  Coding regions on vcDNA: vcDNA=SeqID_76899; Strand=+; Position=1-78
MTNSMQANTIKCWTPTYLSRHKDVKF

SEQ ID NO: 150477 - protein, 69 aa, Heterodera glycines
  Coding regions on vcDNA: vcDNA=SeqID_76900; Strand=+; Position=1-208
  Homolog annotation: Hit_ID=CAE61809.1; Match level="QueryCoverage =100%, HitCoverage=75%, E-value=2e-13, Identity=44%"; Hit description= Hypothetical protein CBG05776 [Caenorhabditis briggsae]
MSRIALLVLLVALFCACALVDHASAQYWGGRGGWGGRGGGWGGNRWGGGWGGNRWGGGWGGRGGGWGGR

SEQ ID NO: 150478 - protein, 40 aa, Heterodera glycines
  Coding regions on vcDNA: vcDNA=SeqID_76901; Strand=-; Position=1 -115,495-502
MFPHTLLAIVLLSVSLKCSVAQWSMMGTNPMIGMGGWGES

SEQ ID NO: 150479 - protein, 326 aa, Heterodera glycines
  Coding regions on vcDNA: vcDNA=SeqID_76902; Strand=+; Position=1 -163,754-891,1085-1287,1332-1613,1871-2065
MSPRLFVLQRHPSATVPMREGAGSVPGRRVHRREFRLRRVPTGGKQKVDRQMRRVRPFAAILALRPNVAVSKICRQKHLSEGPNVWTDRQSHRSTVKSLKIHPTLSLFRSSLGPCRFCPQLSSSIVGTEIEAKKQQRTDIYPLERLLPDNFNPFEGQGVRHRRCVEGERIVNRHDCARFMECVDGDWFSLSCPLGHYFSLENETSKFNEIENPGPLIQGCLLASSSNSSSAAIPMCNELLTVAEKATSITTELKDTNSKSDSAGAFSFCDANAAKRLPNAYDCTRFRECALTGADIRGKAMRTRHTIRPDIWAVHFQVTKCQSEFE

SEQ ID NO: 150480 - protein, 287 aa, Heterodera glycines
  Coding regions on vcDNA: vcDNA=SeqID_76903; Strand=+; Position=1-864
  Homolog annotation: Hit_ID=XP_318162.1; Match level="QueryCoverage =97%, HitCoverage=35%, E-value=5e-54, Identity=39%"; Hit description =ENSANGP00000020700 [Anopheles gambiae]
MLASNDILVHFDLEKPLFLATDASDYGIGAVLFHKDAKTGKVGVIAYASKTLSSSERKYAQIEKEGRGVIFGVEKFNQYLYGRKFTLQTDHEPLKRIFGPKGQMPVVAARRLHRWSLILMNYEFDIEYCSTTNFGHADGLSRLPTPEVDKICKESFDIGEIQKECQNALPITANGIAKELRKDPTLKIVKNFTEHGWPTNKQIDAEIRPFYVVHDEIEIQNGCLMLGTRTIIPAKFRGEILKLIHETHPGIVRMKSLARQKVWWPGIDKDIEAIRKNAKFARKMLQK

SEQ ID NO: 150481 - protein, 428 aa, Heterodera glycines
  Coding regions on vcDNA: vcDNA=SeqID_76904; Strand=-; Position=1 -715,769-957,1274-1357,1712-1736,1873-2146
  Homolog annotation: Hit_ID=NP_572750.2; Match level="QueryCoverage =75%, HitCoverage=34%, E-value=9e-16, Identity=26%"; Hit description =CG32662-PA [Drosophila melanogaster] gb|AAF48098.2| CG32662-PA [Drosophila melanogaster]
MPKIEMDKLGEESFENEFNEEADQNVSSADHNDSANEMESQKKLGEKRERMEKSKEIKMELIRNFDKMRKEKIYGFNYDKKKRNKIENEIAIEIGINRNKIYKLKKELGQKRVKTEESEETKMELIRKFDKMRKEKIYGFKYDKKKRQKIETEIANELGINRNKIYKLKKELGQKRVKTEESEETKMELIRKFDKMRKEKIYGFNYDKKKRNKIENEIAIEIGIKRKKIYKWKKELEIGIKKKVSTQQQIEKVKEFEKVKEEFAKNFNLEPNWKIKEKIAEKIGARMNTISAWKRKLDSIAREKKRYSDAEKLEYVKRSEEIRKSNPMMNFVWFLGNLFTVVIFFFIQMKFMRLCFAIQLLIFPLRELLFIRKPNKKLTDLYPLDKFVEPMTYHYCIHVVKKDIILDTDVPRNMHEHLMNLMDRNGNC

SEQ ID NO: 150482 - protein, 55 aa, Heterodera glycines
  Coding regions on vcDNA: vcDNA=SeqID_76905; Strand=-; Position=1 -85,154-236
MTDVLLIGTQCLPAVRFGEKAFPIKINKIILLAYYERKHYGRMNYCKKVKFTKEI

SEQ ID NO: 150483 - protein, 175 aa, Heterodera glycines
  Coding regions on vcDNA: vcDNA=SeqID_76906; Strand=+; Position=1 -160,671-912,1876-2001
MTSHTPEWKNLAAGGSHGIRSSVLTSLNGTTPSRNPNYVKGKVNEGDRYLCLRNSNLIDWSKTNCVAVGLGSKIFQWNAGTGAVDVSSFTVFSTKSCEFKEIKDFSETHSHPTLVKWSCEGQYLAVGFNDGQLKDEVLRIWHVWKMDESMRKQTQESVTANARKQLQGAAGNIIR

SEQ ID NO: 150484 - protein, 155 aa, Heterodera glycines
  Coding regions on vcDNA: vcDNA=SeqID_76907; Strand=-; Position=1 -159,202-286,399-449,511-620
  Homolog annotation: Hit_ID=NP_499448.1; Match level="QueryCoverage =96%, HitCoverage=17%, E-value=4e-30, Identity=43%"; Hit description =oxysterol binding protein like (3M348) [Caenorhabditis elegans] emb|CAB57894.2| Hypothetical protein Y47D
NSTDVGVKENSAKTNDPNKFEKAGWLYKWTNYVKGYRQRWFVLNAEGILSYYRHPSEVNRSCRGSHPSEVNRSCRGSINLSEANIHSNQGESSIITTPSAQTFHLKASNEIDRSQWLKAIDRSQWLKALEYAKHRAIIQAVSHEEDEEESQLLLN

SEQ ID NO: 150485 - protein, 60 aa, Heterodera glycines
  Coding regions on vcDNA: vcDNA=SeqID_76908; Strand=+; Position=1-183
LQNIRPSRQIVKVFVYKFLKLDGILVLRLIDSNTGQIHMADIVHQLWLSFNEKSYFKETS

SEQ ID NO: 150486 - protein, 184 aa, Heterodera glycines
  Coding regions on vcDNA: vcDNA=SeqID_76909; Strand=-; Position=1 -66,184-383,441-664,1374-1438
  Homolog annotation: Hit_ID=CAC21848.1; Match level="QueryCoverage =75%, HitCoverage=65%, E-value=1e-12, Identity=34%"; Hit description =hypothetical protein [Globodera rostochiensis]
MENDKKNILERISEMEKQTKKKVFLKFQENCWDAFACHKDIQISGDKSLIVQHKGNTFGISVFAKCPILLNKHLSDFFYYEISVMKKKNWVIFGFAVKQQTKLDESIQLEKGTYAFDNYGFLWINGKGKGANAEYSYGVGDTVGIGVNSATRQIIFTKNGLRLAAADQFSKILEKITELEKDGS

SEQ ID NO: 150487 - protein, 187 aa, Heterodera glycines
  Coding regions on vcDNA: vcDNA=SeqID_76910; Strand=-; Position=1 -99,653-713,2231-2322,2411-2476,2537-2627,3022-3176
MKVAELMCIKTALNEFIAYQRLAQMVANGTLNGVAFRSFVSGICTSFLTTCVAEVNGDAISLENDGQLFDGNSETITDQQQQLKEFHEKFAKLETELKMAKLELENKALEQKLMHQELVGEQKALKEKVVKIEQKNVSGDHLKAILERIGELEKQQQQQTKGEANLTKMKFLGFSLVTAQLDIFRIL

SEQ ID NO: 150488 - protein, 183 aa, Heterodera glycines
  Coding regions on vcDNA: vcDNA=SeqID_76911; Strand=-; Position=1 -145,471-626,679-828,1055-1155
  Homolog annotation: Hit_ID=NP_956276.1; Match level="QueryCoverage =79%, HitCoverage=9%, E-value=4e-14, Identity=33%"; Hit description =Unknown (protein for MGC:63531) [Danio rerio] gb|AAH61450.1| Unknown (protein for MGC:63531) [Danio rerio]
MTPLFLAVRHANLPLCRVLVARGANIDLGTDFATTPLMHACKRSQTEIGFHFALKSAAMGGSLEVCRLLVEEWAADVNQQTIQERYTPVICAASKGHLAIVNFLVEHGADLQRVDVDGHNALMWAVKFGKIEMARHLVAIGADINQRNIEDSKTINSRCDSTERANQWPKAADGFLRKTLIDH

SEQ ID NO: 150489 - protein, 122 aa, Heterodera glycines
  Coding regions on vcDNA: vcDNA=SeqID_76912; Strand=+; Position=1 -21,221-281,820-969,1032-1140,1195-1222
MATSNNCLEKGADPNEPIIFETHDHRTMNFLIEHGADLQRVDVDGHNALMWAVKNGKIEMARHLVAIGADINQRNMEGKRAQDFAEESGNAEMVDIFRATATDNGRHAAEGTDGQQNDQEQM

SEQ ID NO: 150490 - protein, 170 aa, Heterodera glycines
  Coding regions on vcDNA: vcDNA=SeqID_76913; Strand=-; Position=1 -68,250-426,496-589,1083-1136,1261-1372,1470-1477
  Homolog annotation: Hit_ID=XP_308764.1; Match level="QueryCoverage =80%, HitCoverage=23%, E-value=1e-30, Identity=46%"; Hit description =ENSANGP00000023199 [Anopheles gambiae]
MNREFLIYIIIKTNLNFVVPEKNGTLDTLGRRYLYSFYWSTLMLTAIGEVPWPIKSVEFVIVCADLLFGVLVFATTVGNVGTLITNAGSARLDFQTNIDKVKSFMKHRSVGKKVFSPKDYVCRKGDVGREMYIVKKGRLQVVADDGVKIFHTLVEGAVFGELSLLNIPEL

SEQ ID NO: 150491 - protein, 717 aa, Heterodera glycines
  Coding regions on vcDNA: vcDNA=SeqID_76914; Strand=+; Position=1-2154
  Homolog annotation: Hit_ID=S71754; Match level="QueryCoverage=49%, HitCoverage=67%, E-value=1e-30, Identity=34%"; Hit description =cellular hepatitis A receptor HAVcr-1 precursor - green monkey emb|CAA66906.1| HAVcr-1 protein [Cercopithecus
MSFPFPEEQNCTLPVETPPLTVKSNLYIPIRIPRVFPAFKCWNITTIACTESFLRVITLDHPDKKIETEASVEDCQASLHHLPMNRVSETRWESLSPIQREYGWYGVNCFDNVQTIVEEGTAGILEGKRLITSWGDSLKVDKSLGEEGSWIRLPGAMELLMWRIPSEEFWHSHFAIGPVVTEIWPNKAVVVDELQYTFPISKNQERKFPVIGVPNDALKTENNVYVHVIGKVNSTKITRARRDANPKKSNVPRANPTKKPNIRRNQNDGLPSNSSVSTMAIPTTTIPVTTTKIPTTAIPTTTIPVTTTKIPTTAIPTTTIPVTTTKIPTTAIPTTTIPATTTKIPTTAFPTTTIPVTTAKIPTTAIPTTTIPATTTKIPITAIPTTTIPVTTTKIPTTAIPTTKIPTTKIPTTRIPVTTIRSSSALATPQSSTDTTNNIPATLKELNELAQQITDDDVLRHSAPTPFIIQNEPSEESPTTVITKREVSESNEVGSEKFWKEKNLYHENSRLSYLGWKTHRVNIQNAREKWISDCHERNNALAIAKALARQMPEDAARSLYKRDDITAFWTQPSREQKWSIALCRQMKAEEVFWDQKVETKCFRELPVKVTRQILFVKPGTRDLTYIGTEISCDAQGNNPWAAEHSNNNSELNNANLGHRFITDQYSNAQNPLIFFNRGSIFESEQARLERNLKELTERITRPELDFPEIGTIDANQT

SEQ ID NO: 150492 - protein, 185 aa, Heterodera glycines
  Coding regions on vcDNA: vcDNA=SeqID_76915; Strand=+; Position=1 -55,139-254,514-594,669-780,886-972,1062-1165
MSSSIASPDTFLRSETDQTPAASAAEEVGKYEVFSWHGNLSDQLSAELFVTDQQLLKECREKLAKSELKETKLLWNNGELNAENRALKAELEKQKLMTEHIELKAKVFNMEQEKQQFEKKYVSVDVFNSLAERIKRLENQQQEKREEDRNVSVGQLLEKFLAGEKQQKQQKKDNAQQRLDGKCSV

SEQ ID NO: 150493 - protein, 386 aa, Heterodera glycines
  Coding regions on vcDNA: vcDNA=SeqID_76916; Strand=+; Position=1 -176,229-434,504-652,706-831,872-1117,1168-1233
  Homolog annotation: Hit_ID=AAH68420.1; Match level="QueryCoverage =98%, HitCoverage=34%, E-value=2e-51, Identity=35%"; Hit description =Unknown (protein for IMAGE:6970634) [Danio rerio]
FSNLKSVPSNSFVRRLAVCLIEKIDGNFVDFCRLWTKFLQILRHHWEYNLNLPKSVSPMPQLSCCLLHQKLQMINFPQLSCCLLHQKLQMINFCISVKKRKHKEMEANETENLGGSAKDLPANRNTAGKFGEISGKTDRRQTDFYDEFFDEFFDAIESFDQFDVATSSECPRGRSLPDSNEFLKSNPNQRIFVPFTQEEGPMTEDQIEQREEEGPMTEDQIEQRESFLCNLEDANLRTKAQSELLLSDMQAFKAANPGCELVDFLRWAANPGCELVDFLRWHSPRDLTEGEGEGERIFDNDGSNRLRGELSDRMKIAGNFWQETWDSARAIPATQQQRLFNETREVEQILQYFANICIKELVELILQYFANICIKELVELLLPIVS

SEQ ID NO: 150494 - protein, 128 aa, Heterodera glycines
  Coding regions on vcDNA: vcDNA=SeqID_76917; Strand=-; Position=1 -168,769-869,1268-1384
  Homolog annotation: Hit_ID=CAE66610.1; Match level="QueryCoverage =98%, HitCoverage=9%, E-value=2e-43, Identity=67%"; Hit description =Hypothetical protein CBG11942 [Caenorhabditis briggsae]
KRTDKSSAVVSGAIRLHIKVDINGEERLAPFHLQYTCLHEHLFLVRYTHATNDLPLNTYDTAWTLYFDENGQQIVDEFAMRYGIEQIYQAMTHFACLCTKYMCDGVPAVLSMLLANINAHFAHATANV

SEQ ID NO: 150495 - protein, 118 aa, Heterodera glycines
  Coding regions on vcDNA: vcDNA=SeqID_76918; Strand=-; Position=1 -96,194-251,599-801
  Homolog annotation: Hit_ID=A41101; Match level="QueryCoverage=71%, HitCoverage=7%, E-value=3e-19, Identity=45%"; Hit description =phorbol ester-binding protein unc-13 - Caenorhabditis elegans
KQLVYRKCLQALIYPISATTTPHNFCTTNFQQTPPIWCYECEGLLWGLARQVIRDRMKAQERNKPEVFRRISDAFSVDDKTQQQVGPIGGRVDGVLESVLEINIPKITQLWNLENPGE

SEQ ID NO: 150496 - protein, 447 aa, Heterodera glycines
  Coding regions on vcDNA: vcDNA=SeqID_76919; Strand=-; Position=1 -90,149-263,312-376,428-580,649-759,856-972,1021-1165,1228-1310,1356 -1511
  Homolog annotation: Hit_ID=NP_496800.1; Match level="QueryCoverage =96%, HitCoverage=95%, E-value=1e-72, Identity=39%"; Hit description =nuclear receptor-binding factor 1 like (38.2 kD) (2N476) [Caenorhabditis elegans] emb|CAB04958.1| Hypothe
IRWVHRWAWTSRRLCSSTKIIYEQNGNPAEVLKLSNEKIDQNAIGVLKLSNEKIDQNAIGANEVFVRWMASPINPSDINQIQGVYPIKPPLPAVAGNEGCARVEIQGVYPIKPPLPAVAGNEGCARVEKIGSNVRELKVGDIVLPTNAGLGKIGSNVRELKVGDIVLPTNAGLGTWCTHGIYQSTQLFPIDSSLQLDSIATAMVNPSTAYRVNPSTAYRMLHDYAKLVPGDIVVQNGGNSAVGRFVIQMCRNLGFKSISVVRDRPQINEMKDELKQLGATEVFTEEEFAKAFAKAVKSKIGAKLALNCVGGKSTTYLTRALANGGCMVTYGGMSKNPVQVPTSSLIFNDITLYGFPTSSLIFNDITLYGFWMSRWYNCGHSEKERANMYKVFDDWKERANMYKVFDDWYKSGKLSTPPFRKWKIEEYKEAVENAMEPMTKFQHVFAY

SEQ ID NO: 150497 - protein, 50 aa, Heterodera glycines
  Coding regions on vcDNA: vcDNA=SeqID_76920; Strand=-; Position=1-151
MEFLRGLCPAFVVFAAAVFVLSVHFEQCAGRQRWAEVTHRVDFVAKVYAL

SEQ ID NO: 150498 - protein, 221 aa, Heterodera glycines
  Coding regions on vcDNA: vcDNA=SeqID_76921; Strand=+; Position=1 -255,962-1209,1454-1613
  Homolog annotation: Hit_ID=CAE67736.1; Match level="QueryCoverage =61%, HitCoverage=21%, E-value=8e-22, Identity=43%"; Hit description =Hypothetical protein CBG13311 [Caenorhabditis briggsae]
MRKGNQFGFYFSIVDTKCQRSCDLSARCCDVSPPPPPMDRRRRHSNELRQSLEKGAEGQGLLAKRTNSIQQLISALSENSPPSPKTRIPALILHEWNFKEYPVSDIALKFLLDNADQPVFDVRLVNPGLYRRAKNLRKFRKLRVKISHMWPFVQMCKLAAELMTENGILRTMFASVPKRFLSLESVDVYSLLDFERIANKNLIELVEPLALKGAAHIENCE

SEQ ID NO: 150499 - protein, 137 aa, Heterodera glycines
  Coding regions on vcDNA: vcDNA=SeqID_76922; Strand=+; Position=1 -136,188-337,397-490,536-569
  Homolog annotation: Hit_ID=NP_990454.1; Match level="QueryCoverage =93%, HitCoverage=12%, E-value=2e-12, Identity=33%"; Hit description =133kDa myosin-binding subunit of smooth muscle myosin phosphatase (M133) [Gallus gallus] pir||A55142 myos
MGAAIEARLEVCRLLVDEWAADVNQEAIDGTTALIRASDEGHVDVVNFLIERGANLHHTDMDGYNSLMCAVRNGKTEMARHLVAIGARTDQIGTDGKRARDLAEEGEIAEMIDIFRPAAEQRENVDGQQNEHQQQRM

SEQ ID NO: 150500 - protein, 165 aa, Heterodera glycines
  Coding regions on vcDNA: vcDNA=SeqID_76923; Strand=+; Position=1-499
  Homolog annotation: Hit_ID=EAK89729.1; Match level="QueryCoverage =91%, HitCoverage=86%, E-value=1e-14, Identity=28%"; Hit description =uncharacterized glycine-rich low complexity protein [Cryptosporidium parvum]
TQPSSIQSLGLNPPTFQSLGLNPPTFQSTGLNPPTFQSLGLNPPTFQSTGLSPPAFQSLGLNPPTFQSLGLNPPTFQSTGLNPPAFQSLGLNPPTFHSTGLNPPAFQSLGLNPFSRIQITGLNLINPSSTQLPGLSSPTFQSPELNLSNGIQNYLKGIQKLKYNP

SEQ ID NO: 150501 - protein, 21 aa, Heterodera glycines
  Coding regions on vcDNA: vcDNA=SeqID_76924; Strand=+; Position=1 -46,163-182
MHHKISKKARYRFFNASFICN

SEQ ID NO: 150502 - protein, 39 aa, Heterodera glycines
  Coding regions on vcDNA: vcDNA=SeqID_76925; Strand=-; Position=1 -6,218-331
MTAFANASSPVNFIVICFQLSADSVVPFDLINELIVDKD

SEQ ID NO: 150503 - protein, 21 aa, Heterodera glycines
  Coding regions on vcDNA: vcDNA=SeqID_76926; Strand=-; Position=1 -34,327-358
MNEQEIQWKWIDLLNSCFGLN

SEQ ID NO: 150504 - protein, 142 aa, Heterodera glycines
  Coding regions on vcDNA: vcDNA=SeqID_76927; Strand=+; Position=1 -24,527-931
  Homolog annotation: Hit_ID=NP_246917.1; Match level="QueryCoverage =95%, HitCoverage=16%, E-value=2e-14, Identity=30%"; Hit description =Lon [Pasteurella multocida subsp. multocida str. Pm70] gb|AAK04062.1| Lon [Pasteurella multocida subsp. m
MKCRPRIEEAIRFAFSSVRRAYERRQLSTFFEQNKINLSFPPLSTKRSGPSASAAAALAILSLATGRPVQAGVCVTGKVTTIGHISKISQMKEKTIAAAEANMVKMAFPRANLSEFKKVPYRTRKNLRRKTLNKVDDLFSLY

SEQ ID NO: 150505 - protein, 149 aa, Heterodera glycines
  Coding regions on vcDNA: vcDNA=SeqID_76928; Strand=-; Position=1 -45,548-952
  Homolog annotation: Hit_ID=NP_246917.1; Match level="QueryCoverage =94%, HitCoverage=17%, E-value=2e-17, Identity=32%"; Hit description =Lon [Pasteurella multocida subsp. multocida str. Pm70] gb|AAK04062.1| Lon [Pasteurella multocida subsp. m
MHPLLIYGNVDPVLKEAIRFAFSSVRRAYERRQLSTFFEQNKINLSFPPLSTKRSGPSASAAAALAILSLATGRPVQAGVCVTGKVTTMGHISKIGQMKEKTIAAAEANMVKMAFPRANLSEFKKVPYRTRKNLRRKTLNKVDELFSLY

SEQ ID NO: 150506 - protein, 61 aa, Heterodera glycines
  Coding regions on vcDNA: vcDNA=SeqID_76929; Strand=-; Position=1 -78,137-244
MRSFFFASLALVLICASTTVSKPHATPAHLSRPMKKVAIKCALSLCASTFALRPRLAFFCL

SEQ ID NO: 150507 - protein, 61 aa, Heterodera glycines
  Coding regions on vcDNA: vcDNA=SeqID_76930; Strand=+; Position=1 -103,577-659
MRFTAPTGTPIINAQKLNLEHLLFSLCPNEILFKVFYYFNFFSPLAKFAWAQLTLLAAAAT

SEQ ID NO: 150508 - protein, 78 aa, Heterodera glycines
  Coding regions on vcDNA: vcDNA=SeqID_76931; Strand=-; Position=1 -39,300-464,1110-1142
MIGVDEHALTLITQELEPETLQEARFFADTVKNGANKLRNDCNKMFELQALKKHDSSFSSDLKTIHAQVIKAAENASA

SEQ ID NO: 150509 - protein, 58 aa, Heterodera glycines
  Coding regions on vcDNA: vcDNA=SeqID_76932; Strand=-; Position=1 -39,276-413
MSEADSESKYGAVRKQVSKGRKATEQQMPNKNEMDGLPTKKKKPIPAHGTLKILFEYF

SEQ ID NO: 150510 - protein, 66 aa, Heterodera glycines
  Coding regions on vcDNA: vcDNA=SeqID_76933; Strand=+; Position=1 -138,821-883
MVMPSLVIIVSTSTSVPLQERHRPASSKGRKRGDERRGPLIVIPLVQKIVFTYFIHFLLTNYQLRK

SEQ ID NO: 150511 - protein, 148 aa, Heterodera glycines
  Coding regions on vcDNA: vcDNA=SeqID_76934; Strand=-; Position=1-447
MAINMQDKKGLLHQILGEADITITTSGITISGPRLSSPRFLPFDEAGRCRSCKGTEVEVDTMITKEGITIWCTRFDKVQFVPFDIIYDLPGHCFFRVKNKARVFNIPYGELPAITFPKHQEQQQQQQQQQKNDLRQKANAALDLMERD

SEQ ID NO: 150512 - protein, 47 aa, Heterodera glycines
  Coding regions on vcDNA: vcDNA=SeqID_76935; Strand=-; Position=1 -38,127-232
MEGQVWSEGTISLIKVEKNDLNNKKITGETRRSINYSKEITATLNYG

SEQ ID NO: 150513 - protein, 657 aa, Heterodera glycines
  Coding regions on vcDNA: vcDNA=SeqID_76936; Strand=-; Position=1-1973
  Homolog annotation: Hit_ID=NP_508324.1; Match level="QueryCoverage =85%, HitCoverage=21%, E-value=1e-80, Identity=35%"; Hit description =predicted CDS, peptidase family A16 and RNA-directed DNA polymerase and Integrase, catalytic domain and Z
MSDNPEENDKEEVMRTFRKSLTFKEGRYECGLPWNERVKDLPTNFQQARARLCGTVKKLRELNLVEEYQKIFNEWERNGIIERVPDPTQSTGPVHYLQHRPVIKIDKATTKIRIVMDASAKPANRKGAPSLNECLHTGPLLLNELTGILLRWRRMKDLILADIEKAFLQLSVREEDRDATRFLWLEDPQKTEISSPTYVRTVVFRFCRVSFGLTTSPFLLNATIREHLSFYDTVLPQTIMENLYVDNILINVKKNEDMAQICHESIELFRQGGMKLQEFFCSKPIAIRSLPVELLAKNQREIKVLGIPWTNEDDEICFRFKKFAGKHTKRNILAHIAKIYDPLGLVAPAVLPAKHFLQKRFEAKNGWDEGLEEELIHEWNQIMETWQTREGTEVQIRFARRVDNEDEVDKEMHCFADASGKGLGVAIYIRESTEKMSANLVFAKSLVKPSNISDVAATIPKMELQSITLGVKLLKYVLQHLKFKPSQTTIWTDSLCSVERIKEHKKCDRFVSNRLAKIRGQFEIKHLVSADNPADVASRGTTPRELSRNLLWKHGPKWLSEEKALWPKPAKVYHPDEEKLRGSAEDEEIKTAAVMNGVPFQPTIDMNRYSSWKKAKTVGAYVLRWIHSVAKNKYNGNLLPILSKMGPKKHWNQDKGV

SEQ ID NO: 150514 - protein, 177 aa, Heterodera glycines
  Coding regions on vcDNA: vcDNA=SeqID_76937; Strand=-; Position=1 -269,317-462,515-633
  Homolog annotation: Hit_ID=NP_498620.1; Match level="QueryCoverage =97%, HitCoverage=68%, E-value=7e-40, Identity=50%"; Hit description=- related (24.4 kD) (3I436) [Caenorhabditis elegans] gb|AAK68310.1| Hypothetical protein F08F8.7 [Caenorha
MMVSNPSKWLDPLHKAGIDQFTFHWEALGEDEAVDTLIDRVKSKGIRCGLSIKPMTPVIHGIEDNQWDESSAGQTDEVLRKDRHSTHNVLTVEPGFGGQKFMQDQMEKVRQLRKAYPNLDIQVDGGVGLDNIEHCANAGANMIVSGTGIVRSADPRQTMQKMRETVEIASSKETLGV

SEQ ID NO: 150515 - protein, 99 aa, Heterodera glycines
  Coding regions on vcDNA: vcDNA=SeqID_76938; Strand=-; Position=1 -201,442-540
MSLNGKDALGKSNIFMDRGTYLSLDAKDALEILTKYLRIGLALDAKDALEILTNQICLRTGIIFVHWNCTVGDVQPIKSLVVNRSMKSKKHFYISRNGI

SEQ ID NO: 150516 - protein, 217 aa, Heterodera glycines
  Coding regions on vcDNA: vcDNA=SeqID_76939; Strand=+; Position=1 -128,199-325,659-745,797-941,1357-1520
  Homolog annotation: Hit_ID=CAE71617.1; Match level="QueryCoverage =72%, HitCoverage=4%, E-value=2e-29, Identity=44%"; Hit description =Hypothetical protein CBG18580 [Caenorhabditis briggsae]
IPTVCQTERFRVPILDGVLPQSVSLNSNGRPIFLGIEYSRTQSDSLNAVSADVKVLFRLHASVDHKAFYGLNITNSAILNNTGNGGVLGIQGQICPSVHKYIRFSKSVLTIQGHIKASQIRDRFALHNVSVEGNQGLAGLLVQDGAADVWLNDTSFSWNWGDVNSDWPSVSLFAGLSSFAKVLINWVEFSDNIYHPHVEVFACQSANQRLMHVDLSG

SEQ ID NO: 150517 - protein, 112 aa, Heterodera glycines
  Coding regions on vcDNA: vcDNA=SeqID_76940; Strand=+; Position=1 -153,229-414
  Homolog annotation: Hit_ID=NP_498454.2; Match level="QueryCoverage =93%, HitCoverage=22%, E-value=2e-24, Identity=46%"; Hit description =differentially expressed in FDCP 8 (56.5 kD) (3H680) [Caenorhabditis elegans] gb|AAB53983.2| Hypothetical
MFTMDDLLQLANGRLLADIEAIVRIFTAHITEECEICRGNAFFCELCTDNQRIYPFSENVAICKSCCAVYHRPCFDRASKRCPRCLRRKARRKAVMEENEGDEEEEEDGQQP

SEQ ID NO: 150518 - protein, 102 aa, Heterodera glycines
  Coding regions on vcDNA: vcDNA=SeqID_76941; Strand=-; Position=1 -58,104-153,1499-1699
MFCYFLIAFLLLVLAKGFEGYTFSCLDGCECDTDDELISVIFSFVMSPIDPDKMALLKRLFPVLGKHLRKGDCGKIGVIGGSPDYTGGILQRNECIFMAFPR

SEQ ID NO: 150519 - protein, 151 aa, Heterodera glycines
  Coding regions on vcDNA: vcDNA=SeqID_76942; Strand=+; Position=1 -83,224-346,405-658
  Homolog annotation: Hit_ID=NP_107983.1; Match level="QueryCoverage =86%, HitCoverage=18%, E-value=2e-37, Identity=61%"; Hit description =3-methylcrotonyl-CoA carboxylase biotin-containing subunit [Mesorhizobium loti MAFF303099] dbj|BAB54128.1
KIDRVLVANRGEIALRIMRTSKQMGIKTIAVYSDADSKSLHVQFADEACRIGEASALRSYLCADRIVQAAAALSAGADAIHPGYGFLSENANFAEQCAANGLIFMGPSAEAIRVMGMKNTAKNIMTEVKTMPIVSYLNHKIKHQHVAILAD

SEQ ID NO: 150520 - protein, 412 aa, Heterodera glycines
  misc_feature (232)..(232): Xaa can be any naturally occurring amino acid
  Coding regions on vcDNA: vcDNA=SeqID_76943; Strand=+; Position=1 -191,262-310,366-534,634-940,1491-1630,2017-2179,2240-2336
  Homolog annotation: Hit_ID=ZP_00348041.1; Match level="QueryCoverage =94%, HitCoverage=53%, E-value=2e-51, Identity=35%"; Hit description =COG4770: Acetyl/propionyl-CoA carboxylase, alpha subunit [Pseudomonas aeruginosa UCBPP-PA14]
PRELAQDFANFCLIFLSPSKVEHPITEAITGLDLVQWQFLVAQGDRLPLTQQQIALNGHAMEARIYAEDSEAGFMPTARIYAEDSEAGFMPTAGHLEHLFFPSSMPHLRVDSGVHLEHLFFPSSMPHLRVDSGVREGDEISVHYDPMVAKVIAWGADRSEAIRRLDEGLRQTRIGGLRNNVRFVRACLAHERFRLGDVYTDFVAEHIDQLLPLQIADCGGAWAGKCWWIACXGRTRSIVAVQGSLFIWMFLKKLCGSNEALLQCTRQKRTRRPFYASPAFFRMNHSRRTLRLDAEQSAEVEIQGRTLPYQFEGIVVSISGAVPLLDGVAGKARSPIPGLVEKVFVKADDPVVKGQPLVAMSSMKMEFIIRAPFDGTAISVAPFDGTAISVFCTPGQNVAKDVVLLLLNVAKT

SEQ ID NO: 150521 - protein, 277 aa, Heterodera glycines
  Coding regions on vcDNA: vcDNA=SeqID_76944; Strand=+; Position=1 -124,178-201,248-388,783-845,902-1010,1059-1123,1171-1241,1392 -1459,1836-1919,1977-2061
  Homolog annotation: Hit_ID=CAE72865.1; Match level="QueryCoverage =98%, HitCoverage=97%, E-value=2e-32, Identity=50%"; Hit description =Hypothetical protein CBG20164 [Caenorhabditis briggsae]
MKSNSKTADIGDFYEILGVPRNASEQEIKNAYRKLALTYHPDRNPGNEQAQEQFKKVSIAYSVLSDPNKRRQYDVSGPSMAMNDFEGLDISELGGVVIIRCKSLAMSKFKLVLFDQEGAVRHIRESQKKKKYTSAELFFVPFQRINISEFIPIRFYMEDKDTPLPFHFLDTLETHGANVMELQPGKHILCVYGDNFLRMPVLASKKSEMQEFQKEYMDLKRKWEAAKEKLKKEEEDISSCLKAREKAYDELYDACSKPYQSQALTAKPSGFLSSLFG

SEQ ID NO: 150522 - protein, 223 aa, Heterodera glycines
  Coding regions on vcDNA: vcDNA=SeqID_76945; Strand=-; Position=1 -159,231-482,529-789
  Homolog annotation: Hit_ID=NP_501375.2; Match level="QueryCoverage =100%, HitCoverage=36%, E-value=5e-19, Identity=29%"; Hit description= prion-like Q/N-rich domain protein, Prion-like Q/N-rich domain protein PQN-9 (83.4 kD) (pqn-9) [Caenorha
MQDNLSHITEARQAVNALRDENERQRREMLRAEHDRRQSQLRHKMEHMRQMKHEMLLNERQLAIQRFQNNERQIMQQRMLVQQPQQIHQYQMPPMVSPYPHQQHYQQIPNSMPPNTAVTMNAIPSLPQNITTPMPPNEMLTNVNLVGIRAFQSNEHQIMQQQMMGQQPQMHQYQMPHLASPYPHQQQPHYQQIPNSMPPNAITADEQKNQMTGVQEDLLITFD

SEQ ID NO: 150523 - protein, 75 aa, Heterodera glycines
  Coding regions on vcDNA: vcDNA=SeqID_76946; Strand=+; Position=1 -90,567-618,1075-1160
MPHNQNQQQFVAAANPRFGNFRDRLFQAMLVIQNLEEYRERLSRKESAQNEADDSSDGEDTHQGQKLKCCQFANK

SEQ ID NO: 150524 - protein, 187 aa, Heterodera glycines
  Coding regions on vcDNA: vcDNA=SeqID_76947; Strand=-; Position=1 -66,545-752,894-1183
MKKSGGKRRSNFCSTTFKRLTSEYVPGGVFAKKEPKNKKKKGVEAKKDGQKKGEEGQQQQQKDNESRGEKTTEGKNEDEKTPFLEQEKSEEDSEFVSPPPTVPLAPLPKEENKTDETVQMAEKAQNEGERNCSSRSESRSSSKKDGTSGSEGDDAEEGTQTGTDDSNSWEKLSENSHRSGDGGKKTL

SEQ ID NO: 150525 - protein, 355 aa, Heterodera glycines
  Coding regions on vcDNA: vcDNA=SeqID_76948; Strand=+; Position=1 -980,1114-1201
  Homolog annotation: Hit_ID=NP_001004509.1; Match level="QueryCoverage= 91%, HitCoverage=21%, E-value=1e-41, Identity=32%"; Hit description =si:busm1-180o5.3 [Danio rerio] emb|CAD60788.1| novel protein similar to DNA polymerases [Danio rerio]
MTIFKGKFLNEKELAIVPEGGYERNDRASVFAIKYLDWRSKRDGVRIQHAGNGLEKRWRQFKLDGWIAEQNKCIEVLGCYWHGCESCFKPDDELVDGKTCRELNDATKLRLLKLQEPVPAEDACGEADEEGLDVEEIWECQIREQLKRDDEMRDFFDDLGTDRGPIDPRQTFYGGRTGPLQLIAEPKEDEKISVFDIVSLYPWVNYATDYPTGIPAVIHPTIEEMIVDWTRPEHLQYQGIYRVRVIPPKGLRIPVLPLKIDERLLFCCCHRCAAKFRKLNTRRVHKCTHTDEQRAFTGNFTHIELARALETGYRVDRFWRAWHYDEWWRPAVFLMVPTLWNNSSSSRTSTEESTV

SEQ ID NO: 150526 - protein, 217 aa, Heterodera glycines
  Coding regions on vcDNA: vcDNA=SeqID_76949; Strand=+; Position=1 -22,68-259,304-424,466-785
  Homolog annotation: Hit_ID=NP_001004509.1; Match level="QueryCoverage= 93%, HitCoverage=13%, E-value=4e-11, Identity=25%"; Hit description =si:busm1-180o5.3 [Danio rerio] emb|CAD60788.1| novel protein similar to DNA polymerases [Danio rerio]
LIMDHKIEVSAVIPLSDTAVRVMYKSKKNFVSEHTSSNIVISLWTTSRARLKLLDFMTQIDRTEGAKLLYTDTDSVAVLHKRDIVPIQTGEYLGQMSEEYLDYEIKTFVCGGAKQYGFRMLNKRTGEVEYVQKIRGITFDVNNSKALQFEHFLQKVKNYGRNTGDDNDDAPAVFSYDKIMPTRDSRVITRELRKKYMPICQKGIINEQYEVYPFGYE

SEQ ID NO: 150527 - protein, 186 aa, Heterodera glycines
  Coding regions on vcDNA: vcDNA=SeqID_76950; Strand=-; Position=1 -36,88-612
MLSEEEVRGNSVERTSICGTEGLEDLPGRLAAVSVTPLRTTEQQQHEPDRGRTGSDQLLERRRTRKRDYNLVRVLCRFNNCGPYRLTKQLQKRRTENLAYLSQLDIETVHLRKNIKIIPDALCPIGANQVFAYRGFLGITVQQHLYTRHRVMLKYPTLPCVVQFGGGHHRDIFPIELLRVSKTETL

SEQ ID NO: 150528 - protein, 243 aa, Heterodera glycines
  Coding regions on vcDNA: vcDNA=SeqID_76951; Strand=+; Position=1 -154,659-822,919-1099,1385-1501,1952-2067
  Homolog annotation: Hit_ID=CAE63498.1; Match level="QueryCoverage =90%, HitCoverage=29%, E-value=4e-57, Identity=55%"; Hit description =Hypothetical protein CBG07971 [Caenorhabditis briggsae]
AGLIYELNAIQCFAFGSMISAVDPLITLAIFQALKVEVQLYMLAFGESMLNDAVSIVLATTAQELSSPDVATMSSFAMVQFAFLRFLVMFFASAALGALIGLISALLFKHIDLRRTPQLELALLLVFAYLPYGLAEAISLSGWQLWNGNHRFPVFKNGPQTQGGQGSIMAILFCAIVMSQYTHFNISPITQITFQQTFRTISFVAGSSLCKPCGQRFPTVRPRQSVQQDENFDEKSDHHLVQR

SEQ ID NO: 150529 - protein, 30 aa, Heterodera glycines
  Coding regions on vcDNA: vcDNA=SeqID_76952; Strand=-; Position=1 -28,164-228
MCCLLKGGGAIEKYLLENDNSKNGQLTNIK

SEQ ID NO: 150530 - protein, 19 aa, Heterodera glycines
  Coding regions on vcDNA: vcDNA=SeqID_76953; Strand=-; Position=1-58
NYYRHYMIFTKPYKIKKRL

SEQ ID NO: 150531 - protein, 136 aa, Heterodera glycines
  Coding regions on vcDNA: vcDNA=SeqID_76954; Strand=-; Position=1 -68,362-401,679-981
MAVLRNAPARFLFCAVVTMTHRSCFNKQLGQLIIWLLCGLRKQVTNCCWQLTVAWIVEIGTIVPTFAMPFLAFCGAMAIIRCQTGKMPWHGWHQIMPETMPTSETITMCNSNEEQQNAIIFTFNVSLLKMAPHLGT

SEQ ID NO: 150532 - protein, 55 aa, Heterodera glycines; identical to SEQ ID NO: 126013
  Coding regions on vcDNA: vcDNA=SeqID_76955; Strand=+; Position=1 -54,184-297

SEQ ID NO: 150533 - protein, 70 aa, Heterodera glycines
  Coding regions on vcDNA: vcDNA=SeqID_76956; Strand=+; Position=1 -94,155-273
  Homolog annotation: Hit_ID=CAE58304.1; Match level="QueryCoverage =91%, HitCoverage=18%, E-value=3e-11, Identity=50%"; Hit description =Hypothetical protein CBG01414 [Caenorhabditis briggsae]
MNALETGILGIIGAVYCDYPLLIYTTGSMGLSLWFAETAAEFLLAINRCLELLKPELAYVIFNGIFSLHY

SEQ ID NO: 150534 - protein, 32 aa, Heterodera glycines
  Coding regions on vcDNA: vcDNA=SeqID_76957; Strand=+; Position=1-96
MAMFTKPILFSGLNLAWFFNPYVGYTDDFGKI

SEQ ID NO: 150535 - protein, 29 aa, Heterodera glycines
  Coding regions on vcDNA: vcDNA=SeqID_76958; Strand=-; Position=1-91
TRAEIYVQGSLLLAFAASVRHWGQHFMCR

SEQ ID NO: 150536 - protein, 28 aa, Heterodera glycines
  Coding regions on vcDNA: vcDNA=SeqID_76959; Strand=-; Position=1-86
NPCGNIKARKSSARLCSLCTALGPTLYV

SEQ ID NO: 150537 - protein, 69 aa, Heterodera glycines
  Coding regions on vcDNA: vcDNA=SeqID_76960; Strand=-; Position=1-211
TRAEIYVQGSLLLTFAASVRHWGQHFMCRSFYANSGSFLRTRAEIYSAGSLLLAFAASVPHWGQHFMCR

SEQ ID NO: 150538 - protein, 68 aa, Heterodera glycines
  Coding regions on vcDNA: vcDNA=SeqID_76961; Strand=-; Position=1-206
FSLSFFHVSLPSVFFLCSFFPLKEPFLPPLKPLTNQFYSPKFVTQFCTLESVAHPSLLIFILYFCPSP

SEQ ID NO: 150539 - protein, 649 aa, Heterodera glycines
  Coding regions on vcDNA: vcDNA=SeqID_76962; Strand=+; Position=1 -258,417-2105
  Homolog annotation: Hit_ID=EAL49477.1; Match level="QueryCoverage =99%, HitCoverage=66%, E-value=2e-84, Identity=31%"; Hit description =hypothetical protein 42.t00003 [Entamoeba histolytica HM-1:IMSS]
MEELLEMYGVRKSGETVAEEGVPSVKNSWASTYLRERKANAQQQQQKTGTNNEKGGKSRTAQNWEEGKEREKQETNTGNEDKQFRERLLNAHQTVDELLKKRGIGDLKKEREMLLRQYEALLAAADEELETEWARMRKRGGGAAGNGRRDSSDSGLSEDYSEREKAPTEGKMEEEEKIDEEEEEEQEKEEEEEEEEDENEKEEEEVKEEEKEEEEREEEEVRIEEKLHKKEETEKVKRQVKCHQRIKEKCEQKIKESEERKVEVTLKLREKKEKEAKAEKIVTEKRRMRKEHSIKNEGKEEAKIKDEEKKREEEKKREEEVRKKEDEERKRKEEEKKRKEEEAKRKEENRKVEERKRKEEKEKKEKKEEEKKRKEEEAKRKEENRRVEERKRDEEKKREEEHKREEEVMKKEDEERKRKEEKEGKEEEKQRGDEERKRKEEEAKTKEEKKPKEKAQSSRKMANVSLQHCSFSLGKESGEKEKGQKEGEKSVRAHFRLTMPTEEKKTTKKTIQVRKQKSGAERTMKERKGREREEKKMEENKEERETDREEKGVKEREEENEEGRETDREEKQVKEKVKEQLTRKKPAKEAQEVRELLQSLRGNLRRTEKPKRQFPVEKQSKTTREKGKRTQRERETMEKGVQAEKQRTR

SEQ ID NO: 150540 - protein, 45 aa, Heterodera glycines
  Coding regions on vcDNA: vcDNA=SeqID_76963; Strand=-; Position=1 -88,294-343
MTRDGKNMDIKSQNMAIKYGLKSRNMDINAKNQPKKRNFGFFAYF

SEQ ID NO: 150541 - protein, 89 aa, Heterodera glycines
  Coding regions on vcDNA: vcDNA=SeqID_76964; Strand=-; Position=1-270
MATNNTAKIKKFGKNDRIRCFNIAIWRDVCENIMMRGLRKKFGQQGMLKQMLIKTGSKTLVESSPHDVFWVSRHLRTDICGPLFLDRTV

SEQ ID NO: 150542 - protein, 96 aa, Heterodera glycines
  Coding regions on vcDNA: vcDNA=SeqID_76965; Strand=+; Position=1-5,80- 365
MRESFNYGYNDLQSIFGKIQQKIPNIIGPQRFFNAMFIHNQNFWTSECTIQLGVAYIPIGSMPPFNFVEFYFSDPQPWFFNFRYRLYLILCMLCFV

SEQ ID NO: 150543 - protein, 206 aa, Heterodera glycines
  Coding regions on vcDNA: vcDNA=SeqID_76966; Strand=-; Position=1 -254,778-1034,1725-1834
MLRPAHANNEQQQSLCAQLPTNVWCTPSAIGRMATILRQMHAVVSEEMGRELMGRQRLMDHLCLVHGYFFMLRGDFASALEHILFIKTAKTTATKKCATPFSSRKNVSHSTKIAEKCVNDALAMCSPPANVANLMHLLCGVKLTKREQMKCKIFSEKFMLKSRLREGQRNEYRSSFYSMLIILQKVRMFLNRLAHYVFEEVQTNSN

SEQ ID NO: 150544 - protein, 72 aa, Heterodera glycines
  Coding regions on vcDNA: vcDNA=SeqID_76967; Strand=-; Position=1 -90,442-570
MEEKTAAKENGEKRKDEIEREGNGGREAENSFSAKIIMFSGRNKMLYNMQKITSLYDLYPLRYGHFNFVKIY

SEQ ID NO: 150545 - protein, 143 aa, Heterodera glycines
  Coding regions on vcDNA: vcDNA=SeqID_76968; Strand=-; Position=1-432
MKLCILFFLIAFLIALIEIGAEKKKFEQNTFDEIFGEKWEEKEEKGNDQNENDQKKREIIEKFNKIKEKIKQKGRKYSRKEWKRNYAEIVKKIRVGQVVIKRWKKQFGMGEGMTEKEKMEKVKIYLQMKGQNPKMSDEKIAKY

SEQ ID NO: 150546 - protein, 218 aa, Heterodera glycines
  Coding regions on vcDNA: vcDNA=SeqID_76969; Strand=-; Position=1 -97,160-209,738-900,1303-1611,1851-1888
MASCKSPISLLSVLLIMLLIDPCFNYYFFNPASDDCVVAIRNRTQIPPGLDSYVDLAVRYDQREAAQKANVFRNTFTADCVPGGELGHIWGGFYGCLTFTCTDEHGKDLFRINGCATENDKQCPKFFNTFCRESGGNSSDCRHCDELVDGKVCNSFDQLINLDQSEEQMNSNLKSHSHHSNSSSKAEKLGPASAFTWISSNLLLLFGIEIIITKALIK

SEQ ID NO: 150547 - protein, 33 aa, Heterodera glycines
  Coding regions on vcDNA: vcDNA=SeqID_76970; Strand=-; Position=1-99
LPLRWWSTGTASIWRRALPHGDDVEAQYRWMLT

SEQ ID NO: 150548 - protein, 75 aa, Heterodera glycines
  Coding regions on vcDNA: vcDNA=SeqID_76971; Strand=-; Position=1 -114,267-538
CCRQIFNSFISSEAAHLGYWKKELRADNCQLWVAFEKNYQQNDAEHYCHWHQQQQKQAEVTHCLCPVVNGLLKKN

SEQ ID NO: 150549 - protein, 265 aa, Heterodera glycines
  Coding regions on vcDNA: vcDNA=SeqID_76972; Strand=-; Position=1 -150,454-631,874-1342
  Homolog annotation: Hit_ID=NP_501912.1; Match level="QueryCoverage =53%, HitCoverage=23%, E-value=3e-25, Identity=45%"; Hit description =yeast SIR related (68.8 kD) (sir-2.1) [Caenorhabditis elegans] emb|CAA94364.1| Hypothetical protein R11A8
QVALCNRCVTGVLKPDIVFFGEDLGGAFHDQMGADHTQLDLLVVIGSSMQVRPVSLIPFNIAGDVPQILINRQMLRNYTADIKLLGSCDPILVQIALAMGGQMRQKMLDELQLRRGVKHSGGVPPLPSDLLARADQLLLSRKTSTAAVAQISNSNGAKMEENGEEETAATEKASSFPRQMTVDQFKQYINTTDNNTGDQGDDMEELTETARKRCKMMPIREDEEEGTVPEMETQTIVRQQSKRQQSLWQSNYARVDAHLPSTDTL

SEQ ID NO: 150550 - protein, 21 aa, Heterodera glycines
  Coding regions on vcDNA: vcDNA=SeqID_76973; Strand=+; Position=1-64
MSGRGKGGKAKTGGKAKSRSS

SEQ ID NO: 150551 - protein, 47 aa, Heterodera glycines
  Coding regions on vcDNA: vcDNA=SeqID_76974; Strand=-; Position=1 -110,224-257
MAPDPGVVEETHSKHAVPGQDITRATKERRPQGLLQTCKLPTGAPFV

SEQ ID NO: 150552 - protein, 125 aa, Heterodera glycines
  Coding regions on vcDNA: vcDNA=SeqID_76975; Strand=+; Position=1 -235,395-537
  Homolog annotation: Hit_ID=XP_392337.1; Match level="QueryCoverage =96%, HitCoverage=82%, E-value=1e-41, Identity=64%"; Hit description =similar to Ubiquitin-conjugating enzyme E2-17 kDa (Ubiquitin-protein ligase) (Ubiquitin carrier protein)
MDDGKDLYHWRASIKGPPESPYEGGTFHLDIVLRRDYPCTPPIVKFVTDIYHPNVGERGDICLDILKQMWAPALTISKVLLSISSLLCDPNPDCALRQDIATMYRDNREEYNRNAREWTRKYAMT

SEQ ID NO: 150553 - protein, 123 aa, Heterodera glycines
  Coding regions on vcDNA: vcDNA=SeqID_76976; Strand=-; Position=1-372
MLPAAPLDNNNGTSSQTIGDRIGLDDAIMRLAEAEKNDGLEWCATPFCRPTPALTKRSMRSKMPSADFGMPSLTDVLTGTFEFVQKTSERHSIALRCIQQQIEDQQKQLDSEKANDSIAVKMN

SEQ ID NO: 150554 - protein, 137 aa, Heterodera glycines
  Coding regions on vcDNA: vcDNA=SeqID_76977; Strand=-; Position=1-414
MNSLSKTPLNNSIFIKFPQWHTLLAPTECRLEDDVLAAAAPAVPLVERWRPVQSTADLVLLRRRAVVPTRIAAPTPWPAPAGWRIGPRPTVTGPTPVPEHEEQQKLRHTVTTLLMMVMVQQLPNEPKQMQEAHELCH

SEQ ID NO: 150555 - protein, 36 aa, Heterodera glycines
  Coding regions on vcDNA: vcDNA=SeqID_76978; Strand=-; Position=1 -104,633-639
MPRGVDWYLFCRNSCVFSNWTVQSQRHMAISVPGRK

SEQ ID NO: 150556 - protein, 220 aa, Heterodera glycines
  Coding regions on vcDNA: vcDNA=SeqID_76979; Strand=+; Position=1 -114,358-675,723-953
MALLSYRFDVLVDKYFGGKSELTIWNAMTIFDCIGSLEPIWDVFVCEIWPIFATNIRHLRLGRSYNLDNLRRRTSPTIFTDLDQLNPIDSVDLLPDVFADDGPNATAGQALAKWLHTPSTDGQSKRLLCRNYSLNFEWLNNFIETFLRATTSVSYKIRNDMSSSTRPIEPFELVNERTKEKLTLTNDGFGWLLKRCPIIVEMAAQKYEIFGYWNRVIFRL

SEQ ID NO: 150557 - protein, 133 aa, Heterodera glycines
  Coding regions on vcDNA: vcDNA=SeqID_76980; Strand=+; Position=1 -154,244-491
MSLFSSQLCRGALCQLRSQLAQLGYLIDLTTEEIYFLAGDAATVGPSSTGAAMAAQQQKGEKPPAARCALCRFLLYNQKNNSSLLLINKAAVPLAQCSDHWSNWYEIGCGWIINVQMDLNDSHTKNGAWSFIP

SEQ ID NO: 150558 - protein, 154 aa, Heterodera glycines
  Coding regions on vcDNA: vcDNA=SeqID_76981; Strand=+; Position=1 -47,94-397,1177-1290
MSDNRKEGEEKMAKAILISADCLFKVFNLLPPTQLGLGIALISHRFDCGRTFQIAQMGAKIYSNSKRNWTEWRKKREWKLSIALTISQATPRRYLFVQALRAISEKFEKKLAYLSAKSWGEKAGICTGLTQKNNHFMHNPPWGIIRENTAKHPM

SEQ ID NO: 150559 - protein, 97 aa, Heterodera glycines
  Coding regions on vcDNA: vcDNA=SeqID_76982; Strand=-; Position=1 -201,537-629
MSFHFPIFVFFSAIMWFCFECSNGSGIGDVKMAEASSNSNMNTTKRKQANPDEEKHNKKAKTEIRKTENHWDATACDTRLRIIDGLTVIHSAKQSGI

SEQ ID NO: 150560 - protein, 893 aa, Heterodera glycines
  Coding regions on vcDNA: vcDNA=SeqID_76983; Strand=+; Position=1-2682
  Homolog annotation: Hit_ID=NP_920205.1; Match level="QueryCoverage =95%, HitCoverage=57%, E-value=6e-93, Identity=31%"; Hit description =putative DNA helicase homolog [Oryza sativa (japonica cultivar -group)] gb|AAP52492.1| putative DNA helica
MHREVRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMNFRGATEAFAVVHSMPFAKLSHHVVHLSIHLPNQQPVVYRAFQLVSKAEEIQRGELPETPCSAYWKQWQNEWQHVPSLKDMLFEKVPEQFRWAKDRWVFYKKKPIKRPPIGRVVPVPPTDRERFALYALMRHFPGDPDHLKLVNGQQYNTFTEAALQHGLLEDDQIWHKTLGEAALHRWPDQMRWLFVSILVFGQPSNALELWNKYKDQMYNPQGITSAAIRQAREQEALADIDWRLHFFNSSCMHCGLPDPPNSKAKNINLAVEEAFFGDDDLNMPPGQPNPRQQQNAPPPLNSDQQKVFDAVVRAIQSDPKDPTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIAVIDRVCKEMAIRQHKDLLFGGKTVIFSGDFKQSLPVVPHEGLTAQVAACFQTSPLFCQFLTMKLTINQRLGQGQQAYLQMCRQIGLGETGEHFWIPPQFLVKSRDELIDFVYPDFQKLLGNDKELLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGIKYERLQFPIKPAFAMTILKGQGQTISTVGIDLERDVFSHGQLYTAFSRATDGNNVRVTLPEGRPTTQTESKC

SEQ ID NO: 150561 - protein, 25 aa, Heterodera glycines
  Coding regions on vcDNA: vcDNA=SeqID_76984; Strand=-; Position=1-77
MIIIIIFPEYLGIHLNVQKKVKSRK

SEQ ID NO: 150562 - protein, 114 aa, Heterodera glycines
  Coding regions on vcDNA: vcDNA=SeqID_76985; Strand=-; Position=1 -103,996-1096,1349-1487
  Homolog annotation: Hit_ID=AAG23825.1; Match level="QueryCoverage =80%, HitCoverage=7%, E-value=1e-39, Identity=88%"; Hit description =guanylyl cyclase [Heterodera glycines]
QKPFQSELEKKLMEQIVTVQSKVDKMGMAHQQQKANKIHISKETCILLHENSEGGAYLTESRGEVIIKGKGVMETFWLLGNAKISGGTIGTNHSQAAERQMAMESDKSEKEMYK

SEQ ID NO: 150563 - protein, 35 aa, Heterodera glycines
  Coding regions on vcDNA: vcDNA=SeqID_76986; Strand=-; Position=1-106
ALYESNQLTMPGFYTITLFMFEQTLYFLASFESTK

SEQ ID NO: 150564 - protein, 339 aa, Heterodera glycines
  Coding regions on vcDNA: vcDNA=SeqID_76987; Strand=+; Position=1 -90,136-377,430-743,1511-1647,1695-1811,2176-2295
  Homolog annotation: Hit_ID=CAE67644.1; Match level="QueryCoverage =97%, HitCoverage=74%, E-value=7e-21, Identity=23%"; Hit description =Hypothetical protein CBG13203 [Caenorhabditis briggsae]
MKFCGSVLLKLFKSAQVVELGFCADFGYCQGMKNGGEKCTNAVNTSLCSFCPFHTQQRARQLSMARGALNRSYNLPPKKMRSLEEHSNSFDTPTQIGVKTIARTQISDGKIFTKPLSVVQQRLESKTAEMKEKRMDELKKLVTEKVNENEGIFSLIIMGKENILLVLAVWLWCEEFVAEAAEGQREPKPAGGSVGTVAVAQSKVASVHARIHPLATNDSKAQKENGSKSDDGETNFGGSFSDEQIRTLLEKTSNHDKEAKRAELNQQNVYFDRRQIEEQIETNATSLMELKNCKVVTCSISCGAKEFCRVAMKDERKVLTERERLKLKEEEKNFSSLKA

SEQ ID NO: 150565 - protein, 20 aa, Heterodera glycines
  Coding regions on vcDNA: vcDNA=SeqID_76988; Strand=+; Position=1-62
YTRKQDNFNISRKLQTKIIS

SEQ ID NO: 150566 - protein, 51 aa, Heterodera glycines
  Coding regions on vcDNA: vcDNA=SeqID_76989; Strand=+; Position=1 -73,510-592
MVLSDLSNAVNNGATLSLQELRRRHIFWSEFALSWWSKKMGFELIDGGAVE

SEQ ID NO: 150567 - protein, 38 aa, Heterodera glycines
  Coding regions on vcDNA: vcDNA=SeqID_76990; Strand=-; Position=1 -4,655-767
MDILLNILMVDVGTTFVKFSDCTNSALNTNCGRIPSTI

SEQ ID NO: 150568 - protein, 92 aa, Heterodera glycines
  Coding regions on vcDNA: vcDNA=SeqID_76991; Strand=+; Position=1 -87,130-321
MAVRRRVAHHEAGHIMANHLNKDGAECLASDIVEDQFMCEQFKKREVKEAIKQVSLLEQFKNSRIKLANALLQRNVLQCNDIKRLEIFSNDK

SEQ ID NO: 150569 - protein, 200 aa, Heterodera glycines
  Coding regions on vcDNA: vcDNA=SeqID_76992; Strand=-; Position=1 -474,624-752
MGGKDLDFGNGIGEEWHSTNTIFNENPVIFGESPEISSMNNDDDNNNNYHPYYYYNNYGYGNDSNFPGNNNWYNANAYTDNWYSVNDGDDDTSGYGSTTSGNYGFETNSYSSSTLGGNYDYGNSSESSSAPALTKKKKELQQIFRGNIQIRETDSDGLCFEVYCGTSNLTDGIFTDHYGNFEETLHKEQEEALKKMQIWN

SEQ ID NO: 150570 - protein, 174 aa, Heterodera glycines
  Coding regions on vcDNA: vcDNA=SeqID_76993; Strand=-; Position=1 -437,966-1053
  Homolog annotation: Hit_ID=CAE59383.1; Match level="QueryCoverage =83%, HitCoverage=88%, E-value=3e-26, Identity=46%"; Hit description =Hypothetical protein CBG02739 [Caenorhabditis briggsae]
MDRERKREKEKRQKERERWRERENGRKKRDRRSERDGEREKTGERKETEGAREMERERKREKEKRQKERERWRERENGRKKRDRRSERDGEREKTGERKETEGAREMERERKREKEKRQKERERWRERENGRKKRDRRSERDGERGIFKCYYLNQQCAIPPHIQRLLNKTHSLT

SEQ ID NO: 150571 - protein, 289 aa, Heterodera glycines
  Coding regions on vcDNA: vcDNA=SeqID_76994; Strand=+; Position=1 -245,295-715,878-1081
  Homolog annotation: Hit_ID=AAL78214.1; Match level="QueryCoverage =41%, HitCoverage=64%, E-value=8e-09, Identity=29%"; Hit description =putative esophageal gland cell protein Hgg-20 [Heterodera glycines]
MSDHKGPTAFVKIAKINFQFWKLVDDHLRNKKWLLDYLEIDEEEQMDGTTEMVIYDGTGKILPIPQNPLPTKISGFQTIWITYLDANVIAFLHLFQHLFTSCEITLTIEMTNGQFLFSLAQNIWPLIKNNVKRFSMPTNFEHFRHHFPSILSSDQWPSLQFFYCENVLPDFPADDCANASDGQVLSKWLFSAHFGDLPPKVAQCECSTDLQGITSKMALVKSAFVNASSRANFIVYIWFNASSSDHVTDIPTFKLSNNSTGEHMTLKRIRDKYANITVGLVGLRQVKEI

SEQ ID NO: 150572 - protein, 53 aa, Heterodera glycines
  Coding regions on vcDNA: vcDNA=SeqID_76995; Strand=+; Position=1 -75,166-252
  Homolog annotation: Hit_ID=XP_320184.1; Match level="QueryCoverage =90%, HitCoverage=13%, E-value=1e-09, Identity=56%"; Hit description =ENSANGP00000011676 [Anopheles gambiae]
MPITKCAIHSGGNIMAYAIGYDWSKGFEYSTANNVTKIFLHGCDEEMKPKPKK

SEQ ID NO: 150573 - protein, 22 aa, Heterodera glycines
  Coding regions on vcDNA: vcDNA=SeqID_76996; Strand=-; Position=1-65
HYVSTRMNGAFCDWHWQGIGTL

SEQ ID NO: 150574 - protein, 129 aa, Heterodera glycines
  Coding regions on vcDNA: vcDNA=SeqID_76997; Strand=-; Position=1 -223,293-459
  Homolog annotation: Hit_ID=NP_492651.1; Match level="QueryCoverage =28%, HitCoverage=19%, E-value=2e-14, Identity=97%"; Hit description =neuronal Calcium Sensor (22.0 kD) (ncs-2) [Caenorhabditis elegans] emb|CAB02282.1| Hypothetical protein F
MGLKGSKPKLSKEDLEFLKKNTNFTEEQIKEWYKGFVVSPYTLRGLRPFTAFCPRLARLSQGPSDQRAVHQSVQGLFPLRLRGRLLRTRVPDLRHGQQRVHRLQGVLAGHQRHFLRHTRAETRMGIPGF

SEQ ID NO: 150575 - protein, 109 aa, Heterodera glycines
  Coding regions on vcDNA: vcDNA=SeqID_76998; Strand=-; Position=1 -8,470-791
MSRPFTAQANVFPPISSGHAQPPAFSHGMMIIDTSVRPPPINMIAGHTMPMPSNCPGPSTRMAPYPPQYLPSYAEAAQQAPSNSNSNRRIDVKCYRCGKIGHFSKRCRT

SEQ ID NO: 150576 - protein, 232 aa, Heterodera glycines
  Coding regions on vcDNA: vcDNA=SeqID_76999; Strand=-; Position=1 -169,1123-1652
MRRNVDNDSGANNGANISSDPKIAHAVDTGNGANDALGDGMDIGHCPNCSWHCNVCKKVYQGTVRLEDAANRSLRVINRRAVQNTDAINQVSVTVNANMDTLSTRLDQVVDKVETLESQVENWDNPNTDNLSQNGDATVVLRSRVGLLEEEDDEDEFLNVLTTVDPFASQLPACKDENLTSFDNWAQKFRDLLDYAGTTWSEKEKLGRLKFSLEGQIRMGSSQIQWMLLYCS

SEQ ID NO: 150577 - protein, 121 aa, Heterodera glycines
  Coding regions on vcDNA: vcDNA=SeqID_77000; Strand=+; Position=1 -160,232-435
  Homolog annotation: Hit_ID=CAG79851.1; Match level="QueryCoverage =95%, HitCoverage=42%, E-value=2e-09, Identity=38%"; Hit description =unnamed protein product [Yarrowia lipolytica CLIB99] ref|XP _504256.1| hypothetical protein [Yarrowia lipol
MPAGPEGAEASAKPTGQSAAPGGTSAAGGTSAVGQQPADASKKSLAPAGTASAAVPSTYAAPGTGTTLSTASQKSAAPAGGASALSTASQKSAAGGAMSQKSAAPAGGASALSTASQKSAA

SEQ ID NO: 150578 - protein, 74 aa, Heterodera glycines
  Coding regions on vcDNA: vcDNA=SeqID_77001; Strand=-; Position=1-250
FILYPRKMAISFLEKFYASQKRLRMRRRAVHNRHFISQRIFIFRGYPRKMAISFFDKFYTHTNALEHDREGGAQ

SEQ ID NO: 150579 - protein, 44 aa, Heterodera glycines
  Coding regions on vcDNA: vcDNA=SeqID_77002; Strand=-; Position=1-8,76- 202
MKGPEGSELPREFYGIGDPTLGKFRIPDPASYNFLTICGSKIYW

SEQ ID NO: 150580 - protein, 224 aa, Heterodera glycines
  Coding regions on vcDNA: vcDNA=SeqID_77003; Strand=+; Position=1 -234,289-367,783-989,1817-1971
MFYSIAIPLIQIIFVNLCFGNDESPNDGQKTQINLLKEAGKKPGNELNLNEEGNSNGNQSADNEENELMVLSRQIQNKGKEKEKDSLEKESHLITKTKEQQNIFELPTELNEFEQDLLPLPWAFDNDLLLLSEQIQKQSEMLQLAKSNEKVQKTPAVEKRQENGKAKAAWVDYGSKILETGFSKSAGPDRSDIFRSNRFPGPASQKPVKPENRIFKLPGPEPVW

SEQ ID NO: 150581 - protein, 242 aa, Heterodera glycines
  Coding regions on vcDNA: vcDNA=SeqID_77004; Strand=-; Position=1 -160,232-800
  Homolog annotation: Hit_ID=YP_090429.1; Match level="QueryCoverage =99%, HitCoverage=82%, E-value=2e-23, Identity=31%"; Hit description =hypothetical protein BLi00801 [Bacillus licheniformis ATCC 14580] gb|AAU39736.1| hypothetical protein BLi
MPAGPEGAEASAKPTGQSAAPGGTSAAGGTSAVGQQPADASKKSLAPAGTASAAVPSTYAAPGTGTTLCTASQKTAPAGGTSTLGTASQKTAPAGGTSTLGTASQTPAGGTSTLGTASQKTAPAGGTSTLGTASQKTAPAGGTSALGTASQKTAAAPAGGTSALGTASQKSAAAPAGGTSALGTASQKTAAAPAGGTSALGTASQKSAAGGTTLKSAPVGGASALGTASQKSAAGGAASQKA

SEQ ID NO: 150582 - protein, 143 aa, Heterodera glycines
  Coding regions on vcDNA: vcDNA=SeqID_77005; Strand=+; Position=1 -158,205-294,413-595
ESLLTQYQNDNSLLQFVEEEIRKEFFGAEIEGFAEDLQEIKFIGNEMKEKIMLSYLKKNKFTENNDNFNKALNELQQIIEEWSDEARLQVTGALMIKYENESFSPICLLPGEFNRAKIFGNLICDFKKRTLCQDESLYCIFCK

SEQ ID NO: 150583 - protein, 223 aa, Heterodera glycines
  Coding regions on vcDNA: vcDNA=SeqID_77006; Strand=+; Position=1 -19,352-492,1292-1414,1473-1611,2019-2268
  Homolog annotation: Hit_ID=CAE64813.1; Match level="QueryCoverage =64%, HitCoverage=20%, E-value=8e-14, Identity=29%"; Hit description =Hypothetical protein CBG09607 [Caenorhabditis briggsae]
MFHWCKTEEKADEIREKIKNTKKLEDLLTKFCQNALKDREKVNEMKTMLAILMVLENIWPSNEEIYKEKVVEIKKRSDLKVFVQSLAYLEKWAIDNYIFNSELGYLDSNILKIMLSKIIAIYPNSSAPFIIHKFFLTFSLWHWPLPVQLEQLTYEQSGELLLMWSPGREWVLKKQNVKSKSLRKRHQRILTMPIIGPMFPQQNLGHKINSLTAKVIQRKMQEG

SEQ ID NO: 150584 - protein, 330 aa, Heterodera glycines
  Coding regions on vcDNA: vcDNA=SeqID_77007; Strand=-; Position=1 -87,185-401,447-627,675-928,1287-1540
MDRVNPLNVVLPDALLMKDGENTLLYDSRLLDVLKRARKISVDGTFKVAPAAWTQCFVIGAFVNRRLALCVHALLPGKQRKYYEEALNAVKAVIAPNTPAHIISDFETATIRAMRETFPAAQLTGCLFHMSQAVFRKWREMGLAELYANDEEQGEVARNSFRKLLALALIPGQHVRRGFAVIVNHAPEGLAAFFGYFARVYVGLTAHEQEAGAVAFVPGTDQSRRSSISTNATEDAEYSRRNSFGSDFLAAILDDVDKQVDIARSARVFPHKRRIKYILKEQLIGDALDEAEYNTDEDVMNILSLLSLQMQGYVGGLRARGAQHEHEDRE

SEQ ID NO: 150585 - protein, 151 aa, Heterodera glycines
  Coding regions on vcDNA: vcDNA=SeqID_77008; Strand=+; Position=1 -159,660-953
  Homolog annotation: Hit_ID=NP_506166.1; Match level="QueryCoverage =98%, HitCoverage=47%, E-value=2e-14, Identity=31%"; Hit description =RA domain containing protein (28.2 kD) (5N149) [Caenorhabditis elegans] emb|CAA98966.1| Hypothetical prot
MDGTEARSILELDRMARPLDLQKCHPVGMSRFILGMDSNAILARIYDGEVNPESNYKSVLISRRTCCAEVLQMLCQMSRPSFVSADCRLRPARDAPSKAQYCQQLGLDAISELRLFVDSPRGAESALIPAKCPLAGVYTALMPGQRIALRR

SEQ ID NO: 150586 - protein, 115 aa, Heterodera glycines
  Coding regions on vcDNA: vcDNA=SeqID_77009; Strand=-; Position=1 -62,330-477,617-754
  Homolog annotation: Hit_ID=AAO24602.1; Match level="QueryCoverage =88%, HitCoverage=72%, E-value=2e-20, Identity=49%"; Hit description =histone H3 variant [Trypanosoma brucei brucei] gb|AAO24601.1| histone H3 variant [Trypanosoma brucei bruce
MKKKINKKEEERRKRYRPGEKALKEIRRYQKSTDNLMPRQPFRRLIREVISEITWNSHRLETQAATALQEAAETFLTTFFEAANRCAVHANRVTIMPSDFVLIRWILHTFGNNIV

SEQ ID NO: 150587 - protein, 88 aa, Heterodera glycines
  Coding regions on vcDNA: vcDNA=SeqID_77010; Strand=-; Position=1 -234,1361-1393
MKMLPKEQKQTPQTDTSSAKLFLLHLFTISTIILHILPTTECRPSFAKENGDDDGQNAILINDETTKTSAALPTDFEKTQIIRQNVPA

SEQ ID NO: 150588 - protein, 69 aa, Heterodera glycines
  Coding regions on vcDNA: vcDNA=SeqID_77011; Strand=-; Position=1 -55,216-370
MKRVMADQNKKYKKGIYQYKFYHSNPEENLQFRRLGWPAAANWSKFERGIRDDGHGYGYGHPSDRKSKK

SEQ ID NO: 150589 - protein, 117 aa, Heterodera glycines
  Coding regions on vcDNA: vcDNA=SeqID_77012; Strand=-; Position=1-354
MGLNPPTFQSTGLNPPAFNHWDSTHQHSNQQDSIHHHLINGTQPTNIPINGIQSTSISISGTQFFCISITGTLFSCILGIFIISSCFLWHFLMAQHSWHFHHLLVFWHFLMAQHDTN

SEQ ID NO: 150590 - protein, 122 aa, Heterodera glycines
  Coding regions on vcDNA: vcDNA=SeqID_77013; Strand=-; Position=1 -230,514-652
MMIWIIVVVGIIALALLSCVLSRACHRSSTSSASAGANDIEMAPTSSASTSNRLPGFNYSSDVRSVHHYLPRVHDRRVQNFEKSVCLDQGSLLDLDLHFQDKNQENSGPGKTRLVETCIFEI

SEQ ID NO: 150591 - protein, 127 aa, Heterodera glycines
  Coding regions on vcDNA: vcDNA=SeqID_77014; Strand=-; Position=1 -301,431-511
MLLAIVFFVCSIAFPQPIFSVIKSKPQNLVLIDRQIYEQKLAENDGTGELREFIQKLEDQNETMAKVIEKCEAIEEREDAKLAQIYLSLRTKLGEIKGGEVLESVCDEAAVERLRKNAVEAVFLLAK

SEQ ID NO: 150592 - protein, 42 aa, Heterodera glycines
  Coding regions on vcDNA: vcDNA=SeqID_77015; Strand=-; Position=1 -117,202-213
MHSVFAKLGWTSNRKAAGGTLRPGAHRSIALKALIAYKKVLT

SEQ ID NO: 150593 - protein, 182 aa, Heterodera glycines
  Coding regions on vcDNA: vcDNA=SeqID_77016; Strand=-; Position=1 -502,567-611
MELHQQGEPGTEKGTEKLEQAKLTFSPPPAAANEEALSISESDANDEKEDKSNRKEAKSKSEKVEEKANESNGKTENGTTEEEIGQNVAEKAEQQREEAKGRTIAAIRKGGNGARSLPPIIDVGGIAAEEANEEEEQKKETDEKGKTELTWWDKIVLGLRCARHDCRETLIVKNEQLPRMIN

SEQ ID NO: 150594 - protein, 71 aa, Heterodera glycines
  Coding regions on vcDNA: vcDNA=SeqID_77017; Strand=-; Position=1 -49,108-213,345-405
MLNKFYLDRLIENGQTAYFENLYAYFMCIIFNIKRPFEYHVPTPCVCAGDDQIFIRDLDISWAGHFVGQRH

SEQ ID NO: 150595 - protein, 50 aa, Heterodera glycines
  Coding regions on vcDNA: vcDNA=SeqID_77018; Strand=-; Position=1 -78,1157-1231
MSKKLEAKKYSLTLSKSTSKNWRSQSANRGHLGLSNDTNNVEIGWQIKKL

SEQ ID NO: 150596 - protein, 89 aa, Heterodera glycines
  Coding regions on vcDNA: vcDNA=SeqID_77019; Strand=+; Position=1 -106,599-642,687-804
MEEKTEENFADFVFPLNDITSDCFQQILAWMREHHNLAEPIVKEDPVTQERIWFKFTDWERQFFDVDFERVKEYFLASNFLDIRSLYLY

SEQ ID NO: 150597 - protein, 112 aa, Heterodera glycines
  Coding regions on vcDNA: vcDNA=SeqID_77020; Strand=+; Position=1 -31,484-791
MAFSWEKMQKMVLWPLDSDKAGRSVYLGWSIFLGGHFDKRIWRGIVLAFPNADGHSRVVIAGVHHLLFFPLFLFQIHWLMALLRFAETKTNRGKILLSRGGYEYTFEVKKLI

SEQ ID NO: 150598 - protein, 59 aa, Heterodera glycines
  Coding regions on vcDNA: vcDNA=SeqID_77021; Strand=-; Position=1-179
MTMHFLGPGQFSTCQEISTVADFDSDRFRQWISTVADFDSDRFRQWISTMADFDSDRFR

SEQ ID NO: 150599 - protein, 104 aa, Heterodera glycines
  Coding regions on vcDNA: vcDNA=SeqID_77022; Strand=+; Position=1 -79,654-889
MKERWPHNNSHPSSVGCGLVAKTTDPRFNAFVHLCVSFISDSTSKAMPVNGTGSIITMFVPSALNPIFSICMIKSYRSAFAKEALKIGKFQEISYFLHYKPPLD

SEQ ID NO: 150600 - protein, 67 aa, Heterodera glycines
  Coding regions on vcDNA: vcDNA=SeqID_77023; Strand=+; Position=1 -142,1065-1126
MQSLSKRNSKQRKFITIFTQIWFFFQPYAFVTKYFCLLLPKTPLLVMVFTNFHLPGQHSDCLQKYDG

SEQ ID NO: 150601 - protein, 60 aa, Heterodera glycines
  Coding regions on vcDNA: vcDNA=SeqID_77024; Strand=+; Position=1 -132,310-360
MFNGMWTNCWPIVRTVVHKSMLVSNKHTAVAGWRTLSRADSTDKKIDLLTQLKKEKKLAN

SEQ ID NO: 150602 - protein, 87 aa, Heterodera glycines
  Coding regions on vcDNA: vcDNA=SeqID_77025; Strand=+; Position=1 -204,400-459
MPGAQNDGRDYMFAIFKHVSSSAKVDIGTVPSSETTAAVSANGTVATTGANGTSADNATAESWVGKGCGAFDVAVPPLVPIVAATFG

SEQ ID NO: 150603 - protein, 317 aa, Heterodera glycines
  Coding regions on vcDNA: vcDNA=SeqID_77026; Strand=+; Position=1 -218,438-696,1703-2179
MAICAHFWDTSAQSAECVGLSLGPVGYSNDDIADAVRERLAEMELTMERGKFIRFTVDKSSSFSSYNARPSFFNPFPFVGGGSFASAMALPFDWQLVDCSPEVLEAFFNNDAEEDDAGGEEAEIGLGEGIEVTVCAARRLETVLRTVLERDQQMVQLRKVEHKISDPSTLLRVRSNIERFLDVVESPFGFGTIRRVRAPIIGTAKEQNAMGEERDQIDMEIMEYLDIVQLDSSESCAQFWTKHGQVRKERERETIKDGERGEKWGEIKKEVRDAEMGRVKRGELRKEGERLREEKERVKRKGKREGERNREEENERG

SEQ ID NO: 150604 - protein, 124 aa, Heterodera glycines
  Coding regions on vcDNA: vcDNA=SeqID_77027; Strand=-; Position=1 -198,272-445
  Homolog annotation: Hit_ID=NP_499161.1; Match level="QueryCoverage =85%, HitCoverage=5%, E-value=2e-27, Identity=52%"; Hit description =CBP/p300 homolog (cbp-1) [Caenorhabditis elegans] emb|CAA82353.2| Hypothetical protein R10E11.1a [Caenorha
MNNANSGGPPQMRGGGIAQQQQTAGNHPQQQMLGCAGQPQDPKTRKLIQQQLVLLLHARTCQQIERSEPLQNRAPCTLPYCSVMKGVLEHMVGCSAGRQCQYAHCASSRQIIAHWKNCNKDDCP

SEQ ID NO: 150605 - protein, 53 aa, Heterodera glycines
  Coding regions on vcDNA: vcDNA=SeqID_77028; Strand=+; Position=1 -48,353-466
MTRLVNNFKKGAKCQKKINIWLGYNFSSLYFQNFLNGLGASFSNLGCDLRVPK

SEQ ID NO: 150606 - protein, 108 aa, Heterodera glycines
  Coding regions on vcDNA: vcDNA=SeqID_77029; Strand=+; Position=1 -130,625-715,807-912
MAIKILFSFVIFFILSEQICGVNPRQSKGKSKSLNKVDQTEEEESHAFCIECLRKYTEAAHEEMPFARGGLGLKRNKVPAPGSAQLNSSIGKSLCRILCVVSGRSMLG

SEQ ID NO: 150607 - protein, 47 aa, Heterodera glycines
  Coding regions on vcDNA: vcDNA=SeqID_77030; Strand=+; Position=1-208
IPIKFFKILPINWLIFSENLFINDQNFQFFFPAAPIGTAAPPKLLFF

SEQ ID NO: 150608 - protein, 146 aa, Heterodera glycines
  Coding regions on vcDNA: vcDNA=SeqID_77031; Strand=+; Position=1 -111,188-394,647-769
MCKFAPGSFCKKALINNNFLFYRLLHKTKRADFWRRINEAEREEHAFYTYQERNYHALLPRIPTHRCLGTMFCRLDPLAYLVHEADDEQMAERTMYISLRVGTVAQRLVLQNHFQNQEDQIQEALNLVAFTFMELPAQEGVVRNLI

SEQ ID NO: 150609 - protein, 86 aa, Heterodera glycines
  Coding regions on vcDNA: vcDNA=SeqID_77032; Strand=-; Position=1 -158,602-706
LLNAIKNGQNNYTLEVANKVYVKDGFEVLDTFKAQIAEHYGGQFEAVDFADSGNWADKFDSKFTKKRTFYVDEKNSKEVNESQTFI

SEQ ID NO: 150610 - protein, 1361 aa, Heterodera glycines
  Coding regions on vcDNA: vcDNA=SeqID_77033; Strand=+; Position=1 -355,443-3414,4026-4784
  Homolog annotation: Hit_ID=NP_500013.1; Match level="QueryCoverage =76%, HitCoverage=61%, E-value=2e-93, Identity=34%"; Hit description =predicted CDS, polyprotein family member (4B673) [Caenorhabditis elegans] gb|AAC02594.1| Hypothetical pro
MAFIDPRTMILSSDARLAPCSEYRKQLIFLRGSLHEVDQIDAQVKQVNANRIDGFSLNLSLAPTYARHSFLHLALVNVSDFIGQFYDANFARESELTFQLKSEDTVITKTLSEQWEQVNFLIRFGLMIRDEYVGRGTTRRMTFGGNKTQKIVKSPAHLNMMNLNASVEFGNEIELSPVKLIEPAQTQAYKFAGKRKRPVKRTRFSFRAPKVLIGLLVIFLPNAFANPDVNNQISIQFTSPSMIYLLIIPFLIFITISVLLRSKRNSDLPMLPNLNAISPHHAVVQTLINSTPVRCLMDTGASLTVAPRSIADELNCRTFSSDLEAMSASGHVIRLKEYAQVNLNIAGYTVRSLIYFVDDSEFTVARDYSVIVGWDVFEKLPPIKFDHLNGKFFVGNNESKLCYRSILLLNDLRVSAEKNTLIPADSQILVDASIESSPNPKNSFCIDRPDISLIKKGLSVINSVSPAGQKQIKVAVVNPTMEPKWIWKGTHLAFANELLCDRNGLLKENSTKEILTLNSERKKMEIDPTFVVDFSKAMVEGKDLEKLKALIEEFSDVFSKFRYDLGLFTAAEHHITTTTEEPIASAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDKVYQMITMPFGLKNATAAFSRAMAIVLSGLEDTSLAYVDDVLIFTKSPNFSEHLTAVRKVLERFRLYNLKLSPKKCIFASNEMNFLGFVLTAEGFKPSLSRIEILKEMPVPLNVKEVKRVLGQAGFYRRHIENFAMVVEPLLKLTRQGNKFEWGREQQNAFDKIKELLTQAPSLIFPDYDKAFHIFTDASSTGQGGVLMQKDDVTGTFSAISYCSRTLSAAERKWPAVQIEMSAIIYALREFRTFIFMSDIELHTDHKPLAFLLKKSETNQHLARWLIELQNYQVKIVHVAGKANTLADALSRAAEDKPLSEIYNVDELEDIIEFPVCLALAAHSRVVAYPFLHTLTIRHEDGNTYEVNLLEEQAGDPEAAAYIAFVRDGEFPADLDEKEKELFAVGTANYKLISGILYFEDKPEFDEFLDAANFCYNTSVHASTGETPFFLMFGRDPIFCVDQIIDPKVRDPIAISDRNEFKQKLVVAIRHAWHAAADEYAKAQRKMKEQYDRKARPQQITIGDRVLIRNYDGRVGTSKKFQLPWRRIFRVIKIEGIYVTVISCTSPNSNPKRLHLNQIKKCFEILGPPCTMPTQPVEEKKCLEKTQNVEEVSSERSGIRNEMDPESREGENLEEIHARGPETRPEIEADEEKNEQKKIDTEPRKYDLRKRTRT

SEQ ID NO: 150611 - protein, 91 aa, Heterodera glycines
  Coding regions on vcDNA: vcDNA=SeqID_77034; Strand=+; Position=1 -151,193-317
MEQRNQEIKTKRNKQKLEHEGALYVLHQISDDGLRKYWRCEFFGPNNKCKGRIHTDINGNVLTIIGSHTCDMSAAQVECQRRVTPAQAACS

SEQ ID NO: 150612 - protein, 149 aa, Heterodera glycines
  Coding regions on vcDNA: vcDNA=SeqID_77035; Strand=+; Position=1 -201,1369-1617
MDNYTGRPWFNGGLTVPRFAKYRAADARILRLLQSYNAINNNQAHQNDHNYHALINVNPYNIINFSLMISASAKKLDRITIEKILHKCFQVLVLTNVFGLSRFMRPFNAVSRCKHRLPNGTVHKHALGNKVDGLGNANTPFRLQFSKQP

SEQ ID NO: 150613 - protein, 61 aa, Heterodera glycines
  Coding regions on vcDNA: vcDNA=SeqID_77036; Strand=-; Position=1 -44,460-601
MNFLNSVKFLDCERWKFRQWLISTVTDFDSGFRQWLISTVTDFDSELFSFILLFSDISDSG

SEQ ID NO: 150614 - protein, 71 aa, Heterodera glycines
  Coding regions on vcDNA: vcDNA=SeqID_77037; Strand=-; Position=1-4,82- 293
MTSNHYEELLQNFFTLNFVLDNYEFNIAAKDYTPEYFFNKISKQMGRRVDEICLTSMFPLYLQKVNTVINY

SEQ ID NO: 150615 - protein, 41 aa, Heterodera glycines
  Coding regions on vcDNA: vcDNA=SeqID_77038; Strand=-; Position=1-123
GSPLQGIPRSRTIIAMSDPNHGKFSPVYQPLSGKDKHADFA

SEQ ID NO: 150616 - protein, 100 aa, Heterodera glycines
  Coding regions on vcDNA: vcDNA=SeqID_77039; Strand=-; Position=1 -116,941-1126
PSRLLDCLHYVCEECVPEQCLLLDNLEPDEIRCPNCSQVEMSSISGQSTESSRVEICIKHEKFTRFCLSCARLLCVNCEQQLSLPTAQVNNVTNVVAVPQ

SEQ ID NO: 150617 - protein, 37 aa, Heterodera glycines
  Coding regions on vcDNA: vcDNA=SeqID_77040; Strand=-; Position=1 -24,321-410
MATAFDRYFNFVNENKCETVQENETSLNTGKLIAKYS

SEQ ID NO: 150618 - protein, 284 aa, Heterodera glycines
  Coding regions on vcDNA: vcDNA=SeqID_77041; Strand=-; Position=1-855
  Homolog annotation: Hit_ID=ZP_00235599.1; Match level="QueryCoverage =58%, HitCoverage=32%, E-value=6e-11, Identity=29%"; Hit description =hypothetical protein membrane Associated protein [Bacillus cereus G9241] gb|EAL17029.1| hypothetical pr
MDPKLITDPGSVERTAECADRSANCGVLKKNGFCWEIRYVRLIRIQCQHTCGFCENEHGNGATKKQGKNGIGNQNQGQNMGKDNGQDLKINVGLDNADGQDGNEEYDMQNGGQEWEHGIDLPTGEDRTMNGNRGQELSMFGLDKTEGQAEENHGKMGVHDLDYGNGIDEEWHSNNNNIADGNDSGTRHGNDGIGTTNSQNGNANGQINGQEEQKQAESNFMDKKKQKKKLLLLTTSDEADLNNPKLLNKVDEHYTKWTFPKRRKPIGNGDETDQAVEKKTWHET

SEQ ID NO: 150619 - protein, 57 aa, Heterodera glycines
  Coding regions on vcDNA: vcDNA=SeqID_77042; Strand=+; Position=1-171
MDLTPVGPSVAPLAFSSSSTDASAVELPYAVPNFGTPTEKLLLGGELIAVPSALLAD

SEQ ID NO: 150620 - protein, 133 aa, Heterodera glycines
  Coding regions on vcDNA: vcDNA=SeqID_77043; Strand=+; Position=1 -104,182-291,544-628,930-985,1051-1096,1303-1395,1799-1912
  Homolog annotation: Hit_ID=AAH41712.1; Match level="QueryCoverage =97%, HitCoverage=30%, E-value=4e-27, Identity=51%"; Hit description =MGC52531 protein [Xenopus laevis]
MGATESVEHSKSDLQQLKGDIFVNGRPFPDQICQRIVALAMGGMPPRDILRNLLVSSGCVSKILASCGTIDGRSGPQMLSQEIVEKITLYKTEYPSIFAWEIRDRLKQDSLCTAETLPSISSINTVLRSHAIL

SEQ ID NO: 150621 - protein, 165 aa, Heterodera glycines
  Coding regions on vcDNA: vcDNA=SeqID_77044; Strand=+; Position=1 -81,201-300,419-735
MSNFRMDLIICAISFRVSCHIVAQTYSRTFLAIEQRKTTRDWQMSSPLIIGDIDTILDQLEIGENALPLHSYKNFILNASMTSTRTFYAINAQVKMLKKSIDSTNRNVMTKCIEEEEKHWSREKDGVSKRNEFKSHRSQKAEAKAEIKVERNDNKRKQKDKSYSE

SEQ ID NO: 150622 - protein, 299 aa, Heterodera glycines
  Coding regions on vcDNA: vcDNA=SeqID_77045; Strand=-; Position=1 -154,728-845,890-971,1016-1098,1206-1276,1396-1787
  Homolog annotation: Hit_ID=AAG39382.1; Match level="QueryCoverage =77%, HitCoverage=17%, E-value=4e-52, Identity=40%"; Hit description =chitin synthase [Dirofilaria immitis]
MRIIASIPSAFIFAVLFTGAYLWYLTQAHLEFRFGVLLPLSFLMCAVGHWERMQRQGVFSDFYITLIWLFSYMKWSYRFISGENFDQMDEIIVSMSPMMSGLDICQSLVVFRCSIAKKETDCDSDYNYRESISRIFNGEMDRILTLLDEEHAIRLSEKNTLEGTKFRLEVHIFFDDSWTDDKECGRIPNEYFKLLFEVLMELTRFYLISQLVPWYFCFVLSSSDNAEADMYSRILLNTPYGGRLVLALNGGSLLFVHLKDKRLIRHKKRWSQVMYMYFLLGHRIMDSHLSVEDKQLQVF

SEQ ID NO: 150623 - protein, 129 aa, Heterodera glycines
  Coding regions on vcDNA: vcDNA=SeqID_77046; Strand=+; Position=1 -92,146-443
MPIGHNAKSVIRRFLRLPFAVEIRAIGGKRNKWIFVHFALKLGTAKGTNGKSTGKWRRCHSLRGRVSERAASHNEATHRRNTQAHLLSLVAPWGKRVVNVGRSTGDETVRSGDCHRLFSHNPNNLNPYE

SEQ ID NO: 150624 - protein, 147 aa, Heterodera glycines
  Coding regions on vcDNA: vcDNA=SeqID_77047; Strand=+; Position=1 -268,419-594
MAPPGQYHHEVLTVGEPQLMACSYGEHDERHITRVENTAFAAAAAGGGAMGPPPMPPPQGIMVSSAPGTSALGMPPMPVPTTAMGGDNGAPPHHLLGANNDFEQHIQQQQQQQQQMPPGGLWNPLPPATSAGPGGNGGDQAMGGNGG

SEQ ID NO: 150625 - protein, 201 aa, Heterodera glycines
  Coding regions on vcDNA: vcDNA=SeqID_77048; Strand=+; Position=1 -69,172-331,632-948,1389-1448
MDENANADDAGEGREKRQPKANQINYASLGHLLDRLIVSQRRTSLLPVVPIAFFPLTDFEKRNVSLCTRTNPTEVFDALSCASKSSTETMHRQTDQQEIERRGTDTLAPTQLRPNSNIENEMCAIEMNSELALQRHDGLVDEEMNENGPTPALTQQPQIDFENEMFDNDSTLVPPSPRDFLEVRDSKLAKMVVRFELSGSN

SEQ ID NO: 150626 - protein, 137 aa, Heterodera glycines
  Coding regions on vcDNA: vcDNA=SeqID_77049; Strand=-; Position=1 -55,527-882
MGRSDAPRIDGRKIMENKHNRRNFPTVGKCRNGEESAREAFQRKVREKRKKQKSEIEFSRKNIQMPSNAGRTQANIAAIRKKLDTALAEGTSGTAQNEGETEQRGEEEEEDMLMSENVLSAKDPITKRDIKEPVKNS

SEQ ID NO: 150627 - protein, 149 aa, Heterodera glycines
  Coding regions on vcDNA: vcDNA=SeqID_77050; Strand=-; Position=1 -52,99-393,446-547
  Homolog annotation: Hit_ID=NP_501645.1; Match level="QueryCoverage =97%, HitCoverage=49%, E-value=4e-14, Identity=31%"; Hit description =phosphatidylinositol glycan class C like (4K106) [Caenorhabditis elegans] emb|CAA92490.2| Hypothetical pr
MRHCFSTNSGQMVRSLFVGFVPFTFSSAICAACTVMAHFDLVALFLCCFELVHSDVFGPFALFCFCSFASSATLLAHFALLRSSDLFQISSSDFVEYCRTFVTILAFGYAFTPVIRTLTTSISTDTIYACAILLFFASLFVHDYGINVP

SEQ ID NO: 150628 - protein, 606 aa, Heterodera glycines
  Coding regions on vcDNA: vcDNA=SeqID_77051; Strand=-; Position=1-1820
  Homolog annotation: Hit_ID=CAA82797.1; Match level="QueryCoverage =72%, HitCoverage=63%, E-value=5e-26, Identity=26%"; Hit description =gag protein [Ascaris lumbricoides]
MSGPIRSKIGPCAARTKAYIEAATVNLGKDTTDESIQADLTAERRGLRRAIRLLEDCNDKWQSLLLKFNGADRQQEEQRYDDFKPSGKHFMEWSDKARGAVDTIDGVIGPEDDDEITGSIISQPANPPQIQHVQPPPPRHEVNLPPISLPKFAGEPREWPMFWRLFRSSVDNLPIDDFKKHIYLLGCLPHNSPARRAVDLYPPSDENYPRVVDILKKRFGDSKTITESLQAELLHLPKPGESVLSLRNFAESVERICFQLMDFGESEDNMFMASTIKSKLPFSILTHVVEKELSSGKTFSCLDIRKALQTIVEVKEEVQRCAHVLRGDERPRSSAFNSPPQQRGAWDQRGDHRHSNNRQSQPPRPFNRGGTPQPEYRAFSAINKNPERAKTPARKWGRSCSLCSGTDHLPSECPAFPTPGARRKRLTEQQRCLNCLVQGHNTEECTSPYRCRNCGNKHHFLICFKREESHSRSNGNRSASSPKSGREPGGRKFHQRQVESQTHLITAGFQQNDQSNPPPREGEIVQSMGMSTVDTSKGRANKVPKCKNPHAYLMMRRLLAKSSRDSRNIIKVAVLFDPGSQTTYGADPLIDKLRPHKLTSEEMEVH

SEQ ID NO: 150629 - protein, 30 aa, Heterodera glycines
  Coding regions on vcDNA: vcDNA=SeqID_77052; Strand=-; Position=1-89
PALTFSAYKKGTLFIKCSLPHFHSFISAAA

SEQ ID NO: 150630 - protein, 247 aa, Heterodera glycines
  Coding regions on vcDNA: vcDNA=SeqID_77053; Strand=-; Position=1 -220,288-373,415-481,554-832,1162-1251
  Homolog annotation: Hit_ID=CAE67008.1; Match level="QueryCoverage =78%, HitCoverage=7%, E-value=3e-92, Identity=82%"; Hit description =Hypothetical protein CBG12408 [Caenorhabditis briggsae]
MSTSSPPSSESDPPELLQTPHSPSSRPFWRDQEELVISGISGRFPRSDNVKQFGDLLLAGEDLVTEDELRWPPGFYDLPKRHGKLKELRKFDAQFFSVTPKQANYMDPQVRILLEVAYEAMIDSGVNPMEFRGTKTGVFVGCSASETGGALTQDPEMVTGYTLTGCVRSMFSNRLSYAFDLRGPSFSVDTACSSSLLALQLAIDAIRQEQCEAAIVAAAFRRASYLCDCCAREEQHGRLQRAGHHLS

SEQ ID NO: 150631 - protein, 101 aa, Heterodera glycines
  Coding regions on vcDNA: vcDNA=SeqID_77054; Strand=+; Position=1-306
MVAADSSSCLLHLIVINCGDLRCRDEVNKGEEQRERRGRGARRIGGAKGGGGKGGRRRRGGGKGGRRRRRRRKETDGRVDGRKESTEEKSRCSEFVLCRRR

SEQ ID NO: 150632 - protein, 31 aa, Heterodera glycines
  Coding regions on vcDNA: vcDNA=SeqID_77055; Strand=-; Position=1-93
LRSLSNGSQRRRQSTNSEQRLFSSVDSFLPS

SEQ ID NO: 150633 - protein, 23 aa, Heterodera glycines
  Coding regions on vcDNA: vcDNA=SeqID_77056; Strand=+; Position=1-69
MGGSKGEREKKLEEVKEKERAAR

SEQ ID NO: 150634 - protein, 18 aa, Heterodera glycines
  Coding regions on vcDNA: vcDNA=SeqID_77057; Strand=+; Position=1-57
FGREILFFETKLKTYITY

SEQ ID NO: 150635 - protein, 51 aa, Heterodera glycines
  Coding regions on vcDNA: vcDNA=SeqID_77058; Strand=+; Position=1 -45,122-232
MTLFLFTANFFLAYKVLPSDPENPPSSDKVPALTVGAHEFTCHVMPYLDIQ

SEQ ID NO: 150636 - protein, 97 aa, Heterodera glycines
  Coding regions on vcDNA: vcDNA=SeqID_77059; Strand=-; Position=1 -183,564-674
ETLRLTNLVVFNNPHMTLDEIKVGNFTVESGTPIVPQVDKKSGEIFFSFIFQISSVLFSEKVLPSDLKNPPSSDKVPALTVGAHEFTCHVMPYLHIQ

SEQ ID NO: 150637 - protein, 670 aa, Heterodera glycines
  Coding regions on vcDNA: vcDNA=SeqID_77060; Strand=-; Position=1 -48,1380-3348,5247-5275
  Homolog annotation: Hit_ID=XP_474741.1; Match level="QueryCoverage =96%, HitCoverage=45%, E-value=1e-104, Identity=32%"; Hit description= OSJNBa0059D20.6 [Oryza sativa (japonica cultivar-group)] emb|CAD39763.2| OSJNBa0059D20.6 [Oryza sativa (
QKKQLRKGRHGIDLLEGARPCQQRPYRYPVALQPEIKRQVKELLRQNVIRPSSSAWASPIVLVRKPDGSYRFCVDYRKLNQLTKRSTYYLPRIQSILDEVTGKKYFSVADCSSGFFHIKLAKGHEERSAFICHMGLFEWLRCPFGLAGAPTTFQRAMEEVQMCSATFLVYLDDCIVGSMTEDEHLRDIDIFLKTMAEVGFRLKPEKCRFALGEIRYLGHLISEKGVRIDPKDLEPIQRLKKPANITELRSLIGMLSYFRKFIFGFAEILQPIYELTKNENTTEWGQIHENALEELKQRLMTAPVLAPPKFGKPFVVETDASTKAIAGCLLQENRDGEVHPISYFSRVLTKHEKRYSVVELEALAICASLKNFRPYLEGAESTVITDNSALTSLFRRKDLEGRLSRYQLAIMAFDVDIIHRPGKRNQFCDHLSRYLEESAEPQINWLNVEAKTSQSEMVEAQKRDAEIQKIMIRLKTTVDGEESNENEKKRWKLFEELLCIMDKGDLRSKIMGEYHSAFQGAHLGEKRTREKIRRSLFWEGLDGDVQRFVKTCDACQRRKIIGIQMSAELCPIEPASRPCERLHLDLMGPLKTAKGGFQYILMIVDSFSKYMMAIPLREQSATTVTAVFVDKFLCLFGLPKIVVTDCGTQFLSTTFESLAKIARQQKKRKI

SEQ ID NO: 150638 - protein, 139 aa, Heterodera glycines
  Coding regions on vcDNA: vcDNA=SeqID_77061; Strand=+; Position=1-420
  Homolog annotation: Hit_ID=XP_227715.2; Match level="QueryCoverage =95%, HitCoverage=11%, E-value=2e-15, Identity=37%"; Hit description =similar to lymphocyte alpha-kinase [Rattus norvegicus]
MVVVGIAVVGILAVLTGIVVVGNAVVGILVVVTGIVVVGIAVIGILVVVTGIVVVGIAVIGILVVVAGIVVVGIAVVGILVVVTGIVVVGIAVVGILVVVTGIVVVEIAVVGILVVVTGIVVVGIAIVETELLDGSPSF

SEQ ID NO: 150639 - protein, 138 aa, Heterodera glycines
  Coding regions on vcDNA: vcDNA=SeqID_77062; Strand=-; Position=1-417
  Homolog annotation: Hit_ID=AAC39772.1; Match level="QueryCoverage =100%, HitCoverage=43%, E-value=3e-27, Identity=49%"; Hit description= hepatitis A virus cellular receptor 1 long form [Cercopithecus aethiops]
TTTIPVTTTKIPTTAISTTTIPVTTTKIPTTAIPTTTIPVTTTKIPTTAIPTTTIPATTTKIPITAIPTTTIPVTTTKIPITAIPTTTIPVTTTKIPTTAFPTTTIPVRTAKIPTTAIPTTTIPATTTKIPITAIPTT

SEQ ID NO: 150640 - protein, 37 aa, Heterodera glycines
  Coding regions on vcDNA: vcDNA=SeqID_77063; Strand=+; Position=1 -7,375-481
MPVLLFLMCWFCPICPLAKKLRERKEEEAENSGEMDE

SEQ ID NO: 150641 - protein, 177 aa, Heterodera glycines
  Coding regions on vcDNA: vcDNA=SeqID_77064; Strand=+; Position=1 -52,111-153,220-435,494-659
  Homolog annotation: Hit_ID=CAE59843.1; Match level="QueryCoverage =81%, HitCoverage=28%, E-value=2e-29, Identity=45%"; Hit description =Hypothetical protein CBG03316 [Caenorhabditis briggsae]
EIYERAVKPLREKLWDGLLQMLINYDWVPVPLAYSQVYSQVVFLATRVYFLLCLFGRQFRIWEQRDSMAYFEYYFPLMTFLQLMCYMGWLKMAESLLNPLGEDDEDFESGYIIDRNLAVGMTGYIIDRNLAVGMTMVDEFYGQLPTQKPDKFGKEGEVPSAYTELAGVSHWHFANSI

SEQ ID NO: 150642 - protein, 41 aa, Heterodera glycines
  Coding regions on vcDNA: vcDNA=SeqID_77065; Strand=+; Position=1 -89,264-300
MKIHCIFFILLINELFVVPLIFGQPIKEKSVLEGVPVTLNE

SEQ ID NO: 150643 - protein, 569 aa, Heterodera glycines
  Coding regions on vcDNA: vcDNA=SeqID_77066; Strand=-; Position=1 -107,650-821,925-1992,2234-2497,2847-2945
  Homolog annotation: Hit_ID=T13606; Match level="QueryCoverage=78%, HitCoverage=30%, E-value=3e-09, Identity=21%"; Hit description =hypothetical protein 87B1.5 - fruit fly (Drosophila melanogaster) emb|CAB10975.1| EG:87B1.5 [Drosophila melano
MERNLQQQQQQQQLEMGNNQFRKSSPDNLDGMALKSVIKKRDRLSFALVDERERQQTPSCCPPSSPGKVRRRRTAHSVTPLLDARLFLNGLDESAVERTADGAAEMKKDGIIIEQSLEAVVDQALMRKEIVSARETKCTKIDEEKKGQQQEEKHMEMVAQQMANSTLQHEKLVLASQTMPTEEAKFSARQQHREQQNMPPKEENLLQNEAVPPSPALVTMSTKAKKHLLTDRNSTAETQQQKRQRVKANAQRTHGQTVSERVGGQQQQFGTNNNRTAAASTINVKPNALRVLPPAAAGVLRTAQKRTNNNLAPAPKCTANITADPSSAPKCAPAVCRIRIVAKPNSNNNNVHGITTTTIEADQHQQKRAPHQQQMCSSSSSMPDRPLKPSQVKACQPKVQKPAAAHGGVGTLGQKATVTASAGPFKTDKNVTTIGGGCATATATAAVVAKMKPSSATPTSNNSNGSSTGSRRSVTTAATNTTVGSCQMMMMICRGQTPQCQEKQQQQKDGKAMAPAQPTQPQQQQHLRATKPTLTRRLSTSSRPTLVHSTGRSCTTTAGSREREKPKWI

SEQ ID NO: 150644 - protein, 690 aa, Heterodera glycines
  Coding regions on vcDNA: vcDNA=SeqID_77067; Strand=+; Position=1-2070
  Homolog annotation: Hit_ID=NP_921817.1; Match level="QueryCoverage =94%, HitCoverage=37%, E-value=5e-31, Identity=24%"; Hit description =hypothetical protein [Oryza sativa (japonica cultivar-group)] gb|AAP54104.1| hypothetical protein [Oryza
MATPITRRCSAFHKGWQCAAAAAKHFPEYCDSGKLGDKKCADCGAHLFSHEDSNICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEKMIQVHHPAVQAYKQAREQLTELLQQQNQEELRFFRMTLLDSRRAPAGLKDPKLHPHQIITPSTGEGMFAIHADPTGAPPPKGIWVENKQGQLNEIAPFSPWTDSLTYPLIKPMGDDGYTTGIKYAKPPSRKRKGVQNASGLFDSEAESDNESCETQSIASSDAGSVADSDAESVASVSSQHRRIDKSKQFISLRDYCKYYLAIRDENVELQYHHILSCGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLE

SEQ ID NO: 150645 - protein, 42 aa, Heterodera glycines
  Coding regions on vcDNA: vcDNA=SeqID_77068; Strand=-; Position=1 -103,548-573
MAPPSMSNTVLMPDIGDCAAAEAGGASFTAPSHKESTDIMRK

SEQ ID NO: 150646 - protein, 103 aa, Heterodera glycines
  Coding regions on vcDNA: vcDNA=SeqID_77069; Strand=-; Position=1 -123,659-847
MRIYLCLLSLLISVHYATVNEPQNKTNDDDSNLTLPSVKLANNVKLADENDQQKNNGPPKNGVAFVVEGIERSDFGQSLRTSNFQRSRAALGIIKLQKLKLLT

SEQ ID NO: 150647 - protein, 107 aa, Heterodera glycines
  Coding regions on vcDNA: vcDNA=SeqID_77070; Strand=+; Position=1-324
MSEMAELKAIINRLSAIEKLISTNNNNTLATEMTAQFSAIADRLGEIERKLNNNNNGIGSAEDKERKRSLVLIGLPESEEEVPSLRAKDDAKTVEEVLDRLDVEVCP

SEQ ID NO: 150648 - protein, 257 aa, Heterodera glycines
  Coding regions on vcDNA: vcDNA=SeqID_77071; Strand=-; Position=1 -174,312-398,615-781,990-1107,1211-1438
  Homolog annotation: Hit_ID=CAE57612.1; Match level="QueryCoverage =84%, HitCoverage=34%, E-value=8e-28, Identity=37%"; Hit description =Hypothetical protein CBG00593 [Caenorhabditis briggsae]
MVTIQSNSQTLFLSSSRGVWSENKALSVQLPALAEGEALASPLVSDVDSDGQLDILMPVCASAACTIVARLWCYSRQTVRTVQIDFRQVTLVPEIDGQTIVPFRIGDFSQNGFPDLLATVTPPGGSKTPMIFENIPDDGSYPRKFELTKKPERILPPLNDKLSGLTMSAFFDLKEDGNLDMMVEYLDEVKGSSVNFIRCDDKGDTTFLKVQVFTSTECTGPCCEQQYLPSSHSTNGVRQIKIGQSVVRVGDFYRQQL

SEQ ID NO: 150649 - protein, 240 aa, Heterodera glycines
  Coding regions on vcDNA: vcDNA=SeqID_77072; Strand=-; Position=1 -165,796-934,1260-1409,1483-1751
MPKSLVMSLLASVTAASIVSIGDKPMQPIPGRVCAIADMDKDGNTDLVVQQNDVLTFQADLNIIDKVKALFTTTAESQYAAILYLNDGNDTFTEHQVCDENSLEGTTPVSPDPGPPTPPLHCPTKFLDHPTLVDINGDGVTDLLGFVQRKSADNAKEFTELFCLEGVRHQSSASVPKFRHCEHQFPPVPSGGVFPGFTPIFADLDKDLSAEFVFLAADKRSLVVWSQSRFISFCSFLVTL

SEQ ID NO: 150650 - protein, 536 aa, Heterodera glycines
  Coding regions on vcDNA: vcDNA=SeqID_77073; Strand=+; Position=1 -41,456-2045
  Homolog annotation: Hit_ID=S08405; Match level="QueryCoverage=95%, HitCoverage=44%, E-value=8e-78, Identity=34%"; Hit description =hypothetical protein 2 - silkworm transposon mag
TIVKISMKETLFLYLGFGLRVLANPITTDASAVAYAGALMQSADENQMHAVGFWSRTLNSTEAKFPPTHVELAAIVHAVQNFKPIIYGAELIILTDHRPLTFLFSKSSSNPKLNRWLMSLQEFEPKVVYLEGKANRVADALSRVPIKWDQIESKCKEDIPFLLVTDEENGFEINREKIEKETSLDPILSQIVSKIKENWAEPIQEELNVYYKQRDQLYLEGNLIRKKPLRQIVIPEKMRNSVLKLVHRAHFGIVRNKARARNQIWWPEIGDDVENFVKSCWICQKNGSTPKTDAAYKWPDSKFPFERVHADLAGPIWGTNFFILVDAYSKFPFVYQMNSTHSSALINSLRELFGIFGSPKTLVTDNGTQFVSNEMETFLQGEGIRHLTSPTYHPSSNGEAERFVRTFKEGMGKMLEDGKSIKIAQFIFLQEYRATPSEGQSPSQKFLGRELRTELDKIKMSASAIERKRRLLPEANREKNLVTKNFKPGDLVWVKEPNGWTPGVLLRPIGERIWKVEPEGCTISKSAHLDQLKARR

SEQ ID NO: 150651 - protein, 133 aa, Heterodera glycines
  Coding regions on vcDNA: vcDNA=SeqID_77074; Strand=-; Position=1 -7,301-695
MPGAPVTVASVNIDTDTLLRTRHTDAKHSNDDENRENDGKFDDANDDGEDGEDQQKGGEETVAKEGEEEEDNGMGIERRGRHNAKAETIGGAQLAPMVSVRRGTVVAETRGGNYKVSIPFRALIYTGSDPKLF

SEQ ID NO: 150652 - protein, 167 aa, Heterodera glycines
  Coding regions on vcDNA: vcDNA=SeqID_77075; Strand=-; Position=1 -135,625-990
MVVSELFVSDCNVRIELNDGTTVAMQKRRWDGGDKSGGRREAMDWRFRPFETREIGHAKVLGNLERNSTAFIVAKLRRMGSGDGWRTTHSPSSPSAPNDATAQRQQKNDGSDDRKMGGDDSDAKKAVPKEQQGQLWHNHRKKQPNAGEEGEGDDPFAQLLVVAIGVQ

SEQ ID NO: 150653 - protein, 120 aa, Heterodera glycines
  Coding regions on vcDNA: vcDNA=SeqID_77076; Strand=+; Position=1 -90,397-669
MPISCGSTTSQSAELAEETNGNQYDDNIKENMCRPVQCIVSVIQSPPSLQIANEQFVDSAFAIVHNVQSGGDMIIQNATMCTQLPCYFLLVSTKNGHLTHGILKVENYKTMAAMPKTCPW

SEQ ID NO: 150654 - protein, 922 aa, Heterodera glycines
  Coding regions on vcDNA: vcDNA=SeqID_77077; Strand=-; Position=1 -801,1021-2549,2801-3239
  Homolog annotation: Hit_ID=NP_725510.1; Match level="QueryCoverage =62%, HitCoverage=24%, E-value=5e-13, Identity=20%"; Hit description =CG18255-PD, isoform D [Drosophila melanogaster] gb|AAF58087.2| CG18255-PD, isoform D [Drosophila melanoga
MDEFYIVLPSNTPGSTNTASNFTVRLPHTLELDSNWTVALASIIYPYSFPSVGIDEDDIISIKLVNPNYRFLDDKKFLHIELKVPSMQFSSVEHLRLTLNSLIREVYQQQQFSSGHDGASRTKRQVTDLFFHENPVDYWEKIGELRTKQEQFEKEVKQEESELSADTTDVERKKLIQSELPLKRIRMQRKKEELEELERAAERRDQESPENEQRKISDFFQHHPEDYNKKLNESRLIFTQHLSGLQEVMSKYIGEKDINKIRQLNTEKIEELQAKAVGLKDNASFEKQIERAKQMIEYRRKRFAALEFEAKKRDEQQQFVAAAANTITAPTASALIGREALKKRTGISARTDGEVGDKADVGPQTATTTTHGEVLKEKILEQQKHTDNDDKADVGPQTATTTIHGEVLKEKILEQQKHTDNDDTADAGPQAATTTHGEAVREKILDQQKHTDNDDTADAGPQAATTTHGEAVREKILDQQKRTDDDDKAAVGQQTIPTATKTRGETLKEKISQEQKHLVDDKSNSANAKQDDGSGTDEKIAHGQTLIARLKQSEEQKKEWGDPPQDNDDDGRAPKHGEMLWKLLRSTVPTNQQQMGDVIHHQFADAEQTRGQVLMELLKNILEEKTDTADAQQNYHHLQKSAYLSSTLRRGEALKELIKKTQNEPLHKSSAKTRGEILKLMLEHMKFSREEEVSFEKLVAKQQKESTAAEFVFNDLAQRFVLITGAGVLHVDVSKHLAYVLGFDNTRLFHGEQARYMPDLSGGVKQLYVYAPKLIEDNKMTHVTFNPDSINWGPLLALEQVGGGEMQYFVGTRHQRGAGLLRNVARFLMPVASNMLKAVSREGVTAGSRIMEDLSQGKALKESIQAHAKHGMENLAEKLKQCGKGAPTRKRKRPVKKVKVPLPMHSLRGNKRQAIDQLTFAP

SEQ ID NO: 150655 - protein, 113 aa, Heterodera glycines
  Coding regions on vcDNA: vcDNA=SeqID_77078; Strand=-; Position=1 -81,216-317,371-496,1893-1925
MRCSFALSLLFAVGVQLLILRMANSEKEFVMAKREMRDGTVPLSFKMDRNAFRMSFGKRNAALLLPFPAVRSSVPRPLDIDRNAFRMSFGKRMPISDGSGERMENVILIIFRF

SEQ ID NO: 150656 - protein, 19 aa, Heterodera glycines
  Coding regions on vcDNA: vcDNA=SeqID_77079; Strand=-; Position=1-58
MANWQCFFVSDHWPTLIAY

SEQ ID NO: 150657 - protein, 40 aa, Heterodera glycines
  Coding regions on vcDNA: vcDNA=SeqID_77080; Strand=+; Position=1-122
MDKGGEVTGGRTVMCDGAAVEYRGTLFIRRDAYREEKLPY

SEQ ID NO: 150658 - protein, 162 aa, Heterodera glycines
  Coding regions on vcDNA: vcDNA=SeqID_77081; Strand=+; Position=1 -355,440-573
MLGKNIHGIELPVGIFHRLRQFTPSLLNECPSLRISNAYYFCFFPEFPCNDNAAASDGQAVAKWLFTPLQDNVPKVFNCWLQNDEANLTSKVEVLIDLALLWALGFSDKNINNYIIKNCFCLGFISVQFHHFHFVSFAFCFLRCTICSNQRIDSGAIGVEKN

SEQ ID NO: 150659 - protein, 24 aa, Heterodera glycines
  Coding regions on vcDNA: vcDNA=SeqID_77082; Strand=-; Position=1 -38,233-269
MVFHSITEKILDSVNHSHQMTKKK

SEQ ID NO: 150660 - protein, 33 aa, Heterodera glycines
  Coding regions on vcDNA: vcDNA=SeqID_77083; Strand=-; Position=1-142
AASRPRTGALRPFFKFCWAYTCASRPFLNLLGY

SEQ ID NO: 150661 - protein, 296 aa, Heterodera glycines
  misc_feature (1)..(1): Xaa can be any naturally occurring amino acid
  misc_feature (165)..(165): Xaa can be any naturally occurring amino acid
  Coding regions on vcDNA: vcDNA=SeqID_77084; Strand=-; Position=1 -289,342-669,974-1111,1155-1217
  Homolog annotation: Hit_ID=NP_501141.1; Match level="QueryCoverage =99%, HitCoverage=27%, E-value=9e-61, Identity=43%"; Hit description =solute carrier family 12 member (4H981) [Caenorhabditis elegans] gb|AAA81476.1| Temporarily assigned gene
XDKLLAGAVNGMALLVAKGITEFPSNVKLSGYLDVYWIVRDGGLCVLITFLLKQSKVWRSCKTRIVAVARPQENSAKLKKQLQHYVYQLRIDAEILVTELNDPELSTTAYERTLLMVTELNDPELSTTAYERTLLMEERTKMLKQMQRRGMPSLQSTQPKRTLEXLTDPFGANGLPLSVAFQPNTQSQEEETQEEQTKASTDEDASEEQTETKGRKEGQGTTEVHKMHGAIRLNELILEHSRCSQLVLFSLPKPPFFEDEDDYIQYLEVISDNLQVISDNLQKVLFVRGTGAEVIT

SEQ ID NO: 150662 - protein, 116 aa, Heterodera glycines
  Coding regions on vcDNA: vcDNA=SeqID_77085; Strand=-; Position=1 -91,448-705
MHGSIGVGDFIIGPDSSDSDGKENSGQGSASTSFVAGQSTDSYISSLKAKIIELEKVKTELEVEKKRQEEANQQFYTYWCNENAKFEKVQNEFQKFQLYHCVRKAILDKIVGTNGG

SEQ ID NO: 150663 - protein, 608 aa, Heterodera glycines
  Coding regions on vcDNA: vcDNA=SeqID_77086; Strand=-; Position=1 -182,258-458,560-847,905-1035,1087-1258,1314-1526,1568-1666,1717 -1868,1924-2121
  Homolog annotation: Hit_ID=CAE69218.1; Match level="QueryCoverage =100%, HitCoverage=60%, E-value=1e-127, Identity=42%"; Hit description=Hypothetical protein CBG15258 [Caenorhabditis briggsae]
YAWQRECLEDERLVEGRENFVLWLPTGAGKTVVAELMMLRECVRWRRNCLLILPYVAIVQEKVISLSSFEEKLGIIVEEYAAAKGRFPPIRRRTAKSIYICTIEKANGLVNSLIENGRAHELGLVIVDEIHMLGEQGGRGALLEQCLCKLLFRPTNEQQQERVQLIGMSATLGNASELCRFLGANLFRTHFRPVALIERIKLHDKLFRVDEQGEWRMEKELEKGNLLERRDPDGLFKLLGNLLKGSVLIFCPTKQSCENVCQMLSNFSPKQLRHRADERNALIGRLMQLRHRADERNALIGRLMDEHEGLICPVLSACIRNGVAYHHSGLSSDERQLVEGAYKSGISGIISVICCTSTLAAGVNLPARRVIIRSPHVGREQLKKAQYLQMIGRAGRAGLDDKGDSIVILHHGTEAQTFKKMHEGPIEPCLSGLSDFKKMHEGPIEPCLSGLSDQVQLEGFFLDLIVLKLCSSLDDLFLCSSLDDLFRFLRHSLFGVQHTDDKLLSFVERTVQSLLDKKMFDKKLFPTQIGSATFNANFNPQMATQIGSATFNANFNPQMALDMCNDLGANLGKGIVLISHFHLLYNCVPLDVAVQVDWNLFYNEVSQS

SEQ ID NO: 150664 - protein, 489 aa, Heterodera glycines
  Coding regions on vcDNA: vcDNA=SeqID_77087; Strand=+; Position=1 -87,155-240,301-532,725-803,1405-1491,1540-1641,1690-1821,1872 -1993,2042-2102,2156-2340
  Homolog annotation: Hit_ID=CAE70028.1; Match level="QueryCoverage =87%, HitCoverage=49%, E-value=1e-74, Identity=37%"; Hit description =Hypothetical protein CBG16448 [Caenorhabditis briggsae]
VADGHRVKPMRVEALFVFPGERYDILIRGLISPRRRGLISPRRRLYRIIVETMEYINWDWTHTKVDVDIGWQLALFSNLISNYLDVDIGWQLALFSNLISNYLKVDWTHRQCTPEAKCNVLNCPFEQFPPSLNLTCVSAHLLESAEPIEDTELLEQKVFPNSFQEVFANMHADNHFDGWLFEHPFGIPYFNRDNLSRIARLCDTSESCSPKTNAHWDRSCDCDRSCDCFVHFNFTLGSVVQITIYNMGDMGNPHGPGYSHPLHLHGTHFYLVGYSHPLHLHGTHFYLVKVGFGGYHANNGSIWTMNKDIPCIDDKVRCVGLKWANSTWLGGRCVGLKWANSTWLGGNVPAMRQRPSSRDTVNIPVGGYITIRFRALNAGWWFSHCHLMLFRALNAGWWFSHCHLMLHNMGGTAFAFRVGTDEQMPKPPDGGTAFAFRVGTDEQMPKPPDAYPHSCGIRRKVKLGTPFLAFSGCQFQMFLMNLMTINMFN

SEQ ID NO: 150665 - protein, 345 aa, Heterodera glycines
  Coding regions on vcDNA: vcDNA=SeqID_77088; Strand=+; Position=1 -192,421-587,722-1000,1079-1277,1539-1725
  Homolog annotation: Hit_ID=NP_500145.2; Match level="QueryCoverage =89%, HitCoverage=18%, E-value=1e-92, Identity=54%"; Hit description =CRAG protein (4C711) [Caenorhabditis elegans] gb|AAC68958.2| Hypothetical protein F52C12.4 [Caenorhabditi
MYEVPFPSPARPRVLVELGSDMIAFESSDDSQTPLTGANFVETLKCLGTENLLYAMLLTLLEQKLLVHSLRPWLLTCVAETLCALMFPFSWNLPYIPQCPLPLGFVFNAPLSFMAGVDSRYFDLYEEPPSDVTCFDLDTATISQSAVRKLYQLSMLPKKPLKRLRAALDEIGTKISEKQPKKGSGAGGGAMDYEQTARRMHSELAIRDAFLRFMCCLMFMCCLMDGYTDFLCPIMDSPWKKGATDVCKLFDWEHFMQSRDKNSMEFYAKFRETTCFNRFIEERSTVEDKSVFYVFFDDCIAKLRAGEGNDFEKGANYKNNLVKIDNIFERIRFFFLINNLLKQTE

SEQ ID NO: 150666 - protein, 233 aa, Heterodera glycines
  Coding regions on vcDNA: vcDNA=SeqID_77089; Strand=+; Position=1 -174,314-563,796-1072
  Homolog annotation: Hit_ID=AAQ10514.1; Match level="QueryCoverage =75%, HitCoverage=9%, E-value=1e-14, Identity=29%"; Hit description=c- MYC promoter-binding protein IRLB [Homo sapiens] ref|NP_005839.1| c -myc promoter binding protein [Homo sa
MEQIGVPFHDQVCYRLLMHLCGAYGRPEMAIIVLKRMLNMGIIPNAITYKVYHKALIQSEWPSELSLSAIAAWRRVQFRLDVCARFRAMLPNSANILPPPATHEQKLNDMTTLSTTNTTALEEEEEDDDNSKDCSNIVQEIVPMKIVEIDEPICEQQQQLLTNHHFCNNNNNNNNNKITKGKSTTMANANLFDPLGASVELETALNNVSIVGNGTPVSRPPQHQHNPPPKPPR

SEQ ID NO: 150667 - protein, 138 aa, Heterodera glycines
  Coding regions on vcDNA: vcDNA=SeqID_77090; Strand=+; Position=1 -132,256-429,560-670
NLDTVSRDDSLVSDARSASTSSAAVGSPSILSLANKMRKRAMRTYNEVVGQGVINDLLERSGLNSPAQIFKEAKLNLSRSYRAADQSGLSTMSSSDDNLFAMSIHYWMNDILPDDDAELRDVWLRYSAGPVSSPEEYL

SEQ ID NO: 150668 - protein, 107 aa, Heterodera glycines
  Coding regions on vcDNA: vcDNA=SeqID_77091; Strand=+; Position=1 -172,318-469
MPEESNNNNNNTSNNNSVNANAQLWKLLRKKYILTFNLCHCCSQKLFNSTKNNNNSGEAASLIITQHLAISKTIARTLTLGIIKATHTTTTTAMKVDKWYITTMPDG

SEQ ID NO: 150669 - protein, 266 aa, Heterodera glycines
  Coding regions on vcDNA: vcDNA=SeqID_77092; Strand=+; Position=1 -129,198-513,666-957,1117-1180
MNSQQRQAERAQLRARLNLLVDEVDFVVQGLINNYQADGLINAAPADVQLMEMDNGHEQQQQPWELDPPMPAQQLEIGPQLPDAWELVPYQPPQWDQVVHVEQQQQQQHHQQQQQHQQGAWDEGWEEQLSPNALAQIQDEADGLRQDLTFWLDEGTAGIPDQQQQQQHPMQGWETPRTHFERPVPQRTPSPSGDAPAALIRELNFSDQCLLCMGEHGLDCEVTVRGNNCGCVTICDTCCENGWWARSRGTMCAPSVSAARRAESTT

SEQ ID NO: 150670 - protein, 137 aa, Heterodera glycines
  Coding regions on vcDNA: vcDNA=SeqID_77093; Strand=-; Position=1 -232,271-452
MEWLEMLPIKIILLIFLICTPNSAENITENAKSRNERDLISVGLIIGAVTAVLTPIIIGSVVAGYVIGSNTAHANNDQSKLVKVFFQVQVTVHDQLLSISLENFTNEFLFEQIERITKNPSIQSICLHGVVLLFAYN

SEQ ID NO: 150671 - protein, 32 aa, Heterodera glycines
  Coding regions on vcDNA: vcDNA=SeqID_77094; Strand=+; Position=1-97
CGRSTKNSVWAIHKKSQCGQSTKNLSVGDPQK

SEQ ID NO: 150672 - protein, 16 aa, Heterodera glycines
  Coding regions on vcDNA: vcDNA=SeqID_77095; Strand=-; Position=1 -33,373-390
MTRCLVYRFTRNVSLN

SEQ ID NO: 150673 - protein, 30 aa, Heterodera glycines
  Coding regions on vcDNA: vcDNA=SeqID_77096; Strand=+; Position=1 -26,253-319
MGYQMVPRIKSLCHIVNVIQFEVLIGHIKI

SEQ ID NO: 150674 - protein, 47 aa, Heterodera glycines
  Coding regions on vcDNA: vcDNA=SeqID_77097; Strand=-; Position=1 -40,88-191
MWSMPNLDEICFFDLKGTKRRHTRSGQIEIFLFYLSKMELPVSLNAC

SEQ ID NO: 150675 - protein, 200 aa, Heterodera glycines
  Coding regions on vcDNA: vcDNA=SeqID_77098; Strand=-; Position=1 -504,550-648
MTYFKKVNNESSQNLSKSTLERYLSRIKTSVGKYSTKADETKYIARQCITKNDQEKLFLIGKEQEDNWRKFGVTLIYNNKFYISCIKCQIIQQKLFHPEINQLEEYIRNHKMPAIDATEMFKWASNIDFLAAAKLFQLNVIVCSPNIQTSQSNIKYTWAVYSPDSNNSLSISLKSDINSIFVYYDCHGHFEAIINPQEIN

SEQ ID NO: 150676 - protein, 177 aa, Heterodera glycines
  Coding regions on vcDNA: vcDNA=SeqID_77099; Strand=-; Position=1 -123,1369-1601,1657-1834
MPNWCHLNGKINFLALIYCFNQQIQLLRTIEGEDGKPIQTNGFQKAESFDVATDTETLSEQSLSFHYPTYNSVRRSYNRRRQQAHGISTDSYNLPESLLITRFGSIKLALNKELSSQDNWVIYRNREDGIIIFATKTASQAMQKCPIIALDGTFEVAPKPFMQLYIVHGLVLDFIFI

SEQ ID NO: 150677 - protein, 310 aa, Heterodera glycines
  Coding regions on vcDNA: vcDNA=SeqID_77100; Strand=-; Position=1 -456,863-1156,1415-1595
MNESVLDLMKRGIETYNGLPDQALIQSQPKPLLLVLDDLMLNVGSDFLDLLFTRGSHNWNVSVIFVTQSLYGRNIRTARANSHYLVLTRNPSGQLQVRTVGSQLFPKRLNYFMEAYNEATSQPFSYLVINMHPNAPENERLTSKIFPGESRELNIWSRKLLQLHRHNNKMKHTKKMLLVPESEYLALINLLKGGAGGTDSLQAEKAAIDASIQKNLNDNKTGADVKMKRHSWLYKQRHQIKDMIENKPQKLKTGPEHYDKLHEMIERNPEKYGVDKSSGEILTNFKKPVIRSNYIDSLMYLTGQRADVPK

SEQ ID NO: 150678 - protein, 107 aa, Heterodera glycines
  Coding regions on vcDNA: vcDNA=SeqID_77101; Strand=+; Position=1-324
MSHQPFANFEIVRLEAMIIGLEIDKEQLQRDVYHLKNRKTQIHNKKFELLQQKEQLIREINVLRETKATLVNETKDLREEILELRDTDGSTDDPLCAVCYTRKVVSV

SEQ ID NO: 150679 - protein, 46 aa, Heterodera glycines
  Coding regions on vcDNA: vcDNA=SeqID_77102; Strand=-; Position=1 -52,215-300
MASIWVPIRIPNPDRKETKVFIEIIQKLIAKETRAMNRLRRDQKEK

SEQ ID NO: 150680 - protein, 89 aa, Heterodera glycines
  Coding regions on vcDNA: vcDNA=SeqID_77103; Strand=+; Position=1 -95,558-732
MGAAGYQGTPGNEGEEGREGAQGRTGPDAAYCWRQRWRSLPPKAPKVTLNFTSTVEEGEENNGETGNVTTKMTTLANDQTKRKVGPKKL

SEQ ID NO: 150681 - protein, 228 aa, Heterodera glycines
  misc_feature (102)..(102): Xaa can be any naturally occurring amino acid
  misc_feature (196)..(196): Xaa can be any naturally occurring amino acid
  Coding regions on vcDNA: vcDNA=SeqID_77104; Strand=-; Position=1 -27,490-1152
  Homolog annotation: Hit_ID=CAE73973.1; Match level="QueryCoverage =99%, HitCoverage=31%, E-value=2e-35, Identity=44%"; Hit description =Hypothetical protein CBG21601 [Caenorhabditis briggsae]
LRRRHLRRPCHPQVSAPQMSAPQVSLWLAPQMSAPQMSAPQVSSKQVSAPQMSAPQVSLWLAPQMSAPQMSAPQVSSPQVSAPQMSAPQVSLWLAPQISAPXMSAPQVSSPQVSAPQMSLWLAPQMSAPQMSAPQVSSKQVSAPQMSAPQVSLWLAPQMSAPQMSAPQVSSPQVSAPQMSAPQVSLWLAPQISAPXMSAPQVSSPQVSAPQMSAPQVSLWLGAANLSS

SEQ ID NO: 150682 - protein, 231 aa, Heterodera glycines
  Coding regions on vcDNA: vcDNA=SeqID_77105; Strand=-; Position=1 -127,240-350,463-614,724-1029
MDNPEQFVDEKEAKQIINKQCYHNFGKMDVPMSNAHITVPIPVQLCKKAYLSKLLTYYESSDSSCSQFQRYCYMLNCSTMNNNNQIELITEWGCTDANYDTDDLIHGTGRALAQAYIGPIPDNSLCVSAVALQTNAKLVMKLWATKPQLANVLQTLIYAMQSNAMTVNLPINNLFHSEFGPNPFFCLKVISQTNLSKSGAVLRAFQMFPSFAWIKLLNLASDLTSVCANVI

SEQ ID NO: 150683 - protein, 53 aa, Heterodera glycines
  Coding regions on vcDNA: vcDNA=SeqID_77106; Strand=-; Position=1 -25,126-262
MAKKVGVRAIIFCFFVGNASRTLAQNRKSEHPSENQTISPSRKQSTKFQKNLL

SEQ ID NO: 150684 - protein, 186 aa, Heterodera glycines
  Coding regions on vcDNA: vcDNA=SeqID_77107; Strand=+; Position=1 -39,117-320,409-603,933-1055
MAFPYVVNLCANEKPNWSFLLTLGPKLMKFIKINTKLPPELNNELLHFVPEFYYRRVLISSNFLVYYFFNNGKRGKRLKCKDVAEREAGTTYTFGAGTPIRSFLPLDERHRVANFLATMNIYQFFHPAEGGGHYALVSLRMSGPDERQQIRSYFQREGIAMNFDNRFCTSGIRLFLMNNLVIIQYT

SEQ ID NO: 150685 - protein, 91 aa, Heterodera glycines
  Coding regions on vcDNA: vcDNA=SeqID_77108; Strand=-; Position=1 -132,757-900
FSAVRYERKIQPKEEASFDYAFIPSDAFVGRPLGLVVNLHYVDTKRNPPNWALLAIGNSRRRSPAEKGKTKGGTMTKRKVCEFAKQSVILM

SEQ ID NO: 150686 - protein, 56 aa, Heterodera glycines
  Coding regions on vcDNA: vcDNA=SeqID_77109; Strand=-; Position=1 -70,119-219
MSTNAASPTPKATTAPSVQRKSSTGEAQQPPPQKRPKRVVDEAELSEGEILSDEED

SEQ ID NO: 150687 - protein, 184 aa, Heterodera glycines
  Coding regions on vcDNA: vcDNA=SeqID_77110; Strand=+; Position=1 -134,870-1046,1164-1332,1384-1458
  Homolog annotation: Hit_ID=NP_497858.1; Match level="QueryCoverage =100%, HitCoverage=43%, E-value=1e-19, Identity=73%"; Hit description= DNA replication licensing factor Mini Chromosome Maintenance (84.9 kD) (mcm-5) [Caenorhabditis elegans]
MEGGAMVLADGGVVCIDELTTMREDDRVAIHEAMEQQTISIAKVRASAIGHSDHCASTRGGGPPQRGACQNGIGSVCGRTPRGRSTPTVQSVDHCCGAERQSVGPFSVGVEGFTSAEDQESFTRVEKQLKKRFQVGTYASEQLIIEEFARQGYPEGLVRKAIDFYVRRGDLQYRMQRKLLYRFK

SEQ ID NO: 150688 - protein, 40 aa, Heterodera glycines
  Coding regions on vcDNA: vcDNA=SeqID_77111; Strand=-; Position=1 -21,516-615
MPSKQQMITKCRSNIYELNDAIMAKENDHEMRTSARCVYR

SEQ ID NO: 150689 - protein, 44 aa, Heterodera glycines
  Coding regions on vcDNA: vcDNA=SeqID_77112; Strand=-; Position=1 -93,242-283
MIPSMLNLDASGKSYGVDQKLIFYGDQLFNQCILGVPVHYKGVI

SEQ ID NO: 150690 - protein, 144 aa, Heterodera glycines
  Coding regions on vcDNA: vcDNA=SeqID_77113; Strand=-; Position=1 -31,369-549,1254-1428,1504-1551
MFSWKSPGPPDKISNNGSFPTISDSVKVITNAFEINLEKAPNKVYQYELRFSARYLNTKVDIELSRGPHNDESNETRRELNLSLWQILLDENKEFFGKNKNMFCYDCERQLYSTKYLTARVFQIKEENKIRERIFKFILIFSAA

SEQ ID NO: 150691 - protein, 31 aa, Heterodera glycines
  Coding regions on vcDNA: vcDNA=SeqID_77114; Strand=+; Position=1 -31,1048-1112
MEISFNQKIKLISFINRKGIGMKILHCLIDY

SEQ ID NO: 150692 - protein, 33 aa, Heterodera glycines
  Coding regions on vcDNA: vcDNA=SeqID_77115; Strand=+; Position=1 -19,404-486
MAIPIDERFLFYGKWMCRKKYVFIKVGETKQKE

SEQ ID NO: 150693 - protein, 87 aa, Heterodera glycines
  Coding regions on vcDNA: vcDNA=SeqID_77116; Strand=-; Position=1-264
MEYRREKHRNIGEGVKAFGIWQNAGAGLEMGFHFLCKMPSQKCITQSKLNVNNSKIQLESITAQQIIHFCRSIGSRVSSRSIKTRRL

SEQ ID NO: 150694 - protein, 118 aa, Heterodera glycines
  Coding regions on vcDNA: vcDNA=SeqID_77117; Strand=+; Position=1 -105,452-703
MNGGVCIWSMIERIMTKEELRRRLLVVSIERSQPKYLPNNGVNAPTNLQCHGDIQYAAVNPVTAPSNAQKFLAQNQQKFTRQAFQMPEMNQEPRHFPTYLYPPGLAVIEFPITDIREP

SEQ ID NO: 150695 - protein, 294 aa, Heterodera glycines
  Coding regions on vcDNA: vcDNA=SeqID_77118; Strand=-; Position=1 -66,105-278,325-543,859-963,1009-1329
  Homolog annotation: Hit_ID=XP_525629.1; Match level="QueryCoverage =95%, HitCoverage=24%, E-value=2e-19, Identity=27%"; Hit description =PREDICTED: zinc finger, BED domain containing 4 [Pan troglodytes]
MKRVSKDLGFESIDCAAHVLQLCIKEGLKKIDEEERLKELIENVKKFVRKVRKSRVLTEKLAEFQSNEEILQTVLLKNTEVRWNSSYKMLERFLINRSAVNLLAIEHAELPKLNADDWTLLSSVKNVLAPIYEATLLLQNRNASSSIIIPLFKYTDDLLVENNASGSSSTDIFSQFEKDAEFDQLINTAPSPSPSALEIKQKAEVEVNEYWRDAKIKAKSDPYAYWEINSQKWPMIGRIVPKFLSPPATSSESERLFSTAGLISNDLRKSLAPENLAKLLFLHHNLILTGFSSE

SEQ ID NO: 150696 - protein, 119 aa, Heterodera glycines
  Coding regions on vcDNA: vcDNA=SeqID_77119; Strand=+; Position=1 -37,292-466,657-804
MEQPAGNESKVPPHEIRGIAPVGVLLNAFELNLSAVPDKVFRHELRFVAEYPNTKWGQADIQELTRELRNDGGQRVPLDKQTLQAEAQQLFPLALAFAASNEQIEKIEPTNRGSQHIYN

SEQ ID NO: 150697 - protein, 73 aa, Heterodera glycines
  Coding regions on vcDNA: vcDNA=SeqID_77120; Strand=-; Position=1-222
MALLLLTFFSFRFASPRHRWWWAPADCECVKHPFASAQMNVHQHVEPVADQRHAEAEFVDVHAFEGVEQDVVA

SEQ ID NO: 150698 - protein, 66 aa, Heterodera glycines
  Coding regions on vcDNA: vcDNA=SeqID_77121; Strand=+; Position=1 -185,682-697
MVAQIVVYKWRTVWRQMPAATLVDGGEQRQLQQVSKRTDRTLPIPQGPLPDQVVGFKGICIHLILY

SEQ ID NO: 150699 - protein, 203 aa, Heterodera glycines
  Coding regions on vcDNA: vcDNA=SeqID_77122; Strand=+; Position=1 -39,97-199,281-404,501-579,645-909
  Homolog annotation: Hit_ID=CAE60266.1; Match level="QueryCoverage =93%, HitCoverage=21%, E-value=2e-61, Identity=61%"; Hit description =Hypothetical protein CBG03843 [Caenorhabditis briggsae]
MVDVERLKVAFETCPPSSVRNVCIIAHVDHGKTTLADFLVSSNGVISARLAGKLRYMDCREDEQMRGITMKSSSISLFYEPLLLNLIDSPGHVDFVAEVSSAVNLADIAILVVDAVEGVCSQTESLIRQALSCKLDILLVLNKLDRLVVELKMREQEAHRHLQRLLESVNSCLSQAIHGQLLEEDWHTFEQVERTIKENQFIA

SEQ ID NO: 150700 - protein, 46 aa, Heterodera glycines
  Coding regions on vcDNA: vcDNA=SeqID_77123; Strand=-; Position=1 -69,616-687
MRTCAIPTTAPAQIALKRVEIAKDSAWRMSDSVWEQTPSTSKDAMD

SEQ ID NO: 150701 - protein, 400 aa, Heterodera glycines
  Coding regions on vcDNA: vcDNA=SeqID_77124; Strand=+; Position=1 -103,185-308,405-483,549-776,848-1121,1169-1314,1531-1779
  Homolog annotation: Hit_ID=NP_492611.2; Match level="QueryCoverage =89%, HitCoverage=37%, E-value=6e-94, Identity=52%"; Hit description =elongation factor, GTP-binding and Elongation factor Tu, domain 2 and Elongation factor G, C-terminal (1K
CPPSSVRNVCIIAHVDHGKTTLADFLVSSNGVISARLAGKLRYMDCREDEQMRGITMKSSSISLLYEPLLLNLIDSPGHVDFVAEVSSAVNLADIAILVVDAVEGVCSQTESLIRQALSCKLDILLVLNKLDRLVVELKMREQEAHRHLQRLLESVNSCLSQAIHGQLLEEDWHTFEQMESLLHFDPSKGNVLFASALYGYAFASEDFADLWTKRIFGQQKIGDKSPNDHREIVKAQLNANLFSSDHFFATNSKQILPGAEQRGKKPLLEQFVLEPLWELHRCALVEGDMDKLRQMAAKLSLPLLKGRRAEEVAKGGRAFTEMMRQWLPLSSAVVRACARMRSAQKAFQTNNRLEQLLPIGCEVGPARLCFCHSFYALSSFRSLRPLSSMPYATATPWTN

SEQ ID NO: 150702 - protein, 44 aa, Heterodera glycines
  Coding regions on vcDNA: vcDNA=SeqID_77125; Strand=-; Position=1 -28,447-553
MFDFVDKEKIKFLVENGGADIAIVASDGLTALKAAILTNKVEIL

SEQ ID NO: 150703 - protein, 62 aa, Heterodera glycines; identical to SEQ ID NO: 125756
  Coding regions on vcDNA: vcDNA=SeqID_77126; Strand=+; Position=1-289

SEQ ID NO: 150704 - protein, 53 aa, Heterodera glycines
  Coding regions on vcDNA: vcDNA=SeqID_77127; Strand=+; Position=1 -47,359-473
MAGWDVRKPKKKFLKTLKNFPYSKNIKVFHNHLNIRKSRSIGERTGERKGEFS

SEQ ID NO: 150705 - protein, 34 aa, Heterodera glycines
  Coding regions on vcDNA: vcDNA=SeqID_77128; Strand=+; Position=1 -15,75-164
MDNVWSFWLIKYLILFAIKQLSVHLITKNLGHIT

SEQ ID NO: 150706 - protein, 66 aa, Heterodera glycines
  Coding regions on vcDNA: vcDNA=SeqID_77129; Strand=-; Position=1 -64,145-276,404-408
MHFSLGLFLFFFPLLIFGQDLDFMPVPVRPISAVNSSAGGGGEHLQLRQEPRCLESVEAGTGTDTV

SEQ ID NO: 150707 - protein, 20 aa, Heterodera glycines
  Coding regions on vcDNA: vcDNA=SeqID_77130; Strand=-; Position=1-62
SVTVFIYIFIIIFMDISSNC

SEQ ID NO: 150708 - protein, 243 aa, Heterodera glycines
  Coding regions on vcDNA: vcDNA=SeqID_77131; Strand=-; Position=1 -91,181-285,350-462,1831-2253
  Homolog annotation: Hit_ID=NP_080025.2; Match level="QueryCoverage =40%, HitCoverage=63%, E-value=7e-23, Identity=47%"; Hit description =RIKEN cDNA 4933409D10 [Mus musculus] gb|AAQ88275.1| testis-specific zinc finger protein [Mus musculus]
EHLKPGPPKAAAHQPIYCYICGRQFGSKSIGIHQPQCLKKWKIQNDQLPKEVRRTEPEPPKIVRKADNSIDVNATNMAAYEASLAQLIRCENCGRKFAPERLQQKFLGGAYGNDVDNLDAPKQHILGGVGGEKQLKPEDAQPRRMRGAWPWIPPRNDTNGQEQRKFLGGAKVETVVIKPEDAQPRRMRGAWPWIPPRNDTNGQEQRKFLGGAKVETVMIKPPEADDQKQQQTILGGVHGNDAN

SEQ ID NO: 150709 - protein, 196 aa, Heterodera glycines
  Coding regions on vcDNA: vcDNA=SeqID_77132; Strand=-; Position=1 -63,289-479,535-683,754-941
  Homolog annotation: Hit_ID=NP_498776.1; Match level="QueryCoverage =39%, HitCoverage=96%, E-value=1e-11, Identity=35%"; Hit description =heat shock protein (hsp-12.2) [Caenorhabditis elegans] gb|AAA27953.1| Heat shock protein protein 12.2 [Ca
MAQIVKVTHDLATDLWDWPLQINLSADHLFIYCHHEERVDEHSWVKRELHRSYKVPEDVDAGTIRSHFTRNGILQLKAQKKNTIRRPSINVEVIAEETPKKGQKAQRKYGAAAEAAQKSGKKVVVEVEKEKMPVARPKSPRENLFTSADDFCSSQMPLGPFGWSANLFDLTDNLKEILLRSANNSSSSINALVGKS

SEQ ID NO: 150710 - protein, 173 aa, Heterodera glycines
  Coding regions on vcDNA: vcDNA=SeqID_77133; Strand=-; Position=1 -204,418-735
  Homolog annotation: Hit_ID=AAG21334.2; Match level="QueryCoverage =79%, HitCoverage=36%, E-value=2e-11, Identity=28%"; Hit description =hypothetical esophageal gland cell secretory protein 4 [Heterodera glycines]
MRLSPVLLLTIVVIVVLAKNAKDSKTDEAKRAKEPRNRPAMSRRRRSAYSAIWSELKLAKEATSIGCKVLHTKTCDAIARSERGTPTTLEDIVPSDVDALVEKATVALKKATETDGFNELSEAEQRRVLLETAEKQGEIVKVKQQDGTKMSTEQSGKSCGNRLFVSSTTNKMF

SEQ ID NO: 150711 - protein, 79 aa, Heterodera glycines
  Coding regions on vcDNA: vcDNA=SeqID_77134; Strand=+; Position=1-240
MIKVAQPVLKWLKEAEEGSDESEDDDLDVAFDDRSRNIGMTVEVEKGAKDGVTRVQNGQIATNGKMDDGNADDIDIDNI

SEQ ID NO: 150712 - protein, 86 aa, Heterodera glycines
  Coding regions on vcDNA: vcDNA=SeqID_77135; Strand=-; Position=1 -156,264-368
  Homolog annotation: Hit_ID=CAE75416.1; Match level="QueryCoverage =98%, HitCoverage=9%, E-value=2e-20, Identity=55%"; Hit description =Hypothetical protein CBG23406 [Caenorhabditis briggsae]
MEMLCLFSTDDLANVFATYCYAKGFIWSQEEPRNAGCWAFVGPRFQSAFGLTLKYAGRTEMEWFATSIIETHKEEEMHVMDSTFAQ

SEQ ID NO: 150713 - protein, 556 aa, Heterodera glycines
  Coding regions on vcDNA: vcDNA=SeqID_77136; Strand=-; Position=1 -119,196-254,300-347,424-516,570-669,812-873,937-959,1008-1161,1217 -1345,1386-1585,1653-1755,1803-1868,1927-2009,2106-2154
  Homolog annotation: Hit_ID=CAE75416.1; Match level="QueryCoverage =99%, HitCoverage=47%, E-value=1e-94, Identity=40%"; Hit description =Hypothetical protein CBG23406 [Caenorhabditis briggsae]
LLELFGMASPKFVFALFPSSSRSTPPPSEQFIFDGAHRGRLALQTVLFRFPPGQLFRKMRGLAEFPGDVKGIGDKMRGLAEFPGDVKGIGDVLVLTHQHSHFDYESPAGGRVHVSTLPNPSHLEVSLAVCSGKARARAVSLAVCSGKARARAQTLRSNRGGGGGGEGMEGEGVLPVHHHGDGAFTGQGIVWEVLALSQVPVLALSQVPHFRVGGAHFRVGGAIHLIVNNQIAFTAESAVGRSSLHCSDVAKAIDSPVIHVNAESVEDVIFAAQLALDFRQKFRKDVIFAAQLALDFRQKFRKDVFVNLICWRRYGHNELDNPRFTQPLMYHSVDAKRCLVDSFVDRLANRFTQPLMYHSVDAKRCLVDSFVDRLANKGLFSTDQSESIVSGHSEMLSEQLELVDSGRTPPIAEHLGGLWKGFCQAPAAVTKWDFCQAPAAVTKWDTGMDMDLLRQIGVASVTIPEGFIVHPHLKKTHIEARRRKIEQGQGFIVHPHLKKTHIEARRRKIEQGQQQIDWSTAEALAIGTALLHRVRIGDSAGGRATFTHRHAMLVDQ

SEQ ID NO: 150714 - protein, 317 aa, Heterodera glycines
  Coding regions on vcDNA: vcDNA=SeqID_77137; Strand=-; Position=1-954
  Homolog annotation: Hit_ID=CAE56862.1; Match level="QueryCoverage =61%, HitCoverage=36%, E-value=5e-13, Identity=28%"; Hit description =Hypothetical protein CBG24692 [Caenorhabditis briggsae]
MLSLYPQLTEAQKLSRVRILLTGQARAELDSIDPHPTTLGDALNHLKGKFENENTRSIARQALSICRQAPGEKVYEFANRLNEAIRTALAGENEGSIRKRLLEEFLERLNPDLQFEVKAGRPANYSGAYELAQHFELLLASKRETQISVADSMAELSTRVVTLALTQQRDGDFKGQDRRRCYYCRRQGHVVRDCRIKKKDENDSRRWGSNNDGRRWGSNNWHPRENWDRGRDDRGKILRQIAEDKGTKETIGKWRTDLQEKGNTLMGQKIKETAEPRLPLVGRKMKDMSKQIHHQAEYTLGDGDLPPQDWRVLFSWP

SEQ ID NO: 150715 - protein, 116 aa, Heterodera glycines
  Coding regions on vcDNA: vcDNA=SeqID_77138; Strand=-; Position=1-348
MTEQNMNNSQSGSNIQMPACSMGSDFDAIYFSQEENQTMANLLNRMRIFESSVYHQFRAVQQEISNFTAEIPKQKAIGRLEELERSMNDLENMEEMDNFENTEKWAKMETKVENLT

SEQ ID NO: 150716 - protein, 93 aa, Heterodera glycines
  Coding regions on vcDNA: vcDNA=SeqID_77139; Strand=-; Position=1 -113,747-915
MAIKYGQQIAKYRHKIAKISKYGHKMTKYGHKFFKLRVTRFNPIPDPVKKLGLGPGPGFSIPGNTHSDPVFGQILGPGVPYIKAINEKYTPKN

SEQ ID NO: 150717 - protein, 118 aa, Heterodera glycines
  Coding regions on vcDNA: vcDNA=SeqID_77140; Strand=+; Position=1 -319,725-762
MPNPLLLLIIVVQLFQAIHAQPARLRVPSADFFGGIGHRLSGDENVAMVFMLLMITILATNTAILIMQIVMFWTVISRPRAAAGEQQTEKKKTDNYKKMMSNTNGKVTSPVFLYCYYQ

SEQ ID NO: 150718 - protein, 58 aa, Heterodera glycines
  Coding regions on vcDNA: vcDNA=SeqID_77141; Strand=-; Position=1 -94,591-673
MHQFIIISFCFNYLLLVHFVVNKSINSQNIKKIEFFKFQSSRVKSVTNTADRLTSVLA

SEQ ID NO: 150719 - protein, 183 aa, Heterodera glycines
  Coding regions on vcDNA: vcDNA=SeqID_77142; Strand=-; Position=1 -310,563-804
  Homolog annotation: Hit_ID=EAL33598.1; Match level="QueryCoverage =66%, HitCoverage=24%, E-value=2e-16, Identity=38%"; Hit description =GA12162-PA [Drosophila pseudoobscura]
MKFQRNLCRFWRQILIQNLIRQTNSLISRSLGTKEGVVLVSFGTNDAFTGPGDAQFVKALAGTMDKFPNILFIWKLTQGIEGQLQFKWDNVITQSWINQKELLAHPKTKAFVSHCGMNSLLESVFHGVPIICVPFIGDQYYNAELMAFRHIGLAVDRENDQQTVQNDLINALSEALGRQQGKK

SEQ ID NO: 150720 - protein, 189 aa, Heterodera glycines
  Coding regions on vcDNA: vcDNA=SeqID_77143; Strand=-; Position=1 -157,416-634,1066-1259
MLVPITDATYKLTNKNDEVQLNVRYFVQKKTKPLHEFIMEGDLSKMNDRIYHEIADDFELMDELRAEKFDVGMAEAFCFTEYSLALFHFLQIAVTISTQSQPMSPFQLYLMGHLSKMNHSEGMPTEFIGISTMNFFRNGGERMKLLNMRTKEQMDEELKWRRDEVWKNCVEQTLAKIKEHINMVEIIII

SEQ ID NO: 150721 - protein, 16 aa, Heterodera glycines
  Coding regions on vcDNA: vcDNA=SeqID_77144; Strand=+; Position=1 -18,221-253
MTSKEHPTISEYLPIL

SEQ ID NO: 150722 - protein, 53 aa, Heterodera glycines
  Coding regions on vcDNA: vcDNA=SeqID_77145; Strand=-; Position=1 -93,756-824
MPTEPALDGTELSRSMCQKGGQTTNIAGQMQQNNAKGFGKSFSGRLIQCHAYK

SEQ ID NO: 150723 - protein, 43 aa, Heterodera glycines
  Coding regions on vcDNA: vcDNA=SeqID_77146; Strand=-; Position=1 -43,195-283
MIQFFHFSKFENLCVGLSNAYTSYLYNYKMRPTCSSTGGCGSP

SEQ ID NO: 150724 - protein, 75 aa, Heterodera glycines
  Coding regions on vcDNA: vcDNA=SeqID_77147; Strand=+; Position=1 -85,1317-1459
MGIYCEYLIGKKFNISIPLTAPLITTEGYAQLTAYTNLPSNKCKKIEESDGSVFYFIHNHEEHVKSRNIEEKLQF

SEQ ID NO: 150725 - protein, 60 aa, Heterodera glycines
  Coding regions on vcDNA: vcDNA=SeqID_77148; Strand=-; Position=1-483
FFAYQIFAINAHLFKKYSILLKCSVFCYILRIAVHLKASVIEQISQISRKVQAVAVKIVI

SEQ ID NO: 150726 - protein, 81 aa, Heterodera glycines
  Coding regions on vcDNA: vcDNA=SeqID_77149; Strand=-; Position=1-484
FFAYQIFAINAHLFKKYSILLKCSVFCYILRIAVHLKASVIEQISQISRKVQAVAVKIVYIKTMAIRISALGPFTKLMCFY

SEQ ID NO: 150727 - protein, 223 aa, Heterodera glycines
  Coding regions on vcDNA: vcDNA=SeqID_77150; Strand=+; Position=1 -177,495-628,1457-1521,2297-2589
  Homolog annotation: Hit_ID=CAE64859.1; Match level="QueryCoverage =42%, HitCoverage=27%, E-value=8e-14, Identity=43%"; Hit description =Hypothetical protein CBG09655 [Caenorhabditis briggsae]
MTQNKIAPRKQRTHELSWLRDDEMRALAKLTDVQSIWSLLRPILVERQVGTPQHDAVAHYLKTKVEEFGFTAEWDSFMAHTPMGVKRFHNLVATFDPLIHRRLVEFFTTLPFPHYLVAYLSLGKKVTAFPKQRQQFQFRHPQQWPVGPPSSPTWPNIGHRRRRRRATLFVPPPPPPTSSGGGAILAQLPQSRASVVPNSWPIPPQSPPPPANTRRGGGEKVDS

SEQ ID NO: 150728 - protein, 78 aa, Heterodera glycines
  Coding regions on vcDNA: vcDNA=SeqID_77151; Strand=-; Position=1 -106,440-570
MAPPPLDVGGGGGGTKSVARRRRRRWPMFGQVGDDVSYGYFLGFLVTIILKRNKRKSFVLNRTIQEIFYDSKILIDCD

SEQ ID NO: 150729 - protein, 80 aa, Heterodera glycines
  Coding regions on vcDNA: vcDNA=SeqID_77152; Strand=-; Position=1-312
LISSQKSCQLKTAKKAEFSKFFISIFFYSSKFFVIFSRLIEPVKSFRMISRLFDSVNNFKSYIDSKLAQTELARRSWPVP

SEQ ID NO: 150730 - protein, 19 aa, Heterodera glycines
  Coding regions on vcDNA: vcDNA=SeqID_77153; Strand=+; Position=1 -10,166-215
MCQKKQRKEKIKRKEKSAK

SEQ ID NO: 150731 - protein, 281 aa, Heterodera glycines
  Coding regions on vcDNA: vcDNA=SeqID_77154; Strand=+; Position=1-846
MRYDELRFPCRRQGGDGSSGTFCQQCRFVFPNADCFEAHRRRVDVAPAPPPGVAAAAAAAVPHGGEEATGGDGDDAVSLAAAVGAAVAPAFADRRRGRPHRSMCEERRLCEWCNVVVWARSGPHVCCRRPQQQQQQQQQENRAVLQQQQQNHHHQQPSRPKCEKCGGPHDPERTPHFIQPKQYARQCQWRRGAARGAHDNADDGAVANAATAVEDDDDDDNVSEEEGAAAVAERDGAGDGARGRVRKPKPVRFIFWDVECAQERVGEQQEQLEDGNQFVFK

SEQ ID NO: 150732 - protein, 421 aa, Heterodera glycines
  Coding regions on vcDNA: vcDNA=SeqID_77155; Strand=+; Position=1 -417,482-899,959-1360,1428-1456
  Homolog annotation: Hit_ID=NP_507780.1; Match level="QueryCoverage =96%, HitCoverage=24%, E-value=8e-30, Identity=26%"; Hit description =predicted CDS, DNA polymerase type B, organellar and viral family member (5T899) [Caenorhabditis elegans]
MDAVQQQQQQLPELLKHVPVLVCAEVICERCIAYGVDIEREPLRRAPQCQCGVPWRGANRRRWCSRIGEELFDDDDTGGPATAQQQQQQMPPDGLNPRRLRFFCDGEPGTGRGAMAQFVDFLLHTGPKGTRTVMLAHNGGRYDVHLLLEELQRRGERPKKAVQHGLRVYMLELRGTHQRQLICKDSLNFFHAALATLPRTFGLHGVLDKPFFPYHHIREQNLDVELPAGTLPPAAAYDPDRMRAAQRADFMAWYERELHRPGRQPFVLRRELLRYCWNDVRILRAACLRFRELVGECADGMEPFLAATTIASLAMAVFRQHHLRPHTMVHTPEGGFLRGRRASAESRRFFALLAAMRPDLGPLRTARWSVGEMVVDNSSWGGDDDGFRLDCVAYRRPPLRPLCIEFNGCYMHGCRECYPDA

SEQ ID NO: 150733 - protein, 225 aa, Heterodera glycines
  Coding regions on vcDNA: vcDNA=SeqID_77156; Strand=+; Position=1-675
MTKRPRSQSEYSPMSKQSDIHQLIDSQMKFAKNTIDALNKLQDSFTLDQKPILSHLISTLSTQFDLLNSSIVHLRSADPTQKDVPISAEELERQRSVVIIGLPEHNDISPSKRGEMDRSKINCLFDSLGIECGTISYRMGRPYNPAQKSARPLKVLLPSRAFQRQALVEWRNKSNTIRSKDPSLQNVRVRESLTKAQLDERRRLHAQCVEKRQRDGQDWIVYAGS

SEQ ID NO: 150734 - protein, 103 aa, Heterodera glycines
  Coding regions on vcDNA: vcDNA=SeqID_77157; Strand=-; Position=1-310
MLNPAIYCSCFVEQMSHKIDSKLSQGFEARIITPTLLRMVNDFERNLKNGKCKFSTTPAISEYFLRTIVAGKNQIYGQMKIGHSNTFRLALCQLLHLNNFLAE

SEQ ID NO: 150735 - protein, 61 aa, Heterodera glycines
  Coding regions on vcDNA: vcDNA=SeqID_77158; Strand=-; Position=1 -24,470-628
  Homolog annotation: Hit_ID=T37317; Match level="QueryCoverage=100%, HitCoverage=16%, E-value=3e-16, Identity=71%"; Hit description =probable Ca2+/calmodulin-dependent protein kinase kinase (EC 2.7.1. -) - Caenorhabditis elegans
MKVLDKLKLVKNYACFKPPPIRKKNANPLHLAVHRNPLQLVQREIAILKKLSHPNVVKLIE

SEQ ID NO: 150736 - protein, 33 aa, Heterodera glycines
  Coding regions on vcDNA: vcDNA=SeqID_77159; Strand=-; Position=1 -33,593-661
MSSDLAPPTIQTNPVETGDGAESSYIQLNQASH

SEQ ID NO: 150737 - protein, 192 aa, Heterodera glycines
  Coding regions on vcDNA: vcDNA=SeqID_77160; Strand=-; Position=1 -71,104-324,853-1001,1327-1464
MVPSTSILERDRINIFHLYTKSKLSFFLVFGNFPFCYSKIGLFVFKFDFHAKKRCSVLKLVISGLILVAFIMTLSFLFVFTELSEHVNKISSYVAQKSPFTACSLCTDIKVIGGEEYTKFEKWTDGNGCLRLTITCGLEQETEAIIQWFNEDKNMGASFMERFGQSNVIRSLECNARGRYELFENGNRGISK

SEQ ID NO: 150738 - protein, 24 aa, Heterodera glycines
  Coding regions on vcDNA: vcDNA=SeqID_77161; Strand=-; Position=1-73
MNFDAADIVEQGKNISRSPSTGTE

SEQ ID NO: 150739 - protein, 54 aa, Heterodera glycines
  Coding regions on vcDNA: vcDNA=SeqID_77162; Strand=+; Position=1-288
TSSGPKAWKICFLVIVKQLFELLAPILSFLFSLNPKKFNKTYVDLFCVLLKIYE

SEQ ID NO: 150740 - protein, 97 aa, Heterodera glycines
  Coding regions on vcDNA: vcDNA=SeqID_77163; Strand=-; Position=1 -128,715-880
MQFEDDSILIAFIEEIFLNLLNDKNFVDELQGENNFNNMRLKIVHWKCSPSGTDYDAYVAFLKKILLGRKFCKFCRLLALILRYFFAKYSIILKTTD

SEQ ID NO: 150741 - protein, 77 aa, Heterodera glycines
  Coding regions on vcDNA: vcDNA=SeqID_77164; Strand=+; Position=1 -138,399-494
MSGITSAVVNLEQTDSQTSCAVKPNLHPMLHNVIWHLLNWQNFLRHRNGKINYLFQQLVYTFFMLFIYFCHSFIPSN

SEQ ID NO: 150742 - protein, 60 aa, Heterodera glycines
  Coding regions on vcDNA: vcDNA=SeqID_77165; Strand=-; Position=1-180
MSLTRASNGTILSAKWSDGTNTHYGNPLKVADRTPWYTPEHRPKQDSPESNCVFMLLTNS

SEQ ID NO: 150743 - protein, 82 aa, Heterodera glycines
  Coding regions on vcDNA: vcDNA=SeqID_77166; Strand=-; Position=1-249
MKNVPPNHWIERMEWPPGKENEVVLTPCRRGEQKKVAPKCCFLLAFWPKALFECYLSTDERIDDAPAGQKVLEQKYEQCQKI

SEQ ID NO: 150744 - protein, 165 aa, Heterodera glycines
  misc_feature (25)..(25): Xaa can be any naturally occurring amino acid
  misc_feature (48)..(48): Xaa can be any naturally occurring amino acid
  Coding regions on vcDNA: vcDNA=SeqID_77167; Strand=+; Position=1 -216,966-1041,1487-1690
  Homolog annotation: Hit_ID=CAE59048.1; Match level="QueryCoverage =77%, HitCoverage=27%, E-value=1e-31, Identity=50%"; Hit description =Hypothetical protein CBG02331 [Caenorhabditis briggsae]
CFIGVLIILHGLAKKKSINFWQFAXNLCLLFGIKNLPIFFVSLFFWAXRPQFHWSEAQNWFPNDKFYINPHNIMAVLLQDYDKASNPTGGVIEVQAEITVQDISSLSETSSSFVVDLWFSQIWSDPRLVYSHLSCKSNLSLDESLAQQLWTPNLCFINSHDTYIH

SEQ ID NO: 150745 - protein, 66 aa, Heterodera glycines
  Coding regions on vcDNA: vcDNA=SeqID_77168; Strand=-; Position=1 -143,731-788
MRAWTKLYQYNVNGQRQSMMLPAVPTGTTTATTTTTPAHLCHNLEQIRIYYLRNKDTYEASIIQIN

SEQ ID NO: 150746 - protein, 21 aa, Heterodera glycines
  Coding regions on vcDNA: vcDNA=SeqID_77169; Strand=+; Position=1-68
LGIGRRHHISLAYSPTLKMED

SEQ ID NO: 150747 - protein, 392 aa, Heterodera glycines
  Coding regions on vcDNA: vcDNA=SeqID_77170; Strand=-; Position=1 -10,190-305,408-581,631-849,889-1119,1161-1268,1310-1630
  Homolog annotation: Hit_ID=XP_415979.1; Match level="QueryCoverage =86%, HitCoverage=36%, E-value=2e-31, Identity=26%"; Hit description =PREDICTED: similar to Zinc finger BED domain containing protein 4 [Gallus gallus]
MNFWRHTAEAIVAFIREALNDFQIQEEKISALTRDTENTMKKCIKEGLRSIEEEERLKNLLENVKRFVRKVRKSRVLTEQLAELQQKEEVPPTVLIKNVEVRWNSSYKMIERFIRNRSAVNLFSIDHCELPKFNADDWLLLSSIKSVLSPIYEATILLQNRSSSCSIIIPLFKAISFGLREDKDNRFSNIKKTIANAIELRLKQAEEQKNLVLATILDPRFKTIYLDSSRLNQYKDWLISEVESYHAKTDEIDLQIDVRDCSGSSSAGDIFSRFEKDAEFEQILNTATSPSPSALETRQKAEVEVNEYLRDPKIKSRADPSLYWEVNSQKWPMIGDVVRKFLSPPATSSESERLFSTAGLISDDLRKSLLPENLAKLLFLHHNLLLTGFSIE

SEQ ID NO: 150748 - protein, 231 aa, Heterodera glycines
  Coding regions on vcDNA: vcDNA=SeqID_77171; Strand=-; Position=1 -355,848-963,1064-1287
MSNLNPGNWWYYFERQGKATAKCKADGCSYSKTLNASLSTTVLTFHLKNHHPELYKQREDFVQAEKQKTEKKGQSGINPLKRAFANAFCGSSQQITDDEEKEAPISSKSPILIGLNAKRRHTAEAIVAFIREALNDFQIQEEKISALTRDTENTMKKCIKEGLRSIEEEERLKNLLENVKRFVRKVRKSRVLTEQLAELQQKEEVPPTVLIKNVEVLFFYISPFYIKAINF

SEQ ID NO: 150749 - protein, 71 aa, Heterodera glycines
  Coding regions on vcDNA: vcDNA=SeqID_77172; Strand=-; Position=1 -168,496-543
MRRNASSAGGGSVRSERGGGGGQKATTPAGMAQQNSNNNRQTPPQLRPEREEEGGNIIEACELRPTKKDYV

SEQ ID NO: 150750 - protein, 91 aa, Heterodera glycines
  Coding regions on vcDNA: vcDNA=SeqID_77173; Strand=-; Position=1 -186,427-515
QFSEGGSNGEKCQSVDDGLSCVPSRSDNRAHRVNAVNKQQRRTTLILVTIVLFFFFAWLPHNIREMVIEYDEQLLHRDGINYTYFLSMVTH

SEQ ID NO: 150751 - protein, 63 aa, Heterodera glycines
  Coding regions on vcDNA: vcDNA=SeqID_77174; Strand=-; Position=1-191
MARDRHFEKSLYLDLDLDSMLDLDLDFLDKNPGKSRSRKNPGSSGPGSRPGPGFFETHFKIKK

SEQ ID NO: 150752 - protein, 112 aa, Heterodera glycines
  Coding regions on vcDNA: vcDNA=SeqID_77175; Strand=-; Position=1 -27,525-836
  Homolog annotation: Hit_ID=CAE68647.1; Match level="QueryCoverage =73%, HitCoverage=18%, E-value=2e-17, Identity=52%"; Hit description =Hypothetical protein CBG14540 [Caenorhabditis briggsae]
MTLTNEGANERQQCLHYVDQQPDPSNSQWAIALFLGLYSNIFVLGLLGNLAIVLVTVQCRQLRSVQNIFILNLAISDVIVCLLSLPFTPVSYIYKGVGCLARPFAICYRWFR

SEQ ID NO: 150753 - protein, 99 aa, Heterodera glycines
  Coding regions on vcDNA: vcDNA=SeqID_77176; Strand=+; Position=1 -279,479-499
MAELWVNHSPALPAPASDNNWSINGLMMMASMRERVCIGETDGLEKRGILSAIGTEKSGTGKGAVARKDGMGMDKPHKSSIGGTNPSPRSPSNRNTISI

SEQ ID NO: 150754 - protein, 77 aa, Heterodera glycines
  Coding regions on vcDNA: vcDNA=SeqID_77177; Strand=-; Position=1 -119,167-280
MLLDTIHQPLSLCDGHNIAIVHRSGTINGRFISNLVILQRYNMSGKYLVFKVLVIISTIKVIVDKCVDYYGSSKHWE

SEQ ID NO: 150755 - protein, 75 aa, Heterodera glycines
  Coding regions on vcDNA: vcDNA=SeqID_77178; Strand=+; Position=1 -12,344-424,607-741
MCRRICSAINNFMRHKQIKQLSPILKCWQLQRIRMIASIVYHNWLKLQVLYRCHVVIIWPKHGLVCLSVHRTVGN

SEQ ID NO: 150756 - protein, 125 aa, Heterodera glycines
  Coding regions on vcDNA: vcDNA=SeqID_77179; Strand=-; Position=1 -119,167-280,338-482
MLLDTIHQSISLCDGHNIAIVHRSGTINGRFISNLVILQRYNMSGKYLVFKVLITICLTKVIVDKCVDYYGSSKHWEKLVRCELSDPANQSEIIGYTVYNILIIEVAEVLCYAMLWLISWWNQCQ

SEQ ID NO: 150757 - protein, 54 aa, Heterodera glycines
  Coding regions on vcDNA: vcDNA=SeqID_77180; Strand=-; Position=1 -97,572-639
MRPTGNNFIQFIFLYISFVFKFSNLNNNYVIKYRFVPNDNIFYLADRFTPNAIF

SEQ ID NO: 150758 - protein, 132 aa, Heterodera glycines
  Coding regions on vcDNA: vcDNA=SeqID_77181; Strand=-; Position=1 -62,222-558
MCDNVPRKIWRPPFRRNLPLGPQKIGKCQPFRQKIIFRVWFQGVAAKIGTSVPFPCTENDGTVIELSAHFPSNGRVVDTLAAGDCFVAGTVHFLNAGDGLRQALIKATFLAGESVGQRGLMGLKVPSDDSSI

SEQ ID NO: 150759 - protein, 32 aa, Heterodera glycines
  Coding regions on vcDNA: vcDNA=SeqID_77182; Strand=-; Position=1-97
MSTWTIIIYCAASAISSLFILAIVCEIRKSLK

SEQ ID NO: 150760 - protein, 472 aa, Heterodera glycines
  misc_feature (30)..(30): Xaa can be any naturally occurring amino acid
  misc_feature (460)..(460): Xaa can be any naturally occurring amino acid
  misc_feature (467)..(467): Xaa can be any naturally occurring amino acid
  Coding regions on vcDNA: vcDNA=SeqID_77183; Strand=-; Position=1 -102,233-340,390-513,562-642,736-863,934-966,1010-1194,1389-1437,1514- 1583,1874-1918,2110-2193,2290-2567
  Homolog annotation: Hit_ID=CAE72544.1; Match level="QueryCoverage =96%, HitCoverage=75%, E-value=1e-105, Identity=45%"; Hit description= Hypothetical protein CBG19728 [Caenorhabditis briggsae]
RLIITLQIVHLLCLILFYAFAYLWVSHIYXKLREVTSEKTKAAAKSARQLDSPGKWSTVLLGYDTIIPRQVFETSRQVFETSCQRVHRYCADKGQKLRGVRGPSGGKGPPGPVGPPGRRGPSGRMGRRGPSGRMGPIGPVGDIGAEGPPGSDGRCNCSLPDLYVQRVPVPGPPIIEKLVPVPIIVLKEMEVTKLVPFEVPFEPTPPGFAPPLGWVPGMPMPDLSQTRLPPLGWVPGMPMPDLSQTRLVPPTVRPTASSQYRHVVAPVAASLHHKRNGNNDDGDSNTTASTPTPYTGPPTLSENRRECRLNAVGIPVCRLNAVGIPVLHAESQYGTTGSWFRDSMPRSGKWKEKRWVTDGDASPVLYEYANERELMNKKQNIKYYVDFLASGTGSTVNNGSYFYHRHGSNILVRYDLESNDQIQSDALGPIASLDCEKLPNWCHNFDKGPWKPDQTFTVNXLIFAVNXSFTLF

SEQ ID NO: 150761 - protein, 115 aa, Heterodera glycines
  Coding regions on vcDNA: vcDNA=SeqID_77184; Strand=-; Position=1-348
MISDHSISYHFTWHSEAPPYRTDRGQPRSKIAVQSEAKQIRDKRKANEDEAEKHENGGLAISAPNLGKLSPVQLSILTKQRSVLRTVPRHFLLLMDTNPFVQFMQGQMVERFIGQ

SEQ ID NO: 150762 - protein, 114 aa, Heterodera glycines
  Coding regions on vcDNA: vcDNA=SeqID_77185; Strand=+; Position=1 -214,276-406
  Homolog annotation: Hit_ID=CAE63336.1; Match level="QueryCoverage =85%, HitCoverage=24%, E-value=4e-14, Identity=37%"; Hit description =Hypothetical protein CBG07736 [Caenorhabditis briggsae]
MANFCSKDSTSAEMRIEIHFDITLHKLSCPLVTIDVMSQSGESQDGIQHDVFKQRLDKQGNNMEGAQPEKQVVNTNASKSANVSRRTSSDEECGSCYGAIKGSVGQLGRSSDSS

SEQ ID NO: 150763 - protein, 115 aa, Heterodera glycines
  Coding regions on vcDNA: vcDNA=SeqID_77186; Strand=-; Position=1 -20,505-690,811-889,1079-1140
  Homolog annotation: Hit_ID=NP_510080.2; Match level="QueryCoverage =88%, HitCoverage=33%, E-value=3e-31, Identity=56%"; Hit description =nima -related kinase (XN8) [Caenorhabditis elegans] emb|CAA92169.2| Hypothetical protein F19H6.1 [Caenorh
SPIFMTPERMNEMGYSFKSDIWSLGCVLYEMAALQSPFFGEKQNLLALVRKISKCEYPPIPANIYSQQLRLTIANCICTNPSRRFDAQDVLTISEHMHSHFSALSKSAPVSSAHL

SEQ ID NO: 150764 - protein, 149 aa, Heterodera glycines
  Coding regions on vcDNA: vcDNA=SeqID_77187; Strand=+; Position=1 -173,221-425
  Homolog annotation: Hit_ID=CAE63336.1; Match level="QueryCoverage =99%, HitCoverage=33%, E-value=8e-31, Identity=46%"; Hit description =Hypothetical protein CBG07736 [Caenorhabditis briggsae]
FPAPPPSPHSICHFVHDFHSVSPARFDASHTINHLSFGKPFPGKTHPLDGKQFITNKGGIMHQYQLKIVPTRYIYGVGIMHQYQLKIVPTRYIYGVTRKEETLVSHQFAITRVERDIMTGASGIPGLFVQCELSPLMVQYEERKRKLAK

SEQ ID NO: 150765 - protein, 66 aa, Heterodera glycines
  Coding regions on vcDNA: vcDNA=SeqID_77188; Strand=-; Position=1 -87,135-247
  Homolog annotation: Hit_ID=AAD11968.1; Match level="QueryCoverage =100%, HitCoverage=31%, E-value=1e-12, Identity=43%"; Hit description= P22U [Dirofilaria immitis]
MERQCKCAEIKPCKDRYQKTMEPCLDTCQSHITSLGGNFRQVKACFTPKESLLNSAMRCTERQHDN

SEQ ID NO: 150766 - protein, 417 aa, Heterodera glycines
  Coding regions on vcDNA: vcDNA=SeqID_77189; Strand=+; Position=1-1251
  Homolog annotation: Hit_ID=AAD46501.1; Match level="QueryCoverage =93%, HitCoverage=42%, E-value=9e-16, Identity=19%"; Hit description =latent nuclear antigen [Human herpesvirus 8]
MNSKTILHVFLLLFLFSSLFVIISLAMQIEEQQTKSIHNGDDDGNENEKNGNDSNFMLSDASAFKTYQKRENPKSAKTGKNDELDGAGAEKSNRRGKANGVEKAPQKQKKTDRIASKQRPMDKSKARNAITKQRRLNEEEAAAVAVDQMSEPAGIDGEEAEPSRHQSLTPSKRQRSARKKPNKSQWDVQLTPTGTVSDAEIPADDNSTRNLSPAADGPSEEPSSSKGVNNSPLALVDNWQRPQIKNRIREQTRRIDELGQEVAELKQWKAQQEQKQLNQSQEEALRQQWHCFVSIQQMMALQVQAQQMAHFQSANIQDLEQQSETDQQQTLFRPIASHGSVTERTVTAEEKEKQHEMQENGQHEQGGHQDEEVQQQQQFEEGKQQQTTNALMSSYHGLPREAQQEEEEQHQMHHHQQ

SEQ ID NO: 150767 - protein, 307 aa, Heterodera glycines
  Coding regions on vcDNA: vcDNA=SeqID_77190; Strand=-; Position=1 -64,604-678,720-822,1144-1203,1373-1518,1963-2124,2603-2673,2806 -2941,4016-4052
  Homolog annotation: Hit_ID=NP_506659.1; Match level="QueryCoverage =99%, HitCoverage=50%, E-value=3e-68, Identity=48%"; Hit description =rhodopsin-like GPCR superfamily (5P330) [Caenorhabditis elegans] pir||T27559 hypothetical protein ZC412.1
FKFCGEYNGEGHMQLKLAYGISLLVIQFLIPTSIMAYCYWKILQKVRQDWMVPASFSSTMTVEQQAQTLQKVRQDWMVPASFSSTMTVEQQAQTAMRKRRVMFVLINKVLIFMGSWMPLTIVNLVEPIIVIFVQLRDMDFLRDATNMYFKLLNVHAIAMTSIVSNPLLYFWMSKRHRRALRDDINWFTNMRRQQQQNVGGLLNKFTPSPSIGLLCRKNLERHLLMNAARRGTLADPTCISRERALQEMHANCFLLVPLMPLCESFTPTTTSATTSSNGHTHFTAIDFPRKRSNAFYKKCLLGFSFLI

SEQ ID NO: 150768 - protein, 68 aa, Heterodera glycines
  Coding regions on vcDNA: vcDNA=SeqID_77191; Strand=+; Position=1 -77,148-277
MFNNLLPQRRHCLFLMRRLHLKTFLRPPPEIFKESQFLRLFVTLITNMTFVLLNSETWTRTRAKIQIH

SEQ ID NO: 150769 - protein, 122 aa, Heterodera glycines
  Coding regions on vcDNA: vcDNA=SeqID_77192; Strand=-; Position=1 -126,693-935
MDRETLKRLQTMEIVDAMSNSGGQLVTQQIEKVIRRHQRLNKDQVLLLRKQCLDEQFFVVQFAFLTKLRWANRKVAKNGQMTDSDLLDIKNAQFRAGRRALWTDQTVLEIADVEEACLYQTN

SEQ ID NO: 150770 - protein, 104 aa, Heterodera glycines
  Coding regions on vcDNA: vcDNA=SeqID_77193; Strand=+; Position=1 -240,495-569
  Homolog annotation: Hit_ID=NP_494754.1; Match level="QueryCoverage =98%, HitCoverage=16%, E-value=2e-33, Identity=63%"; Hit description =NAD-dependent epimerase dehydratase family (71.1 kD) (2E587) [Caenorhabditis elegans] gb|AAB00715.1| Hypo
LRFEPKNVLVTGACGFIGSNFVNFAFEKWPQSNFVNVDKLILNSDCNYVARKVRNSARYKSELADIRNGKVLKKVLEQNEIDTIVHFAADCTSKRCYNNPMESV

SEQ ID NO: 150771 - protein, 254 aa, Heterodera glycines
  Coding regions on vcDNA: vcDNA=SeqID_77194; Strand=-; Position=1 -414,532-701,761-941
  Homolog annotation: Hit_ID=NP_499741.1; Match level="QueryCoverage =91%, HitCoverage=38%, E-value=4e-66, Identity=52%"; Hit description =phosphomannomutase 45A (66.6 kD) (3O391) [Caenorhabditis elegans] emb|CAA16334.1| Hypothetical protein Y4
MVGLFAICISPVNIFHFPITASHNPKEDNGFKAYWANGAQILSPHDTEICRIVAEESKPEEAYWDTVQLGTSAFLHSADSVLEKYFAGESAICCHHKFHAAHFWFSLPFPFSVAQPNFVPPSHLFRFPWRRLQIRPPNEQDEPDADFGTVPFPNPEEGHRVLKLCIETANANDSTLLLVNDPDADRLQLAEKEANGEWRVFSGNEMGILLTWWAWTNWRAANPTADSSRVFVLHSAVSSQMVATMAKKEGLSLN

SEQ ID NO: 150772 - protein, 98 aa, Heterodera glycines
  Coding regions on vcDNA: vcDNA=SeqID_77195; Strand=-; Position=1 -209,271-358
MKQTPMRQHQQRSRISEHEEQQHKAEEAAVDAVTLQYQQQIGGPLSQRGTSERRSYYSKTTHIGPSTEMEKRKRVERLFATSGGSNIVFEDGTLQTQV

SEQ ID NO: 150773 - protein, 95 aa, Heterodera glycines
  Coding regions on vcDNA: vcDNA=SeqID_77196; Strand=+; Position=1-288
MTQQIVQLSTTGKAQAANVWRKNWPNFTDENIPNWLVICAVWGKPQTQIGASSVKNLLIGTEECDDGMIDTPEKQMLYINISENPLIYSIRRRLN

SEQ ID NO: 150774 - protein, 70 aa, Heterodera glycines
  Coding regions on vcDNA: vcDNA=SeqID_77197; Strand=-; Position=1 -113,250-349
MFAGTVQTNPNAVGNAGPLRVGRLALKTGLKIKRNHEISLSTFRVRGLAILTKRNEYNCDMYKINMCMRM

SEQ ID NO: 150775 - protein, 79 aa, Heterodera glycines
  Coding regions on vcDNA: vcDNA=SeqID_77198; Strand=+; Position=1 -60,327-506
MSSGFSFFPLESDVSVGNCETYNENLRHHSKLSHSIIPADAQRTQCSKCLRDFLSFRWIPLFQSTFVSLDPIKWTAIPV

SEQ ID NO: 150776 - protein, 115 aa, Heterodera glycines
  Coding regions on vcDNA: vcDNA=SeqID_77199; Strand=-; Position=1 -159,335-521
MSTETTESNEKKENPEGISSTVFFEHQQELLNETVSSGDEDFRCMSVTSNESEPIAEIESRLFFLKIQEPRLSTPTSQLPTETSDSSGKKENPEDISSTVFFEHQQELLNESVSS

SEQ ID NO: 150777 - protein, 63 aa, Heterodera glycines
  Coding regions on vcDNA: vcDNA=SeqID_77200; Strand=+; Position=1 -116,735-810
MHSGIFGVADHEYDLSFGQFRVPDPNLDPKAKIKTDFYVVIWAADHEYDICFSKFRTLIRTKI

SEQ ID NO: 150778 - protein, 101 aa, Heterodera glycines
  Coding regions on vcDNA: vcDNA=SeqID_77201; Strand=-; Position=1 -88,1191-1408
MCTFFKIECLFLIDYKNSILPNNTVFRTKGSTGEKQAEKHDNGTGCAKKDEAEDEAGEPTLKMLYPPDEEGQNNEAAVEDNDAEPEEENSGAEDEATSSPW

SEQ ID NO: 150779 - protein, 192 aa, Heterodera glycines
  misc_feature (2)..(2): Xaa can be any naturally occurring amino acid
  Coding regions on vcDNA: vcDNA=SeqID_77202; Strand=+; Position=1 -269,318-389,1042-1116,1172-1265
  Homolog annotation: Hit_ID=CAE57216.1; Match level="QueryCoverage =92%, HitCoverage=69%, E-value=4e-37, Identity=47%"; Hit description =Hypothetical protein CBG00075 [Caenorhabditis briggsae]
IXGFPTKMPISTLPPPTQTVLSLLGMVHPRPISRSLITTDQAFTMREECYHRYANSDHHSSLLHWLHRKNASHYSPISPSYQQALLKLRQAQELAHGLQVTSGQAQELAHGLQVTSGASSCNSRKMKVISASTPLRERALCQFEYVLNYKPNRIPSTFTEVRIPSTFTEVKCSCPRPSIRMVGNRMFECEPL

SEQ ID NO: 150780 - protein, 53 aa, Heterodera glycines
  Coding regions on vcDNA: vcDNA=SeqID_77203; Strand=-; Position=1-159
MVTVSVGIRDWAKLGLALEAEAEGEAQFFSKHEVRSSKPKNREVFEARSTKLE

SEQ ID NO: 150781 - protein, 101 aa, Heterodera glycines
  Coding regions on vcDNA: vcDNA=SeqID_77204; Strand=+; Position=1 -78,1721-1948
MPFLKIMDQHHSFIQVHWNFFKAIKKSQLCPNSRKSGRTNSSSSDSGREDDDQQERERVEGQTVRQNHLSDQRAVINDTFLTNTRTILVILSLAMGHFLLF

SEQ ID NO: 150782 - protein, 76 aa, Heterodera glycines
  Coding regions on vcDNA: vcDNA=SeqID_77205; Strand=-; Position=1-231
MALLEEFKSLSFFCYKCNGFNASKNELTIMHKKSAATAAAAETEEVEEEEEEDEEEENNNDDDNNEEEEKEKGKNE

SEQ ID NO: 150783 - protein, 94 aa, Heterodera glycines
  Coding regions on vcDNA: vcDNA=SeqID_77206; Strand=-; Position=1 -97,492-679
MQLGTPVPMSHNVCADKPDYAVEKPALEKWSIGIQAFQHQPPASSTGFFKRMHKIVKSVRKNGPAGVEDGADNENNNKKDNEANGKKAKEHQKR

SEQ ID NO: 150784 - protein, 34 aa, Heterodera glycines
  Coding regions on vcDNA: vcDNA=SeqID_77207; Strand=-; Position=1-102
MVLDDDFINMSMEEHAAMLQNKGLIQHNVSSKRK

SEQ ID NO: 150785 - protein, 65 aa, Heterodera glycines
  Coding regions on vcDNA: vcDNA=SeqID_77208; Strand=+; Position=1 -87,665-756,1148-1166
MAYTANVNTANFHGTLPKNNTHHSLATKLLNCLPSVAIPLPSPDTTSTNQRKQQKQQQPGRLKKL

SEQ ID NO: 150786 - protein, 134 aa, Heterodera glycines
  Coding regions on vcDNA: vcDNA=SeqID_77209; Strand=-; Position=1 -134,291-561
  Homolog annotation: Hit_ID=AAS38609.1; Match level="QueryCoverage =99%, HitCoverage=28%, E-value=2e-13, Identity=33%"; Hit description =hypothetical protein [Dictyostelium discoideum]
MNLKRKRKRENEIEKEKEKEIENEIERKRKKKMNRKRKMELKLILKRKMNLKRKRKRENEMEKEKVIENERKRKIKLKMKMKLKRIREKGKVKMDWKRKRKMKMKLKLKGKGKGKEKGKGRGRGEEKGMGTEFF

SEQ ID NO: 150787 - protein, 145 aa, Heterodera glycines
  Coding regions on vcDNA: vcDNA=SeqID_77210; Strand=-; Position=1 -182,419-674
  Homolog annotation: Hit_ID=AAS38609.1; Match level="QueryCoverage =100%, HitCoverage=59%, E-value=5e-28, Identity=38%"; Hit description= hypothetical protein [Dictyostelium discoideum]
MNRKRENEIEKEKEIENEIERKRKRENEIEKEKEKEIENEIERKRKKKMNRKRKMKLKLILKRKRENEMEKGNEIERKRKSKKKMNRKRKMKMKMKLKRKRKRENEMEKEKEKENENEIERKRKRENEMEKEKENENGIERKRKM

SEQ ID NO: 150788 - protein, 322 aa, Heterodera glycines
  Coding regions on vcDNA: vcDNA=SeqID_77211; Strand=-; Position=1 -197,327-717,763-1082,1407-1467
MAPPKRKQKFHADYEREFQAIKRSKKGDEYAYCVPCSFDINLESMGKAAIPVHQRSEKHKQNLRAMCMAYHLCRHAQSFKSSDCVSSDGLFRTMFSDSAVAKKFGCAQKKASKIITGNFSKFNVVFVSLFKGVLAPYSVQNMLNELGDQFFFIALDSSNHKTTKLFPIVIRYFCAKKGIQVRLLDLQALPGETSEEVYQWIIKMLQKHGLKFERIVAFCADNTAANFGSAEHRGENNVFYKLKTHKNNLIPVGCPAHLLHNAEKRGADNLPIDIESIVFKLTSHFKNSTRELNNCSTFAMILRGQMPYSLNCYKKWKDSSQK

SEQ ID NO: 150789 - protein, 251 aa, Heterodera glycines
  Coding regions on vcDNA: vcDNA=SeqID_77212; Strand=+; Position=1 -247,2197-2705
  Homolog annotation: Hit_ID=EAL33918.1; Match level="QueryCoverage =48%, HitCoverage=31%, E-value=3e-17, Identity=39%"; Hit description =GA16384-PA [Drosophila pseudoobscura]
MAASTVALGKVRMVNHRWGRKLNSFLAGRNRKSERQSAIPSAWGADSAGRPSTDPLAVLDGGGLLPLGGVSEEDGSHKGTGIEGRFRYVPFEELIERSDFLILSASVNDQTKGLFDKEKFERMKSDAILVNIGRWGKKKAAKIGRGIRLAHLRGCLVRTDDLYEALNDRKLGGAALDVTEPEPLPAEHPLFSLPNCGAKNELETMNCLSFFSNNPSHWFRQRRGPKTDDGNGTGECNRRAEGRRNAIANSN

SEQ ID NO: 150790 - protein, 78 aa, Heterodera glycines
  Coding regions on vcDNA: vcDNA=SeqID_77213; Strand=+; Position=1 -152,200-284
MGKVSKTKSAKKSAGGSGNKTVIWAVEDIVDGPKYETIGTKRQKLYKVRWGETYELASNIPPGLIDLYEKREKVITNP

SEQ ID NO: 150791 - protein, 89 aa, Heterodera glycines
  Coding regions on vcDNA: vcDNA=SeqID_77214; Strand=-; Position=1 -178,306-397
MKMIKILNFPQSDRNDLFGLIQLAMIRTMSNGATSFRDKCKKGTTRQCTNWALREKCIKFVIYTKYFMNDLSKEYHNSEGSPDSVSLDG

SEQ ID NO: 150792 - protein, 485 aa, Heterodera glycines
  misc_feature (19)..(19): Xaa can be any naturally occurring amino acid
  misc_feature (28)..(28): Xaa can be any naturally occurring amino acid
  misc_feature (43)..(43): Xaa can be any naturally occurring amino acid
  misc_feature (479)..(479): Xaa can be any naturally occurring amino acid
  Coding regions on vcDNA: vcDNA=SeqID_77215; Strand=-; Position=1 -323,386-483,534-662,794-851,898-1027,1171-1347,1417-1569,1611 -1730,1809-1946
  Homolog annotation: Hit_ID=CAE60342.1; Match level="QueryCoverage =89%, HitCoverage=89%, E-value=4e-93, Identity=46%"; Hit description =Hypothetical protein CBG03934 [Caenorhabditis briggsae]
LLEQKKTTQILNIRKSKYXLVFLSQLLXNKIQNFFLAVQYIFXLKVIEHFDRLLLEIVAHSEKGTVFPSVKTIGGFFSRLFADKNLKRQQQMDAPMGIYLHGAVGNKTMLMDLFFESVQIQRRERIHFHEFMQQFHKDLHRLKISSALHRLKISSAVPSADLVPKIAEAIIGRAVLFCFDEFQVVDIADAMILKRLFTELFSRGLVLVATSNRPPVTSNRPPVDLYKNGLQRHQFVPFIRLLEQKCRVICLDSGIDYRKENDGECRGINVPTNRANNNNNIGLNKCSVVGPKTLNILGRTLKIERCCGRVADVHFDDLCKKPLSANDLCKKPLSANDYLAISSVFHTVLIRRIPFFTRAKLSEARRFITLIDTFYDQKVRVICSADAEPDKLFQFEEEAKVRVICSADAEPDKLFQFEEEALSDTQRMLMDDLSMCDGEESATANVFSGSEEMFAFARTVSRMAEMRTETFQKHRRPSXRKLSLL

SEQ ID NO: 150793 - protein, 29 aa, Heterodera glycines
  Coding regions on vcDNA: vcDNA=SeqID_77216; Strand=-; Position=1 -68,198-219
MDLLSRANALDVLNLTDNVQKKRSRLSSL

SEQ ID NO: 150794 - protein, 36 aa, Heterodera glycines
  Coding regions on vcDNA: vcDNA=SeqID_77217; Strand=-; Position=1 -23,61-148
MQGGQAIRQFLSFCLFHYWFVYLIKIFSIKFYLSKK

SEQ ID NO: 150795 - protein, 66 aa, Heterodera glycines
  Coding regions on vcDNA: vcDNA=SeqID_77218; Strand=+; Position=1-201
MQSLGILRNYPHSLIFEGSMDEKEIAVDELKCPYALGPAGLATGRDHGSRKSRDFWGAVITAHGFP

SEQ ID NO: 150796 - protein, 83 aa, Heterodera glycines
  Coding regions on vcDNA: vcDNA=SeqID_77219; Strand=+; Position=1-253
RSLGRRRKCEKWERIAKECEKFEINVCYLKKAEEIQFDDGQTLKFGCKWDIEAQKCGPNDETEKALKGEEKEKPRNLLAWLIQ

SEQ ID NO: 150797 - protein, 53 aa, Heterodera glycines
  Coding regions on vcDNA: vcDNA=SeqID_77220; Strand=+; Position=1 -121,553-593
MFTNFPLLFSLTLVFLLSLTLQFPLKMLGMFANYNAQKNDVNFLSKKGIILKN

SEQ ID NO: 150798 - protein, 216 aa, Heterodera glycines
  Coding regions on vcDNA: vcDNA=SeqID_77221; Strand=+; Position=1 -214,255-691
  Homolog annotation: Hit_ID=AAL05844.1; Match level="QueryCoverage =28%, HitCoverage=13%, E-value=1e-11, Identity=52%"; Hit description =latency associated antigen [Ovine herpesvirus 2]
MVDFSINYCVDLKSADGTVRGGSLDRLMSMAQNGSYNGTTMEFVDKKLSGQSDVTMVPDEEEAKNEDTMDGEVATTNFVYRPSCPPALRPVEFDTLSEGDKAECYEEEEDGNQQAEEEGEEEEEEEEEEEEEDDDEYEYVYEEEEQQQQDENGDGRQPGAVAATIKEDEDGDIKVVMELPPKKRTSIRRKKFSASRSPAPERVDGAQAELDAEVRI

SEQ ID NO: 150799 - protein, 106 aa, Heterodera glycines
  Coding regions on vcDNA: vcDNA=SeqID_77222; Strand=+; Position=1 -112,177-224,354-377,445-579
  Homolog annotation: Hit_ID=NP_494540.1; Match level="QueryCoverage =75%, HitCoverage=13%, E-value=4e-17, Identity=44%"; Hit description =thyroid peroxidase family member (2D722) [Caenorhabditis elegans] gb|AAK68180.1| Hypothetical protein C16
ALPFVLIDTDCALSGLRLRNARQMQFGWWLTVLGLAKCKAAVRAANGEFEETDCTFVSTHEDISIRRTISTTDVRISNGAFGCVPTQTATNCKKNLCYHLKFRSFD

SEQ ID NO: 150800 - protein, 131 aa, Heterodera glycines
  Coding regions on vcDNA: vcDNA=SeqID_77223; Strand=+; Position=1 -108,453-548,825-1016
  Homolog annotation: Hit_ID=CAE70957.1; Match level="QueryCoverage =100%, HitCoverage=21%, E-value=6e-32, Identity=48%"; Hit description= Hypothetical protein CBG17768 [Caenorhabditis briggsae]
MLSSASEIPVRWNALFMQWGQFIAHDVAKTTMLNNQFWTIFVLTSRQISTGRFFFEFALAFLCIFLFKIYGSSTRDQFLFRQGGFMKTNILRGRIFPPVDNNQNLIAGDDRANIFVGLAALHTLFVREHNR

SEQ ID NO: 150801 - protein, 277 aa, Heterodera glycines
  Coding regions on vcDNA: vcDNA=SeqID_77224; Strand=+; Position=1 -93,154-201,368-407,464-538,603-684,789-949,1286-1345,1396-1453,1505 -1610,1845-1955
  Homolog annotation: Hit_ID=NP_494540.1; Match level="QueryCoverage =96%, HitCoverage=36%, E-value=1e-101, Identity=64%"; Hit description= thyroid peroxidase family member (2D722) [Caenorhabditis elegans] gb|AAK68180.1| Hypothetical protein C1
EYSATVVLGKKFNELIGPYRGYNPKVDPSVLNEFTGCAFRFGHGMIQEFYPFFNEKFQQIGGIPFNDGMFRSIHIINNGIDPLIRGLMTLPAKMPQRLTIAVTEKIFGNSDLGSINIQRGRDHGIPGYTAWREVCNLPPVRDFNDLNSTITNPVVRENLRILYKRVELIDMYVGSILEDPVEGGMIGPTLACIIGKQFRALRDGDRFFYENRKVMSEEHIRQIKRASLARMLCDSGDGMKLVPKHAFNQIQGQNELFTCDQIDSPNYFKWKDTSFFS

SEQ ID NO: 150802 - protein, 30 aa, Heterodera glycines
  Coding regions on vcDNA: vcDNA=SeqID_77225; Strand=-; Position=1-95
AEGDDDDEEGDDDDEDAEGDEGGEEEEEEE

SEQ ID NO: 150803 - protein, 77 aa, Heterodera glycines
  Coding regions on vcDNA: vcDNA=SeqID_77226; Strand=+; Position=1-234
TPSCLSVPSSLTCAPPPTILSVFAFSLCYAALSLSFLYDCPCRCSSPWIVVPLLCVFVRRRRRLCRGVPQIAVISLG

SEQ ID NO: 150804 - protein, 59 aa, Heterodera glycines
  Coding regions on vcDNA: vcDNA=SeqID_77227; Strand=+; Position=1 -6,434-607
MHFRFAALYGIGKPYGRKPIYKDSQKCKKSSVNAVEKGEKKEHLFPIFASQEKYFVILI

SEQ ID NO: 150805 - protein, 105 aa, Heterodera glycines
  Coding regions on vcDNA: vcDNA=SeqID_77228; Strand=+; Position=1 -36,191-312,423-582
MKLFVYRIYSFDGDGCFQSYKFFESRRMEIRQIFQFGHQLCLNVTAFKNELFGNDQSHKFCVHTRRGDFVKRGWDSKKEPTEKGIDLGFEYLKATHKLSIQDTLR

SEQ ID NO: 150806 - protein, 73 aa, Heterodera glycines
  Coding regions on vcDNA: vcDNA=SeqID_77229; Strand=-; Position=1 -145,204-280
MPRANDLAFAVLGCDSLFLSAQTSTFAWWIAYLMPDDATILYNSDFLPGLHTRDHFLPEWIPIKLINGSMTRD

SEQ ID NO: 150807 - protein, 106 aa, Heterodera glycines
  Coding regions on vcDNA: vcDNA=SeqID_77230; Strand=-; Position=1 -36,191-312,415-577
MKLFVYRIYSFDGDGCFQSYKFFESRRMEIRQIFQFGHQLCLNVTAFKNELFGNDQSHKFCVHIRRGDFVKRGWDSKKEPTEKGIDFGFEYLKVIHMANGHFLIFN

SEQ ID NO: 150808 - protein, 189 aa, Heterodera glycines
  Coding regions on vcDNA: vcDNA=SeqID_77231; Strand=-; Position=1 -33,410-679,923-1000,1084-1269
MTATGDTAVNTSSTNKMNQKLFLIALFGVIALLALIDAIGLPQQNQCCQQQQCCQGGCSSGCCGGGGGGCCCCQGGGGGGLGGLGGLGRRRRRRGAKELGQVSAIQPHYKAVETPCPQTAWQETLEKSILAGDAIGSVSAIQSGLYARFGQKFLVTCADANETKEGQSVPNRVHFSSSGDGYCNMVKEK

SEQ ID NO: 150809 - protein, 152 aa, Heterodera glycines
  Coding regions on vcDNA: vcDNA=SeqID_77232; Strand=+; Position=1 -439,1072-1091
MPLLHVHLFKCFHRLHFLRLRHFAVLLSNPTLLQSQLCMPFGCEVNVGQALDARQRFLLRVGRALFCRLESGGNLGVVDEAVLGVLLLERLQQLGGVVVARRWANPCRAKVGIRRRQKAAKTHPVGMAYSAGANTEEGGDQHQKCRGSNVMV

SEQ ID NO: 150810 - protein, 167 aa, Heterodera glycines
  Coding regions on vcDNA: vcDNA=SeqID_77233; Strand=+; Position=1 -300,398-601
MALKSDGQMPKETHRQRNSARKGNCPMMPMLLLLSLLAITVILSEGRPNMWRGDGERKQTEIGREKREQEKQRDKEEKLTERGEGRRRYRRQSLPTDNVLVYSSNSNVSIADRIQVLSKESQIRILERNLNTTVWSNASLLQAKNAYDIMSNLNFVIRCHKMVSKFR

SEQ ID NO: 150811 - protein, 330 aa, Heterodera glycines
  Coding regions on vcDNA: vcDNA=SeqID_77234; Strand=+; Position=1-993
MADPSELFTFRHSFPPPSVSPSSAGPSSTEFESLVTHNESASAFPSPDSELFTFPPSLVPDADFLVGQFETVPSQRTTQSLFPLSATISALQFPEETAEEQQQHIAEQFPGIRRENLLIWRPEENEGTEGKEGGEKLETYLVDEKEEEGEEGKRPRRTLNDDVNGRKTEERMPRAEMEVDIAVEGEEDVRAERLRRELGEGIERMLEECEEKRTKTMERETDREETLRNETNREDEKITESDGASAVRVTEVKLKYLGKMDSSKKEVIRMHFTLEGEQNELEKGIRRIGQMDRETADKTLKHQVTNEGREQLGGTDKQWQKINSIQISEK

SEQ ID NO: 150812 - protein, 85 aa, Heterodera glycines
  Coding regions on vcDNA: vcDNA=SeqID_77235; Strand=+; Position=1 -120,433-760,1070-1280
KNRFFCFWAVPPNRCAQIYGETESSGNSFPIACTLILRWIFAPHNCLSTPNGHLKKSIFLFSGQSPRTDAPRFMGRPNPSGIASL

SEQ ID NO: 150813 - protein, 60 aa, Heterodera glycines
  Coding regions on vcDNA: vcDNA=SeqID_77236; Strand=-; Position=1 -52,702-832
  Homolog annotation: Hit_ID=NP_498776.1; Match level="QueryCoverage =66%, HitCoverage=36%, E-value=5e-10, Identity=72%"; Hit description =heat shock protein (hsp-12.2) [Caenorhabditis elegans] gb|AAA27953.1| Heat shock protein protein 12.2 [Ca
MAMSAIPIEHDAASQWDYQHGSVKREIHRQYRLPNDVDAATLKSHLSTRGVLTLTASKKD

SEQ ID NO: 150814 - protein, 129 aa, Heterodera glycines
  Coding regions on vcDNA: vcDNA=SeqID_77237; Strand=-; Position=1 -270,917-1036
  Homolog annotation: Hit_ID=CAE57216.1; Match level="QueryCoverage =55%, HitCoverage=43%, E-value=2e-10, Identity=33%"; Hit description =Hypothetical protein CBG00075 [Caenorhabditis briggsae]
MPFRLQYRLLPFSGHQKHHNTVFTKHGHSEEDGGDQQQLQDGEITLHNECYFRYAETDHHYAFLRWLHHKNVSHYTPISPSYEQILRRVQPVHPNMPIIDRALCQYEYILNYKPNASGQITKNKIIIYD

SEQ ID NO: 150815 - protein, 101 aa, Heterodera glycines
  Coding regions on vcDNA: vcDNA=SeqID_77238; Strand=+; Position=1 -64,472-620,677-707,1409-1449,1815-1835
MIGPIPAAMALLLLVLCSFLNMEKRDRFQMYPHRPQFTSFINFAPNGNRQSVEQQPTLTNTKLKKSVVAKVAKTANTRTKKNQQPKSLIENLELRIFGKTA

SEQ ID NO: 150816 - protein, 124 aa, Heterodera glycines
  Coding regions on vcDNA: vcDNA=SeqID_77239; Strand=+; Position=1 -90,888-1169
MIYLVTLSLANQCDHPVWVFSNAIPNVQMPLTDDEKQKNLICNPAGADKLSLFEWTFDGISQFIDVSYVDGANVPMGVHVPEFPDKDIIINTPTGTTHTVEQLFEDSNGQLVVPLEMIIHDYAG

SEQ ID NO: 150817 - protein, 154 aa, Heterodera glycines
  Coding regions on vcDNA: vcDNA=SeqID_77240; Strand=+; Position=1 -312,355-507
  Homolog annotation: Hit_ID=NP_505102.1; Match level="QueryCoverage =41%, HitCoverage=14%, E-value=4e-22, Identity=71%"; Hit description =arylsulfatase precursor (5I639) [Caenorhabditis elegans] gb|AAA96290.1| Sulfatase domain protein protein
MLQIWPSLAILLLRLLIRLGTVQSQIDVQYDDVNSIYVDEIDDDRSMVLDGENTAESSAGKLPFSRMFRSRPSSAPSSTRPNILVLMVDDLGYGDLQSYGNPTQEWTPVDQLMAEGVRFTNAYAADSMCSPSRAGFMTGAPSLPSSNSRLPSCP

SEQ ID NO: 150818 - protein, 80 aa, Heterodera glycines
  Coding regions on vcDNA: vcDNA=SeqID_77241; Strand=+; Position=1 -141,199-300
MYPLVDSAGEWTVSVVLDKVGTILEKHIGTMFPVPPQLGHFSPEVKRCCDWPKCRCDYLTKERPKSEEEADTFKERWTGI

SEQ ID NO: 150819 - protein, 65 aa, Heterodera glycines
  Coding regions on vcDNA: vcDNA=SeqID_77242; Strand=-; Position=1-249
QCFVLNFRLCSSCSALSSSEFPLRLAVPNDGIRRWQNLIENFLFANKKKKERNVRLAIKIKMNFQ

SEQ ID NO: 150820 - protein, 160 aa, Heterodera glycines
  Coding regions on vcDNA: vcDNA=SeqID_77243; Strand=+; Position=1-482
MTTNDPSVSGDGTATNSATGARIGEGNIATEQKRMFRFLHSALAIVSILWATVCLFLYFHAPSSQVKCPIDALSSHRFLPLAPLSPLFSPESTAFRLSMAFVRSAGPSFVWPCVRLLLAQCPPFLCRFRVHSICHCLLTAHFGHLLVGHRFAYALSPPIG

SEQ ID NO: 150821 - protein, 132 aa, Heterodera glycines
  Coding regions on vcDNA: vcDNA=SeqID_77244; Strand=+; Position=1 -105,192-302,400-582
MDSEMAQADQQWTETRKRETKWRVRQNECQCQHLLSMIFESLSVATGLSFVFSMCLLGAVGFYAVRLLRFCLILSAYISLNLFVTASLLLFAFIQDFFFLATTLDDEVKKKARRGGANSPSMLALISDHCSD

SEQ ID NO: 150822 - protein, 90 aa, Heterodera glycines
  Coding regions on vcDNA: vcDNA=SeqID_77245; Strand=-; Position=1 -99,140-183,907-1036
GNGQRGRMGDENGGGGAIGGGKKRTTEKRFSDALIVSGVKTTCKTLFTVEPPPSDESDSSGGAEKEPFLRAEEKGKEADEVLRAVAIVSF

SEQ ID NO: 150823 - protein, 55 aa, Heterodera glycines
  Coding regions on vcDNA: vcDNA=SeqID_77246; Strand=+; Position=1 -99,239-307
MDGGKRGKEWQNQINNAFGDGDFTEKFNLRNESITFQPYRPAKSVPPSGRCARNN

SEQ ID NO: 150824 - protein, 202 aa, Heterodera glycines
  Coding regions on vcDNA: vcDNA=SeqID_77247; Strand=-; Position=1 -237,816-1069,1557-1674
  Homolog annotation: Hit_ID=CAF99894.1; Match level="QueryCoverage =49%, HitCoverage=8%, E-value=7e-11, Identity=33%"; Hit description =unnamed protein product [Tetraodon nigroviridis]
TEQFADFDRQISLGHSQFRGGRTAADPRIWTRGGQSGKAGRDGDHYMCARVGTDRTATLRGPLKADPMAGRAGFEEFQHEPTIAYLYQDLNGRHLKVCELDLENKELHSPLWQQSLRTYTFLNKKNTTNWAGNIEAATTLLVPVPSPYGGLIVVGQESIIYQKDNSVAFVGSRLGDSQLIRLSTEPVDTELNSFVNVIDTYP

SEQ ID NO: 150825 - protein, 38 aa, Heterodera glycines
  Coding regions on vcDNA: vcDNA=SeqID_77248; Strand=-; Position=1 -54,283-345
MIHWRANCFFNVIAVIGDANRIFLGLSSDIKDVKFWWF

SEQ ID NO: 150826 - protein, 138 aa, Heterodera glycines
  Coding regions on vcDNA: vcDNA=SeqID_77249; Strand=+; Position=1 -253,314-477
MGSCLENLLDSVEVSRPTFKESRHFLKNVLYSVPFDCLQIAPVDRPDSATLLKILEDENRRGENEMTKDIATNQPIDETIDSIKEQIRNESELAKFGFNGQTINEMFFLWKLCGSSVESILIRNGVIKNRPPVLTLPR

SEQ ID NO: 150827 - protein, 457 aa, Heterodera glycines
  misc_feature (4)..(4): Xaa can be any naturally occurring amino acid
  misc_feature (16)..(16): Xaa can be any naturally occurring amino acid
  Coding regions on vcDNA: vcDNA=SeqID_77250; Strand=+; Position=1 -69,307-381,467-613,644-730,782-923,970-1153,1197-1242,1297-1343,1387- 1478,3190-3320
  Homolog annotation: Hit_ID=EAL31964.1; Match level="QueryCoverage =98%, HitCoverage=38%, E-value=6e-68, Identity=37%"; Hit description =GA17907-PA [Drosophila pseudoobscura]
IIDXNLKLPFCRIYDXIRVPKFVWKEPSPTVEDSVQSLVVRERDIAYQFERMRLFRRFERMRLFRRLLSAFPFKSDLFRFECQKDIPPVYRGAIWATLLGVLPTSSFYNIDTFSEHSADRQLQVDIPRCHQYDELFYNIDTFSEHSADRQLQVDIPRCHQYDELMASPMASPMAHHRMKLLIKALLVSHDDFVYWQGLDSLSAPFLILHFNDLSTAFRCLNAFIERYLRGFFLRDNDLSTAFRCLNAFIERYLRGFFLRDNSTVIRNYLAEFMRMLEFVDSELFTHLISLDFLPELFAIPWFLTCFAHVLPLHKLWFLTCFAHVLPLHKLFHLWDSLLLADSFHLWDSLLLADSYFPLFIGVAILIQLRSRLISVSFNEAYFPLFIGVAILIQLRSRLISVSFNEAILLFSDLPEVPMPCLISLDHLQKQILDTVRQIMRKGYSVTQMLIQLADVLL

SEQ ID NO: 150828 - protein, 105 aa, Heterodera glycines
  Coding regions on vcDNA: vcDNA=SeqID_77251; Strand=-; Position=1 -90,386-448,504-556,610-721
IPESAKAAVYLPGMKGPNWNIKPGTVVDTQMCNSLAYCHKIINTPTSLPAPVYIALMYAKRGRDIYKVNRETIQERRDDGQLDYQAISERLCYAHTQLRDQRVNA

SEQ ID NO: 150829 - protein, 150 aa, Heterodera glycines
  Coding regions on vcDNA: vcDNA=SeqID_77252; Strand=-; Position=1 -72,119-203,252-403,451-470,541-661
  Homolog annotation: Hit_ID=NP_495151.1; Match level="QueryCoverage =89%, HitCoverage=35%, E-value=5e-18, Identity=37%"; Hit description =PAZ Piwi domain protein family member (2G102) [Caenorhabditis elegans] gb|AAC71088.1| Hypothetical protei
MCRKHGMIISNPADQQMIDATPGDVENTIVECKRYHCNFVFFITSDAVKALHEVIKACEQKYEIVTQDLKLSNACEISRRGKPETVENIVAKSNEKLGGINYSVRVTNPDVQRMLEEGTLFIGLGVSHPGAMGSYERARGATPRDPSVIG

SEQ ID NO: 150830 - protein, 164 aa, Heterodera glycines
  Coding regions on vcDNA: vcDNA=SeqID_77253; Strand=-; Position=1 -145,198-251,303-429,494-663
  Homolog annotation: Hit_ID=CAE66929.1; Match level="QueryCoverage =95%, HitCoverage=15%, E-value=4e-10, Identity=28%"; Hit description =Hypothetical protein CBG12321 [Caenorhabditis briggsae]
EEHVIIGGGNTYLINASNHGFVAEDGPVLSQHNKYLAIGIHKSIRYVEGPRGRGNKKVGLIVESKKTPFHNIDGTLLDKVSSIVGPNNIKGDGQVRPNLIGSLNAQLKGLHVNVNYPKGRTRDVRLSGVSTATASNHIIDVQGEKVPVSEYFKRKYEYELESVG

SEQ ID NO: 150831 - protein, 311 aa, Heterodera glycines
  Coding regions on vcDNA: vcDNA=SeqID_77254; Strand=-; Position=1 -125,194-356,418-645,698-907,1048-1253,2470-2473
  Homolog annotation: Hit_ID=YP_054252.1; Match level="QueryCoverage =55%, HitCoverage=10%, E-value=3e-09, Identity=28%"; Hit description =Pre-rRNA processing protein RRP5, putative [Paramecium tetraurelia] emb|CAH03521.1| Pre-rRNA processing p
MQNFMARSSGKTITVKVICVSRSKSISARGRELLMERRQSDRIVECTAISEKVQEPRKKLSLIRYREQFDFGNVVPVFIVDTAKKEGTDQTHFTGEINPEFRAIIQITQSAKPAAKKDGTDTDQSENTAQMFDSGELRFGRVIGVNKTKKGRVVCLSLVRSDEYDFNELKQNINTQKRTKESVNSAEENVEEEEGGKNNEKEESEEDEKENEERGEGNSTMEKTEEEGRDGEEAQTNGEHKEPTFCFGLPDEHSLASAEEYEKLLIADSNLSSAWIGFVRFYLTHEGLKVCRRYERGRAVAERALKTITFQ

SEQ ID NO: 150832 - protein, 386 aa, Heterodera glycines
  Coding regions on vcDNA: vcDNA=SeqID_77255; Strand=-; Position=1 -133,182-483,760-1228,1329-1585
  Homolog annotation: Hit_ID=CAI15102.1; Match level="QueryCoverage =97%, HitCoverage=22%, E-value=3e-16, Identity=23%"; Hit description =programmed cell death 11 [Homo sapiens] emb|CAI16749.1| programmed cell death 11 [Homo sapiens] emb|CAH714
MQNLGRKSVPTVTVCPNEVNSHLIPSLLIANSVLNGAVISTEEKGAVIDLGFSTSSVNGFVHSDDLPPHLSLDKLHVGQVALFRVKESPTPSTRVIKLSGFTEMGCLIGEEGQDVLEFKHLTPGSIVEVEPEKIVTDGLFVGLIAEFRVGSRINGCVFFVDKQRNVYFKLDDDSEKHLLTAKALRIHIDDVETNRKLSIIYGFMFLYVLVSKFAIGSVHECRVIGFSMSERQLFVTTRSADLQQSVVCAEEALPGMKISGRINSVNANGIKVTFGRDISGYVSAIHALDNPNKHWQKRFQKGQKVSCRVLYLDHNLNKLFLTAKHSLVKQSKTEKQIVAISNDVVGVVSTGTVIKHLDGGSVLVAFYDRTIGFLPSRLLRFTINAF

SEQ ID NO: 150833 - protein, 127 aa, Heterodera glycines
  Coding regions on vcDNA: vcDNA=SeqID_77256; Strand=+; Position=1 -3,550-668,918-1179
MPKIRQIVPAFYLLRQRANELGIQVVPIAGQPIAIFDYFGRVITVLKKEERIAADKLRQYELDPTQGIRIRERKKTYRENDLAIRNLVEGFDAIENPNEDEILAHLRSLQYRLMRNDFENWDDPNGD

SEQ ID NO: 150834 - protein, 30 aa, Heterodera glycines
  Coding regions on vcDNA: vcDNA=SeqID_77257; Strand=+; Position=1 -25,445-512
MAPAHPKAATKNPFPDYYYVFMEFNTFKNE

SEQ ID NO: 150835 - protein, 56 aa, Heterodera glycines
  misc_feature (9)..(9): Xaa can be any naturally occurring amino acid
  Coding regions on vcDNA: vcDNA=SeqID_77258; Strand=-; Position=1 -113,582-638
NGTGTSKGXYVDVERERARKRYVQPQIQSRAIRLAFAQWTPNGKCHTRDVALFDLK

SEQ ID NO: 150836 - protein, 94 aa, Heterodera glycines
  Coding regions on vcDNA: vcDNA=SeqID_77259; Strand=-; Position=1 -43,489-616,1064-1177
MPSSAGRPIARGGGDDWTPLCSASFLISSQKKGKKDLVVNDEITKCIPECLVYMPLKKFMDPANGWYDEEKDSVILVTELFVDEANREEEEKVK

SEQ ID NO: 150837 - protein, 27 aa, Heterodera glycines
  Coding regions on vcDNA: vcDNA=SeqID_77260; Strand=-; Position=1-83
AKENLVDAVIDGMKVRVDYSVTRGGGQ

SEQ ID NO: 150838 - protein, 103 aa, Heterodera glycines
  Coding regions on vcDNA: vcDNA=SeqID_77261; Strand=+; Position=1 -86,525-750
MFFLNFIFFFFVFNVEQHFTLGDGSNGTRFWLCYKSALNATNLSWKLAKRFRFDKMLSSNPMINDSDDDGDQFCGQNDRKIQFLIKNESITIGGQQLFSRSIN

SEQ ID NO: 150839 - protein, 146 aa, Heterodera glycines
  Coding regions on vcDNA: vcDNA=SeqID_77262; Strand=+; Position=1 -252,647-835
MNISNEFFDHSNFGSFLTDYAGLWLLPADIAPKLGQKSTKLTFVVPDECIFMPNRTIVPPLKCRTFNFEAVTRHGRAKRRINPLIYNGTNTEIKHLPWTVYFEGIKPFNATANILESCTASLISSQFVLLAAHCLKGVNKIKLGKN

SEQ ID NO: 150840 - protein, 21 aa, Heterodera glycines
  Coding regions on vcDNA: vcDNA=SeqID_77263; Strand=+; Position=1 -54,212-223
MIDIEEEEPLLEKMDKDGKNR

SEQ ID NO: 150841 - protein, 248 aa, Heterodera glycines
  Coding regions on vcDNA: vcDNA=SeqID_77264; Strand=-; Position=1 -129,222-369,1524-1739,2256-2347,2416-2577
  Homolog annotation: Hit_ID=NP_741442.1; Match level="QueryCoverage =100%, HitCoverage=66%, E-value=1e-109, Identity=48%"; Hit description=voltage-gated Calcium Channel Alpha subunit, putative L -type calcium channel alpha 1 subunit, EGg Layin
DNVMDAMISLFVVSTFEGWPDLLYVAINSNEENRGPVHNARQPVAIFFIAFIVVIAFFMMNIFVGFVIVTFQNEGEREYENCELDKNQRKCIDPEMDVVLDVLNLIFTGVFAFEALFKIIALNPKNYFGDRWNSFDFVIVLGSFIDIIYGKIGGTGSNIISINFFRLFRVMRLVKLLSRGEGIRTLLWTFMKSFQALPYVALLIVLLFFIYAVIGMQVFGKVALDDDTEIHRNNNFHTFPAAVLVLFR

SEQ ID NO: 150842 - protein, 359 aa, Heterodera glycines
  Coding regions on vcDNA: vcDNA=SeqID_77265; Strand=-; Position=1 -16,97-153,840-933,999-1101,1255-1460,1619-1684,1931-2098,2514 -2607,2679-2796,2842-2999
  Homolog annotation: Hit_ID=NP_505009.3; Match level="QueryCoverage =94%, HitCoverage=62%, E-value=6e-58, Identity=37%"; Hit description =cytochrome p450 family member (5I263) [Caenorhabditis elegans] gb|AAB37074.3| Hypothetical protein C26F1.
MRLWIGPKPIVIFWKPESAKAILEKAAMGTQLDAQRGGNPKYVEAVKKMCELSFLRMRSPWLWPAPVWWLSGKGGEFKRNLKAITEFTQGVIASRKRERAVQQQQKQRKQQENDIKMQQNGVQSHQQNDTTVISQNGNGIDVDVKTGTKSAAACFLDILDEDIREEVETFMFEGHDTVASSVGFTVFSLGHRPQLQERLHTEMDNLFGECAERDITYDDLPRMRYTEQANITMRKLTNITETTEICGFKIPAGCTAMVAPFSIHRDKRYYHAPDDYDPEHFSEENVLWRNKEPFAYLPFSAGPRNCIGQKFAGTEQKISLAKIFRRFRVISVQHELESRGLPELVLKPSDGFWIRIERR

SEQ ID NO: 150843 - protein, 126 aa, Heterodera glycines
  Coding regions on vcDNA: vcDNA=SeqID_77266; Strand=-; Position=1 -174,477-680
MAFLAETRIGNSQEKSATPNRQQTTEEEEEQVAAAQLQQQCASFGRFASERIQRRDQSPMVAPKQRKSQSKLSRETAAAAAQKNAASAKEKQQQQRVKAEEEAKLKDEVDSSQEIVLLKREEEEMV

SEQ ID NO: 150844 - protein, 84 aa, Heterodera glycines
  Coding regions on vcDNA: vcDNA=SeqID_77267; Strand=+; Position=1 -33,418-639
MATLSRQQKYGLIFLVGWLANLFLCCLVAFVLVRALFAVAEPDHWVLVSFWTHICLFLGFSIAFLLFLLFNNYTDVIFATVFTE

SEQ ID NO: 150845 - protein, 355 aa, Heterodera glycines
  Coding regions on vcDNA: vcDNA=SeqID_77268; Strand=-; Position=1 -633,791-1104,1153-1239,1361-1394
  Homolog annotation: Hit_ID=NP_913627.1; Match level="QueryCoverage =61%, HitCoverage=16%, E-value=1e-22, Identity=32%"; Hit description =putative helicase [Oryza sativa (japonica cultivar-group)]
MAIPQHKDLLFGGKTVIFSGDFKQSLPVVPHEGLTAQVTACFQTSPLFCQFTTMKLTINQRLGQGQQAYLQMCRQIGLGETGEHFWIPPQFLVLSREELIDFVYPDFQRLLGNDKELLNRLILAPHIDTCDEINEIMMANVPGQVREYLSSDKPLDERPLDIDEIELEVAALNRRTDSGMPPHRLRLKVGSVVVLLINKSDKEGLINGTRIFLFSFPRRMSIPRRPPPIVAAFAIVPMALFGSASSATQQNHLDYSSASSPCPSHPFAFECRHSACCASYHQRFLMLLFSLAIFAFALLVLIIWLAIEWRPRRWRRSHRNGKRMSEVEIRSSEETRYLRRMSELNPNARREIVDG

SEQ ID NO: 150846 - protein, 294 aa, Heterodera glycines
  Coding regions on vcDNA: vcDNA=SeqID_77269; Strand=-; Position=1 -156,305-376,445-600,649-882,1084-1348
VLNFCSSVSRCAINSHPSLDDPFAVQLAVAHSQKPFVHIGTVADAEFVGDRKAKSGGALKLFDGATDGHAICTFGMEEFALSGVHELVVFVNMHGVSSRPPISVSGRSRIVGLSLKEPFLHVLSEDGSIIFYDFFPIPPSFSTVDAHLVQSLAFPTDEVQEVRQNICGRSPAPITCQLENIDGVILIASPGDSALYELVPVSVVVQELNHLRKKLAFLLLQNANFSDGIALLSSIDGTDCALTFLSLVVNQRPQLGMDPVTQNGQSQVPIDGTFPEIPLEFVKQYLEETIRQRD

SEQ ID NO: 150847 - protein, 347 aa, Heterodera glycines
  Coding regions on vcDNA: vcDNA=SeqID_77270; Strand=+; Position=1 -90,167-283,549-662,1208-1330,1401-1532,2192-2302,2679-2820,2880 -2910,3260-3313,3379-3418
  Homolog annotation: Hit_ID=CAE57674.1; Match level="QueryCoverage =99%, HitCoverage=44%, E-value=1e-123, Identity=63%"; Hit description= Hypothetical protein CBG00668 [Caenorhabditis briggsae]
NGMNSTEFRHYGRKMVDYVADYLETIEKRRVFPAIEPGYLRKLLPVFPAIEPGYLRKLLPMDPPIQPENFDQILQDTESYIMPGVTHWQHPRFHAYFPAGNSFPSIMADMLSDGIGCMGFSWAACPALTELETHMLQWFGQMLGLPAFFLPYSKNSIGGGVIQTSATSASEAILDALLAARFDKLKQLKEENKTEGELLDKLIAYCSKEAHSSVEKAAKISMVRVRLLETDSRLRLRGETLQKALDKDRKKGLIPFFVSITLGTTSCCSFDVLSEIGPVATKNNIWLHVDAAYAGSAMICPEFGSAMICPEFRYLMEGIEHAMSFNTNPNKWMLWMLIAFDCSAMWL

SEQ ID NO: 150848 - protein, 43 aa, Heterodera glycines
  Coding regions on vcDNA: vcDNA=SeqID_77271; Strand=-; Position=1 -126,436-441
MASLKWQRQKPIRTQVKALTFPELTSNSRPVPFAKFRPSSEGV

SEQ ID NO: 150849 - protein, 312 aa, Heterodera glycines
  Coding regions on vcDNA: vcDNA=SeqID_77272; Strand=+; Position=1 -269,662-692,746-1162,1271-1491
  Homolog annotation: Hit_ID=NP_490725.1; Match level="QueryCoverage =82%, HitCoverage=51%, E-value=3e-39, Identity=37%"; Hit description =metallopeptidase family M24 (1A840) [Caenorhabditis elegans] pir||F87719 protein R119.2 [imported] - Caen
VLPLDEFDAYMAGTVRNGLLALDLPSMADHAADAPAQMKKMWKMLSDGVWTHVSLNEHVDTLRWRKSETEKAMMRRTCAVGGEALNAMVRECRKATNESHIVGFLEFECRRRGANFLAYPPVVAGGSNANTIHYIDSNMVSFAAMCVPFYNVFVCLKPIRPNDCVLVDAGCDFGGYVSDITRCFPVSGTFSATQKTLYDALCHVQQQLLHFVQNTRPLRLNEASFVIFADTWKPKPIYLLYAFMLARMANALSSIVFFKRDGLSEDELIAVGWGRGGGQKATMKRICAIPKECDKLCPHHVSHWLGLDVHDT

SEQ ID NO: 150850 - protein, 271 aa, Heterodera glycines
  Coding regions on vcDNA: vcDNA=SeqID_77273; Strand=+; Position=1 -100,439-640,881-1103,1540-1830
  Homolog annotation: Hit_ID=CAE74515.1; Match level="QueryCoverage =95%, HitCoverage=98%, E-value=9e-14, Identity=28%"; Hit description =Hypothetical protein CBG22269 [Caenorhabditis briggsae]
MCSGIPEGTYELKIGASFLCSNKSRPPEFNTLRCFSTEFIPLNAFPFSQVVVFGEAQKKTIFKGAKKEIKGDKECLLVYNRKSKELCLERVSANINVKKTRDTDLDQKAISEIERLQKRRRPKQSPPSPKAPVENATAVEPPAEQRKERTFSTSSAGDEIDEDDEENVSALEQLMAPTKVERSEAEEDIFHPAQQRPKMELKTEEHQNQMEESANGTTEREEKQSPQQKHPMAVKKTSSFVRKSILAEDLQLSESSSEDEEEGGRDSEDTD

SEQ ID NO: 150851 - protein, 57 aa, Heterodera glycines
  Coding regions on vcDNA: vcDNA=SeqID_77274; Strand=-; Position=1-257
EHPVSAVLWTFKRLRSVSDHSLLRSVRVFAVPPSFLLILRTALAQLQIFRQNAFPYE

SEQ ID NO: 150852 - protein, 207 aa, Heterodera glycines
  Coding regions on vcDNA: vcDNA=SeqID_77275; Strand=+; Position=1 -267,478-836
ATLPFGQSKRRAVLLEVRKGADMATPSAAENGTAHCQSPHKEKVIIGNRTTPDGAAEGEKATQRAGEAGKWHKWGAKTRGNGAKGLARVYDQHFLLSQTQPSTSGTVIPLAPSADTEHPPNIHLKQQQPHFAASVWHPSHGQEAGPGSPSVSVFIALAKEGRRRWWHCWRSGCEERRRQRRHEGNGIGTAAADQSVAAHFAKFGDCF

SEQ ID NO: 150853 - protein, 26 aa, Heterodera glycines
  Coding regions on vcDNA: vcDNA=SeqID_77276; Strand=-; Position=1 -72,329-337
MNANGNAEKSVENGQRENEEEKVTIC

SEQ ID NO: 150854 - protein, 322 aa, Heterodera glycines
  Coding regions on vcDNA: vcDNA=SeqID_77277; Strand=+; Position=1 -267,422-510,679-726,779-901,964-1019,1533-1735,1814-1880
  Homolog annotation: Hit_ID=XP_419692.1; Match level="QueryCoverage =90%, HitCoverage=53%, E-value=4e-70, Identity=48%"; Hit description =PREDICTED: similar to NEW1 domain containing protein [Gallus gallus]
FWHFLPICPIKVSVFAPSLFSLPFLSELVSLLIPAAGGGFLFVMATLFKTAFSDPGIVPRASPREVLEWERQCQETGEFDGTQFPPPPRTRVVNIRGQPVKLKYCFTCCIFRPPRSSHCSICDNCVLNFDHHCPWVGNCIGLRNYRHFFLFIFHCPWVGNCIGLRNYRHFFLFIFSLSVLDAFLGVSVGIHLYLCDEKGSFVEAVKLSPASILTGEKGSFVEAVKLSPASILTGLINIISWSVLGLSGFHTYLIALGQTTNEDIKGTFNRKLHPQVKNPYSSGNCVKNLIATLCAPERPSLLDRRGWLPPENLGPTIYVDGA

SEQ ID NO: 150855 - protein, 71 aa, Heterodera glycines
  Coding regions on vcDNA: vcDNA=SeqID_77278; Strand=-; Position=1 -82,530-663
MPLVWLLRRVFLFVAIRLLRLWSFFWHENCAASKKDNLFQKQCFLEIFKNHESLSTANTSADKTQQIGSGD

SEQ ID NO: 150856 - protein, 52 aa, Heterodera glycines
  Coding regions on vcDNA: vcDNA=SeqID_77279; Strand=-; Position=1-157
LAFWTHPPVWSCTCWQCCWLHFAPSSSLWHCCAAAVVAAVDGTNRSAVNAIS

SEQ ID NO: 150857 - protein, 60 aa, Heterodera glycines
  Coding regions on vcDNA: vcDNA=SeqID_77280; Strand=-; Position=1-182
LRSLISEKSNGGGFTLFLFADATAFDERMRAEVPFSTTAGGEAAKLIRKKSQPSAGLATS

SEQ ID NO: 150858 - protein, 141 aa, Heterodera glycines
  Coding regions on vcDNA: vcDNA=SeqID_77281; Strand=+; Position=1 -180,234-479
MTTDTINTILNRFNDVAQSKKQDGVTLWGEPFTVTMTTVNRNGLPEKRQLKGGAARKLTHIQNFDGDNYCLFLAMQATMIRTLGGLARQRFYDYMNGNHCFHGKLKTEAREMMNAVNAPPNLPNYDAETLFHLYYLIKYVH

SEQ ID NO: 150859 - protein, 107 aa, Heterodera glycines
  Coding regions on vcDNA: vcDNA=SeqID_77282; Strand=-; Position=1 -78,264-410,463-560
  Homolog annotation: Hit_ID=AAP30770.1; Match level="QueryCoverage =91%, HitCoverage=36%, E-value=4e-17, Identity=47%"; Hit description =putative gland protein G17G01 [Heterodera glycines]
MSALWSLVGLLWQGITKMRRSVEAYERLAFFNAFFYAFYWCLYAVLSFNLLFYWTDLWTCVNFQADHTMVPLTILVFSIVLMCLYAKEFFLRKPAWIHRINLQLRRN

SEQ ID NO: 150860 - protein, 64 aa, Heterodera glycines
  Coding regions on vcDNA: vcDNA=SeqID_77283; Strand=-; Position=1-193
RLAFLLQHPAQLRTVRLARENHRRFSPGLCLIRMKKNNFFFIFIVYGIFQNTENWLQSKKGNDK

SEQ ID NO: 150861 - protein, 87 aa, Heterodera glycines
  Coding regions on vcDNA: vcDNA=SeqID_77284; Strand=+; Position=1 -126,184-321
MKIYLLLLLYASSQFVISNSKKNEMAKKIGPLKMDNSNSIKKAFEGKEKPNGVEECKLIKSLEDIVITELISEELDQFAAGNENDTI

SEQ ID NO: 150862 - protein, 43 aa, Heterodera glycines
  Coding regions on vcDNA: vcDNA=SeqID_77285; Strand=+; Position=1 -68,585-648
MDWSNGRWQAVWLVVSEEGKELRFLFPTNSLIYYYSYLQIIVC

SEQ ID NO: 150863 - protein, 289 aa, Heterodera glycines
  Coding regions on vcDNA: vcDNA=SeqID_77286; Strand=+; Position=1 -167,216-630,751-1038
MTWEWSSKCFIKIEPEPITLNPVVVNACQGEKKFDFENIPLPVPEGIREFSRIQVSCLDENVIRFLGQIKYLFKEGIILELENVHQIMPSIFAAIWPIIKEDLYALSVDYHGLNFMRQCISNTVLTSCPKLRWIEASNVFPQLPDDDDSAETAENALRDWLHLPLSDPAKPKILQCRTNDQEELKIEETADIQTKFNNADTRSSYILGLANPLIEQNEHENLTEIRNGISECMQFELKVNGDDDRDNWFLLSGRTLDTDNDWSSFYDEATSELTKKRNVVCIKIVNEQA

SEQ ID NO: 150864 - protein, 99 aa, Heterodera glycines
  Coding regions on vcDNA: vcDNA=SeqID_77287; Strand=-; Position=1 -258,517-558
MTGLKLNELYELMQMTSPSILRECANLRIVGCDNTFPESPSYDGPGASQNQALSKWLHTPRDDERPKMLKCYYLYNIERQLEDLKMINICDTYITNRTE

SEQ ID NO: 150865 - protein, 28 aa, Heterodera glycines
  Coding regions on vcDNA: vcDNA=SeqID_77288; Strand=-; Position=1 -56,163-193
MIDRLIDEISLSVEQFMTSSDAAFEEMG

SEQ ID NO: 150866 - protein, 24 aa, Heterodera glycines
  Coding regions on vcDNA: vcDNA=SeqID_77289; Strand=-; Position=1-75
HFGNIFTYFECYLAYLNLGSQDLQ

SEQ ID NO: 150867 - protein, 32 aa, Heterodera glycines
  Coding regions on vcDNA: vcDNA=SeqID_77290; Strand=-; Position=1 -17,158-239
MSEEEYSEEEVEVEEDVEEVSQMSPTVKAPPE

SEQ ID NO: 150868 - protein, 361 aa, Heterodera glycines
  Coding regions on vcDNA: vcDNA=SeqID_77291; Strand=-; Position=1 -181,239-401,952-991,1259-1426,1579-1806,2190-2314,2366-2546
  Homolog annotation: Hit_ID=BAC56937.1; Match level="QueryCoverage =95%, HitCoverage=33%, E-value=3e-13, Identity=23%"; Hit description =structural maintenance of chromosomes protein 6 [Xenopus laevis]
EHTSELHQLERRRDQWREEKNTLASSKVNRLALFGANMPKLVKLIEMNRESFRRLPIGPIGSFIKLRDQKWANAVEFHMKKTLSAFICDSSEDRAALDDIFKRNGLDPPEIITAAPRQTSRWPSPCYAHEQKVRGAGHALSEVNSTISEFDRQLNQLTEQRFKVEDELQKLDQLCFSGEMIDNLQGTIREISKQLAQCTGQLNELNTKYAQKTEEQKETKRQIDEADKKVAYLKNNVNQIEVIRFDYYEDWSLWSIHEQGNDIDSFDLQQRKIDEKIENCEIGSDQQQKKIDKLQKEITNWENENTELQQHIASMELAPDQEEFPPDLTKIPPTDELKRNLREIERFIKTEENKYNNMIKI

SEQ ID NO: 150869 - protein, 69 aa, Heterodera glycines
  Coding regions on vcDNA: vcDNA=SeqID_77292; Strand=+; Position=1 -122,344-431
MAMLSVRFDCLVATHLKTRKWAFKRMGIFYSKENGGGAGERPGSNWTLIFRIQHHPDLTFSKYPDYPIL

SEQ ID NO: 150870 - protein, 187 aa, Heterodera glycines
  Coding regions on vcDNA: vcDNA=SeqID_77293; Strand=+; Position=1 -125,351-483,878-1183
MGITLKHMGDGMDKQRSWGLFIHKILPLIGIPNIHKLYVTCGGAKRLRGLLASTSTTFLIDCPNLRSIYYDGNTTGLDRPVDANAKEFLSATSAVNFIICFTSFCIDEQPAEPDDVELFQLDNKRTNERLALERMVLDQQSKVCMTRAPIGRDERKWAEWMRKAWEEEEPSNLLIFWITEANMGPDI

SEQ ID NO: 150871 - protein, 189 aa, Heterodera glycines
  misc_feature (1)..(1): Xaa can be any naturally occurring amino acid
  Coding regions on vcDNA: vcDNA=SeqID_77294; Strand=-; Position=1 -150,198-340,405-591,1083-1116
  Homolog annotation: Hit_ID=CAG07581.1; Match level="QueryCoverage =98%, HitCoverage=48%, E-value=2e-75, Identity=76%"; Hit description =unnamed protein product [Tetraodon nigroviridis]
XISAMSGVTTCLRFGQLNADLRKLAVNMVPFPRLHFFMPGFAPLTSRNSQQFRSQQFRALSVADLTQQIFDAKNMMAACDPRHGRYLTAAVIFRGRMSMKDVDEEMLAVQKRNKSFDVDEEMLAVQKRNKSFFVEWIPHNVKTAVCDIPPRGLRMSATFIGNSTAIQELFKRVTEQFNAMFRRKAFLHW

SEQ ID NO: 150872 - protein, 276 aa, Heterodera glycines
  Coding regions on vcDNA: vcDNA=SeqID_77295; Strand=-; Position=1 -113,553-664,790-1029,1074-1436
  Homolog annotation: Hit_ID=CAE68372.1; Match level="QueryCoverage =87%, HitCoverage=40%, E-value=6e-37, Identity=39%"; Hit description =Hypothetical protein CBG14128 [Caenorhabditis briggsae]
MQNKQRKLLRKRVRENKGKEEEFMEIENQPKRRRKGNKLRVKDLLHAVGRKCGIDPSEIDKIDLENIVQRQIALNEGREPPPDTNDDPPPPKEPRPPSPEEQKPLLQQRLPLPPKKPPHPSPPPMALADQRFFGGPPEERTFPLDESHHKREKQLNLELCKFIAIDMDELPNAVEVLPEEQALSWTDPPKVNVRPQQNLVEPNPDIASPAQLVAQTPPQVIVDDTTHRMIDLEPKKFKEKKEKYGRNPKKLYETYQEEWDRLEKLSDKKLGPRRKS

SEQ ID NO: 150873 - protein, 256 aa, Heterodera glycines
  Coding regions on vcDNA: vcDNA=SeqID_77296; Strand=-; Position=1 -57,103-230,275-314,365-532,576-667,715-813
  Homolog annotation: Hit_ID=AAB84297.1; Match level="QueryCoverage =94%, HitCoverage=40%, E-value=9e-74, Identity=59%"; Hit description =beta-1 tubulin [Manduca sexta] sp|O17449|TBB1_MANSE Tubulin beta-1 chain (Beta-1 tubulin)
MREIVHIQTGQCGNQIGAKFWEVISDEHGFWEVISDEHGISPDGFYRGDSDLQLERVNVYYKEAAEFKFVPRAVLADLEPVTMDAVLADLEPVTMDAVRNGPYGNLFRPDNFIHGQSGAAVRNGPYGNLFRPDNFIHGQSGAGNNWARGHYTEGGELSDAILDVIRKEAEDCECLQGFQMTHSLGGGTGFQMTHSLGGGTGSGLGTLLLSKLREEYPDRIISTYIISTYSVVPSPKVSDTVVEIGEPELRPRNVSQ

SEQ ID NO: 150874 - protein, 346 aa, Heterodera glycines
  misc_feature (281)..(281): Xaa can be any naturally occurring amino acid
  Coding regions on vcDNA: vcDNA=SeqID_77297; Strand=+; Position=1 -117,163-268,314-475,531-749,805-871,990-1094,2518-2605
  Homolog annotation: Hit_ID=NP_493724.1; Match level="QueryCoverage =100%, HitCoverage=52%, E-value=5e-72, Identity=45%"; Hit description= predicted CDS, BTB/POZ domain containing protein (2A682) [Caenorhabditis elegans] gb|AAB66129.1| Hypothe
RELRPSVTNWDLSGRYTGLSDRVKVLLERMHGSPAPEELPEPPVDMEHLLSASDLNFATVPEELPEPPVDMEHLLSASDLNFATVKAKTGRAYHVNPYYVAAWSSLFQERYVAAWSSLFQERLCNGISSDGVPKIYCPCSSEELKYFLMAIYPPQLRITECNIAPVLMAACKLESHGLLRCNIAPVLMAACKLESHGLLRKCASLLLSPHTQLSVFVRLSLLDRCRLQQLLAQCLLMVHRAENIVEMSQQQTYECLSVRAKECLSVRAKSEMVSEENVPLXDTSVYTRAFGRCKTQSNCAEVTWQCVQCKTYTSPQTIRRNVGNVLTAYLTISHRNALNGKYKRFV

SEQ ID NO: 150875 - protein, 248 aa, Heterodera glycines
  misc_feature (9)..(9): Xaa can be any naturally occurring amino acid
  misc_feature (224)..(224): Xaa can be any naturally occurring amino acid
  Coding regions on vcDNA: vcDNA=SeqID_77298; Strand=-; Position=1 -49,99-155,262-339,380-460,522-592,654-838,2548-2605
  Homolog annotation: Hit_ID=NP_508526.2; Match level="QueryCoverage =99%, HitCoverage=34%, E-value=2e-52, Identity=49%"; Hit description =potassium channel subunit n2P16 family member (63.9 kD) (XD703) [Caenorhabditis elegans] gb|AAB54033.2| T
KQIFCITIXGIPMTMIIIANIGQFLNQFAGIIANIGQFLNQFAGATRKNIEAFRERRRRSRVSLNGEEIGDSSIEVMSVGLLVAFLLYVCFGAVLVMSVGLLVAFLLYVCFGAVLLPLLNGKFDFYNGIYFNFLCFDFYNGIYFNFLCLTAIDFGQLVPFRWAFLPITFRWAFLPITFLYVCIGLAITTIAIDIGSEYMKKLHHFGKKMKNVASTKIWFGGKTXVKRNIFQCIGARKVPICGHLDAIL

SEQ ID NO: 150876 - protein, 38 aa, Heterodera glycines
  Coding regions on vcDNA: vcDNA=SeqID_77299; Strand=-; Position=1 -59,883-940
MGGKTKVETMDEIRNWHTKRRYFCYLEVIKELRKKVVA

SEQ ID NO: 150877 - protein, 81 aa, Heterodera glycines
  Coding regions on vcDNA: vcDNA=SeqID_77300; Strand=+; Position=1 -118,195-322
  Homolog annotation: Hit_ID=NP_740789.1; Match level="QueryCoverage =100%, HitCoverage=22%, E-value=2e-36, Identity=93%"; Hit description= G protein, class Q, Alpha subunit, EGg Laying defective EGL-30 (41.9 kD) (egl-30) [Caenorhabditis elegan
MACCLSEEAREQKRINQEIERQLQRDKRNARRELKLLLLGTGESGKSTFIKQMRIIHGSGYSLEDKRQHIRLVYQNVFMAM

SEQ ID NO: 150878 - protein, 70 aa, Heterodera glycines
  Coding regions on vcDNA: vcDNA=SeqID_77301; Strand=+; Position=1 -80,164-296
MELDIFCSLFACEHLCDIPVVKNESLESIGLLYQEYNEMPNFRVLILARNSAFLLAKFSSARQNSDCRNF

SEQ ID NO: 150879 - protein, 161 aa, Heterodera glycines
  Coding regions on vcDNA: vcDNA=SeqID_77302; Strand=-; Position=1 -88,205-332,722-801,1238-1340,1608-1649,1705-1749
  Homolog annotation: Hit_ID=NP_501822.1; Match level="QueryCoverage =91%, HitCoverage=38%, E-value=2e-51, Identity=65%"; Hit description =C. elegans WNT family member precursor (40.4 kD) (wnt-2) [Caenorhabditis elegans] emb|CAA92624.1| Hypothe
ECEWQFRYHRWNCSTPQELKEHIGPIHKKGTREAAFTYAILSAGVTHEIGRRCRLGFLRSCGCSESDNAPNRQQSRGVNEDWTWSGCGDNIDYGYRFSRDFIDVREKEESNKRSAEWHGRSLMNRWNNEVGRKIVKRHAKPKCKCHGRLMQFKDMLDAIGV

SEQ ID NO: 150880 - protein, 394 aa, Heterodera glycines
  Coding regions on vcDNA: vcDNA=SeqID_77303; Strand=+; Position=1-1185
MPKRATENWQLGTIAKECMGADKYGMEKSSAKILRINCLNLKLKVKRERKANFSGQTQTDAGICWTSVCSQKDAEHELCTALKLGELDPVLGQSGPGAMIVQSPLQALLAVFLLRSGTVTSNTAARTFVEMIIKSGPQMEMATYSEKRGDYVGTGKFPQENDQVKALEKCFEMCFVARAALSATGYKPLAMAPPIGLELLAGADQEGWKEVFDQSAWFLERARAKIIHKTESFVSHERVFVGDSSARHLQGFFDRSLYIGPNEGPVADVIRTFKPVVISSRVKVMVVFVGRDSLAAGETPEAIIEQCKLLAELCKRFPVQVLWSCPPYIHKKQREFETLVAQMQGLINDPPQILPICTTPNGRSALEIFRFGDHFNTHMVEEDGKLKKCGLSGT

SEQ ID NO: 150881 - protein, 307 aa, Heterodera glycines
  Coding regions on vcDNA: vcDNA=SeqID_77304; Strand=-; Position=1 -621,677-979
MDIRKYSNSKQNWRKWHQGNGNCQFRWKTIANSANSNATQSHRIQMHPDPVKAKNLAAFSHLCIFSFIDQNAIAFLHRFRQLFASNCPINLAIHTNNVRILLFILRNIWPMIGNNICGIGLFTNIFYRLRKLVPSILNDCPSLRVVSSYFDEFFTDFPCDDSAMASNGQAVAKWLFTPLQNNVPKVLRCWLHIDDGNLASNIEALKAAFSSASSPANFIVVIPFPPSFADSIVPFDLTNEFTREQFALKRIKKSNRFLLIRCPIVRDESKWTKWEDEADDWRIRDQCNQINIRINNEREIGDGSANK

SEQ ID NO: 150882 - protein, 81 aa, Heterodera glycines
  Coding regions on vcDNA: vcDNA=SeqID_77305; Strand=-; Position=1-246
MITQQQQQNQEVQAVQQEQQILMGNEMKMDNSKNGETREEEGNSIGEGGETEEKERKRKNSAQKGGENEAEKRKEQQQIGT

SEQ ID NO: 150883 - protein, 569 aa, Heterodera glycines
  Coding regions on vcDNA: vcDNA=SeqID_77306; Strand=+; Position=1 -1065,1770-2413
  Homolog annotation: Hit_ID=NP_498959.1; Match level="QueryCoverage =61%, HitCoverage=27%, E-value=3e-18, Identity=32%"; Hit description =zn-finger, CCHC type and RNA-directed DNA polymerase  and Integrase, catalytic domain containing protein
MVIKVEVLGERTKAMLDGGAQISVIDAAFLYKLMKNKNLNPNDLRVAKSETRISDANGNPLACLGVVCLPILRNDCTKEVQVALHIAQAPIGFDLLFGTNALSSLGFKLFDDTTNTKINFEEVQLRKSDSLTVIYQTILAPKSTQIVELGIKEEFEGKDLFLWSEGHQNFRIEPTVGIGKDGKVIVLMTNFTSLSIKLEPGNSIGKNEVVNHVEECENFLSASNECFRINCVATDDQNVSIDKILIEILEKGTFPDSEKQNLLELLSQFKNIFAVSDSQLTQTTLVQHEIETGIAAPVRSKMRPVPYAYREKLAEMLKDYLERDLIRPSYSPWASPIVIVPKRDGSLRFCVDYRAAAKNDPMRNFIIMTDASKIGISAILSQQDEKGRIRPIYFASRQCNKFESRYAPTELEALAIRFGVKKFAQFVTMIPTRVITDHKSLIGMFKSKKETGNARVDKWILELNSKFILKVEYQPGKKNVIADVLSRTFETKEREMLKFAAPEDVALIGMLKIAGQETELTVDEKTEWTRETKESEMKFVYDFLSQRIIPEDPRQQKSLIGLGMSDFHM

SEQ ID NO: 150884 - protein, 44 aa, Heterodera glycines
  Coding regions on vcDNA: vcDNA=SeqID_77307; Strand=+; Position=1 -96,167-202
MALSFSQIIMYAIMQKSVREGEELHLTNCALSEIVFAGAGMICW

SEQ ID NO: 150885 - protein, 97 aa, Heterodera glycines
  Coding regions on vcDNA: vcDNA=SeqID_77308; Strand=+; Position=1 -29,104-142,307-529
RPVNTSAGSGRVPASSSASSWACWPFLRWTFSRTKFCRQPESIATVRRKCERGNTMQREQPSPATVHTHTKYQYKFLIYHLLFVSCQLLSVSKIKRI

SEQ ID NO: 150886 - protein, 101 aa, Heterodera glycines
  Coding regions on vcDNA: vcDNA=SeqID_77309; Strand=-; Position=1 -70,382-499,552-604,950-1000
  Homolog annotation: Hit_ID=AAO92291.1; Match level="QueryCoverage =98%, HitCoverage=63%, E-value=1e-46, Identity=95%"; Hit description =FMRFamide-related peptide precursor [Heterodera glycines]
CPFAESGHPADQQQQFGQSDCAQLAAGDEERMLLCQLYESSALLAQLGILVNEGIGRLAVSQGMGKFMGKFVVAEAGREKRKHEYLRFGKRKHEYLRFGRK

SEQ ID NO: 150887 - protein, 108 aa, Heterodera glycines
  Coding regions on vcDNA: vcDNA=SeqID_77310; Strand=+; Position=1 -75,220-277,732-925
MAMVSLLVGIYYNVIVAWSLIYIFTIITGNHHDISSCNSTFNTIYCASSLEDARCAHQLNATGAFFFNKSCHLLTDRLAATLRNETYNKLPAVSPAEEFFECLFNIIN

SEQ ID NO: 150888 - protein, 296 aa, Heterodera glycines
  Coding regions on vcDNA: vcDNA=SeqID_77311; Strand=+; Position=1 -133,274-329,397-478,1011-1180,1728-1917,2403-2516,2569-2668
  Homolog annotation: Hit_ID=CAE59375.1; Match level="QueryCoverage =99%, HitCoverage=40%, E-value=3e-68, Identity=43%"; Hit description =Hypothetical protein CBG02728 [Caenorhabditis briggsae]
NYVLEKAPTMDSFGGLNLKMVIALGFAWLITVLVLIRGVEVMGKIAWLTGTTPYIIIVILFIRAVTLDGAKIGLDFYLLKPDVSAIFLAKTWRTAATQVCYSLAVGMGGLLSLSSFNTFHNDCFKDAFIITAADAISSIFGGTAVFSTLGFMAKQLNVSIEAVVQSGTGLAFIAYPEAMSRMPGWTWLWQLLFFLMIFILGVASHFGLAEVMCTALYDQFPALRRYKSGLVIGVCLSCYLAGLTICSRAGIFYFNIFDDYAAAGIFYFNIFDDYAASFSMMLLVFLELILVAHIYG

SEQ ID NO: 150889 - protein, 157 aa, Heterodera glycines
  Coding regions on vcDNA: vcDNA=SeqID_77312; Strand=+; Position=1 -131,420-605,1019-1177
WNNYKADIQAMLGTPRNLLSKFYGPSGLCIKYIYSYIAPILLIVVLVFAFMQQVFTTRVTYGRDKRLYVFPAWSIVFGWFLSLISWIFLPGLIVANTVKFIRQGKPLNELLKMQPKWPSYERVTRGVGKSKTSNIMSANRNQPPLNITMNEFANGSS

SEQ ID NO: 150890 - protein, 53 aa, Heterodera glycines
  Coding regions on vcDNA: vcDNA=SeqID_77313; Strand=+; Position=1 -60,872-973
MYSCGAEYAAALQKLNKLIMFIVGPFTFIGLSSLLDCPTVGLSVSLESVLSRI

SEQ ID NO: 150891 - protein, 109 aa, Heterodera glycines
  Coding regions on vcDNA: vcDNA=SeqID_77314; Strand=-; Position=1 -207,337-459
MSTTIFKIFLQDIPDNVFPDRLLKLNHHLLLLGRHHAGIAAAGLVKHHLLLGRHHAVIAAARLVKHHLLHENSKFVVLTSAKNTYDQNFHFSWSSPFGTTEGPFPFFQH

SEQ ID NO: 150892 - protein, 62 aa, Heterodera glycines
  Coding regions on vcDNA: vcDNA=SeqID_77315; Strand=+; Position=1-188
MPTILANAAATANDAATSNHTATANDAATRTNYTSIGLSVCLLYAAGTGFLGFSHILFEDSI

SEQ ID NO: 150893 - protein, 107 aa, Heterodera glycines
  Coding regions on vcDNA: vcDNA=SeqID_77316; Strand=+; Position=1 -98,167-227,454-618
MESAGETILSVPPLLHLLAIQQQQKQKQQQNNGNNADTNNATNEMTLSSSDGNFCIAEQQMQIGTNGSESAEESGASDGENGSGEKRREEEDEKQQGKVSMGRSITK

SEQ ID NO: 150894 - protein, 573 aa, Heterodera glycines
  Coding regions on vcDNA: vcDNA=SeqID_77317; Strand=+; Position=1 -103,156-251,363-499,557-695,755-886,941-1016,1078-1222,1274 -1618,1669-1905,1991-2113,2196-2312,2403-2471
  Homolog annotation: Hit_ID=CAE68489.1; Match level="QueryCoverage =27%, HitCoverage=59%, E-value=2e-40, Identity=53%"; Hit description =Hypothetical protein CBG14292 [Caenorhabditis briggsae]
LEIVEESATPPPLFRQQTLQFAEEMMDVKIESPRDLHIQIPPLNAFNGYGTPSMAQSAASTPTEQQSNKPLPVIKPPGDEKEERPSLSYKDLIIEAIESSPERRLKLSEIYQVIKYLHPYYQRRSDQWGWQNSIRHNLSLHDCFVKLPLKQTSANGVVGHFWTVVTRGPDEKPLGPTRRRTRGSGKAKKGTMASMPFNGSQNGGTASNTLSGIKHGTIKGLKGRQSVSSDSGIMSDEGGACSHSNSPTEMGTRSVPLLHANAEAVAPARAAQFSANLFQFPRPTAQMPTLAQHHHQVQAVHSPAPTPAGHGHAQSQLSPLELVLQMQHQHNQQQQLQQQQQQLQQQQQQNLHPFASLQQFSPIPKSDSVAAGVADEVNSAPAAASTPTLIMPNDAIGGAAANNNAFLPCELQQLLAIAALTQQHHQPQQQQPMVPVSAANGTNTNNNSNNNLPSFHSLPPPAAPDHNTMTLLQLLNTAGTSSGTPPSDGGLGLLSNLATQLAPAVSPAPPQHPNNVAVGNNLLASAAAAATAELQRLHMIQLYAQQQQQQLQQQLAALLEQQQQQQQLHFQQR

SEQ ID NO: 150895 - protein, 332 aa, Heterodera glycines
  Coding regions on vcDNA: vcDNA=SeqID_77318; Strand=-; Position=1 -87,860-1076,1771-1930,2255-2789
  Homolog annotation: Hit_ID=CAA65506.1; Match level="QueryCoverage =30%, HitCoverage=84%, E-value=7e-18, Identity=41%"; Hit description =cuticular collagen [Teladorsagia circumcincta]
MLCVLSVPFVYNYIQQAHSVVQNEADYCKGRPGMPGPKGVPGAQGTLSDQPGPPGPPGKPGPKGLSGEKGAPGIAGKNGVPGPKGPPGEPGQVGPPGKVGTRIGREFVHGRQRTERIVQRGQGIRSDVENDTPNQRRGTRGAMQKRQIDSEWQRFFECPEDACDGKSALLLVNKKHEPKAKSYSFVYVGKMLVNEVTVAEVSAEQLECVRRECAEESVPVVEEAIRWRRKAKDERKELAQGKDKFKVFKECAVKRRRIGKDGKAMGGKARIETLVAHVKMDKLVLFFVSLPKVTEKGIGDHLNFREWAAICTRAKAFCQANARRTNCSREAK

SEQ ID NO: 150896 - protein, 490 aa, Heterodera glycines
  Coding regions on vcDNA: vcDNA=SeqID_77319; Strand=-; Position=1 -372,598-1165,1655-1852,2234-2567
MASNGSGAINNYHNRNQQAPLQYAYGSRRRPSPSFYTPLAGLAAAGGAAAAPRSPRSFGGGGGDRSGIVMQQLPQHRLPYTNNNYRRGGSMRTFCAVAPGADCCEPGDASAGVAGDYAVQRRQRVSFSPPAASVLSNCSPSSISQHHQNALALLRGTDGRRSAGPAVAAGDPSGNSNSRQQMASLINFGPIVQNNNHHHHITSLISFDPKSNTLIRVREHRRPSSSSSSLEEATGDRYPPTQPAATSAATGDCSESVPSSPATELSPSSCPTVGRFELLQQPVSAAGNDHMKGRVHAPPLVNNGMYSNSAPPTRIANVPSSDGRGQQKQYYYDYGGLDNSSNSYGGNGQIGPNNNNNQNNNNNCIDGHENGRTMPNNTNANVPSSAGVSMYEAYVGTAVPLDSPRTAFPALIDGSPRQRQQQQPSATARRSLLFDCSAASAIRLSSHSVDNGTSVIDAVATTGGDCGDRSQTATAATTAFRPRVGTTNET

SEQ ID NO: 150897 - protein, 127 aa, Heterodera glycines
  Coding regions on vcDNA: vcDNA=SeqID_77320; Strand=-; Position=1 -113,182-408,513-556
MLFYIGVTDMVSPIIGITTKAQMPIISVGHADEWPRDGVIWGADHEYDIYFSKFRIPNPNSNKNSKFINYKENIFLGVLEVAENDYDMHFGQIRNSNPDLNKKPRFNLLKNLKVVIRKDHQILMLIG

SEQ ID NO: 150898 - protein, 140 aa, Heterodera glycines
  Coding regions on vcDNA: vcDNA=SeqID_77321; Strand=-; Position=1 -63,890-1249
MSCFGIRVATMIGIGFILKTEQQILKTKRKLVRVVYNVKIQPRSSALIEVAVNDEIDEQAILIKVASEVSEHKIEPTLITPKFGKATIPVTNFSPLPIVLAENDQIGTGVILEKQITGETFLKLGLFESFSCCYLHSVFK

SEQ ID NO: 150899 - protein, 624 aa, Heterodera glycines
  Coding regions on vcDNA: vcDNA=SeqID_77322; Strand=-; Position=1 -496,1224-2599
  Homolog annotation: Hit_ID=XP_320664.1; Match level="QueryCoverage =25%, HitCoverage=15%, E-value=2e-12, Identity=30%"; Hit description =ENSANGP00000021153 [Anopheles gambiae]
MFVLRFLALMFKRGEETIASLEKHRKEIRQISKSGEFKAEDFSLAERVLIRLDQMDDAEEFQHLKTVIGDDGILRLKTRLEMSEKPYSFSHPILLAIHSALAKLIILDRDQKRHHLGVDTTLTEFLSEFWMPSARLNVKRTLRDCLHCRRMNAQQFALPTMPPLPEKEPSRTTKAHDTKTSVNRRKGMVVLISQDLVPRNQWPMGRIVETHGRPGAIRSVKVEIPVRGTNNKKPKDMPRKTVLTRPVNRIFPLEAGPEMTDPGTEAVAATEQPNENHPKLARVPGHQTVTRRKAKLTRKSLPVVAIDPPRHFALPFASGFPIGKCDECGLTCYTKGIVVTVPPEIQKFEICCAESCIVRQGIKALNFELPIEVLLNNHHCEARFWTDSQHTFTSNTTRPAVDECDLIDCYFCFTQLVNPTCQPVIAAMLAGGLSLSLLCFIFTMCSMVGYAMAGLRILFWIFSVLFARLFKPRKETWVLSEEEENLLYPHRRIRRPRPATRNWTSGRVSQMAMLVMASLPFVHGGIETVAIMAKSESCLNNGTTKMCQVKGSVTLALLPAGQPNVLSIKTDDGLILGTLQVILKGLSLECQAFTKAWKRSYEIASLASKRCPSAGSCVGDFCTK

SEQ ID NO: 150900 - protein, 115 aa, Heterodera glycines
  Coding regions on vcDNA: vcDNA=SeqID_77323; Strand=-; Position=1 -279,667-735
LLMSLDKILKSDEKPYISPVINIRQFLADASAQMDRLRQYFDDIPSASAAADCSAVEQSTSSNASDPRKNFLKFVMDRGFSTEDAAKAIASGEVLHNIREGHQSSAVKKVLVERG

SEQ ID NO: 150901 - protein, 32 aa, Heterodera glycines
  Coding regions on vcDNA: vcDNA=SeqID_77324; Strand=+; Position=1 -87,448-459
MAIKYGPKIAKYGYKIWTKNMDINFKYGEKNL

SEQ ID NO: 150902 - protein, 742 aa, Heterodera glycines
  Coding regions on vcDNA: vcDNA=SeqID_77325; Strand=+; Position=1 -591,622-1665,1729-2284
  Homolog annotation: Hit_ID=AAV44035.1; Match level="QueryCoverage =99%, HitCoverage=47%, E-value=1e-149, Identity=37%"; Hit description= putative helicase [Oryza sativa (japonica cultivar-group)]
KYIREHQKELCAESYFELAEWLEDEDQRENKKLTKIILPSSVTGSPRYIEQNYQDAMAMVRRFGKPDFFLNPKWPEIVMNLFPGQRLEDRPDLIVKVFRLYMKKLIDEIVKDKIFGNVRAWLYVVEFQKRGLPHIHLLLSMSNNDKIRNPNDVDSFISAVFPDPTKDHKGFDLVKKHMVHGPCGGLNPSCVCMEEYECSKNYPKEFCMETAMDCSKNYPKEFCMETAMDTDGYPTYARPNNGMTAIINGKEIDNRWVVPHNLYLLKRYDCHINFECVHNIKSVKYLYKYVHKGHDRAEIEIIKQQDNDEIKEYQDVRYVTPPEALWRIFGYEMQKRSYSIKRLPIHLPQKQIVYFDKNWSEDKIEEKLKKPTELMAYFELNKKSPEARQLLYYEIPEKYIFKDNQWVKRLKHFNIIGRMHFVKPHNTELVCLRLLLCHVKGATSFEDLRTVNGILNKTYQEACFRIGLLKDDQEWIDCIKEAINFAMPNQLRSLFARILVHCNPSKPKELWELFKVELSEDFSRHNNKEIAKKPIRILQKKMKNEGKPLENFPEMDQIETKLTNEQKLIVDTVFEKLHNKKRPALFFINGAGGYGKTFTYEVICHLARSENIRVSVMAPTGIAAILLPGGQTIHSRFGLDLNLHDQQLTQIKKNGKLNDSEIFIIDEAPMMHKKILELINEKLKEITGINLFGNKIIILGGDFRQTLPIQKFATKSQLIDLSIKKSHFWRQFQKFNLSKNLR

SEQ ID NO: 150903 - protein, 48 aa, Heterodera glycines
  Coding regions on vcDNA: vcDNA=SeqID_77326; Strand=-; Position=1 -28,297-415
MSKPRNVHKDISNTNEDAVNLGVELCEPNAVIIFDNVEQQTLNEAEVQ

SEQ ID NO: 150904 - protein, 21 aa, Heterodera glycines
  Coding regions on vcDNA: vcDNA=SeqID_77327; Strand=-; Position=1-64
GPGSRSRVLKSSGPGPGPGRA

SEQ ID NO: 150905 - protein, 181 aa, Heterodera glycines
  Coding regions on vcDNA: vcDNA=SeqID_77328; Strand=-; Position=1 -87,714-801,1297-1525,1981-2122
  Homolog annotation: Hit_ID=NP_508428.2; Match level="QueryCoverage =49%, HitCoverage=17%, E-value=3e-17, Identity=53%"; Hit description =glycine receptor family member (57.0 kD) (XC983) [Caenorhabditis elegans] gb|AAA81448.2| Hypothetical pro
MLIPNRTCAFDGPHGLTQRLTGIWTLKCPANAVKLSLPEVSYMKAIDSWMNMCMAFVFAVMVEYTIAHFAKNQEHLFQMARQNVPPSLVVDPDTLNSLFSSVAAASTPNSNDPTDEAVAVRHELEQFLTSEQLHRCIGNQFANNGGGAEAAQNQQKPFECRLLRHERNTDEAIFKVNEHNV

SEQ ID NO: 150906 - protein, 199 aa, Heterodera glycines
  Coding regions on vcDNA: vcDNA=SeqID_77329; Strand=+; Position=1-600
  Homolog annotation: Hit_ID=NP_608540.1; Match level="QueryCoverage =52%, HitCoverage=56%, E-value=2e-10, Identity=39%"; Hit description =CG2839-PA [Drosophila melanogaster] gb|AAF51469.2| CG2839-PA [Drosophila melanogaster]
MMEVKMMEEERTEEEEQNNNNGKRGEKEKMKGDKMRRTREEAKKKHKRRKRQIGRRKRTERTIEKRRKKEGRRGEKGGGKETNRGRRSENGRKAKEGRGGGAGEKKQPLPGSKMVQHLTIIFIYSMCIGHRKSILYEYWLPKGRVRGSVGRRRAESLGVLATGGPSSSEYWMPVGRALGVFGYRRTELLGMLAIGEPSS

SEQ ID NO: 150907 - protein, 97 aa, Heterodera glycines
  Coding regions on vcDNA: vcDNA=SeqID_77330; Strand=-; Position=1 -133,177-337
MAEQFVQPETAEEQQVKAKKPHVDERFLWKITRGQFVLAIRLCSEDWNNLFHNKDKARRLEDGRVAIGLEMCEECARINCCVSDMIADQKKKPKTTE

SEQ ID NO: 150908 - protein, 179 aa, Heterodera glycines
  Coding regions on vcDNA: vcDNA=SeqID_77331; Strand=+; Position=51-590
MVLVIEFCAQILGCSPKSLRDKLNHPEDRVKALKELVGKKVQTTYKDRNGMQKTFFVDGISDHGAALTPAYGRLRQPYNINIAAHFYARHRIKLHLPYVPCVVEKYTGCGEDRYYPMELLEIVDDDYTNKERWLGKLFTEIEDDFIPVKRLGRVDEVEEIDDNDGGGRYECSQPSYVYW

SEQ ID NO: 150909 - protein, 204 aa, Heterodera glycines
  Coding regions on vcDNA: vcDNA=SeqID_77332; Strand=-; Position=1 -177,227-342,524-845
  Homolog annotation: Hit_ID=XP_318550.1; Match level="QueryCoverage =49%, HitCoverage=15%, E-value=2e-13, Identity=34%"; Hit description =ENSANGP00000020240 [Anopheles gambiae]
MPPPHDLSNLRSFLGALNYYGRFIKSVLEIANNWTNFADASKDGIGTTISHIFPDKSEKPNRKGTIGCQKFHRMLFGRKFTLFMDHKPLLANFDSKYLLPERPKESTQAPLALWTSCSRPFKCIHIDFAGPCSDGHSYLILIDSLIAYRLGFPEEIVSDNGTQFHAAEFKEFSVNLASRIPSLHRITRSRMAKRSDSSIRSKRQ

SEQ ID NO: 150910 - protein, 47 aa, Heterodera glycines
  Coding regions on vcDNA: vcDNA=SeqID_77333; Strand=-; Position=1 -46,487-584
MSSKFIDRLSYQKNLDNENYQRNDSLLLCYSAANVHMVPKYFRVPYQ

SEQ ID NO: 150911 - protein, 30 aa, Heterodera glycines
  Coding regions on vcDNA: vcDNA=SeqID_77334; Strand=-; Position=1-95
DLIRNWFIESHEKLYGVPIAAEETELIWFA

SEQ ID NO: 150912 - protein, 155 aa, Heterodera glycines
  Coding regions on vcDNA: vcDNA=SeqID_77335; Strand=+; Position=1 -154,207-325,373-567
MSIDTVHALNFVHRQEENSRKSNRIDEENQISSIINQSNPDPKHYNLGSDQGNLRKFILQFNDKISTQNEKLMEAKKIAKDEQNKMHERFLKKEIRSIQLDHPFQKYNIITMVLRAQNITIGRYFLANFLNGGNQQQLGIVKILFKNLLIFLNEV

SEQ ID NO: 150913 - protein, 203 aa, Heterodera glycines
  Coding regions on vcDNA: vcDNA=SeqID_77336; Strand=-; Position=1 -385,473-699
RLLNELSERYKCKWGFDFETERPLESADSRFEFEAVPANSVPGFYRASNALSPLNLSSSNSDTENHHSAFVEEEPMLIEGKEFGSEAGHCPRNKKRTEKGGAVLRKLQQKSIQTPKRRRSELGQTRVTDFLSTRKHSSVHAKKADLCDDSNDVGSIADYSPHSRRRRSLFLFPEEMPTPKKSIVRQRRCGAVGPSSVVSTLFK

SEQ ID NO: 150914 - protein, 95 aa, Heterodera glycines
  Coding regions on vcDNA: vcDNA=SeqID_77337; Strand=+; Position=1-290
SYSAKTGGRNGGAGKAKKRRRDKSWERKGRAKAAEAKANLWGDKAKAEVGRTVKRERNDGRREGTEAEGNADEEKQLLGPGNRQTFGKHSLNLEF

SEQ ID NO: 150915 - protein, 298 aa, Heterodera glycines
  misc_feature (256)..(256): Xaa can be any naturally occurring amino acid
  misc_feature (295)..(295): Xaa can be any naturally occurring amino acid
  Coding regions on vcDNA: vcDNA=SeqID_77338; Strand=+; Position=1 -76,126-237,290-420,542-743,792-867,981-1117,1679-1762
  Homolog annotation: Hit_ID=CAE72244.1; Match level="QueryCoverage =79%, HitCoverage=80%, E-value=3e-31, Identity=35%"; Hit description =Hypothetical protein CBG19362 [Caenorhabditis briggsae]
FAQLSKFLFSKLVAEFVGTLLFVFIGILSAVSSILSAVSSQHSDSVPVLSVAFGHGLAIFVVISSLGHVSGAHFNPAVSLGIAGAHFNPAVSLGIALSGKMRPFLVPFYWFAQLSGGFCAAFLVSVGEPKGKREAIGSFDTVSSFPQALCAEALLTALLVLCVLCCAIDAPAQNALFAPLAIGMSISAAILGGASISGASISGASLNPARSFGPCLAASLFIDHFHFVYWVGPFIGAALSAFLYSFILSCQPAIHXQWLGIFLGFSSPEGWAVRRTSARGRLKSEGQRNIPKELXNPK

SEQ ID NO: 150916 - protein, 95 aa, Heterodera glycines
  Coding regions on vcDNA: vcDNA=SeqID_77339; Strand=-; Position=1 -153,581-714
MDSERTIGQMHTPTTENKLKQVYIPTYNKPSVHLLGAANAQPTKNPCESCKNRLSIGRNGLSQSALKGSGVSSLLGQKGRVAFYLNAALEARVAR

SEQ ID NO: 150917 - protein, 108 aa, Heterodera glycines
  Coding regions on vcDNA: vcDNA=SeqID_77340; Strand=-; Position=1-327
  Homolog annotation: Hit_ID=EAK89442.1; Match level="QueryCoverage =73%, HitCoverage=13%, E-value=3e-11, Identity=36%"; Hit description =sushi-domain containing secreted protein; with a signal peptide, low complexity region followed by a sushi
MAKPAQESQTQAKPSQAKPSQTKPSQNPSQAKPNQAKPSQAKPGQAKPNQAKPSQAKPTQENQPKPSQTKPSQANSVKRAFEQRFCHCVFACPTKVEVRPVSRHFSRI

SEQ ID NO: 150918 - protein, 246 aa, Heterodera glycines
  Coding regions on vcDNA: vcDNA=SeqID_77341; Strand=+; Position=1 -63,278-360,541-942,1152-1247,1292-1386
  Homolog annotation: Hit_ID=CAE58895.1; Match level="QueryCoverage =29%, HitCoverage=12%, E-value=3e-22, Identity=65%"; Hit description =Hypothetical protein CBG02142 [Caenorhabditis briggsae]
MSEGRSRKPFSRDGGMGTLQRKFAHSPRLHLRPLDGFPFADSQCFSAEQRRSVVFPKFLSLFFAKVRQKEDVFLYLWKAHNLVNGRLRGRETEDPKFPKYQFPPKFLCPECRRGDKFDEGKVREFLLKYYGRVRPIDGEQRTTENGRGNGEHGGGGEEKEEEADKQRNERMPKVIGGTAEEEKNDGGRKVIKGKAEDKSDQIGKTEEKSDQREKMNDGGRKVIKGKAEEKKDIAPHLISFALSPKH

SEQ ID NO: 150919 - protein, 33 aa, Heterodera glycines; identical to SEQ ID NO: 129788
  Coding regions on vcDNA: vcDNA=SeqID_77342; Strand=-; Position=1-101

SEQ ID NO: 150920 - protein, 71 aa, Heterodera glycines
  Coding regions on vcDNA: vcDNA=SeqID_77343; Strand=+; Position=1-215
MAAAGVPPLSWPQFLQRLAAVEMNKTCSSVCVLKKFGELIDLCKCCLRHKCCGELSTGDAEPKVWWLVLVY

SEQ ID NO: 150921 - protein, 586 aa, Heterodera glycines
  Coding regions on vcDNA: vcDNA=SeqID_77344; Strand=+; Position=1 -39,111-160,211-307,366-455,501-554,597-746,979-1148,1195-1902,1946 -2051,2730-2803
  Homolog annotation: Hit_ID=NP_005056.3; Match level="QueryCoverage =99%, HitCoverage=63%, E-value=1e-130, Identity=45%"; Hit description= sel-1 suppressor of lin-12-like [Homo sapiens] dbj|BAA87904.1| Pancreas-specific gene [Homo sapiens] dbj
AALGGNPLAQMAGYRFANGVGTKQNCETALMWYKKLMWYKKVADRVASQVKLTGTPSIQRIRIPDELESSSITGTLLDNNVFESSSITGTLLDNNVFSYYKYLAETGDMQAILGLAQLYLTGLGLAQLYLTGGKGVAMDLNSAAKYFTIASEAGSSQANSAAKYFTIASEAGSSQANGYLGKMYLEGTHATPQNNITAFQFFKKAADKGNSIGQAGLGMMFLYGYGVKQEPQKALKLFALAAEQGSPDAQLHLGQMYYKGLGVKRDFKQALKYFQLASQSGHIDFKQALKYFQLASQSGHILAIYNLAQMHAKGTGVLRNCRVAVALYKNVAERGRWGGRFMDAYLRFQNGGAVDEAAFRYLFLAEFGYEAAQTNFAFLLDREDTHLFAKEEAYRRAFMNWLRAANQDYPVARVKLGDYKYYGLGSEPSMEEAAEHYKLAATSHQSAQAMFNLGYMHEHGLGVQKDLHLAKRYYDLAAETSTEAVWPVAMALMKLRVEFMLEYLLMVNPERDLSKQIPLDAVLGPDLDAVLGPDWDLYLMSLLLGLIVWLAYCYFRNRQNGGAALCEDPSGQEEQSEAPFVQGAPH

SEQ ID NO: 150922 - protein, 53 aa, Heterodera glycines
  Coding regions on vcDNA: vcDNA=SeqID_77345; Strand=-; Position=1 -125,711-747
MEYVLKLRGLTLNYDVINNQGFRYKNSKSNVMLKQERLNQLIIKQRKTQFVNY

SEQ ID NO: 150923 - protein, 60 aa, Heterodera glycines
  Coding regions on vcDNA: vcDNA=SeqID_77346; Strand=+; Position=1 -102,196-276
MQQMMFVAEKIADTAFIHKILKFYGRMSLFYQENKKKFFGKGEIGTKCHKNDLIRPRITF

SEQ ID NO: 150924 - protein, 143 aa, Heterodera glycines
  Coding regions on vcDNA: vcDNA=SeqID_77347; Strand=-; Position=1 -216,544-759
MTPKSGINLDSTFFGRPKSVQVQYKASSSKAGTEPGIDDEQSNSLNEPVLQRLLTQRRDSNPNSIPFHFEHKRQDLKNNSGLHFEQGRQSFGASSSTNPAGLNPLYRSLSVRSDSSTLNRIDKINKISQIEEEEITVKEKFVI

SEQ ID NO: 150925 - protein, 266 aa, Heterodera glycines
  Coding regions on vcDNA: vcDNA=SeqID_77348; Strand=-; Position=1 -213,778-1089,1420-1560,1776-1910
MNFLFPLIIFCFVTFAANGMDLTKIDFSKAQPVVDDPPRLRSRTMPRKTHRFSAELTKESRQEMYGITKTHFNNTTPSPSSSSVNRLNNKQLELFNKLLQELNKNLAQILKNIRRPNWFVKLFEHEKKAENPKVMKEHIYKTLDNGAMESPCEKIMPICDPKTSKLYNDHELRQKVKEILDQLTSWTELKDSISSAFKNSSETDLFDGVDSTGTTPFYWSNEHLNSFEPLWDFRIFTNHFEIYDPGMRSYDFLNNLFIFHIPFYWM

SEQ ID NO: 150926 - protein, 124 aa, Heterodera glycines
  misc_feature (11)..(11): Xaa can be any naturally occurring amino acid
  Coding regions on vcDNA: vcDNA=SeqID_77349; Strand=+; Position=1 -47,4054-4100,4195-4299,4502-4674
  Homolog annotation: Hit_ID=NP_492127.1; Match level="QueryCoverage =97%, HitCoverage=20%, E-value=1e-54, Identity=51%"; Hit description =EGF motif related, Low-density lipoprotein Receptor Related (lrp-1) [Caenorhabditis elegans] emb|CAA98124
WFRHHRFFLSXFSICNSFNDCGEHDFSDEHLSMCSSFSEYGDCSTDEFKCSNGKCINATLACDRKDDCGDATDEIGCAKNNGKSCHSKGDNGGCKHSCTDVQDGYYCHCRDGFRPDPANPFDCV

SEQ ID NO: 150927 - protein, 100 aa, Heterodera glycines
  Coding regions on vcDNA: vcDNA=SeqID_77350; Strand=-; Position=1 -254,841-889
MHKFTITRIIGGKMMQHNCETVVQMPIQIPRFDVGNTSLAYTKRPVNEEAMANLAISQRHSWTNGGTFGSQRMDVPEKNANAANSPAERPAKLNYRSLCQ

SEQ ID NO: 150928 - protein, 151 aa, Heterodera glycines
  Coding regions on vcDNA: vcDNA=SeqID_77351; Strand=-; Position=1 -3,137-447,610-672,947-1025
MQCNCDRDWIVHRDLLPIQSVKVHAGEQLQQRVTHAQATVRKVDDQPGRSAQCLVADHCAAGGIQIAAPITSRSDSAKNSQPRHGCTTTATSSRNLISNCRCTNWLPDNPSVAIRQWSIRQWTIRRTEIIAYSAMSPHPYFYHFGIAPLCT

SEQ ID NO: 150929 - protein, 19 aa, Heterodera glycines
  Coding regions on vcDNA: vcDNA=SeqID_77352; Strand=+; Position=1 -38,182-203
MGRTPVRVQHYMRTKQYKE

SEQ ID NO: 150930 - protein, 198 aa, Heterodera glycines
  Coding regions on vcDNA: vcDNA=SeqID_77353; Strand=-; Position=1 -436,483-642
MIKTEQKEENESIEINNYVNQYGGDNENMEINDQQKRETIHKFDKIKEKLRKKAKYNRKNLAKTETKIGKLLGASREKIYKWKKELNLLMKKSFYEGKKNEFIERFDEFKSLYGQRKQKEFAKELGIGERTFIKWKKELLPNYHKTQYSNEEKLRKMKQYFKIKEMNPKISDEKIAKKLGIGSQTLIRWKKKFASIPI

SEQ ID NO: 150931 - protein, 41 aa, Heterodera glycines
  Coding regions on vcDNA: vcDNA=SeqID_77354; Strand=+; Position=1 -66,154-213
MGVWAFDLFCSHGPWRTLKEKMNSLNEFFHNFKNICEFTLY

SEQ ID NO: 150932 - protein, 60 aa, Heterodera glycines
  Coding regions on vcDNA: vcDNA=SeqID_77355; Strand=-; Position=1 -177,232-237
MNKLIICFMIFASVAEWDVMAKRGLKLRKFAKTAGKKTGEAALVGSLLELAAIGVDKIKK

SEQ ID NO: 150933 - protein, 21 aa, Heterodera glycines
  Coding regions on vcDNA: vcDNA=SeqID_77356; Strand=+; Position=1 -32,142-175
MPQEIYIYYRSYFEEITDNKS

SEQ ID NO: 150934 - protein, 83 aa, Heterodera glycines
  Coding regions on vcDNA: vcDNA=SeqID_77357; Strand=-; Position=1 -58,342-535
MGTAIVRLFDAADCCHHHSGIVDWSAWFAMAFVLLHFWWLSDVRMGRVAGTLVHNVSIFGPSVSFFENFQIKKCQKCQDSWRK

SEQ ID NO: 150935 - protein, 44 aa, Heterodera glycines
  Coding regions on vcDNA: vcDNA=SeqID_77358; Strand=+; Position=1-132
MSSNPALIKEGFVEKYKSGFLSSKWKSVFARLYSDSTLALYSDR

SEQ ID NO: 150936 - protein, 428 aa, Heterodera glycines
  Coding regions on vcDNA: vcDNA=SeqID_77359; Strand=+; Position=1 -164,304-427,479-554,603-694,772-967,1291-1756,2285-2336
  Homolog annotation: Hit_ID=NP_505929.1; Match level="QueryCoverage =96%, HitCoverage=95%, E-value=3e-70, Identity=39%"; Hit description =pleckstrin-like (42.2 kD) (5M31) [Caenorhabditis elegans] emb|CAA98477.1| Hypothetical protein F38B7.3 [C
YFLTGNFFQKMSSNPALIKEGFVEKYKSGFLSSKWKSVFARLYSDSTLALYSDRADSRPSETIFLKNVIPYVCIGFMTDRMPVRRPSLPPGTAVQRLIGIGMDPRAEKVHWILFPSVQRLIGIGMDPRAEKVHWILFPSEQILEEWLNGIMSTLPPPPNPPPQEWLNGIMSTLPPPPNPPPQQPTVPQQNIGFVPPPKYPDQPPPYGGQPIQPQQQSPYYPPPAAGGYGAQPQYPQTVAQQTVVIDRTTTPSGGYGGYALRSSGFGTGLAAGMGGAMLGSLLGYGIGSYFAPHGGWGGGGWGGGGYGNGLGGGYIQVENEGYLKKNNLQDNDTYITNNYYGNNDDSSTPTQNAGGNKLALFEILIKIFIDYSTPAQNDYGDSGGGGTWDDGGGGTWDDGGGFGDGGFDGGGKFMKNPLKKNFFPGGAY

SEQ ID NO: 150937 - protein, 181 aa, Heterodera glycines
  Coding regions on vcDNA: vcDNA=SeqID_77360; Strand=-; Position=1 -61,250-453,1074-1354
MWHTAGQGRSICIGRQGLDDALLIRELPASADDLSVRHAVVRFTDVEPLNVRLAASRLFAFIQMGSLFDAEMAHHKLQRTCLYIDNCADVQIIDQTTHNQSSSSSTANSVNTPFGILPICCMKFFVCFLIAFCLAEPDPAKFQYEHSSGYFYDPATGFYHDPKTEFYYSAKSRSVSVIILV

SEQ ID NO: 150938 - protein, 48 aa, Heterodera glycines
  Coding regions on vcDNA: vcDNA=SeqID_77361; Strand=+; Position=1-323
IYLCFKFVNCLLMICCFSLLWNFKNFFFVFFFFFIHFDQSAAMSFLFV

SEQ ID NO: 150939 - protein, 135 aa, Heterodera glycines
  Coding regions on vcDNA: vcDNA=SeqID_77362; Strand=-; Position=1 -123,281-446,521-637
SQQRAFSVRYLRPTVNSIKCSLSRPIARSFSFAIRLRSSKRGLAKLGSASLLQAVELFRQSATQRLTAIFRQLNELKPKIRQRQQCVRVAEQRIVRIAQSMHFLVFPTTNAEQTAVDKMGEVQHKLSKCAEQTAK

SEQ ID NO: 150940 - protein, 778 aa, Heterodera glycines
  Coding regions on vcDNA: vcDNA=SeqID_77363; Strand=+; Position=1 -2253,2285-2368
  Homolog annotation: Hit_ID=NP_498959.1; Match level="QueryCoverage =89%, HitCoverage=31%, E-value=3e-93, Identity=33%"; Hit description =zn-finger, CCHC type and RNA-directed DNA polymerase  and Integrase, catalytic domain containing protein
MDADKLKPVMDLPMPTTKKQLHSLLGFLTYYRKFIHSFGTIAAPLFKLISEKAEFKIGEQEKQAIEELKSKIIRDVVLHFPDFDAAQNDLTRQFIIMTDACKTGIAAILCQPDPEKQIRPIYFASRQCNVHESRYSATELEALAVRFGVKKFAQFITMIPTRVITDHKALIWMFRSKNETGNSRVDRWLLELSSRFILKVEFQPGKKNIIADVLSRSGKSNESVTESLQEEDIAFIGKVRVFELSNNVEDFTEHREKWIEETKNSEMRPIYEFLEKKIMPADPRIRQSTMDKCHRFVLIEKFLHLCENDGKLRLFVPLSFRENLVKERHEGKCSGHMSAKKLYKQLAELYFWPNMFSDCIHAHNACRICAHTRNARSNEPPLKVVHSSEPLELVCMDILDVGPSQSNFKYICVIIDHFTKYLVAEPIPNKSADSVAKVFVEKFLLIFGTPKKIHSDKGKEFMNTIFKRISEILGFERSFTAGYDPQANGLAERVNGVLIQILKKSTASNWTWDERLPYSVFAYNITPSESTGFSPFLLMFGRSAKIPMDKITEMNFNPLYTIDYENYFQLFLENLLNIQNEAKQNLDEYRKRSKDWYDAKPQVKANKFEISERVMVAFPGMHRNSRHKKLLWNHFGPYTITKISESSAELVPVDKTAADPITVPLERLIKVPKAVPDIATLPRGKNPYKNVLNAMIFMISAQLNFENMPKRATENWQLGTIAKECVRADKYGKEKSSAKILRINCLNLKLKDKRKRTPGFVGLRFAVKKMPSTNSARL

SEQ ID NO: 150941 - protein, 103 aa, Heterodera glycines
  Coding regions on vcDNA: vcDNA=SeqID_77364; Strand=+; Position=1-311
MRDFLRTDQRPKERRWADDGETAQGKAPQQKQRDDERGGGQAQKRRRRRGSSATAQPTTAPQKQRETTAPANGAGGGMGTEENEQRKEKQTQGNTSGGGEGGT

SEQ ID NO: 150942 - protein, 118 aa, Heterodera glycines
  Coding regions on vcDNA: vcDNA=SeqID_77365; Strand=+; Position=1 -122,242-389,534-622
  Homolog annotation: Hit_ID=XP_421796.1; Match level="QueryCoverage =95%, HitCoverage=19%, E-value=4e-37, Identity=59%"; Hit description =PREDICTED: similar to arginine-tRNA-protein transferase 1-2p; ATE1 -2p [Gallus gallus]
LDGRLIAVAVIDLLPHCLSAKYFFYDPDFAFLSLGTYSALREIAFTQQLAQHRPDLHFYYMGFYLFDCPKMRYKNRFRPSELLCDHCFNWVPVTECDRILEASRFSTFHPSAEPTRAE

SEQ ID NO: 150943 - protein, 128 aa, Heterodera glycines
  Coding regions on vcDNA: vcDNA=SeqID_77366; Strand=+; Position=1-384
MCQFLSPVPFFLLLLPLFLPSLCPSILAHQNNAFAAAENLNEHGQIEQQTTKNNDGMLGKLRVAVANENGKMVEKQKKQRQIEGEEEKQRQQHKLMMKMREGAGTLTDKNDATNDDNDNNEQSVETEG

SEQ ID NO: 150944 - protein, 96 aa, Heterodera glycines
  Coding regions on vcDNA: vcDNA=SeqID_77367; Strand=+; Position=1-288
CRRSSNVLHTASNNALDGTSYDCAPPLPPSIIISMSLCCCSSSACVQQQVQVHGAVSTVQQRLQKIRPRRTVGPSWSRTGAVDSVDAVVVVVGPKS

SEQ ID NO: 150945 - protein, 38 aa, Heterodera glycines
  Coding regions on vcDNA: vcDNA=SeqID_77368; Strand=-; Position=1-115
MRRGTTFVKRGTTVIRRGTIVIKRGTKVIRRGTTVIRR

SEQ ID NO: 150946 - protein, 158 aa, Heterodera glycines
  Coding regions on vcDNA: vcDNA=SeqID_77369; Strand=-; Position=1 -30,343-789
MMDHANCWFGAAAVDAVEEERRLRTVVVTNVPESKSDKAAERAREDRAVVDEILNATDVDQAPIVFRVGKRMDGRPRPLKMEFPTKHAARHVIRMRGKVQALNGLHNVRESMTKEQLSERRKLIEDCAKKRQTDSGDWVIYANQVVLRQDIDHIRKIF

SEQ ID NO: 150947 - protein, 21 aa, Heterodera glycines
  Coding regions on vcDNA: vcDNA=SeqID_77370; Strand=+; Position=1-64
GPGSRSRVLKSSGPGPGLGRA

SEQ ID NO: 150948 - protein, 191 aa, Heterodera glycines
  misc_feature (12)..(12): Xaa can be any naturally occurring amino acid
  misc_feature (23)..(23): Xaa can be any naturally occurring amino acid
  misc_feature (126)..(126): Xaa can be any naturally occurring amino acid
  Coding regions on vcDNA: vcDNA=SeqID_77371; Strand=+; Position=1 -108,189-250,463-668,798-973
  Homolog annotation: Hit_ID=CAG01844.1; Match level="QueryCoverage =88%, HitCoverage=39%, E-value=3e-53, Identity=63%"; Hit description =unnamed protein product [Tetraodon nigroviridis]
QVRVRDRNWSKXMSFVLINIFYXQMNQRNVYYMWTIGNFSLRPIGNFSLRPEQMGEFMKSSTFSAGPNDKLKWCLHINPKGLDEESKDYLSLHLLLVQCDDEEVHAKFKFAIQNAIGEETKALGEXIKWRELDSQRACRFVQGTDWCFKKFIRRDFLLDEQNGLLPNDGLTISCEVSILYDSVSNSFMSSF

SEQ ID NO: 150949 - protein, 170 aa, Heterodera glycines
  misc_feature (4)..(4): Xaa can be any naturally occurring amino acid
  misc_feature (8)..(8): Xaa can be any naturally occurring amino acid
  misc_feature (105)..(105): Xaa can be any naturally occurring amino acid
  Coding regions on vcDNA: vcDNA=SeqID_77372; Strand=+; Position=1 -131,490-695,825-1001
  Homolog annotation: Hit_ID=CAG01844.1; Match level="QueryCoverage =93%, HitCoverage=39%, E-value=5e-53, Identity=63%"; Hit description =unnamed protein product [Tetraodon nigroviridis]
FDFXLYKXIYELEIVNDRFPFFIANFSLCPEQMGEFMKSSTFSAGPNDKLKWCLHINPKGLDEESKDYLSLHLLLVQCDDEEVHAKFKFAIQNAIGEETKALGEXIKWRELDSQRACRFVQGTDWCFKKFIRRDFLLDEQIGLLPNDRLTISCEVIILSDSVSNSFMSSF

SEQ ID NO: 150950 - protein, 180 aa, Heterodera glycines
  Coding regions on vcDNA: vcDNA=SeqID_77373; Strand=+; Position=1-543
  Homolog annotation: Hit_ID=EAL22930.1; Match level="QueryCoverage =68%, HitCoverage=7%, E-value=3e-12, Identity=40%"; Hit description =hypothetical protein CNBA6990 [Cryptococcus neoformans var. neoformans B-3501A]
MPPYGPAHNQQQQMMPPSALVGVPPGAAATNTWMDWNSSAAMPPRGTYPMAPTNAMKAGTQTGTYIPPQSGGMMPPPAGQVPYYAVGMPTSTTAVHGQPMEPAAYHQQQQQQHYQAVQQQYTNYHQQQQPNMIYNSQQQQQMLFHQQQQQQLNQQMMMQQRQQQQPKKTLGPNRAGDELR

SEQ ID NO: 150951 - protein, 134 aa, Heterodera glycines
  Coding regions on vcDNA: vcDNA=SeqID_77374; Strand=+; Position=1 -273,1191-1322
MNSTIFLSTICCFLFLAFNNLQSVAAVVKQVCFPGIENYEISMFNDRDESIEEIETETVVTDGGKQCLMLNADKWDGYEEDDVICFYVETEMLGSAPVSLLRTDDSNYVLDFSEGLRHYYYYFNPAIGGMDFGF

SEQ ID NO: 150952 - protein, 290 aa, Heterodera glycines
  Coding regions on vcDNA: vcDNA=SeqID_77375; Strand=-; Position=1 -210,292-468,529-1014
METHVATAQPRPERQGTSFTAKRASRVPPRKPASAAAVACPRPDCPDLPARSDSPDLTECREHLDKQGQMAKPVRVVADPLARAVVNVSLPNPVCLARPDFPVLPETRDFLARTEAKGRWDRLVHLGLMVNLVSLASLANPEPPAESQGTARQSSDPRDHPDPTVKRKDCQKDLIFMGFQGTQVLLANQDCPARLDSPGGWDSPATRESPARPETPERTAVRELPAKLEIWAHATTAQRHAPPRAIKRKKTERTKEIRRRKLLFSVGPDEIRSENVYFIVLKIYLSQKYF

SEQ ID NO: 150953 - protein, 27 aa, Heterodera glycines
  Coding regions on vcDNA: vcDNA=SeqID_77376; Strand=-; Position=1-81
METNKQQIKKEAEELRRLAFFGVVMST

SEQ ID NO: 150954 - protein, 92 aa, Heterodera glycines
  Coding regions on vcDNA: vcDNA=SeqID_77377; Strand=+; Position=1 -99,982-1161
METGRLFCNLLRKGYIIGDRQFNGDWHIKRANTVFDHDVNRQRVSRAQLPAVIDEIMNEANEGARAFILANLENVRKVNMGLNGREGSVKKN

SEQ ID NO: 150955 - protein, 96 aa, Heterodera glycines
  Coding regions on vcDNA: vcDNA=SeqID_77378; Strand=+; Position=1 -147,799-851,1387-1477
MHFILFWSAQNSESSTTETELISGFLAPCTNHILTKRNLNFCTTFWKSKVAIELNAMKVIRRAKMEELLGPQVAGGQLNDDGDDEEGEEEEGSDDE

SEQ ID NO: 150956 - protein, 34 aa, Heterodera glycines
  Coding regions on vcDNA: vcDNA=SeqID_77379; Strand=-; Position=1 -76,699-727
MPDRAQTRGYPAFSRPDLKLIIYYFELESFSGVS

SEQ ID NO: 150957 - protein, 96 aa, Heterodera glycines
  Coding regions on vcDNA: vcDNA=SeqID_77380; Strand=+; Position=1 -124,658-824
MKKELSVNGDKRRMGEKYKEICAKLGASSRSIYKWKRKFGSKAKGHSKKEKIEIMKRYQKLKKEGKKLDEIAKELKISKSNLRRWQKELNFEIGSN

SEQ ID NO: 150958 - protein, 91 aa, Heterodera glycines
  Coding regions on vcDNA: vcDNA=SeqID_77381; Strand=+; Position=1 -112,538-701
MKNDYPQMTNKQILRELQVGTTLYRWQSKFKIGNGNGEKTILSDKEKIKIIHKFDKMKNSYGKDITQKDAKQIAQQLGYCIRTIYNWKKKF

SEQ ID NO: 150959 - protein, 32 aa, Heterodera glycines
  Coding regions on vcDNA: vcDNA=SeqID_77382; Strand=+; Position=1-98
SNLELLVDGLRVHVNAAQPAAVAGWDWYQPTT

SEQ ID NO: 150960 - protein, 86 aa, Heterodera glycines
  Coding regions on vcDNA: vcDNA=SeqID_77383; Strand=+; Position=1 -105,523-678
MTSSEDGDEAVGETKHGKSARKMAKNHLPKDEFKQAFSPLVPIELAQKKFERRIDQMEKQLSEVIANVREDNCGGKKREEEDEEEK

SEQ ID NO: 150961 - protein, 252 aa, Heterodera glycines
  Coding regions on vcDNA: vcDNA=SeqID_77384; Strand=-; Position=1 -51,608-722,798-912,1244-1353,1426-1578,1780-1931,2309-2327
  Homolog annotation: Hit_ID=NP_964008.1; Match level="QueryCoverage =97%, HitCoverage=56%, E-value=2e-36, Identity=34%"; Hit description =BTB (POZ) domain containing 6 [Mus musculus] gb|AAH31195.1| BTB (POZ) domain containing 6 [Mus musculus]
DNHLSIFKDELKASIHFLIPFAPKLKLLPAHKLILKTASNVFEAMFRFDTENLKAPVEVPDVEVGAFKLPVEVPDVEVGAFKLMLNFIYAEDLRELNGDNLFAVLYAAKKYGVVGLVKACVNYKLDPTNVFLVLAQARFYEEEDLDLSRRCWEYIDRNVGAVLFSKEFLQMEHKLLCEILDRELIISGEIVIWNAVLRWSDEQLRQKGKECSVENRRKMLGPAFFKVRIPLIPMQDFAEKLGKYLILRVENF

SEQ ID NO: 150962 - protein, 124 aa, Heterodera glycines
  Coding regions on vcDNA: vcDNA=SeqID_77385; Strand=+; Position=1 -75,157-456
MNERLEANYDVELWENAEFCRNYIKFFESFRRFRARCDRDHKGVSITGNWRKATEAEPLQEFFDADYILHDRLVYAVKGAEGIPRENGEEANGEEKEENKEGKEANREEKEENKEGKEANGEEK

SEQ ID NO: 150963 - protein, 50 aa, Heterodera glycines
  Coding regions on vcDNA: vcDNA=SeqID_77386; Strand=-; Position=1 -144,809-817
MRKLSSSKSLKASTTHNNEKKVAFLTKPIKKLTDEAQQNRAEKQQMDEDF

SEQ ID NO: 150964 - protein, 422 aa, Heterodera glycines
  Coding regions on vcDNA: vcDNA=SeqID_77387; Strand=-; Position=1 -67,121-255,309-677,727-861,911-1045,1095-1229,1283-1574
  Homolog annotation: Hit_ID=CAE67983.1; Match level="QueryCoverage =97%, HitCoverage=96%, E-value=4e-21, Identity=29%"; Hit description =Hypothetical protein CBG13589 [Caenorhabditis briggsae]
MPPPPMGAPQPQQQAPGPAMTPTTDPNYGTLKNLDADIFTKNAPAKPAAAPKAGQAPHGGGGPAQTPTTDSNYVTLKNLDADIFTKNAPAKPAAGGAASQKSAAGGAMSQKSAAPAGGASALSTASQKTAAAPAGGTSALGTASQNLTYDFPLDYLNMSSQWGGGRPVKPAAAPKAGQAPHGGGGPAQTPTTDSNYGTLKNLDADIFTKNAPAKPAAAPKAGQAPHGGGGLAQTPTTDSNYGTLKNLDADIFTKNAPAKPAAAPKAGQAPHGGGGPAQTPTTDSNYGTLKNLDADIFTKNAPAKPAEAPKAGQAPHGGGGPAQTPTTDSNYVTLKNLDADIFTKNAPAKPAAGGAASQKSAAGGAMSQKSAAPAGGASALSTASQKSAAGGAMSQKSAAPAGGASALSTASQKSAAGGDMSQ

SEQ ID NO: 150965 - protein, 24 aa, Heterodera glycines
  Coding regions on vcDNA: vcDNA=SeqID_77388; Strand=+; Position=1-72
IGFLAIIGIGDLIGIGFCLARHIP

SEQ ID NO: 150966 - protein, 750 aa, Heterodera glycines
  misc_feature (2)..(2): Xaa can be any naturally occurring amino acid
  misc_feature (583)..(583): Xaa can be any naturally occurring amino acid
  Coding regions on vcDNA: vcDNA=SeqID_77389; Strand=-; Position=1 -684,746-2085,2152-2367
  Homolog annotation: Hit_ID=XP_318550.1; Match level="QueryCoverage =97%, HitCoverage=76%, E-value=0.0, Identity=45%"; Hit description =ENSANGP00000020240 [Anopheles gambiae]
KXCSKKLTLSRQSSKRKQCQRPKPDDIYAALNGAAYFSNLDLSDAYLQMELDEQSKQLCALNTHRGLFQCQRIPFGVKSAPSIFQHLMDQICSGIPGVFAYLDDGLIASKTMEEHVSALYQLFARFNEYGLHIQLEKCKFLQKELLFLGHIISSEGIRPDPKRSEAICKMPPPHEKTTLRSFLGALNYYGRFIKEICQIRAPLPTAQKGKLEMGGRTTESLRKGKGADASKDASKDGIGATISHIFPNKREKVIEHASCTLSSAQRNYSQIEKEALALVFAVQKFHKMVFGRKFTLLTDHKPLLAIFGSKKGIPIYAASRLQRWALILSNYEFDIKYVNTEAFGQADVLSRLIANYPRPEEDILIANICTESFINSVFQVQIDQLPLTAAEIADATAKDEILSEISRLSKNGWPNKCSNPNIAPFIPKRDEIVEVEGCLLYQQRVIIPGILRDRALKALHLSHPGIVRMKALGRRHIYWPGLDSEIEKTVKSCEECQNAQKNPTKNTLGQWTPTSKVLERVHIDFAGPCDDGFMYFIMVDSYSKWPEVCQMKSINSQATVGFLRSIIYRLGVPEEIVSDNGTXFRSADFAKFCTEFGIKHTFTPPYHPQSNGQAERFVDTFKRAMKKCSINDDWAEKALLSYRTTPTNGYSPDQLFFGRKLRTKMSLVHPRMSDQFDKKMSDQFDKKHGAKHTEFGPGDPVLLLNYRNNKSHWLQGTILERVKNSNFSSQCTDLGGRTVHRHTNQLRRRL

SEQ ID NO: 150967 - protein, 355 aa, Heterodera glycines
  Coding regions on vcDNA: vcDNA=SeqID_77390; Strand=-; Position=1 -859,1010-1218
  Homolog annotation: Hit_ID=XP_313035.1; Match level="QueryCoverage =70%, HitCoverage=30%, E-value=1e-29, Identity=30%"; Hit description =ENSANGP00000011760 [Anopheles gambiae]
MNAAQLEQILNAVLTQSETRMQQLLGNAVPANNNLNNANLASSIDARISKFYYDAESGNTFEQWFKRFRTLIEDDGKDLPEATKVRLLLGKLSDEDYNKYRDSVSPTQPDQISWADTLDKLKSLYAETRSLFVRRYECFKIRQQPNQDITSLIAQINASCENANLSLTKEQLKCIILVIALRDEHHDLRQKCLKMLEDGQKNGTDITLKQIEEELRTIQMVKESALSLMAQPAATNAIHTRPQQWKDSKGKSKPFVKTEQRSHNQQNCSKNVDKGKHRQPTDPCPALNTTCTEVGTADHWYWRILIAVNGVKYGLMSTLVLKPPSSPAKRGAKLANRNCRLPTLKQGTAMEKQYR

SEQ ID NO: 150968 - protein, 289 aa, Heterodera glycines
  Coding regions on vcDNA: vcDNA=SeqID_77391; Strand=-; Position=1 -147,347-450,502-593,638-743,1005-1148,1201-1476
  Homolog annotation: Hit_ID=AAG00554.1; Match level="QueryCoverage =87%, HitCoverage=42%, E-value=1e-13, Identity=27%"; Hit description =retinitis pigmentosa GTPase regulator-like protein [Takifugu rubripes]
MAMPPSCLKRSPSVSNYGPAKRVKFNDILQMEVYIRNPEEWTAFDGIVKRVQQAGGNSTAKIIEEDRISKLKEKRCSTEAGPSGTSVHDNELELLEEKENIESVDKELPMEIPLEFDDSEQMQPSADYLEGNEDEQMAGPSNGEGEENNRELIAEMLGLLQSPIPSNEKSETEHIREEEEERATERKEAREDTLTDKNDFLNQSSEPEDSEDSNLVEPAGQVVKERQKETQHQPTSESLFANGLNITQRRDSGTDELQMEEEEQREKEQKGREEEEEETDDDEIIVIEQ

SEQ ID NO: 150969 - protein, 125 aa, Heterodera glycines
  Coding regions on vcDNA: vcDNA=SeqID_77392; Strand=+; Position=1-378
MEAILTKKNRTKLQHNGHSYIFHKPSADGEVHFWACEHHHAKDITFKGRLHTNLNNNVLREVGNHQCEPSAARMEAQRVITGIKRRAEQTMEPPATIRSLALQNVATPVLAQLPTKNAIKSFFLL

SEQ ID NO: 150970 - protein, 33 aa, Heterodera glycines
  Coding regions on vcDNA: vcDNA=SeqID_77393; Strand=+; Position=1-251
THFVFINFEKFWTFRGFLLFWTFRGLDTLWGCH

SEQ ID NO: 150971 - protein, 108 aa, Heterodera glycines
  Coding regions on vcDNA: vcDNA=SeqID_77394; Strand=-; Position=1 -89,343-528,583-634
MLAGRRNSATSITIPFTVTDIRPTNTIGVELMLLPTTNTPQIGPSIISSHFYTFLFVFFYIYFFLSYPFSLSGYKPCSFYGSYTYAPYRPNKSPSGYYYGWYNGISGF

SEQ ID NO: 150972 - protein, 46 aa, Heterodera glycines
  Coding regions on vcDNA: vcDNA=SeqID_77395; Strand=+; Position=1-201
CMERMSEEEEEEEFGMDAKKVNIHFQFKLLNINKTMNFFPGHFPIK

SEQ ID NO: 150973 - protein, 70 aa, Heterodera glycines
  Coding regions on vcDNA: vcDNA=SeqID_77396; Strand=+; Position=1 -169,230-273
MFHLRFVVLLLLVIVGLFIGPNFVSADWDKKVAGWDDKKVNKGWEEAEAPLNIRARRGGWDERILGIREQ

SEQ ID NO: 150974 - protein, 80 aa, Heterodera glycines
  Coding regions on vcDNA: vcDNA=SeqID_77397; Strand=+; Position=1-244
WYNPNNPFRRDPQLRLFTIPALVCLFRAGANGSWMNTAKDLCQIYESEDHFASVATLERILTNFLDIAAERQGMSVSEGR

SEQ ID NO: 150975 - protein, 414 aa, Heterodera glycines
  Coding regions on vcDNA: vcDNA=SeqID_77398; Strand=-; Position=1 -87,123-1279
  Homolog annotation: Hit_ID=NP_507780.1; Match level="QueryCoverage =88%, HitCoverage=26%, E-value=2e-27, Identity=27%"; Hit description =predicted CDS, DNA polymerase type B, organellar and viral family member (5T899) [Caenorhabditis elegans]
MPGFRQLNRNTMQKYTSIKCKGYGTSNIPIRPITKSDVTDYQFPILLYHNNNHFDGIKTLSKFFNKRYYCLSCESVYERKSQHSMNCSSLCHGCREVGVDYPCEPQQGYFKKCEHCNNNFYNKVCYERHLHKDLCTKFQRCEDCGVIYNVKYHGNVGHQCGEKFCRLCKQFHVKEDDEDNPCSSCFIQPLKPHKLKPYRIIAYDFEATQDKKVGNKFEHEVNFAAATIICTDCIINGDWNKSLQGKKCQICGLHRSITFSPFDYTETTVDQKIITQQPLREFVEWLLFDHNKKFPTVAFAHFGGRYDMTMIIKEVLAQGIHNPDIIKQGNRLYELKINQNEHGPLTILHDSYNLMPIKLSGLIKSFGLHIKDKQHFPHMFNKSSNYDNILSHLPPREQYCPDQMKIPDQQKFDK

SEQ ID NO: 150976 - protein, 45 aa, Heterodera glycines
  Coding regions on vcDNA: vcDNA=SeqID_77399; Strand=+; Position=1 -106,288-319
MQHHHHHHHHGTAPSAFTPLQQHKQQSPAATIVPQGTRILAFNYP

SEQ ID NO: 150977 - protein, 46 aa, Heterodera glycines
  Coding regions on vcDNA: vcDNA=SeqID_77400; Strand=-; Position=1-557
FSIQMALNFLKLSEILPTLALNFLKFFGIPNPKYLNFQSLTSTIRL

SEQ ID NO: 150978 - protein, 40 aa, Heterodera glycines
  Coding regions on vcDNA: vcDNA=SeqID_77401; Strand=-; Position=1 -60,266-328
MCQKKSAVRKVAALTFYARMGYIISNEDISYPKGESECWH

SEQ ID NO: 150979 - protein, 241 aa, Heterodera glycines
  Coding regions on vcDNA: vcDNA=SeqID_77402; Strand=-; Position=1 -148,511-854,1072-1305
MPPIFVPSEFTLLLIMSLLILMTSNNYHNHYGPVLAQSDLETAADLTIFTNRPPRARLFVGKSALHHHHQQVLAPVIAASPPSPTTLAQMMRANPLLATLSMFNDNNNSDNDDISINKLETLDIRHGSRFGTETTTTTVPKTVSMPSLLAKSQFKPTTAKGRSMQMAATANASSSLSDSIANFGTTKTTAPPQQQQQQQMDNFDLLYQIFNVSMFDLADQQEEKPEVLTKFGGKNENAGFF

SEQ ID NO: 150980 - protein, 76 aa, Heterodera glycines
  Coding regions on vcDNA: vcDNA=SeqID_77403; Strand=+; Position=1 -87,561-695,999-1007
  Homolog annotation: Hit_ID=AAM97982.1; Match level="QueryCoverage =97%, HitCoverage=12%, E-value=2e-18, Identity=56%"; Hit description =Abnormal cell lineage protein 45, isoform b [Caenorhabditis elegans]
MLHLPFDQHSKLHVRPNVSCREAISTILKKRNIVPEMCTVCVSEDPQSEQIDLSVELEVLARQLVRKELWVHSEVR

SEQ ID NO: 150981 - protein, 278 aa, Heterodera glycines
  Coding regions on vcDNA: vcDNA=SeqID_77404; Strand=+; Position=1 -145,467-590,769-1151,1338-1521
  Homolog annotation: Hit_ID=NP_525103.2; Match level="QueryCoverage =64%, HitCoverage=12%, E-value=3e-09, Identity=28%"; Hit description =CG5461-PA, isoform A [Drosophila melanogaster] gb|AAF53201.2| CG5461- PA, isoform A [Drosophila melanogast
MEEQLRSVCEKYDGPHEEIAKILSNLLPTTSATTNSNNNNHSANANNNTPTTLTPRSSERTTMDSNADIHYTQQQHHHNHVQQQQQHHFGDNSAAASLTAVHEPCNCGGDGGAAPAVVGDDGTTTAETDNEQQNRQCHHHHQHCYHHHQQQCQCQQGHHHYYFDGRTRDRSSSAPNINSVIRGGGVGGGIMGRGGGGGICLKLHTNSMHSGLHNIINSIQFPPNSAGMCRRSQTPTLLHEVECSTTVVANVGGAGGGHHRHGKGRGQGGSASTTTQWT

SEQ ID NO: 150982 - protein, 35 aa, Heterodera glycines
  Coding regions on vcDNA: vcDNA=SeqID_77405; Strand=+; Position=1 -39,220-288
MPSSLNSEYIGAKSFGTGDAARRHERKNQAFLPMF

SEQ ID NO: 150983 - protein, 226 aa, Heterodera glycines
  Coding regions on vcDNA: vcDNA=SeqID_77406; Strand=+; Position=1 -127,507-709,751-1101
MAPLTQAQTEQGRIDSLSSDTQLENEAILVQDRDVAQQNEDHAKHNWTRCKGDCDCTSAAQCQQNAQAYIASAKYDREFTPKKTMPLKLTKMAKQCHHKHACASSGTNHRVDYYDSGQFGDANCQHCGAVLLANEAYAIRKQGRVSPCCSNGQCHTEQMKAEFAELQNPPQKLKDLVAAPDERIRFEFLDNTMPLNNTFSFASVHSEKAPADQMAGRMDTVKYNGD

SEQ ID NO: 150984 - protein, 26 aa, Heterodera glycines
  Coding regions on vcDNA: vcDNA=SeqID_77407; Strand=+; Position=1 -55,399-424
MACSIIQSNLVNILIKKEVIPLIRSS

SEQ ID NO: 150985 - protein, 73 aa, Heterodera glycines
  Coding regions on vcDNA: vcDNA=SeqID_77408; Strand=+; Position=1 -133,189-277
MCLSLSPPVICPLLLLSNLGPIFNFWTEKTKFCGTRQAETKNSDANHQVFSTHHHHHPSKKRPMLETVGERER

SEQ ID NO: 150986 - protein, 64 aa, Heterodera glycines
  Coding regions on vcDNA: vcDNA=SeqID_77409; Strand=-; Position=1 -143,1007-1058
MPRIYNSATVRLGAIKGPTVRSVHNSLIKAVIIAVGQCRKSDVIVPLNANLRNWTMSSKHNTTT

SEQ ID NO: 150987 - protein, 646 aa, Heterodera glycines
  misc_feature (638)..(638): Xaa can be any naturally occurring amino acid
  Coding regions on vcDNA: vcDNA=SeqID_77410; Strand=+; Position=1 -80,149-191,246-282,346-412,916-1044,1100-1241,1331-1461,1547 -1675,1819-1895,1944-2022,2216-2431,2824-3003,3300-3445,3496 -3623,3949-4025
  Homolog annotation: Hit_ID=AAG23825.1; Match level="QueryCoverage =98%, HitCoverage=45%, E-value=0.0, Identity=63%"; Hit description =guanylyl cyclase [Heterodera glycines]
VVLCFDDIVQLRKFALNLFDGGLYTKEYVYIMPDNDLYLSFNLSRLPNLSRLPFWVQRSNNSIVLDGRDADANNSIVLDGRDADAEAIGRLFFWWHYDITFSTLSNRNYYGFYERVVNRTYGWPFYCPESDCGTVVNGSVYSILLYDTIYNYGIALNESGSVYSILLYDTIYNYGIALNESFKQFGIRPEVYRNGSLLASFRKPFMGLSGLSGYVITESDRNTRVLVLSNRRSEGSKNAFRILMQLGWKDGELNVSMSAGSSLINVSMSAGSSLIWSSHGGSAPLAVPRCGFDGNGCAVSVFDMYKGYFLSGIALSALLIIASVTIIVYLIHAKIVETRKNNLLWKIPFGLAKIVETRKNNLLWKIPFGLLKRQKQRRPERTAERSQHSLRSNQTNLSSLTNSTTDSLAQSKTFTLYSYNGEKCIVRIYCSTSLATMAFSVAQMAECRTLRLFDHENLNRFLGLSLDGPNVLAVWNFCARGSLKDVILSENAMVKDVVFIQSAINELCEGLYFLHSSPLQFHGRLKSSVCLINDRWQVKISYFGLRWLKNVQKIETKDFLWLSPEQLRKMGDNTNNNNTKDFLWLSPEQLRKMGDNTNNNNNDQQIDGSKQPDIYTLALIFTEMDMCPCEESDNTPPXIRGKRAAS

SEQ ID NO: 150988 - protein, 57 aa, Heterodera glycines
  Coding regions on vcDNA: vcDNA=SeqID_77411; Strand=-; Position=1 -96,145-222
  Homolog annotation: Hit_ID=NP_491091.1; Match level="QueryCoverage =75%, HitCoverage=14%, E-value=2e-09, Identity=51%"; Hit description =zinc finger protein 364 (33.4 kD) (1D595) [Caenorhabditis elegans] gb|AAF59555.1| Hypothetical protein Y5
MEYFVLDETVAKLDCDHIFHPDCLKPWLARNNTCPICRKQIDPSKWGPVISDVDELD

SEQ ID NO: 150989 - protein, 28 aa, Heterodera glycines
  Coding regions on vcDNA: vcDNA=SeqID_77412; Strand=-; Position=1 -61,595-620
MSLQCLTQEEVNTICKDVLESKMEPKCR

SEQ ID NO: 150990 - protein, 92 aa, Heterodera glycines
  misc_feature (83)..(83): Xaa can be any naturally occurring amino acid
  Coding regions on vcDNA: vcDNA=SeqID_77413; Strand=-; Position=1 -78,298-351,608-637,697-810
NAFLAFLTQITCRAKSQAHSMPAFWCHKCRSRCIALERYEDGVRCGRCHEGSLRKSTIFRKTILSVPRPIHRSKRRRRFVLQXHENPFGAFP

SEQ ID NO: 150991 - protein, 79 aa, Heterodera glycines
  Coding regions on vcDNA: vcDNA=SeqID_77414; Strand=-; Position=1 -189,238-288
QQTLWPQPPQSPRQQQFGAYGPQQQQPFGAPPMQNPPRTRGHVPTAPLNTLNGTQQQTRPLRNTCPNCQKHIDPSKWRP

SEQ ID NO: 150992 - protein, 23 aa, Heterodera glycines
  Coding regions on vcDNA: vcDNA=SeqID_77415; Strand=+; Position=1 -49,157-179
MRLPFGGYTFFSQTFEPLITASE

SEQ ID NO: 150993 - protein, 236 aa, Heterodera glycines
  Coding regions on vcDNA: vcDNA=SeqID_77416; Strand=-; Position=1 -167,215-236,303-389,473-548,622-722,776-914
  Homolog annotation: Hit_ID=NP_499095.1; Match level="QueryCoverage =100%, HitCoverage=74%, E-value=3e-48, Identity=45%"; Hit description= cytochrome 561 (3K601) [Caenorhabditis elegans] emb|CAA81603.1| Hypothetical protein F55H2.5 [Caenorhabd
MSLLLEYPNLLNEQQSAKLFNGAFVLSQFFGICAVLFVAVWMGGEGGFAWRSDPDRQFRYHPTQFRYHPTFMAMGILFFMAMGILFLQGEAILVYRVFRNERKRFTKLLHMSIHSVALLLLHMSIHSVALLLAVVSLKAVWDSHDFFHRSPNGELQPQPNLYSLHSWFGISAVSFYFIQFIIGFLTFLFPFIIGFLTFLFPGASLSLRKFVLPFHQLFGLIIFLCCTGAAFLGISE

SEQ ID NO: 150994 - protein, 320 aa, Heterodera glycines
  Coding regions on vcDNA: vcDNA=SeqID_77417; Strand=-; Position=1 -162,205-362,471-646,692-1030,1286-1413
TIQMEQPNQEIKTKRNKEKLEHEGSLYVLHKLSDDGLRKYWRCEFFGANDKCKGRLHTDINGNVLKIIGSHTCDMSAAHVECQRHITQLKRRAVETCEAPATIRAQVIKRVRHDEDVPPAAPLSLDALELPPSYRMYNRTENDEENFLLADTGVFQIQGQAGPQRILIFTRSSTSEWSGIMKNCCPYNVATLSCAVLLFPFSGKYEETNCCRGFNSGIAFLYFSNRIVHIKTYNNNAVFAEKSKMITSMAFLPVHHLSAGLTVLQAQLPQQLMGVFNWATMPSTITRLSKMTTITMPMSMLIPITSIICSLVFLAIMKCA

SEQ ID NO: 150995 - protein, 97 aa, Heterodera glycines
  Coding regions on vcDNA: vcDNA=SeqID_77418; Strand=-; Position=1 -72,538-677,725-803
MINRGEDIDERTVQKAGERSIKAELSALKRRAVTIGGDHTLSSKLPDNNSQEVSSSSNMDHPASPFLRYQGSLTTHPYTEGVTWTMFTDPLVITDEQ

SEQ ID NO: 150996 - protein, 28 aa, Heterodera glycines
  Coding regions on vcDNA: vcDNA=SeqID_77419; Strand=+; Position=1 -74,132-144
MSFKRVNSFQPDVPMAKKWDFRSIGYTP

SEQ ID NO: 150997 - protein, 89 aa, Heterodera glycines
  Coding regions on vcDNA: vcDNA=SeqID_77420; Strand=+; Position=1-389
KGCGLVAGVSRTSPCLWEGCSPLKLPPHQKSTMGGCFKTKTYWTTLKLPPDQIRFPKLLRVFFSRAAQRRGKVINHPPVTKVTGGGNSI

SEQ ID NO: 150998 - protein, 244 aa, Heterodera glycines
  Coding regions on vcDNA: vcDNA=SeqID_77421; Strand=+; Position=1 -256,302-780
  Homolog annotation: Hit_ID=NP_502799.1; Match level="QueryCoverage =85%, HitCoverage=33%, E-value=7e-10, Identity=26%"; Hit description =putative nuclear protein, with 2 coiled coil-4 domains (4P607) [Caenorhabditis elegans] emb|CAB16521.1| H
MVEMGTEIQTSRNELKSFQEEVDKAKNITLEHVEKNDLKKAKKSADVAKGIARQAKTKYTSTLEEYNDKSEKGFSGMVVRLNEALEAEKGPQKRERLANEDVQFNYDSIDQKFIVYLSSAVTHIDLSKHLAYVLGFKNTRLFHAEEATYMPDLTGGVRQLYIYAPNLIENTIIGNQMAPLLRIVNVVDDPGSISEVIYSTEYFHRLQSKRISEITIEIHTPFGEFVKFHWGSCILTLHFKKSIF

SEQ ID NO: 150999 - protein, 35 aa, Heterodera glycines
  Coding regions on vcDNA: vcDNA=SeqID_77422; Strand=+; Position=1 -55,199-251
MAQQMGEATNSLALALSKDTELADSISTTNYLIRD

SEQ ID NO: 151000 - protein, 163 aa, Heterodera glycines
  Coding regions on vcDNA: vcDNA=SeqID_77423; Strand=-; Position=1 -139,535-887
MPKAAKSNAVLNRHWISKFPEGTYSTDGKINPGLYKLIDIAKILTGVLKQLPPLMKPIFIEQYFYCSLIDVVTMLNDICKFWQNDQNKFLFTSVIWEMDLVNEEELNYEIKENKSGENASTNGTETKIAKLRIEFERKMKNFCENAKQNAMVATDQLEKAAKI

SEQ ID NO: 151001 - protein, 289 aa, Heterodera glycines
  Coding regions on vcDNA: vcDNA=SeqID_77424; Strand=-; Position=1 -687,1868-2050
MLIAFMKCHQQTQISKYSTQKYEAYLGTVYFMGKNLQCAKIGKRFEQYERTECQKYRKYLGILYEYLFREFAGHNTVKPKFMLKRYQFEMEEPSIIYVLHSLAKVLRFYLNPFISNLYQYKLNNLFSNKHFINEFEPKLLNAFGNDNEQEEMPINEPILKLAIYTANDGQSDEIVEEIINRIIFDRNLKKMFKKAEQRAKENGPWSANEISEDAHKIIWRSKFDDSLIWLYLRRVGFLCSIFLPPRQLGLGISLISHRFDFYVDEHFKEDRVKLDTRKLDTGRLDTILK

SEQ ID NO: 151002 - protein, 26 aa, Heterodera glycines
  Coding regions on vcDNA: vcDNA=SeqID_77425; Strand=-; Position=1-79
MDTVNSPSVSDQQLKSIGEQKRIAQL

SEQ ID NO: 151003 - protein, 174 aa, Heterodera glycines
  Coding regions on vcDNA: vcDNA=SeqID_77426; Strand=+; Position=1 -249,389-575,716-804
  Homolog annotation: Hit_ID=A49070; Match level="QueryCoverage=47%, HitCoverage=9%, E-value=5e-09, Identity=37%"; Hit description =ecdysone-inducible protein E78A - fruit fly (Drosophila melanogaster)
MNIYSAQTYYNNTSPAEVKKAIQMELDFVHRLLLGIQNDNLWAIEARRIQNFVIFVKAPYYPVAKKLLPDMHKKATLENFYGQQKSIESMENWQQNRTHYTEIIDESSEQQNNNYGQGRSKRQLANCKICGRQCQYIFYGVKSCESCKQFFRRVVTKQILFTCPRRNGVGSWDN

SEQ ID NO: 151004 - protein, 153 aa, Heterodera glycines
  Coding regions on vcDNA: vcDNA=SeqID_77427; Strand=-; Position=1 -447,590-604
MEFGKRPSTHLSTLSDNASKKPTSDYHYTILNDQLEAISQQMVNNCADSITKQLLQICVDLVQQVQQYQCVIPEPMTTGSSKRETRQRTAPQCRGAKHAGTAGDKHRGESPPTGLNYCMYSTSLAPSARFLITELGLHTKLDKATARYTYQRY

SEQ ID NO: 151005 - protein, 260 aa, Heterodera glycines
  Coding regions on vcDNA: vcDNA=SeqID_77428; Strand=-; Position=1 -140,373-487,543-618,1147-1282,1642-1813,1859-1901,2039-2075
  Homolog annotation: Hit_ID=NP_503715.1; Match level="QueryCoverage =96%, HitCoverage=51%, E-value=5e-93, Identity=64%"; Hit description =acetylcholine receptor (acr-17) [Caenorhabditis elegans] gb|AAB42293.1| Acetylcholine receptor protein 17
NFNLLTQKLKYWQDEFLRWEPSKFGDIRQLHVPAEMIWRPDLLVYNNANMNVRESEMMTNALVQHDGRVSLFRAIITDITCHLNLHRFPFDQQICHHRFPFDQQICHLMLASWSYDGSQVEVQRASSPAGGPKSTRRPSFMQTLTHYIPNMEWTLIDFRTRSNLKWYDCCPNPYPDICYYFSIKRNPSYYLFTLIMPSALITTITVVGFFTPHSTTGENTEKVSLGVTSLLSLAVSLGVTSLLSLALILGMVSDKLPATS

SEQ ID NO: 151006 - protein, 48 aa, Heterodera glycines
  Coding regions on vcDNA: vcDNA=SeqID_77429; Strand=-; Position=1 -23,717-840
MALVSFGCNRYDWHGHSFLGRSRNGGQTNKLFVIDKKTIHENSKNAVQ

SEQ ID NO: 151007 - protein, 92 aa, Heterodera glycines
  Coding regions on vcDNA: vcDNA=SeqID_77430; Strand=-; Position=1 -103,148-322
PNIPTLAPSVDDGLFFRNGRGTSADDNRATEHSEERSGSNSTLQKDVIDALLDKNAVPPDLITSLMAGVGGSAFSKALELVPSYNQSSQKMA

SEQ ID NO: 151008 - protein, 147 aa, Heterodera glycines
  Coding regions on vcDNA: vcDNA=SeqID_77431; Strand=-; Position=1 -100,365-442,815-857,1472-1692
MSVLIARIAELNRANTIEPSIASSADLFGQDGNGSDDNEFHLDDECGQKKEESEMPTNEEEAKTAVEQKHEQQSWVVFGFAVKQQTKLELMIKKGTYYAYDCYGDIWINEEVKERNAQYSYGAGDTVGIGFNSSNRQIFFTKNGLRL

SEQ ID NO: 151009 - protein, 235 aa, Heterodera glycines
  Coding regions on vcDNA: vcDNA=SeqID_77432; Strand=-; Position=1-708
MLYCDTDSVYFVRARRPPGPQQQQFLRSEGDAFGQLMREWPGRRIVQFFSAGPKNYGFRHRCAASGGDERAERKVRGLELTCTASQLLPFERMRQCSTSSAGEHEGVGGITMECVCVCVCMLPPNRMPDAEQRVAVPCTRFVRTKRAEVFTRRGTKLYQPVYTKGLVVALDAREAGGGAGNAYFTRPFGWYDDDDDDDDADRDDAEEEEAEDGELSDESDTDDDDDDDVDFLVLG

SEQ ID NO: 151010 - protein, 621 aa, Heterodera glycines
  Coding regions on vcDNA: vcDNA=SeqID_77433; Strand=-; Position=1 -619,1066-2312
  Homolog annotation: Hit_ID=NP_502797.1; Match level="QueryCoverage =64%, HitCoverage=99%, E-value=2e-44, Identity=30%"; Hit description =HASI (4P602) [Caenorhabditis elegans] emb|CAB16520.1| Hypothetical protein Y57G11C.19 [Caenorhabditis ele
MTLKHTVRMLLIPEDVYRRLMDNPSAAAATSSTTCMNKLPTPATPIEHTARKMVAASSKHTNDDERLIHYQQEFKRYQKLLEEEAERPLNVQLSQRTTNALRDTVLQKASPATATPPPARPQRTTPLSRRRGLQHQNQAPSASSSSSTRPTKSSSSSSNEQQQPLPQQTAAPQKIGDLPKQAEPRIHAAMAYAQQNPGLLGVGGEDASIMVIGSNAVRSLTVESLLDPIYKDERSPACFTSVEPLLREAKRRHPDARLTRAEISRYLAGQRVYTLHRQVRRRFRRLPTLASGLHTDWQADLADFQRLRAQNRGYAYLLVCIDTLSRQVYVQPVKSKRSDDMIAALKRTFARCGYTPWRLLTDKGREFTASAVQRYLRDEAEVRHHCMETSPLWHAGMAERANRSIKERLYRYFTHRGTQCWTRVIQRIVSSLNASPNSSIFGMRPNEVCFDNAESLRQRIADRAEAERGGRASQHARFRPGDHVRIERARGAFRKGYLPRFTDEVFTVDRVCTGRRPITYKLRDMNGEPITGLFYANDMCLVLVVPPSLDDSSIRSRGSIDKRKTRKRLPDGIDNNNNNKVYAIERILERRYRKDGTECCLVKWKGYSTRHNSWIPAHTII

SEQ ID NO: 151011 - protein, 240 aa, Heterodera glycines
  Coding regions on vcDNA: vcDNA=SeqID_77434; Strand=+; Position=1 -468,522-776
MDSFGTVAWILRPTAQTTGTAVGSMEYEEEENGTGKLVHSVTATVTTPTTAEFRLEKEAPSSEKDGAEEGSGGHGTLLFIESDDGEEEEEDEDIEDTPVATDSPSAATATVVDDSSDTVKGVEQQRSSEHSDVTDGAGGGGGSEGAKLLGGGEEEEPVRMPLLNYLCAFNDCSMKELQLLFHSVHARQRMVSHLQQHCRLHTAHLKPAERNIALHCHDLSVQNANRTFACGGYLELTVIR

SEQ ID NO: 151012 - protein, 23 aa, Heterodera glycines
  Coding regions on vcDNA: vcDNA=SeqID_77435; Strand=+; Position=1 -39,292-324
MNSFNTTIFINDNFKDLMNNFEG

SEQ ID NO: 151013 - protein, 18 aa, Heterodera glycines
  Coding regions on vcDNA: vcDNA=SeqID_77436; Strand=+; Position=1 -42,106-120
MDSDNKDRRAVVGVMSSH

SEQ ID NO: 151014 - protein, 86 aa, Heterodera glycines
  Coding regions on vcDNA: vcDNA=SeqID_77437; Strand=+; Position=1 -148,764-876
MYFSPPTAFVAESLLGPVGYKFFAGTFIISFCSTCCYVSIFVIIRCKNGAVQTIGTNQVRSANPNNKMNKIRSSQQRNVHTINLNR

SEQ ID NO: 151015 - protein, 68 aa, Heterodera glycines
  Coding regions on vcDNA: vcDNA=SeqID_77438; Strand=+; Position=1 -91,1725-1840
MPPKRKTVIIIECVWKAANTGRFAHFQHGGTVQTIDTIQVRSANTNNNMNNIRLSQQMNVHSINLNRY

SEQ ID NO: 151016 - protein, 358 aa, Heterodera glycines
  Coding regions on vcDNA: vcDNA=SeqID_77439; Strand=-; Position=1 -917,1065-1223
  Homolog annotation: Hit_ID=XP_472508.1; Match level="QueryCoverage =86%, HitCoverage=73%, E-value=3e-54, Identity=38%"; Hit description =OSJNBb0049I21.9 [Oryza sativa (japonica cultivar-group)] emb|CAE02268.2| OSJNBb0049I21.9 [Oryza sativa (j
EETQLGEDGYALYKRANNGDFEYVKGIKLTNQNIAPYNPYLLLRFQSHINVEVCSEINAVKYIYKYIYKGYDAAIVQCVKEGPNGEQILLKYDEVGQYLEARYLSPVEACYRLFKYELQGKSHKIERLDVHLENEQVIYFDENANDDNLEEAMQKRSKLIAYFDFFKDCPNAPKFKYVEMPTYCTFDNKNRKWKWPRKGTHKVIGRIYTVNPKNKELYYLRYMLLHKHATSFEDLKTVNGIKFKTYAEACLAMGLTRDDMEWDKCLNEASQFKFPKGLRALFANILINCEPKYPSLLWEKYKDALKDHIINPKEELNLTLNKYSIMNEEQKNIFDYIKDTIEHPGENKKNCFYIDGPG

SEQ ID NO: 151017 - protein, 157 aa, Heterodera glycines
  Coding regions on vcDNA: vcDNA=SeqID_77440; Strand=+; Position=1 -85,309-697
MANFFIIPRRKTIQLLLFIILFKITLQQDSLIETKQLVDQAKSLFNQIKKGNFGANSAIEWIQKNAIGILCNSEFESKMDESLNKLQNKFCDSLENGNYQNLKEMLQTTKIEEKTFDKSQMDKAIAKDQINKGKNKQMFKQLFNNSSNLFEISEKIL

SEQ ID NO: 151018 - protein, 207 aa, Heterodera glycines
  Coding regions on vcDNA: vcDNA=SeqID_77441; Strand=+; Position=1 -301,490-812
MKWIQKNAIGILCNSELKSKMDESLKKLQNKFCDSLENGNYQNLKEMLQTTKNEEKAFDKRQMDKAIAKDQMLNDNNKRMFKKLFNNSSNILEIHEDLIEAERLAVRQQQMPNGFMGRRKKRARDSAIKGCVTAVLLTLISAPYLGYYSNKYANEGNVMVQVNRCKKRFNVRHCYQVQQSVVTQIFEWTILLAIGLICALIFCSCVR

SEQ ID NO: 151019 - protein, 407 aa, Heterodera glycines
  Coding regions on vcDNA: vcDNA=SeqID_77442; Strand=+; Position=1 -26,2103-3186,4434-4586
  Homolog annotation: Hit_ID=NP_510849.1; Match level="QueryCoverage =88%, HitCoverage=26%, E-value=1e-69, Identity=38%"; Hit description =predicted CDS, zn-finger, CCHC type and RNA-directed DNA polymerase and Integrase, catalytic domain conta
EKGGREEEQIKQEKLAKLFEGRVIVPTSLRSRILKALHIAHPGIVRMKALARRHVYWPGMDSEIEKVVSTCEECQLGQKKPTKAPLSPWPTTDKVFQRVHVDFAGPCSDGHQYLILIDSFSKWPEVYRMNTISAYATVFVLRSIIFRLGIPEEIVSDNGTQFRSAEFATFCKEFGIKHTFTPPFHPQSNGQVERFVDTFKRSMRKMSKGEDWIERMLFAYRTTPHVALNGFSPDQLFFGRKLRTKLALVHPKGEKDENFDQNSFNKMAQNFDRKHGSKLINFFPNDHVLLINYRNNKTEWLQGKIVERLHKSPTYRVYVPVLRRVVHRHANQLRRRSFGRRSRKRGTSSQTAAAGCRIASGGETLSQKIIGSVLQIGKSPTKKGKEVNEESSSAVEQEAFALDRNEN

SEQ ID NO: 151020 - protein, 101 aa, Heterodera glycines
  Coding regions on vcDNA: vcDNA=SeqID_77443; Strand=-; Position=1 -141,249-413
  Homolog annotation: Hit_ID=NP_505204.1; Match level="QueryCoverage =98%, HitCoverage=18%, E-value=1e-22, Identity=54%"; Hit description =asparagiNyl tRNA Synthetase (nrs-2) [Caenorhabditis elegans] gb|AAC25799.1| Asparaginyl trna synthetase p
VILGAEYVPTKHQREFLQIVGRGPDLTIISRVSSKVWLGFHRLAIVQPGDSPSEQPICADGLSVVCNGEIYNHRTLKDNSLLDNSSSDCPLPPPPFVRANF

SEQ ID NO: 151021 - protein, 64 aa, Heterodera glycines
  Coding regions on vcDNA: vcDNA=SeqID_77444; Strand=-; Position=1-194
FYLILLKRAKIITQNNKTKIALTFKFHSANFRPFCSAVHECLLRLLVLFQRFVFVVKWEVQILA

SEQ ID NO: 151022 - protein, 239 aa, Heterodera glycines
  misc_feature (237)..(237): Xaa can be any naturally occurring amino acid
  Coding regions on vcDNA: vcDNA=SeqID_77445; Strand=-; Position=1 -26,1224-1442,1782-2213,2874-2918
  Homolog annotation: Hit_ID=CAB62280.1; Match level="QueryCoverage =96%, HitCoverage=91%, E-value=4e-38, Identity=37%"; Hit description =hydroxyproline-rich glycoprotein DZ-HRGP [Volvox carteri f. nagariensis]
GPINTPKPGGEDEDGEVVDTPPRPPAPPPPPPERRAWRGPSPPPPPPPPGRRPRPPPIPPAPPSPPGSPPPRPERPPRPSRRSPPRLPSPSRAKPKPPPRQPTTKREQQKPKKLELKPPKIEPKFEPDSRPSTSKVAPRSKKEPEFPLDPRPSTSRQAGYIPPPAPKIVPKHEPTKRPVPYRIPKREPKIVEETPQRQQQPLPAAVVEEMPPVPPPRRDQTPPPPFQEPKLLRLGSXPM

SEQ ID NO: 151023 - protein, 203 aa, Heterodera glycines
  Coding regions on vcDNA: vcDNA=SeqID_77446; Strand=-; Position=1 -162,491-601,673-748,999-1131,1549-1678
  Homolog annotation: Hit_ID=CAE69097.1; Match level="QueryCoverage =71%, HitCoverage=28%, E-value=1e-45, Identity=52%"; Hit description =Hypothetical protein CBG15122 [Caenorhabditis briggsae]
MPSNGTETMALDNNSDKMGFEIGQNVTQIHSNNGSKNLSSGIGQHLLEQFGMINDCVFRPTFDNYLMIFAFCVIFCLSVVGNSIVVVVILQQRSMRSVTNLYLLNLALSDLLLSVVSVVVTASAYTLAAIALERYYAICKPLHSRVWHTPTHAMFVISLVWLVSVIANVFMLFMYEERTYNRNGLNCAPKFEPIVHFGYQVAF

SEQ ID NO: 151024 - protein, 262 aa, Heterodera glycines
  Coding regions on vcDNA: vcDNA=SeqID_77447; Strand=-; Position=1 -53,880-1026,1082-1184,1239-1291,1351-1388,1433-1484,1536-1632,1684 -1761
  Homolog annotation: Hit_ID=CAE69923.1; Match level="QueryCoverage =97%, HitCoverage=45%, E-value=5e-54, Identity=49%"; Hit description =Hypothetical protein CBG16284 [Caenorhabditis briggsae]
RRPKEIPALFVPGGRRESALPPRRAHSPLFSRTTSAQSLPAPTTDQSSLYERTLYQLTNDPHFQKEIALGKRIGFYRLGKEIALGKRIGFYRLGKELGAGNFSKVKLGVHVLTKEKVKVAIKVMEKSKLDQKALRLLTRRLLTREMENMELMHHPNIIRLFEVVTTLSKHHPNIIRLFEVVTTLSKTYLVTYLVMEYAGGGELYTYVHETGKLTEEVAKPIFAQIVSAVAHLHGKGIQIVSAVAHLHGKGICHRDIKGGGGG

SEQ ID NO: 151025 - protein, 99 aa, Heterodera glycines
  Coding regions on vcDNA: vcDNA=SeqID_77448; Strand=-; Position=1 -116,159-415
HHKIKNSQVFFVCFVVFPTSLSALSLTISSFFSLIIRLTSVFTFACLTADAFFGGAIDLKPFLGPLVGAPFCARFIDFCFAPAGKVVFFFIPCCAICAA

SEQ ID NO: 151026 - protein, 408 aa, Heterodera glycines
  Coding regions on vcDNA: vcDNA=SeqID_77449; Strand=-; Position=1 -291,341-400,445-579,707-875,919-1010,1058-1084,1129-1185,1242-1409
  Homolog annotation: Hit_ID=NP_493723.3; Match level="QueryCoverage =98%, HitCoverage=97%, E-value=5e-92, Identity=50%"; Hit description =nucleotide-sugar transporter (2A681) [Caenorhabditis elegans] gb|AAB66127.3| Hypothetical protein C03H5.2
AVSSAKSSSALKWVSLIVLIGQTTALVLTLRYSQTQKSHPSDGPKYLSSTAVLMAEIVKFFTCVSVLGYQNKWNFGRLLHDFDRDSLKVGVPALLYVVQNNLLFLALSKLDAATYQVVQNNLLFLALSKLDAATYQVTYQLKILTVTYQLKILTTAFFSVTMLNKKLDLIKWMSLILLTFGVALVQVSRNEKAFGADNPPQKSTGDGFVGLFAILAACCSSGFAGVYLEKILKTSQVQLWVRNLQLAFFSIFGAFAMFFSIFGAFAMTLLYDWAQLQQWGFFHGYNWIIWTVIALQAIIWTVIALQAYGGLVIALVVKYADNILKVIALQAYGGLVIALVVKYADNILKGFAGFAVSLSILLSSFVSWAFLADFVPSLTFTLGASIVILSTFLYGYEPKRLVQPAERS

SEQ ID NO: 151027 - protein, 155 aa, Heterodera glycines
  Coding regions on vcDNA: vcDNA=SeqID_77450; Strand=-; Position=1 -69,299-387,440-525,719-831,882-992
  Homolog annotation: Hit_ID=NP_496593.1; Match level="QueryCoverage =91%, HitCoverage=94%, E-value=3e-41, Identity=50%"; Hit description =SPP30 (2M498) [Caenorhabditis elegans] emb|CAB55019.1| Hypothetical protein Y57A10A.16 [Caenorhabditis el
MMRSSAVRTVGILDKSLSKGKHEINLSTFALLFVEMVRYAQNKVTTIQGLQERLTGYGKFVGVRLLDLIAIREAKSKTNGLYFLIEKEPIVNTFISLPKDKGSLNCAAFIAGIIEAFLTESNFPCKVTAHWHMGTAYMIEFEEEVILREKMEASR

SEQ ID NO: 151028 - protein, 304 aa, Heterodera glycines
  Coding regions on vcDNA: vcDNA=SeqID_77451; Strand=-; Position=1 -151,193-397,441-476,519-704,745-918
  Homolog annotation: Hit_ID=CAE68725.1; Match level="QueryCoverage =97%, HitCoverage=51%, E-value=8e-63, Identity=44%"; Hit description =Hypothetical protein CBG14651 [Caenorhabditis briggsae]
MKKKNCQCRQLIGRIWLFSRYSTGWACNLHADYTELVASNCVSNKLSAIEGSRHKRRFFLTTSRHKRRFFLTTFLRNPIDRFISEFTHVSERGATWGRARLFCRGRSPTPEELPACFDPKVGWRNISLDEFLSCPYNLAFLSCPYNLAFNRQTRMLSDLNLINCYNSSSMDSTVFNRQTRMLSDLNLINCYNSSSMDSTVRDRIMLESAKFNLRHFAFFGLKENMTESQFLFEKTFGLTFDSDLALWFDSDLALWNRSKSAHVIPTDRQLGQIRQRNLLDLELYAFARRVFKLRLSKQKTAVIR

SEQ ID NO: 151029 - protein, 53 aa, Heterodera glycines
  Coding regions on vcDNA: vcDNA=SeqID_77452; Strand=+; Position=1-159
MKSPTNEPVLEYRKGSAESDALEKELQKLWAEPMEVPLAIGGEKTFRKEKAIS

SEQ ID NO: 151030 - protein, 294 aa, Heterodera glycines
  misc_feature (207)..(207): Xaa can be any naturally occurring amino acid
  misc_feature (215)..(215): Xaa can be any naturally occurring amino acid
  Coding regions on vcDNA: vcDNA=SeqID_77453; Strand=+; Position=1 -61,378-475,587-755,805-892,1168-1475,1514-1578,1996-2013
  Homolog annotation: Hit_ID=P54099; Match level="QueryCoverage=99%, HitCoverage=22%, E-value=2e-38, Identity=34%"; Hit description=DNA polymerase gamma subunit 1 (Mitochondrial DNA polymerase catalytic subunit) (PolG-alpha) gb|AAF82772.1| mi
TWSFNMGNDGHFPQGPMFSIPFPDEELLFFDVEVCMKDPRLTTLTVALSTTKWYSWCSERLADPSTELPGLVLPEHLIPMTSAKSRLVIGHNVAFDRTFIREQYYLQETAMRFWDTMSMHETAMRFWDTMSMHIAIGGMADHQRDLFNKMKNNKKEEENEENEAEKATECETESKKQSEWDKRMQSFFKTATIDQIRSNGCVHHQSXFHAFLLNXLRHAFKILKVLFDYCASDVQATQAVFRKLYPIFKNRFPHPVTFCGMLEMGNPFPHPVTFCGMLEMGNPYLPITKFWPRN

SEQ ID NO: 151031 - protein, 141 aa, Heterodera glycines
  Coding regions on vcDNA: vcDNA=SeqID_77454; Strand=-; Position=1 -158,981-1119,1166-1187,1894-1999
  Homolog annotation: Hit_ID=CAE57739.1; Match level="QueryCoverage =37%, HitCoverage=6%, E-value=4e-10, Identity=58%"; Hit description =Hypothetical protein CBG00750 [Caenorhabditis briggsae]
ELKDEIAIKSRARENLMFAVEEKPKEERIKLSQQKDELILKCSFNQYDCDIQKLTSDAICQRVRVFANLGSSWLPDNCARQVDSAICGCIWLQCTDGVHVFIWSANVSDPVARDCIKNTSRMLGDLIATGALRNCKCHQPC

SEQ ID NO: 151032 - protein, 120 aa, Heterodera glycines
  Coding regions on vcDNA: vcDNA=SeqID_77455; Strand=+; Position=1 -59,169-409,1199-1261
MISDELNSDETISDEMIGHQYTDHYFLSALLYSIFLGPFAVDRVYFSSKLHFKILVEYFGGNEIGGSGWKRQRIKRILILLSIIGTSTAAFKLGGGSGSVVTILGFLVLKIPVQLICNCK

SEQ ID NO: 151033 - protein, 244 aa, Heterodera glycines
  Coding regions on vcDNA: vcDNA=SeqID_77456; Strand=-; Position=1-735
MKLCLFLFLFMFLIVEIAKVGSEEKKLQQKSFDEIFGEKWEEKEEKQRNEQKKREIIRKYYKIKEKIKQKGRKYPKKEWHKIDQKIAKKLGTNSNYIQKWIKEFGVQKNKCHKSKTDEEKIEIIQKFIKMTNEYKQKRKYSLKEWKQNYAEICKKIGVSQFAIGKWKKKFGIRCRITEKEKMEKMKKYWKIKSENPKMSDKETAKILQIDRTTISKWKKQLGGEILEDLNKFSNKKIIYDIKTD

SEQ ID NO: 151034 - protein, 100 aa, Heterodera glycines
  Coding regions on vcDNA: vcDNA=SeqID_77457; Strand=+; Position=1-303
MEIKKEEKEKMGKGTKFKSERKIKWEEVSNTFRSDQKFASLVPESPQGNPRSFNGASSGASNSFSFGWDGGLVAEDGPERLPQNGLHHPTTVLEESRRWR

SEQ ID NO: 151035 - protein, 326 aa, Heterodera glycines
  misc_feature (269)..(269): Xaa can be any naturally occurring amino acid
  Coding regions on vcDNA: vcDNA=SeqID_77458; Strand=-; Position=1 -476,747-1254
  Homolog annotation: Hit_ID=NP_500013.1; Match level="QueryCoverage =93%, HitCoverage=21%, E-value=6e-71, Identity=43%"; Hit description =predicted CDS, polyprotein family member (4B673) [Caenorhabditis elegans] gb|AAC02594.1| Hypothetical pro
VKTKWDTKVKKQKRELKNVIEKHKNVFSTHHYDLGDCKGKAPPILTTSDVPAKTKPYPVPEKYERELKSQIEKMLKAGVITESFTPWAHNVVLVKKSNGQLRPCVDFRPLNKITIPDPYPIPRMDKTILRVAGQTFYSTLDLASGFWQIPLDSESSYKCHILNGKGYRPSLNNQEVIEGFPEPKNAREVKRFLGMMSFFRKFIQNFAEIANPLQQLTRGKIPEFVWGNREKEAFEKLKNNLLNAQCLRAPNYELPFYLFTDASAIAYAXALMQSQNNDLYSVGYWSRTLSTTEKLPPTHGELAAIVHAVQNFRPIISGRCIIESCN

SEQ ID NO: 151036 - protein, 63 aa, Heterodera glycines
  Coding regions on vcDNA: vcDNA=SeqID_77459; Strand=+; Position=1 -110,1176-1257
MNGEEWVILVRYICDNCRRFPNMMVSVLFGEFGKVMRPIMPPHEISGSGFASHNAKMCPMNHF

SEQ ID NO: 151037 - protein, 174 aa, Heterodera glycines
  Coding regions on vcDNA: vcDNA=SeqID_77460; Strand=+; Position=1 -110,984-1166,1227-1309,1752-1790,2021-2130
  Homolog annotation: Hit_ID=XP_311999.1; Match level="QueryCoverage =54%, HitCoverage=20%, E-value=8e-17, Identity=41%"; Hit description =ENSANGP00000018676 [Anopheles gambiae]
VHMSCCASTGRHQQNDAQNAVDPCAHVVHVLMCYQMTISNCFNSLQFGVSFNCAFENISLSTDGSFSELPDHWCSIAYFELDTQSGELFKVPWQIKEVAIDGGMDPSGALSARFCLGALANVHRSHFMDFEFGGGSGGGDSIVHKICPGVERKVFDLRWAYVEMCRRRENAQLS

SEQ ID NO: 151038 - protein, 80 aa, Heterodera glycines
  Coding regions on vcDNA: vcDNA=SeqID_77461; Strand=+; Position=1-242
MRTPSPAFPRKCPRLRCAVNAVPKRGSTICEGSGQNSGNCCCAFVTLLLFRCAAPFRLVLSKDGAKGTDGGQSKRRHVGL

SEQ ID NO: 151039 - protein, 86 aa, Heterodera glycines
  Coding regions on vcDNA: vcDNA=SeqID_77462; Strand=+; Position=1-261
ELSKLLEIADYGMQYRAVSHVGAVLGSSRDTGTKSADPNDPTVPKEQVPPRWLENWRNRRAKAAQKRESNEKGKESEVILDGNRDN

SEQ ID NO: 151040 - protein, 249 aa, Heterodera glycines
  Coding regions on vcDNA: vcDNA=SeqID_77463; Strand=-; Position=1 -159,480-762,1023-1088,1161-1402
MLENVMANADNQFGTGKPRQTINGRWTIGQMVEKQRQLHQQMISQQQQQQQQQKEFATMAMQIHGKRSEQNKRKLTNERRKSQKREITEVAKARDSRAVLWKISIKISQKLLANGIERPKTLILTNERIAKLPDLPNGQKSNNLTLKGYYGPLKAIDRENEQTNGREDTDINPPPEGTRIKMDGRNDGKANERERQWHRKDGTISPYVNAPEEITGSRFRNIDEQFNAMNGGNGGRGQNRYVKMDLLNE

SEQ ID NO: 151041 - protein, 273 aa, Heterodera glycines
  misc_feature (93)..(93): Xaa can be any naturally occurring amino acid
  Coding regions on vcDNA: vcDNA=SeqID_77464; Strand=-; Position=1 -192,246-297,496-725,778-883,996-1113,1611-1681
  Homolog annotation: Hit_ID=CAA74206.1; Match level="QueryCoverage =97%, HitCoverage=71%, E-value=6e-63, Identity=47%"; Hit description =serine proteinase [Heterodera glycines]
CRIKFLTEKLRISYGNEYVSSQPYKSAVVSIQLYPNAKYYRIYDNFGDETSRADLILHDIAIIKIKNPIKFTIKNPIKFTSNVRPICLFGFQXKNKTLRFNARKISDEKFKIRNTKFIIAGWGMTRPQCAKDQNKTRNDQLNYGKMRMISTQKCREMANEKKNCKLSASDDAEIESASDDAEIESMLNEFETYGLDTTFCVVPDPSIGEPGDSGSPLMLKIGTNNWIQLGVATKTSCNSKDPTSTEELFAQYTPIDCAWIANGTHGEVKCIGW

SEQ ID NO: 151042 - protein, 119 aa, Heterodera glycines
  Coding regions on vcDNA: vcDNA=SeqID_77465; Strand=-; Position=1 -112,808-1055
  Homolog annotation: Hit_ID=NP_871684.1; Match level="QueryCoverage =46%, HitCoverage=15%, E-value=8e-10, Identity=45%"; Hit description =UbiA prenyltransferase family member (40.5 kD) (3I27) [Caenorhabditis elegans] gb|AAN63396.1| Coenzyme q
MLSTICYLSIVLGSSSVFFVALYPLAKRYTNWPQLILASGSHLAWQLGTLHVDDPSDCWQKFLANQWLGTVIFCGILLSNLLKKGETNDGNSEEELEMDEQEKFMMYFVQRNMNVNFYT

SEQ ID NO: 151043 - protein, 35 aa, Heterodera glycines
  Coding regions on vcDNA: vcDNA=SeqID_77466; Strand=+; Position=1 -93,142-156
MLRLRREPKNMDLEDNPEEQRMQLTRHMANRMQIF

SEQ ID NO: 151044 - protein, 84 aa, Heterodera glycines
  Coding regions on vcDNA: vcDNA=SeqID_77467; Strand=-; Position=1 -59,214-409
MEIDDFIKKFTEKRVIGHTRRLKAEKLAELLRQQCQYQPQHPSPSALGMTTQTQYSSQGVAASMYPVLGQAYTSPANFRHSYMS

SEQ ID NO: 151045 - protein, 277 aa, Heterodera glycines
  Coding regions on vcDNA: vcDNA=SeqID_77468; Strand=-; Position=1 -675,721-876
MLIAFMKGHQEIQFSEYSRQKYEAHLGIMHFMRMNWQCDKIAVEFEEYERTECQKYRKYLDILHEYLCREYVGIHTKKPKFVLKNKIEIEGPIIYAVNCLATIFQFYFNSEESEFNEYKLNRLFNYNYEPKLLNNEKRLDYEQKLSINEMILQLAIDTANEWQTNESLDGIIRQNCGDKFDKKLEKMFKKAEKRTKEYGPWGANEINDDKHLIIAYSEFDDQWKWIDDALFSEFVKGLATNLENFFKMAKEYSNYLRLKKEKGYYIIFNEKRMIFFW

SEQ ID NO: 151046 - protein, 80 aa, Heterodera glycines
  Coding regions on vcDNA: vcDNA=SeqID_77469; Strand=+; Position=1 -22,212-261,307-399,1156-1233
MPVVAAVGLAPAVANAVAVAVAGHAVAAAVAAAVADVRSAQLSSARPLKRPKPENQLILNFFVFYLKITTHCLRSIYENV

SEQ ID NO: 151047 - protein, 76 aa, Heterodera glycines
  Coding regions on vcDNA: vcDNA=SeqID_77470; Strand=-; Position=1 -68,1531-1693
MPSLIGTAGPSVPSFLKNCTAKKCQPCFVIKVARECEIGMIGNRKVRVIGITIFTRDEGFTGMTKSKFICGRINFH

SEQ ID NO: 151048 - protein, 500 aa, Heterodera glycines
  Coding regions on vcDNA: vcDNA=SeqID_77471; Strand=-; Position=1-1500
MPSKQQNKRKKELERYRRRTEQSVSPVRSPVPDGSADGNGAASPRGFNTPNISALQLSTPASSTGSKRRGRPQKAGAKPILATQERVSLIDTPRTAVTQSDQGSPCKKRGKVAECGQPMFANEAIALTPLSTQSRGGRPVKQLGGHAGKGRGKTNECMSKCSEMDQTVENALSPAPSHIVFEKIDFSSVQINFATSRNFACKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPGHWTLIVHDVQFGTHFADSLPTTYGRLDPQLTDKIKNIISDILPSAVLTGIVDVENLTVQHDGNSCGYFVCLYAESWLMNNRTFVLPDLSINYEKKRILWHINELYGSDNVPYHPREGVPTPCPIVYRHTDEAQSTSKAAELMEVDEYDDIMIIEPHTSGQAVDAILTQAQVAGENQADTLGLVSESCIPQEPIAQADD

SEQ ID NO: 151049 - protein, 80 aa, Heterodera glycines
  Coding regions on vcDNA: vcDNA=SeqID_77472; Strand=+; Position=1 -157,411-496
MAFPLGGPATCMAKASASLGVISISWSQSRPIWVPWSQSRPALCHGRKADRHEHFFSVKCKDFLILFWSLCVTKCTKLNS

SEQ ID NO: 151050 - protein, 56 aa, Heterodera glycines
  Coding regions on vcDNA: vcDNA=SeqID_77473; Strand=-; Position=1 -48,261-383
MSMIQTELVSMYTETNQTIEVILAVSRRSAKVFCLSLRADMLRYCSEYDDSQSCEF

SEQ ID NO: 151051 - protein, 192 aa, Heterodera glycines
  Coding regions on vcDNA: vcDNA=SeqID_77474; Strand=-; Position=1 -64,171-320,776-922,1073-1207,1255-1337
  Homolog annotation: Hit_ID=NP_066267.2; Match level="QueryCoverage =96%, HitCoverage=17%, E-value=5e-18, Identity=29%"; Hit description =ankyrin 3 isoform 1 [Homo sapiens]
MASNPNAQLLDACEKGAALNHIKSLIERGANVNFADENGLSPLMGACVFGHIRIVSYLIELGATIEQKDVKGLTALGHAVNENQIESVKMLTGKNANCLVFANDNRSPLVIACQEGRMEILSHLNLNHCDEHGITPLMVATQEEKLDVVCFLLQNGADKSQTDAKGRTALAFADDLCDSKERNQLLKLLSDR

SEQ ID NO: 151052 - protein, 47 aa, Heterodera glycines
  Coding regions on vcDNA: vcDNA=SeqID_77475; Strand=+; Position=1-142
LTRHISALVFISQKIKSLFLRTHGCSMHPPNFIPKLHGHLKTFLCVA

SEQ ID NO: 151053 - protein, 45 aa, Heterodera glycines
  Coding regions on vcDNA: vcDNA=SeqID_77476; Strand=-; Position=1 -13,353-477
MIHSQIVYGPESYTDFYGLRIFILNPYECLIRNPDPYFLKMPISN

SEQ ID NO: 151054 - protein, 57 aa, Heterodera glycines
  Coding regions on vcDNA: vcDNA=SeqID_77477; Strand=-; Position=1 -5,116-284
MGQLPIELLTEHSEEIEHLILDENELDEQALEDIPRLDKLETLSLNGSVDRQFNRRK

SEQ ID NO: 151055 - protein, 109 aa, Heterodera glycines
  Coding regions on vcDNA: vcDNA=SeqID_77478; Strand=-; Position=1-329
MLHPSTHCARKISRKQYSNAPDGAEECGGNADALLRKASRKLSQLSGLGDFQQRCNTATSRRRCSSTESLLAALNGHGSVVSAGADSSTASHRSSTDDLTVLDCSNLSL

SEQ ID NO: 151056 - protein, 233 aa, Heterodera glycines
  Coding regions on vcDNA: vcDNA=SeqID_77479; Strand=-; Position=1-702
  Homolog annotation: Hit_ID=BAB78478.1; Match level="QueryCoverage =88%, HitCoverage=37%, E-value=6e-26, Identity=34%"; Hit description =preproMP73 [Cucurbita maxima]
MIAEVERLLTRKRSAPVHASFGNIDDDDEEEGEILDVSFVEEEEDNTGEAPLNPLSYLTKQSAAQQETLRHEKWAQEERKRREEEQRKQRENERRRREEEERRRKTEEDRRKTAEKAAKEKKAKEEKEASEKKAREEKLAREKKEEQRIAKEKKGEKETKDKKAEEERVAKERKAEDERVAKERKAEEERVAMVTKAEEERAAKAEAERVAMVTNAEEERAAKAEAERAENET

SEQ ID NO: 151057 - protein, 96 aa, Heterodera glycines; identical to SEQ ID NO: 149635
  Coding regions on vcDNA: vcDNA=SeqID_77480; Strand=-; Position=1 -196,241-335

SEQ ID NO: 151058 - protein, 111 aa, Heterodera glycines
  Coding regions on vcDNA: vcDNA=SeqID_77481; Strand=-; Position=1 -118,1057-1276
IESKFILNSNTLVYHFIYFGYELLHAPTYPSWTSVSILKDKRSAVAKYNCCGQETLWASQTIWTLWTMTQFCSPILSAKYGYSDCDLAFFEHVRDGRCANWILIKTNYLLN

SEQ ID NO: 151059 - protein, 178 aa, Heterodera glycines
  Coding regions on vcDNA: vcDNA=SeqID_77482; Strand=+; Position=1 -375,408-569
MFSVIPLNDLCQLANNSCLLSKHFNNSPILNGILKNAEIIDHLSKKLQFDESEKGRDIQFIAVWRSSLLLALLSIVKRNVDRLHQLCNEWINTGHFSSIPDHYRLLYAFCCAVRAKLSYLLKDYFFDQLSLRHCDDGLLKGNDLEDESLSKFASFLCRKFLPPPSEVPEHQTDVFYPE

SEQ ID NO: 151060 - protein, 19 aa, Heterodera glycines
  Coding regions on vcDNA: vcDNA=SeqID_77483; Strand=+; Position=1 -32,193-220
MCAATDWSSWRTPNELNDD

SEQ ID NO: 151061 - protein, 209 aa, Heterodera glycines
  Coding regions on vcDNA: vcDNA=SeqID_77484; Strand=-; Position=1 -155,657-903,990-1215
  Homolog annotation: Hit_ID=CAE62851.1; Match level="QueryCoverage =94%, HitCoverage=30%, E-value=6e-19, Identity=28%"; Hit description =Hypothetical protein CBG07030 [Caenorhabditis briggsae]
MDGDGDESYCDSDLELERSSSANNVNQLPLVPTEFTSIPEAMQNFNAVFDSRYGAQHAPFFHGSLQDAIAEAFDSPAGGAEHRRPLAIYLHDDQSVAAHIFAQTVFTPFLLDSCYILENEWVTLIKHVETSDSGVMSNVNVSNLLKCQFILWAWDVSLADNKKHLFDWLELANLTEVSNYIKMVPRSKFPMLIVLIKERAVISRASAIQ

SEQ ID NO: 151062 - protein, 75 aa, Heterodera glycines
  Coding regions on vcDNA: vcDNA=SeqID_77485; Strand=+; Position=1 -63,711-875
MALSLEAKRHIYRREFNSLIRTSELMRSLKPRNFVLRSSFIDHLKQLSNYLSSPFQFPFNDRFAVQNELAISTFY

SEQ ID NO: 151063 - protein, 526 aa, Heterodera glycines
  Coding regions on vcDNA: vcDNA=SeqID_77486; Strand=-; Position=1 -111,303-1264,1476-1983
MQSIVVASPGLHPYQRLFKRQFGAEFDEEIQPGMVVMRRRFGSSNFSVHRSFGSRLSHFTISTVPEVTHSTTNSFTAWIYQWLETKKQLVDYAKRWEEDQPLQMKLSKADKAKPCGHGFIIENWREKLETGFYLKIKIFMSYQDAKKYDAYEDFLRIRDGGDEGEFRPMQSLDSLNKREFRFVGRTFSDWASGDMDDARIGQALLGLGEKLPVQGLTWDSLTQRHPALSSLCEGQQQTALFMMDPIRRLVFMQAPPGTGKTYCSATIAAAILSEDPDATVLCVAPLNIATARLCEEMQKALQKAGSEIPLLALFSGNGKYRYAVHLQKISKHLLATAVSGPDLQEALKDGLEKKKVSRSIKKVLVTGDKYQLHVNMMELPPAVHHGFGLDTAIINFDNSLPVDSTTLTTSFRSHPFITKCIEAGTYADKGEKIAAGRTEDEMTLLTKNSNFKLPVKNSPLLFMHITDQMEQEETSFSSTNPRQTDATIALLHILVPNLQGTIRVVCLYAGQTLTLLSGATRKALRK

SEQ ID NO: 151064 - protein, 48 aa, Heterodera glycines
  Coding regions on vcDNA: vcDNA=SeqID_77487; Strand=+; Position=1 -31,227-342
MPMTRNSPFHDSSVIAIGFGTLESKIWSTAKIGSLPKTRKKGLSPVDS

SEQ ID NO: 151065 - protein, 178 aa, Heterodera glycines
  Coding regions on vcDNA: vcDNA=SeqID_77488; Strand=-; Position=1 -144,585-748,941-1088,1323-1404
HTDGNTYEVNLVDEQRDDPEAATYIDFLSTGEFPPDFTDEEKDNLAAQVPNPIAITDESEFKQRLISCLRKAWKSAAEQSHEAQLRMKIQYDKNVRGLDIKIGPACTLPALPKDEQETLQKADAEEMNDLPGYDHPQQALEAKQTDEPVNLGMHRRRQTSMNQFPANQFLMLITFFRP

SEQ ID NO: 151066 - protein, 399 aa, Heterodera glycines
  misc_feature (7)..(7): Xaa can be any naturally occurring amino acid
  misc_feature (238)..(238): Xaa can be any naturally occurring amino acid
  Coding regions on vcDNA: vcDNA=SeqID_77489; Strand=-; Position=1 -103,1872-2371,2609-3213
  Homolog annotation: Hit_ID=NP_500013.1; Match level="QueryCoverage =88%, HitCoverage=25%, E-value=4e-51, Identity=34%"; Hit description =predicted CDS, polyprotein family member (4B673) [Caenorhabditis elegans] gb|AAC02594.1| Hypothetical pro
HKSRPFXKFTKPKQSQNNKLGRHTQINQISLSCLMDSGSSITVGPRSIAHQLKCKVEPTFLEAISASGHLMVCREKADVEFELVGIRTKITLYFLNDSEFNYIRNYQILIGLDTFEKLPVISFDVAARKLIINGKSTPLGKSYNNLVENLRIAALKNCTLGPNSQNLIDAQIEAIIPSINTITVTNPESKLIQANVGLNDLNALKSLINEFDDIFSKSQYDLGSFTGGEHNFLTTTEXPISSPPLRMPYKYREELKKHIDQLLASEIMVESDTPWVTPFVVVQKKDGGIRPCLDFRKLNDVTVPDRYPLPRLDAIMEKGNCSFYSSIDLASGYLQIKLGDETSYKCGVITEDNVYQMKYLPFGLKNATAAFSRAMAVVLSGLDDSSLAYVDGILDCSKN

SEQ ID NO: 151067 - protein, 113 aa, Heterodera glycines
  Coding regions on vcDNA: vcDNA=SeqID_77490; Strand=-; Position=1 -141,232-429
MSGGDQNDLSISVIDRNFWVGKTQVKVNDVERAHLDVLRLEDGMNRAAQITTLTDQIVNPTTGTTKGTGVSKASTQSVGSQRTNTMAPQLNVPPQNTPALAEDELQGIFALTS

SEQ ID NO: 151068 - protein, 31 aa, Heterodera glycines
  Coding regions on vcDNA: vcDNA=SeqID_77491; Strand=+; Position=1-246
LTHKMSSPRNVQVSNLSFYYSDGPKVRQGVI

SEQ ID NO: 151069 - protein, 84 aa, Heterodera glycines
  Coding regions on vcDNA: vcDNA=SeqID_77492; Strand=-; Position=1 -103,254-405
MSEADPNFVKSEAISNGSSICAMSSNNALTEMMRPWEDEIFRAPHFPIPFWNMHSQATSALARTNNGLEATHLHFMVFNFLKAN

SEQ ID NO: 151070 - protein, 36 aa, Heterodera glycines
  Coding regions on vcDNA: vcDNA=SeqID_77493; Strand=+; Position=1-129
MARKDFRFPTFLGSEFRLPKFLMKSRNFFKFFFSKN

SEQ ID NO: 151071 - protein, 153 aa, Heterodera glycines
  Coding regions on vcDNA: vcDNA=SeqID_77494; Strand=-; Position=1 -111,251-601
MELPNSTFDFVGGIGHRLTHLNLQIDFSSSAYPRTQRTFELFKFQMSDMLQPARAVELEQNFHRFLATTPELGELFARLPSRVVYYPLIADCYNRQIDQFVYLFLIRIYLLPSGSSMDDRSIRSIARARSAANCPHCLDSNVPWADVAMNILP

SEQ ID NO: 151072 - protein, 50 aa, Heterodera glycines
  Coding regions on vcDNA: vcDNA=SeqID_77495; Strand=-; Position=1-150
MGRPQICGEAGQCAKRLAALARNHQPRPNVHCAGGAEFHAPLSQLEHGTT

SEQ ID NO: 151073 - protein, 285 aa, Heterodera glycines
  Coding regions on vcDNA: vcDNA=SeqID_77496; Strand=-; Position=1-858
MKHTKKMVMVPETEYIALMNIVKSMGSRGDPIQDEKTSLDSNIHKNLNDKTIGADIKMKRHSWLYKRRRQLKELMENKPQKVIIEGNPSSAIPNVAPYMGIHKIPKIETAVEQENKRQPLRLIRASRKKKSENVFESSADYSSATECSSSTPIRSQDVKLSQKNFSKIMNIIGKNPDKFGIDMQSGQVLTNFNKPVTGSNYTESLKLLSGEDISLPRGHTFFVQRLKREPEIAKYLFNLQQGKGKKRRTKRKLVLVQVNPIKTQGLNREKPPFKPDYGQNYRKST

SEQ ID NO: 151074 - protein, 118 aa, Heterodera glycines
  Coding regions on vcDNA: vcDNA=SeqID_77497; Strand=-; Position=1-357
MEKNIQLSVDKELEREPLPPPDQQMEREQPLIQPKIEPPDEDFPQEKSSSFIPTAPQTFENDLSCEKFPPLAKISESDPQTLFKTAKLTTEWSQKETVELSGSSADLTQWLEYIMKPE

SEQ ID NO: 151075 - protein, 101 aa, Heterodera glycines
  Coding regions on vcDNA: vcDNA=SeqID_77498; Strand=+; Position=1-306
MLSNLAFILCLFTGDEANVDAISGEEENAIGEHRQKHGDEQRNGETEGGRGKTRRTNAGANGDKRSQLGEKDQRKDDLMPSPGDEWDDQRRHKQMSSPAKT

SEQ ID NO: 151076 - protein, 173 aa, Heterodera glycines
  Coding regions on vcDNA: vcDNA=SeqID_77499; Strand=-; Position=1 -115,192-598
MKRSATKNNSFHFSIIFYLALIGTASGAGETSKSTKQKNETNLPVEIENELITLTQIVQESKDDRIADLFSWALKTQPSIRARTFEKFCDERKITEGKTTEERVKNCVMQCILEKSIPFSFHNAENIADLLKMLLMERKNLLAHLMHKELMGPEMKVNDGGIAYLLNLRPLIK

SEQ ID NO: 151077 - protein, 69 aa, Heterodera glycines
  Coding regions on vcDNA: vcDNA=SeqID_77500; Strand=-; Position=1 -89,1187-1307
MCVCVWNCSIGGFFVRRRKRSLGVLLESENFCRKRLNASLYFVNGSRLTGQFISEKCDSSPFIVHPTDH

SEQ ID NO: 151078 - protein, 86 aa, Heterodera glycines
  Coding regions on vcDNA: vcDNA=SeqID_77501; Strand=+; Position=1 -235,415-440
  Homolog annotation: Hit_ID=CAE68449.1; Match level="QueryCoverage =83%, HitCoverage=7%, E-value=1e-12, Identity=48%"; Hit description =Hypothetical protein CBG14239 [Caenorhabditis briggsae]
MYHTVILLIICHLLHTVISLASVLVSSPFDNFRIECPQSSGAQRLSIRMVESQGQKRQDTVFVLSCQHIVEVMCSTVYEIKEEKCK

SEQ ID NO: 151079 - protein, 86 aa, Heterodera glycines
  Coding regions on vcDNA: vcDNA=SeqID_77502; Strand=-; Position=1-258
MSVRKSRSANVGPQKSVRKSRSAKVGPQKSVRKSRSAKVGPQKSVRKCRSAKVGPQKSVRKCRSAKVGPQKSVRKCRSAKVGPQKS

SEQ ID NO: 151080 - protein, 384 aa, Heterodera glycines
  Coding regions on vcDNA: vcDNA=SeqID_77503; Strand=+; Position=1 -158,216-497,850-1294,1346-1612
  Homolog annotation: Hit_ID=AAL78214.1; Match level="QueryCoverage =49%, HitCoverage=96%, E-value=5e-09, Identity=25%"; Hit description =putative esophageal gland cell protein Hgg-20 [Heterodera glycines]
MAPPAEKKKKHSSADRRLISSTNANQQKQPLGSLVTSYGKRRSVRVAVKKNRRWVCNDILMDIFPLFDRLQLGLKLALISPRFDALVDKHFDGTNELTLSRTIRILKTGVKTKLTVLMDSNLNNFVRFPFPNKPMPIKIRFHLLRIEHIDHFVVTFLRSNQQIFDKGTAFRLYVPLSYKPSVQPIWDVFVREIWPIFATNIRHLHICDGHHLDNFRRLISPTILTDLNQLNSIDSESVFPEAIIGDFDGPNATAGQILSKWLHTPTNDGQPKQLNCRNYYHASMTVHEWLRNFKEAFLRATASACYQIRLELSKSTQIEQFELKNERIGEKLTVEKKGENGHTYSVDWLLKRCQIGKTVQWEEEKTTNNLNNGPLYTFWSFIHW

SEQ ID NO: 151081 - protein, 119 aa, Heterodera glycines
  Coding regions on vcDNA: vcDNA=SeqID_77504; Strand=-; Position=1 -39,472-792
  Homolog annotation: Hit_ID=NP_490685.1; Match level="QueryCoverage =76%, HitCoverage=91%, E-value=3e-11, Identity=41%"; Hit description =transposase (1A616) [Caenorhabditis elegans] gb|AAB54166.1| Hypothetical protein F53G12.11 [Caenorhabditi
MMPFYFHIFPYFRATSPSPSALETRQKAEVEVNEYLRDPKIKSRVDPALYWEVNSQKWPMIGAVVRKFLSPPATSSESERLFSTAGLISDDLRKSLLPENLAKLLFLHHNLLLTGFSIE

SEQ ID NO: 151082 - protein, 18 aa, Heterodera glycines
  Coding regions on vcDNA: vcDNA=SeqID_77505; Strand=-; Position=1-60
PGLADENFQKPHLASKKA

SEQ ID NO: 151083 - protein, 116 aa, Heterodera glycines
  Coding regions on vcDNA: vcDNA=SeqID_77506; Strand=-; Position=1-350
EKNLAEARAKFEKIMKKMYNKAKENATKMEQNEMEQKIFLTGNGQLFGMDMAQTSSSLSSSSLSSLTLAPSPSPSFSSSSSSSSKSASKNADANKNYGEKKDELILHLLNYEVESV

SEQ ID NO: 151084 - protein, 45 aa, Heterodera glycines
  Coding regions on vcDNA: vcDNA=SeqID_77507; Strand=-; Position=1 -18,123-242
MIIWARKLMDPDEGFYDKNEDNVTLAIDFTVEEEKGTKKRKLADG

SEQ ID NO: 151085 - protein, 139 aa, Heterodera glycines
  Coding regions on vcDNA: vcDNA=SeqID_77508; Strand=-; Position=1 -89,518-728,940-1059
MLNSKIWTFEFLFEFASGVQNWPKWIPDSCASLRRMVKNGEFLIALINFDYQRWKLELQMFYHLSNCFTKERNGGFVAKNDHTFNKEENDWGFKYFITFTKLMDPDEGFYDKNEDKVTLAIDFTVEEEKGTKKRKLADG

SEQ ID NO: 151086 - protein, 81 aa, Heterodera glycines
  Coding regions on vcDNA: vcDNA=SeqID_77509; Strand=-; Position=1 -72,559-732
MQIPIPNLSNVFLALVQTRLFDFEALRWADEKCRQDAIECSAENRRSVLGPALLKIRFPLISTEDFSESIGRMKSLKRESK

SEQ ID NO: 151087 - protein, 107 aa, Heterodera glycines
  Coding regions on vcDNA: vcDNA=SeqID_77510; Strand=-; Position=1 -169,215-369
MKMNFYEEKKKEFIERFDEFKSLYGQGKQKEFVKELGIGEKTFRKWKKELAPKYHKTQNKYSNEDKLRKVKQYLEIKERNPKINNEIIAKKLGLGISTLNRWKRKFA

SEQ ID NO: 151088 - protein, 93 aa, Heterodera glycines
  Coding regions on vcDNA: vcDNA=SeqID_77511; Strand=-; Position=1-282
MAKINLWLLIFIIFCLFYEIKSGKIRQNFDEIFGDRWDKNKSEENVIKKEQNDQNEQNENSATVDQMGGKMEIVQMINKKEKPFRNLMQLKKS

SEQ ID NO: 151089 - protein, 154 aa, Heterodera glycines
  Coding regions on vcDNA: vcDNA=SeqID_77512; Strand=-; Position=1 -268,567-763
RDKLIDIKIKILPIFTNAIETNADLKNNQDIQIAIQVFFKIYFTVFCPTPPHSQCDHRDFGAINLFAVYIRILAQTVLPPSTHFTSQENGAPSIVFLLLNKTIRNDCRKIIKNIFGPTKIAGRIFVSIKKIFHLNHVYPQQNAVIVLPTPPNRY

SEQ ID NO: 151090 - protein, 272 aa, Heterodera glycines
  Coding regions on vcDNA: vcDNA=SeqID_77513; Strand=+; Position=1 -303,366-471,940-1211,1271-1408
  Homolog annotation: Hit_ID=NP_507526.1; Match level="QueryCoverage =62%, HitCoverage=59%, E-value=4e-12, Identity=31%"; Hit description =microtubule-associated protein RP EB family member (34.9 kD) (5S541) [Caenorhabditis elegans] emb|CAC1440
MRRQIRIERPPFAISVQPDQNRRDGLGRGLLPTDGLSLPDPSAAQKSEMDQPIGRGLGAQLARVAAIVETHRNCQSLNQNATNLELICRGGPIHLGSWKIGPVPVQSLIRAKFQDNFEFLQWSVSFPFIRSFLFPLAAKPPAAQPLVGPSPAAPRRASPRFMGSSQRPPSAVGRHPPQQTNGGRTGGSTGGRPKTASAFASKATPKAASTATEVNNLKQQVQTLETQNSEVTANLAIERERAQLMERERNFYFDKLRSIEILCGACALSDGE

SEQ ID NO: 151091 - protein, 71 aa, Heterodera glycines
  Coding regions on vcDNA: vcDNA=SeqID_77514; Strand=+; Position=1 -66,580-729
MGTPIKGEEGQLVLVACFLGLFVSANLMPIFHHSAAPQQQMLQQHQSFNAFVPPIPLLNTHQPNASQISKP

SEQ ID NO: 151092 - protein, 540 aa, Heterodera glycines
  Coding regions on vcDNA: vcDNA=SeqID_77515; Strand=+; Position=1 -204,282-449,509-661,703-1110,1164-1374,1427-1638,1945-2209
MNLFFPASSREQKDKNDGGGTTTNNNGSSGSDQLTGNDPANAGDATANLPPGVPPEIAAAISGGNDLFVHIHLGDAIALAVGNDVQHIHGPATIRMVSQSTTPQSAIPMNVPEGHIVQQILDRQGNLSHIIMSQEPPAGVGPMLGQHVITATTVMSQIPSAPSTTAAQQRQMGYQSVQLHPSAATVPLKHFRSNNSPPRSTDVSPLNDAVTLSRQKQHQGMATDSGAVYPSGVVPLLKWSDLQQHHQQQREHYQSQSGPFGRQHQQGRGHHTVPSPFNVYNLADSETVSSAPRHSPGFYVHGSTTMGGMDNRVGPSETLPTVAYHQNHQQQHSQHQHSAPGGADTFDSVNFPTQISSVIDDDEKERLRDTLSSIQPPILSKVTDRDAEVIWQVIDTSEAAASGGPFPQIDTSEFVYKLTLFDPVKHSQTFHKTEAGVNVLHLQQLNPGTEYMGKMASFETVYDGAHEQTVVSGMDSGALYRFRVFARNEMGQSESSPVLTVYPERSDTGGRMPPAYHHHHVQHHYHAQQQQQHGGIVQRG

SEQ ID NO: 151093 - protein, 97 aa, Heterodera glycines
  Coding regions on vcDNA: vcDNA=SeqID_77516; Strand=+; Position=1 -105,595-754,1162-1190
MSRIGPPLRPTSPSWRRTPNTWRRRANLMRMTRTQDEEEDVLDVVHITVSVQLCSSDESEPEDFCTDLEVGRSLWFVPVGPELEVADEDHFFIQFGV

SEQ ID NO: 151094 - protein, 25 aa, Heterodera glycines
  Coding regions on vcDNA: vcDNA=SeqID_77517; Strand=-; Position=1 -44,228-261
MIKKEKAVATFYIHKCESPGGGRLG

SEQ ID NO: 151095 - protein, 84 aa, Heterodera glycines
  Coding regions on vcDNA: vcDNA=SeqID_77518; Strand=-; Position=1 -111,174-317
MQMRMGELVAVICWHQHEQRQNTVKNACLRVGCVVDKHPYEFKCCQQKQSEWEKGCACFGIYMKALLETITAVKPGLWINGNVG

SEQ ID NO: 151096 - protein, 149 aa, Heterodera glycines
  Coding regions on vcDNA: vcDNA=SeqID_77519; Strand=+; Position=1 -147,210-512
MAADLHIINQTFSIKKSNLKVGPKLASISSPGLRKETAGWRPSIESTKKFNDWQFPTGQSDAVLRENDLFAGQIDAAADDVANLEFGIRIERYFENIFFCQLAIKMAIVEIGKSAREFSGHLMAQRSVFCHKANANAKVTMGITVKTWA

SEQ ID NO: 151097 - protein, 91 aa, Heterodera glycines
  Coding regions on vcDNA: vcDNA=SeqID_77520; Strand=-; Position=1 -85,711-787,978-1089
MKIWRSFIFLFLWLQKAISIAAADIQANESNMDSIIRQLIEKNRDKIDQIFADLIRDTITIDYQWNTSDCQSDRMILIPTIIKVKHYGKKK

SEQ ID NO: 151098 - protein, 68 aa, Heterodera glycines
  Coding regions on vcDNA: vcDNA=SeqID_77521; Strand=-; Position=1 -155,216-235,533-564
MSSEYLASRAQIVTKIAKYPYVEDYRWASKFFWLYTKFLAHFLAVQFSTWTRSSSSTSANLKIYIKNV

SEQ ID NO: 151099 - protein, 129 aa, Heterodera glycines
  Coding regions on vcDNA: vcDNA=SeqID_77522; Strand=-; Position=1 -116,1940-1982,2173-2317,2776-2805,2867-2922
MGRGWHFLASAKVQFIAVGTHCQGWTSTKMWTSSRSDPILPVPCGGEQTSGDEVAKKLQKLDCQRDTAALLNGTPVYGFAKGSVNCNEKLAELIDELRPLLRRQQFRRVHSGGMSERNAQRGVGSGRFP

SEQ ID NO: 151100 - protein, 229 aa, Heterodera glycines
  Coding regions on vcDNA: vcDNA=SeqID_77523; Strand=+; Position=1 -177,1185-1249,1396-1504,1557-1642,2742-2895,2949-3047
  Homolog annotation: Hit_ID=NP_496111.1; Match level="QueryCoverage =96%, HitCoverage=50%, E-value=7e-33, Identity=36%"; Hit description =cytochrome P450 family member (2K84) [Caenorhabditis elegans] emb|CAA88603.1| Hypothetical protein T10B9.
MDELKARKKLRESGEQQQQQRAKVDFIDLFLETEQNEQQQLTEQCQNEGEAMLSKTALQRVAKRCTLEEITSQLLMFLLAGFDTSANTLSLVCHALALHAEVQAKVQEEIDSVCFDEDPTYEQLSQLKYTEAVVKETLRLLPIATKWLEAGHQLPPFYAFGGGPRICIGMRFAMIEEKLALVRILRKYSIVQTADTEKELAFSGQLVIAPKSVTVGLKLRDEERHGTFE

SEQ ID NO: 151101 - protein, 192 aa, Heterodera glycines
  Coding regions on vcDNA: vcDNA=SeqID_77524; Strand=+; Position=1-581
ACSLEEEHRLVNTVRSLIRIKNPNDRLCLARAVLFGLHDWRSRSPGGGGPTAFKSFANRQHTHGPDARNLLRRAAIPRNKHKYTIDDVQKVQDWIDQQYGPGEIRIAVFEKEREYRIVFKAASGEAAKFNLCLLFENQHFNYIGRIEQLFRVQGYCIDCERRVTRWYHPQECKVVCRLCLRFGAGYPCKQQQ

SEQ ID NO: 151102 - protein, 279 aa, Heterodera glycines
  Coding regions on vcDNA: vcDNA=SeqID_77525; Strand=+; Position=1 -220,417-691,973-1317
MYSSSSEEGEIHEHPQPNPPVQEFHPNPQAHDPLPNLQPNEKMFFVAETTQHRVVLLADGFEYNFEADSRMADVAQMTLRTSAEAANPMSTRQAVDNTRASIPEGVRAALAPSSSAMGRSYRREVARQRADAGDNLLDAQDPDAIVIGQILQPITIFDGYVEGQRVFAAIKNTIPGWAPVSIMSDFEQSAIAAVRGEFPQATHSGCLFHFAQSLYKKVQTLPHLNTLFLAANQEGHQTKTLIKSLISLAFTPPGEPLYNYFCAVIHQFDHHPDVEGPKS

SEQ ID NO: 151103 - protein, 99 aa, Heterodera glycines
  Coding regions on vcDNA: vcDNA=SeqID_77526; Strand=+; Position=1-300
MRTNNSIEGWHQSFNSQFRFLHPPLSYFVKKMKAEDSHWNLVVQDFNNNPQNGIRGRGMARKNVYVQQDEAIRAIFLDRANRPFLAYLRAIAYRMPDPN

SEQ ID NO: 151104 - protein, 45 aa, Heterodera glycines
  Coding regions on vcDNA: vcDNA=SeqID_77527; Strand=-; Position=1 -83,749-803
MPKLETGPLIFSEFLWSKTKSDITKRNKRLRGFLRSSLATLSSCF

SEQ ID NO: 151105 - protein, 183 aa, Heterodera glycines
  Coding regions on vcDNA: vcDNA=SeqID_77528; Strand=-; Position=1 -75,452-570,940-1117,1349-1528
MAKSHGITKNGAMGRNGGEKVANGLQQQRDTISVLHEHVDEQHNNEAGGGPTANEQNVGMVMDERAFVATPLLQQRRRMPMTPSATTSNNNNMYCSNLSAPPPAPMNNTSSPPTNDQQNGTYERQKPPTIRVQMANGANASLPIAVAPPGEAKPLVWRQKHCQRQNDQPNRWPSAPIAPKDEL

SEQ ID NO: 151106 - protein, 145 aa, Heterodera glycines
  Coding regions on vcDNA: vcDNA=SeqID_77529; Strand=+; Position=1 -66,329-356,563-667,912-1028,1429-1550
  Homolog annotation: Hit_ID=NP_701342.1; Match level="QueryCoverage =88%, HitCoverage=5%, E-value=5e-10, Identity=28%"; Hit description =MAEBL, putative [Plasmodium falciparum 3D7] gb|AAL10509.1| erythrocyte binding protein 1 [Plasmodium falci
MQTKLEKKEEQHMNKFEQLQKDIFIAHQQQNELVGQIKQLKDEQKNYLARVDELEEEQKHLQQEKNVKFQQKAFQEGLEKKQLLEQIVTVQAKVGKIEMENQQQKVSIDQIEKLQNEQNRKINALEKERKEKHMEMVNEYNGNKY

SEQ ID NO: 151107 - protein, 612 aa, Heterodera glycines
  Coding regions on vcDNA: vcDNA=SeqID_77530; Strand=-; Position=1 -990,1386-1525,1804-2511
  Homolog annotation: Hit_ID=CAE60305.1; Match level="QueryCoverage =46%, HitCoverage=18%, E-value=8e-19, Identity=31%"; Hit description =Hypothetical protein CBG03894 [Caenorhabditis briggsae]
MDEDRREEAKAHPHHHHHHHHCDHHQKDQKKQRVNCRRCLASAGGGGDHHHLHHHNYCRFNNTDNHHQQQQQEEGEEGQQDYFNHRRYNNKNAGGSDLFFDGFVLPLPPPPLEAASSFEQQQQMMMMANGKNDCAAPDEQIVAGEGGVGGQNNSASALLSPLSSAVGHDQQQHKLGGTDRRHNINQNAADANSDGTKFDNDDAIAMITSTKKAKKKVKDKLPQSKSNATNGSAKNGGGGNIKGNKSPGVEKSRSKFGQLLRAMLSSSSASPAAVGREKFLASSPTVDDVKIDGKKQPIGAEANGTSTKSAIPSSNCGGQICEGGRHGTEKGTPEHGSGIYVKNIIEGSPADVDGRLAPGDQLLSVNGNSLIGVGQDLAAQKIVSAGPVVHFEVAKHAAQANGLGPYFHQPHPKQQQQQQQNNHSSAVDGAAMMTQPLQSQQRLNGNGAAAAGVQPQPRIASSVSRQSMNGNYTNNSKGGVVPVPLSVHPVVVPKQQKRSMSASELLNTAGGSSSSSNCAIAGAVVVPPPSSSPTGAPVAASSPSFSGGTPFPLVRHSQQQSSSSALSSAASLASSSASRLPAHYRPSVNRPQVVVMQPARRSSAAAATSPSG

SEQ ID NO: 151108 - protein, 91 aa, Heterodera glycines
  Coding regions on vcDNA: vcDNA=SeqID_77531; Strand=-; Position=1 -207,355-423
MPFWFSFRRKPSLLHAVRSSFDTKICEKYFFVRDDDWESVEATPLLRKLIRYLYMGLGYGHLWQRVTTEHYSAFFMAKFMVQIKSPRVVKI

SEQ ID NO: 151109 - protein, 40 aa, Heterodera glycines
  Coding regions on vcDNA: vcDNA=SeqID_77532; Strand=+; Position=1 -75,318-365
MVEECSVCCELIINDQLPMQLKECELQCSCFNLMNFNLIL

SEQ ID NO: 151110 - protein, 130 aa, Heterodera glycines
  Coding regions on vcDNA: vcDNA=SeqID_77533; Strand=-; Position=1 -286,1311-1417
MPIVQFESEIAKMLGTNRAKIYKLKKKLGQTRKYRVNKDINKDTMIRMIRKFDEMKKEKIYGFKYDKNKICKIECEIAKELGITRQKIYQWKKKIVTEHGYALSSFCPSGAAKIRMKNGDRLGHFGGRVV

SEQ ID NO: 151111 - protein, 159 aa, Heterodera glycines
  Coding regions on vcDNA: vcDNA=SeqID_77534; Strand=-; Position=1 -58,203-381,1223-1465
MEKQLIVAETSRQIAYVSIYSSSDDEEEEKKTMDSGTAEENDGSGREGEKGQKMGNGDEANANCVDGRRGRMAEEAIKKVLVLEDRPLPPLPPVTDDEEEDEIGDGTTAVYVNSTGDSGIGGSSKAPQDYANTNIRKTKEARGDPSKFLSYKTHLIALK

SEQ ID NO: 151112 - protein, 277 aa, Heterodera glycines
  Coding regions on vcDNA: vcDNA=SeqID_77535; Strand=-; Position=1 -85,139-234,310-621,684-1021
MSDCGNEAKRKRKEWRQEHGRRVGSTPKSLKQTEADTTADGEGTSTQAAESGPSTSTLDLSTPIRRHVRVHQKTADKATNMDFTTTDSATEVDLTTVDKATDVDLAYEDAATQTDQLDKQLKEQEQVISFLRQQVRNRDAMITALRRQLEEKMAPPMETPTTSKTTPTGRPKMNVDHLQRTSRRKLADQIADVINRDRSRSASRASLEGISREVRHKFAHYTPQKKKQQLSRQKKSVDPEDALLILGLVGTQKAYRRLKSTIRLINAKFDVMPPLEK

SEQ ID NO: 151113 - protein, 27 aa, Heterodera glycines
  Coding regions on vcDNA: vcDNA=SeqID_77536; Strand=-; Position=1-81
KKLLWVFSPHRGSRRALRARFSNFVGL

SEQ ID NO: 151114 - protein, 258 aa, Heterodera glycines
  Coding regions on vcDNA: vcDNA=SeqID_77537; Strand=+; Position=1 -11,70-345,640-1129
  Homolog annotation: Hit_ID=AAL78214.1; Match level="QueryCoverage =59%, HitCoverage=78%, E-value=2e-09, Identity=28%"; Hit description =putative esophageal gland cell protein Hgg-20 [Heterodera glycines]
MNRRWICGDVWMDILPSFDHAQLGLKMALLSDRFDILVDRHLDGKSEFTIWRAIEIRKKEGPKTKLSEWIDGKSVAFPFPDRPLPNKIRFKNLRIYYIDHSVIEFLRSNKHIWDRRGTNLEVFVDAIDMGVQPIWDVFIRQIWPIFATNIHHLGFRNADALNNLRSRTSPTILTDLDQLVSIDSGFLFPDGIADDGPNATAGQALTKWLHTPTKNGQPKQLRFRAYVVPPNLEWLNSFKEVVSPEFSSICFCFTNFCV

SEQ ID NO: 151115 - protein, 287 aa, Heterodera glycines
  Coding regions on vcDNA: vcDNA=SeqID_77538; Strand=+; Position=1 -171,597-733,834-939,1035-1181,1228-1441,1499-1585
RDEVEKLCNEIEQLRAMSVKAGVTPYWNTEGAQGTVAKGGKEEEQPQQNGRGSKKSWPRLSQRQQKEQAATAEGEQRRRGQQLAQFVLLLRPFQSQQKCQCHHASWTTEKLALTDVQLDALDKAKEIDILRETVNRLQHENKLLKYNYSLLERKVRSESRTSSHLSLNTTGIAGGGALEFDAVVQDEVLAEASEQLAPPYEFAASSPSSGDISVNTTTTGSNNSAGGTTPFIPPPADLAATKSVNRCSFASSTTTSSKRSSHGALSTALPSAKVVLCVDLSGRVDSL

SEQ ID NO: 151116 - protein, 45 aa, Heterodera glycines
  Coding regions on vcDNA: vcDNA=SeqID_77539; Strand=+; Position=1-7,71- 201
MAKIFRLIRKARCKESKEFTVSFLIEKYAYMILIKTTMIIFPTFL

SEQ ID NO: 151117 - protein, 32 aa, Heterodera glycines; identical to SEQ ID NO: 125422
  Coding regions on vcDNA: vcDNA=SeqID_77540; Strand=+; Position=1-100

SEQ ID NO: 151118 - protein, 602 aa, Heterodera glycines
  Coding regions on vcDNA: vcDNA=SeqID_77541; Strand=+; Position=1-1809
  Homolog annotation: Hit_ID=CAE56861.1; Match level="QueryCoverage =46%, HitCoverage=20%, E-value=1e-11, Identity=24%"; Hit description =Hypothetical protein CBG24691 [Caenorhabditis briggsae]
MPYRKPQKVKKAYRCAIKRTKEYFYTNLLGDQFVRTEKEFLPVQKRICMAMIEQHKCQYEDKPMTPIEGGGWSSNNPLNDEFPGRFSSLISGERESVTLNCFVEKASLFYRPHNFELISPLYLHLEDCNYLTGNCNMADNTTLNWETECNESCKSCDYHFVESMDGEHTGSTDWAGGTWISKSKEQALTFSKEAKMETACNGKPIRLSDQSFGILEDEYLKIVNDRGLGKRAIQEEQLAAQLTAGQLATSRSIAQLFSKECRRSSRGGNPTIQARRLLRRKDVWLNEDTMQIFSCAEFSMQNVEYQAVNNCYRYIPVQIRIDKKTLNAFLDPELHILTASSPFADCGNFRYHYLQLSQSNWIKIDTRTATIQKIDSSSISEIHEASGDKSLLEITPLVFHRWTIDNETGEGLFAHLDEWLRLDQWKSKEKEHKTARALTLGALPNGVIGLTEEWFMDKLRLLVSYWTTACCIYVTFIFGRDVLIPLVWVYLMGPVIVTIRNLVTGNQWTQRNRVTRGTRRAPAISRIEAIELVPPSMPQEMRANETSSSHQEDPEPSPLVMELKRQMVAFRSKRRFQSRGNVAAERQPRMSVERTNEEDGEE

SEQ ID NO: 151119 - protein, 878 aa, Heterodera glycines
  Coding regions on vcDNA: vcDNA=SeqID_77542; Strand=+; Position=1-2637
  Homolog annotation: Hit_ID=NP_494191.1; Match level="QueryCoverage =44%, HitCoverage=39%, E-value=5e-42, Identity=32%"; Hit description =peptidase family A16 (2C417) [Caenorhabditis elegans] gb|AAB71060.1| Hypothetical protein R52.2 [Caenorha
MDKDERKSEQTAYEQFQTTEKLNTKMEAANTKLTELKDLEMKVEAGAKLQRSKADRDARVEQREHAKAMSKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEYVRRLHTELSNLKRCYSVEDTKQFCMELERLARELEAAEEDIEGPPIYLMLEKKLYKPFLREILEEKAKNPDFWDTSSLRKALGSALSKELAIKEVMREYGFEGKEANPEHGFKRQLRRNRFGGSVNVATTHFGKPNGERRKIPEQKMPSPRQGQRSFQQTPQNSAFRERKGQGRSPKIQRNPTAVNTQGELFLCVFCGGKHRHDSCEKARTVQQRFAVLQEKGLCYKCLKGNHIGRNCPCPMKCFKCQQAHPTALCHQANPQRATEWRNMANKVMNVRKEEKPDKRDEFKEVSFTPSQCNSVQGNSRVLLRTAEVTIFNPSNPKRSMVASVFVDDGSERSFIRANVAKQLGLPVIETEECHLTGFGEKEAKRYVSNVVRVGFLGVNGDPYICALNEMEFIVKAMPIVTLNSMDEAELSKKKLSLPSRPRQPDILLGMDVRHDLKIRDETEKLPSGFTLSTSRVGRMISGYGQVQGPMDMSVQVTYTGALISALQCASSRRDADEEMEEQIKTFFGLNIIGLSDNPEEEDKEEVMRTFRKGLTFKEGRYECGLPWNERVKDLPTNFQQARARLCGTVKKLRELNLVDEYQKIFNEWERNGIIERVPDPTQITGPVHYLPHRPVIKMDKATTKIRIVMDASAKPANRKGAPSLNECLHTGPLLLNELTGILLRWRRMKDLILADIEKAFLQLSVREEDRDATRFLW

SEQ ID NO: 151120 - protein, 200 aa, Heterodera glycines
  Coding regions on vcDNA: vcDNA=SeqID_77543; Strand=-; Position=1 -252,359-557,1052-1201
MSTHLPSRPNSGLFTALRSLPNSFRPPLLAETLPTELTENVTFRAFLSSFFASSPITVEKLDKFLKQMQQFPNLDALVFRSPASMNEFQFDPSDVLYESLCASMASDSEDGQDECFFRIFPNLFDSDLSKAPYILLKQRVQHISHGTTGLNVTFDPSLFPPFAQLLRLLLCVESVPGGVVALICCTVRDKSTEDHFLQII

SEQ ID NO: 151121 - protein, 170 aa, Heterodera glycines
  Coding regions on vcDNA: vcDNA=SeqID_77544; Strand=+; Position=1 -44,478-946
MDTELDGLIWQIDASRENILDLLLIEDRNEFLRQIFGEKEKFDTKNNETKIEETLEELLNEEKKKKKNKRNKKKNGKEKIDKSIKNTTNTETKNSGEGREGEEGRDREEEKNVIEKRKGEEIGNCESDNYSKLDGNKNGNTTDEQMTAKMPTNDAIQAKELDKFGTFRGC

SEQ ID NO: 151122 - protein, 62 aa, Heterodera glycines
  Coding regions on vcDNA: vcDNA=SeqID_77545; Strand=-; Position=1 -81,748-855
MSERVGLVSTRAGRDHGSRLTDHGNHGYLLGCSDRHEGLSMLVQKIFSASKVSLEKFFSLHK

SEQ ID NO: 151123 - protein, 103 aa, Heterodera glycines
  Coding regions on vcDNA: vcDNA=SeqID_77546; Strand=-; Position=1 -97,946-1159
MPPVVGLLRENYLYMLLYQNVATMLSQFLVPLCTVPNWFICCGGAVAWTFCSVGLMAKVRHPSRAAVPPALCPPALASWANSDCLPPFYPKGANAHRRHFWCP

SEQ ID NO: 151124 - protein, 26 aa, Heterodera glycines
  Coding regions on vcDNA: vcDNA=SeqID_77547; Strand=-; Position=1-80
HRRSSSGLSTEIVIDAMANAIRVKKC

SEQ ID NO: 151125 - protein, 63 aa, Heterodera glycines
  Coding regions on vcDNA: vcDNA=SeqID_77548; Strand=-; Position=1 -67,418-542
MDPSKGLYNKDEDKVTLAIDFTLIFQNELTESCILISTKSGNKTCLMDIDFVLPVKWKENAYF

SEQ ID NO: 151126 - protein, 18 aa, Heterodera glycines
  Coding regions on vcDNA: vcDNA=SeqID_77549; Strand=+; Position=1-55
TVFALIIPQSPLIPQSPI

SEQ ID NO: 151127 - protein, 19 aa, Heterodera glycines
  Coding regions on vcDNA: vcDNA=SeqID_77550; Strand=-; Position=1-58
FFYCAPFSHFLLLHFKTSK

SEQ ID NO: 151128 - protein, 21 aa, Heterodera glycines
  Coding regions on vcDNA: vcDNA=SeqID_77551; Strand=-; Position=1-64
GPGSRSRVLKSSGPGPGPGRA

SEQ ID NO: 151129 - protein, 123 aa, Heterodera glycines
  Coding regions on vcDNA: vcDNA=SeqID_77552; Strand=-; Position=1-369
MVMVPESEYLALINLLKGSSGVYPPLADPLQGEKTLLDVQIQKNLADPKRNAEIKMKRHSWLYKRRHQLKDIIDNKPQKVIVESGSVTAPNVAPYMGIQKQQTPSHVSTPHRNSASIQSIGAA

SEQ ID NO: 151130 - protein, 114 aa, Heterodera glycines
  Coding regions on vcDNA: vcDNA=SeqID_77553; Strand=-; Position=1-345
MAFQSLGLNPPAFQSLGLNSPAFQSLGLNSPAFQSLGLNPPAFQSLGLKSPAFQSLGLNPPTFNGIPKHWDSNLRHSKHWDSTHQLSMTFQSLKLNPPAFQYWDSILRHSNLWD

SEQ ID NO: 151131 - protein, 88 aa, Heterodera glycines
  Coding regions on vcDNA: vcDNA=SeqID_77554; Strand=-; Position=1-267
NSYRPFCERRAEADCPAMARLLQTLSCADKAMAEGGRVQAQLLLRRLFQWRHSSACLAGFEARADTTGGGRDDARQTHNTTSTATTTT

SEQ ID NO: 151132 - protein, 236 aa, Heterodera glycines
  Coding regions on vcDNA: vcDNA=SeqID_77555; Strand=-; Position=1 -191,238-302,569-708,755-859,1172-1380
  Homolog annotation: Hit_ID=BAD11764.1; Match level="QueryCoverage =100%, HitCoverage=55%, E-value=2e-60, Identity=47%"; Hit description= mitochondria processing peptidase subunit beta [Brugia malayi]
MLSDILLNSVYGENEIWRERQVIIREAEEVAQNMQEVVFDHLHAGAYAGCSLSRTILGTDENIRRMHREQLIAYIGKYYKGRTINGPRMLLAAAGGVDHSHLVELAKKYFGKIEHGDEHVLDYEPGIFTESHQLIEDKQMEMVYGSLAVEGTSWTSEDNIPVQVVNTTSYKDTGLTGLFFCAEPDALFNLAQSVCKEWRQLCEEVDVDELERAKRSLLTNSLLMLDGSTPICEDIG

SEQ ID NO: 151133 - protein, 90 aa, Heterodera glycines
  Coding regions on vcDNA: vcDNA=SeqID_77556; Strand=+; Position=1 -134,206-344
MSLNRDENSQSPVLDGPYPRAQDDIEFVEDEAPVLLEVLDRLSREEFVKSGLWARGGRVVSMPMQNCYRPFVGKGIVGPNFKVLNFGHTL

SEQ ID NO: 151134 - protein, 85 aa, Heterodera glycines
  Coding regions on vcDNA: vcDNA=SeqID_77557; Strand=+; Position=1 -169,1030-1118
MKKSVTISVPEQKEINQPNAEAEPPKTDTTKKRKVEDRELWKLAKGKFMLATYLCAEAEPPKTDTTKKRKVEDRELWKLTKGSSC

SEQ ID NO: 151135 - protein, 115 aa, Heterodera glycines
  Coding regions on vcDNA: vcDNA=SeqID_77558; Strand=-; Position=1 -116,158-389
MTVKEIGQNGRAERVREEIDNRKGTGKRYSAQKDRETIIAKWTVGKGHRERDSGRVTLGKETAGKGQREKDNWRGTLGKETTGKGQLERDTEERDRGKGTTGKGQLERDTGERDS

SEQ ID NO: 151136 - protein, 249 aa, Heterodera glycines
  misc_feature (25)..(25): Xaa can be any naturally occurring amino acid
  Coding regions on vcDNA: vcDNA=SeqID_77559; Strand=+; Position=1 -205,868-1423
  Homolog annotation: Hit_ID=CAB40395.1; Match level="QueryCoverage =97%, HitCoverage=97%, E-value=5e-40, Identity=38%"; Hit description =TATA binding protein of transcription factor IID [Guillardia theta] gb|AAK39780.1| TATA binding protein of
FMCSKYSKNVNNQNNDQNLDDLLLXNDSVGTFNNIRFHIHTLYCFSRKSHHPTLVVSFSAVPFQLYSFKMFFPTIKNCVAVVDTKTTLDIEKIYLISPSTKYNPRKIHAVIMKVYNPNATAIIFSTGKFVCTGAANEKECRQAAEHVTERIRQCGYQEALIHKFDVKNLIATADVGFHIRLGELSDFLGECCSFTPELFPGLAYRNINPKMSIIVFSSGKLNFTGNNSIDDIKIAFNQFYPILYKFIHS

SEQ ID NO: 151137 - protein, 199 aa, Heterodera glycines
  Coding regions on vcDNA: vcDNA=SeqID_77560; Strand=-; Position=1 -271,645-973
MDTATINRILTMNEKTKEHYLGCFPCNKIPLNINKFPSVLVANNDPSNKEGTHWVSIFIKDYKTVYYFDSFGRTPNKCIEKFLSQFKTVEEHKEFIYGGITKDNARKQMAYNGFKNVTVDQHFYVRHRICLRYANNPCVIEKNKNGHDRFYPLELVRMIENDQADIYLGQNFPKVVPSAQESSNNAHFIKNYYDSYPLW

SEQ ID NO: 151138 - protein, 155 aa, Heterodera glycines
  Coding regions on vcDNA: vcDNA=SeqID_77561; Strand=+; Position=1-467
ELVKNSSKCILFTIVEKLNEVRLELIRDLFNIQDHMKKYQGVTDGRTIQALNEEALRMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQL

SEQ ID NO: 151139 - protein, 368 aa, Heterodera glycines
  Coding regions on vcDNA: vcDNA=SeqID_77562; Strand=-; Position=1-1106
  Homolog annotation: Hit_ID=NP_740973.1; Match level="QueryCoverage =99%, HitCoverage=66%, E-value=5e-11, Identity=23%"; Hit description =M protein repeat containing protein (72.5 kD) (2C572) [Caenorhabditis elegans] gb|AAM97999.1| Hypothetica
MSNLFYVLLPSDSPGYDNKPNKFRVHLPRTLTFGGQWLCGLHSIIYTNSWPAIGTTENQWIKVHLKNGDKIKIDIPAGSYQNEQELENAINESIKNGIKQPATRVKRQTEYGVDLFFHYNPDDYWEKIEEERQRYKELLKLIVTKSRERDDETDTHRKRKIEDEEIDPLQNQSLTKKARIEALEEAARQRDDGKEEKEERTGQEFLEMYSVNYREKLNEVRLELIRDLFNIQDHMKKYQGVTDGRTIQELNETALKMRTAMKHRRKNLNAFNKAVLKKDLRTTAEEYERTSYEQNKDYVEPFFDSHPTDYWEHIHKKYEGLQDDYKKIRELREQQQFLTDEQKKQSIQDEIDQLRRLVDYRKKRFAAL

SEQ ID NO: 151140 - protein, 207 aa, Heterodera glycines
  Coding regions on vcDNA: vcDNA=SeqID_77563; Strand=+; Position=1-623
ERDDETDTHRKRKIEDEEIDPLQNQSLTKKARIEALEEAARQRDDGKEEKEERTGQEFLEMYSVNYREKLNEVRLELIRDLFNIQDHMKKYQGVTDGRTIQELNETALKMRTAMKHRRKNLNAFNKAVLKKDLRTTAEEYERTSYEQNKDYVEPFFDSHPTDYWEHIHKKYEGLQDDYKKIRELREQQQFLTDEQKKQSIQDEIDQL

SEQ ID NO: 151141 - protein, 46 aa, Heterodera glycines
  Coding regions on vcDNA: vcDNA=SeqID_77564; Strand=-; Position=1 -47,87-212,253-337
LKITILAFCHYFFTISTFFEKFFNKNAIKPKNTPLRIDKKNFKKHS

SEQ ID NO: 151142 - protein, 39 aa, Heterodera glycines
  Coding regions on vcDNA: vcDNA=SeqID_77565; Strand=+; Position=1-120
TPFQKTRDEPINRECGEKNISLFGVLFFISVNREKPNLL

SEQ ID NO: 151143 - protein, 19 aa, Heterodera glycines
  Coding regions on vcDNA: vcDNA=SeqID_77566; Strand=-; Position=1-59
TIENFLESNMENLKMLVHI

SEQ ID NO: 151144 - protein, 206 aa, Heterodera glycines
  Coding regions on vcDNA: vcDNA=SeqID_77567; Strand=+; Position=1 -229,687-1078
MFWNRWHNEYLAVFWDRTQWQHKGPKSQEKRVPKEGEVVLIKDDFHPRNTWKIGKIISLNGQKGAIRSAQIKLAPKALYGPYSAIKFLWKLKDNKNNANELEKGLLNEISKKEKLQKRRNRRLFKLANITLVLIYLNTITKIVNGAAEVVSIQSNSEDCERKSNGSVCRIRGTTELTILPAGQKVTLALKDDKGKLAGSLDLFDIG

SEQ ID NO: 151145 - protein, 42 aa, Heterodera glycines
  Coding regions on vcDNA: vcDNA=SeqID_77568; Strand=+; Position=1 -41,174-261
MAFERGKLLTCQLSAKNPLFLPNLLALFIAKHKTNNLFLAQQ

SEQ ID NO: 151146 - protein, 108 aa, Heterodera glycines
  Coding regions on vcDNA: vcDNA=SeqID_77569; Strand=+; Position=1 -174,494-646
MFSTKFSSFLLLSLLVCIVYPTKSFAYRGDGSFVGEAKHEKMARKLVKSGLTQDEFEQTFLPLLPIELEQKKFERRIDQMEKQLIKVISSVHDGNCMTKKSAKEEEEQ

SEQ ID NO: 151147 - protein, 90 aa, Heterodera glycines
  Coding regions on vcDNA: vcDNA=SeqID_77570; Strand=-; Position=1 -227,283-328
MISKKVWLNKRTNEILTLEKEEDYDENTEKDKYTYGDWLLKRCQIGGTATVQWEEENPSILSNVNFKFYSGTNCIGPLSASKAGNCMGEK

SEQ ID NO: 151148 - protein, 114 aa, Heterodera glycines
  Coding regions on vcDNA: vcDNA=SeqID_77571; Strand=+; Position=1 -190,1021-1175
MIKIQIANVCRKNWPNFKCKIIPNWLDIFGFIGVWHIQLQIGVFAKNLLIGTEKFDDGMVNVPAWTNMVPFERLLPICGVYFQICLAISPCHQCRQLQNSVYCSCAVNVNHGAI

SEQ ID NO: 151149 - protein, 409 aa, Heterodera glycines
  Coding regions on vcDNA: vcDNA=SeqID_77572; Strand=-; Position=1 -23,333-533,583-775,832-960,1017-1417,1665-1947
  Homolog annotation: Hit_ID=P40631; Match level="QueryCoverage=97%, HitCoverage=61%, E-value=1e-16, Identity=22%"; Hit description =Micronuclear linker histone polyprotein (MIC LH) [Contains: Micronuclear linker histone-alpha; Micronuclear li
MCDDQMEKKATTKRTEAQKLHPKATAKKNSQLTREEKQQQAAAANQRRGRGKRRPAQTTGVSNKNRQKAQGGGTKHYGSPTTSRRPKQTSGSSKTDNPKDKKEGTSKGGGSTKNEPNAMVDEATSKGGSSSTKNAPKAQVGPTAHRRPKQTSGGSQMDKQKAQEEGTSKGGSINTKNAPNAQVGPTAPRCPKQTSSDSQMDKLKAQEEGTSKGGSINTKNAPNAQVDEATSKGGRASITQQIPRSQRTRRVLTKGGGTTSKGDSKTDMPKDKKEATSKGGSSSTKNAPKAQVDEATSKGGRASITNKFPSHNERAESQRTRRVLTKGGGTTSKGDSKTDKPKDKKEATSKGGSSSTKNAPNAMVDEATSKGGRASITQQNAPAQGEGPSSEGGSTKKPITDKPDYMRQP

SEQ ID NO: 151150 - protein, 30 aa, Heterodera glycines
  Coding regions on vcDNA: vcDNA=SeqID_77573; Strand=+; Position=1-91
DYFSKHLVDWGIIGDCGINIDWAIIRAYTV

SEQ ID NO: 151151 - protein, 548 aa, Heterodera glycines
  Coding regions on vcDNA: vcDNA=SeqID_77574; Strand=+; Position=1-1647
  Homolog annotation: Hit_ID=NP_494149.1; Match level="QueryCoverage =83%, HitCoverage=30%, E-value=2e-58, Identity=30%"; Hit description =predicted CDS, putative protein of ancient origin (2C297) [Caenorhabditis elegans] gb|AAF39854.1| Hypothe
MVRKKQSFSSETKDTNVSSLNKGVQSSPEKKRSEGVQSSPEKKRIDYEEGVPSSQQKRIVFDNVRTYEKQSKDNVILINLDDEDFEPCTSKRTICNVVSEQKIDQLRRDREKRVRYRENEAEAERDKRTKQHRLHMQNVRENEMEVEKNERQEADKLRKRNIKENDSHLHQYKAKNTKQISKVSFGFMNIACTFCGALHWAYQKVQGKNSFDDCCNHGNIFLSEIPEPPQILRNFLIGKDKKSRNFFDGIRYLNSSLAFATMNPMRVKLPNYGPYCFRIHGQIYHRINIALHPDDDESPSHGHLFILDPEDAINSMKQNNLNVDTDVLDLLYKTIKESSPFVDGLEMMIEEENVQKEIALKENRKPYEVQLLLSDNKNLDKRRYNLPRANEVAAVFVCDSEGIIPEPRIVIKERGKSLKILNCNCAEADPLLYPIFLPYGNKQWSPDIQNKKEKRISRSQFIRWQLAIKENRFNSFLHGRKLFQQYCVDQYVRIENDRMKYIREHQKELCAESYFELAEWLEDEDQRENKKLTKVILPSRVTGSPKIY

SEQ ID NO: 151152 - protein, 64 aa, Heterodera glycines
  Coding regions on vcDNA: vcDNA=SeqID_77575; Strand=-; Position=1-193
MTKDTHGDSLVEEIGDISPPRGLSKFAYGKKEKIEEDAEQKERHQQQQQRRTNGKTKTKENDLA

SEQ ID NO: 151153 - protein, 161 aa, Heterodera glycines
  Coding regions on vcDNA: vcDNA=SeqID_77576; Strand=-; Position=1 -197,247-374,1048-1210
LLCVGECEFAFFTATKFKNAQLDNARKGKCWDWKRMAFGTFYDWILSAKILNEEKKDESTCKSKKLFLTFHFANNWIKTMELPEGEIGVNVSSPAEVFSVRLGCQALVKFGHGARPFALEICEGERMIFTAGVDNYICIWRWSMDEKKGAIKNIFCSKIEK

SEQ ID NO: 151154 - protein, 64 aa, Heterodera glycines
  Coding regions on vcDNA: vcDNA=SeqID_77577; Strand=+; Position=1-195
VSTRDESHLNNKYEILMEINTTDGGKQTILLDAKALVFLHDQLDALTRTFPKCYVCVDEKNKQF

SEQ ID NO: 151155 - protein, 330 aa, Heterodera glycines
  Coding regions on vcDNA: vcDNA=SeqID_77578; Strand=+; Position=1 -364,729-1041,1143-1228,1278-1302,1404-1608
  Homolog annotation: Hit_ID=AAH34113.1; Match level="QueryCoverage =67%, HitCoverage=16%, E-value=2e-13, Identity=26%"; Hit description =Trip12 protein [Mus musculus]
MPAAPPAAVATTVSTRVERDREFWANPGPGPFRVEKPGIFGLENRGKTRDWSRSKPGPRYSVVRVLVPVPLYSSVNDTDDDDTDAAADEEGSDGEEETTDEIEDNGEQQPNAAPTPSAASSVDTKSGPIPSPLEAFLKPQLNNAMSDPSQNCLILLQVLYGLNTFWWRIFDANDADTDEDGNDAAADEEEGSDGEEETTDEVEDNEQKQPQTNLPPITHRPIIAPSFFYSPKLNSKVTRQLSDFLTVATQQIPKWTLDLVRAVPFIFNFSSRHSFLFCTAFGRDRALMHLVNETSNDEQDGAGHDTASRLITRLERRKVHFVPSLVQMLI

SEQ ID NO: 151156 - protein, 132 aa, Heterodera glycines
  Coding regions on vcDNA: vcDNA=SeqID_77579; Strand=-; Position=1 -257,480-621
MDNSECKTEKEMDLKPEEKGHGEEKGEEEIVFLGMTINETPKDEKKELPPSTSSGDSRKRRHSFDGSATSMLGAMIKAQGEARAEWVERSEEKVRDWEAAHCSNGNQMMMMIITKLKNSYRLSSRRGPEFFN

SEQ ID NO: 151157 - protein, 189 aa, Heterodera glycines
  Coding regions on vcDNA: vcDNA=SeqID_77580; Strand=-; Position=1 -78,195-258,303-376,424-544,666-898
MRNELGANRVITKPQEFYKLILDHKVDQKNFIDEHSSSNIVLSLWTTSRARLKLLDYMQQVYNTEGAELLYTDTDSVIVKHSRDLAPLQTGEFLVQMSEEYTGFSIKNFVCGGITFDVQNSQTLQFEHFRQKVLNYGRQGEEPAVFHYDKIQPTRASQIVTREQRKRYLPVCQKGIITDELDVLPFGYQ

SEQ ID NO: 151158 - protein, 172 aa, Heterodera glycines
  Coding regions on vcDNA: vcDNA=SeqID_77581; Strand=-; Position=1-519
MAELDKLGQSDGEDGGIGVGENSGEALDKRSLLLSEPVQITVTCLTPPTGAGRPRFYPYQHWGYNEAHRIRIRDWEDNYCMFHALIGARAYHDPMLFNDWMLADQQPQQQNLARLMLMQDFCETKEAFRRLIINRELMSSSVHRLMHAAGVPEGQHAYGMDHLQTVQHYWVQ

SEQ ID NO: 151159 - protein, 31 aa, Heterodera glycines
  Coding regions on vcDNA: vcDNA=SeqID_77582; Strand=-; Position=1 -83,315-327
MEHCQFCDRRFLNKKGLGVHMQIHNRQKKAI

SEQ ID NO: 151160 - protein, 358 aa, Heterodera glycines
  Coding regions on vcDNA: vcDNA=SeqID_77583; Strand=-; Position=1 -174,223-525,578-784,1040-1432
MSGLSRFQLSTATAGQQKRKSDGAPAKTKTLKEVLDFKSAGVFHVTAKVVNLQYKIYKACPLKNRGFFCRKKLDDEMRCTSCDHIVKSPMKSLFLRVEIADRVQPESSVVTTMFSYVGEKYLGINALDVDELSEKEPEKLAEILEAKLDKEVVVKVQIKESKGHFEGQDFDWIIMSMCADNKDVEKEEEEKAKKKVKKEDGELKEESEDDDGDEIQLVGETKSTSTEAQPSPPEQSSALSTSQQQQTDDDNDEHQQGEGRGTRAEGGSQSTGNDLFQQVSHSVHRLERFSVSRHITEFVLNANVEEPDEVLRGAFQILMERAIQNAEQQSGRKVLKIGVTLQGRGLIGRLVALLFLTY

SEQ ID NO: 151161 - protein, 95 aa, Heterodera glycines
  Coding regions on vcDNA: vcDNA=SeqID_77584; Strand=-; Position=1 -193,238-332
MDESKREKFSPQNDDDVITIGDNNTQTLLDLQPGPSKRGRKPRLDKIHEEIASAMKKAKAMEAEVDESPKKQPTNVFEYPTIFWKLARPKVLANI

SEQ ID NO: 151162 - protein, 906 aa, Heterodera glycines
  Coding regions on vcDNA: vcDNA=SeqID_77585; Strand=+; Position=1 -272,435-1080,1139-1418,1585-2264,2565-3132,3178-3452
  Homolog annotation: Hit_ID=CAE56395.1; Match level="QueryCoverage =29%, HitCoverage=34%, E-value=1e-41, Identity=37%"; Hit description =Hypothetical protein CBG24082 [Caenorhabditis briggsae]
MKRVRQSEKLGEFPEIEFAVNTMGVTVYCPRHLQTPRFVPWDQPGRCSSCRSGTVELDYIIQPEGVTIFSNRLKTDGENFVPFDAIGKLQVCHKHLSIFLSIVDILMDYPRINESELAFPIPSGIIVSGPSSSGKTQLVLRLLRHANVMFDPPPKAIGMCKGGFCAVGCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLTTRRESFLPPKMVKREQKIGERVVHNYDYLKKLGKTTSEKKRRHLLNSAGCEELLTLVEICLNVLNGSFCLSRKQKQRLEPFAKDIRQLARVRTRETKNDDDDDIAERTNLGFVKRQVTAAVQKRKGNVSERNAMYNQHLRRYLKMRKEHKERPVRVQLSNGAQLLNKTVETGVQVRPGPDEPKDKSVMVTDEDEEEEIEVPKFLTPTSPTQGSSRSPRTNKKAAKQQKLIEKKDHLLAIIMSDPQRFGATDRGKIINPKTGREFIDSDLAWSIERLVDPRPENAPSPRGTKELKKKLAQNPLASSLLNRLFVGSGFVGQADLADFQALSRKNSGNRYLLLAVDVLSRRMFGSPVKSKRPADMKRAFEELFEQMPRVPDTLYTDRGLEFVAKALKEFYAEKGIQKFETSSKKKAAVAERAIRTLKTRLYKYFSSNNTSVWVDVLPKFLSAINNSVCRATGLRPREISDTNAREVWKRVYGEGLVQSNKTPKIRAGETVRIPEPKHIFEKGYIPNYSDHVYTVDEARSTNPQHYLLKDYYGTKLKRKFYLPELTKVQVDENTMYRIDKKYKERVRDGKREMLVKFIGFPEKYWVTNEEMNV

SEQ ID NO: 151163 - protein, 138 aa, Heterodera glycines
  Coding regions on vcDNA: vcDNA=SeqID_77586; Strand=-; Position=1 -151,406-526,573-717
MPQLVVGPFCTQKPAHKDGDRGMPCRVGQAAEQHQNRNQQHRPADGEILDGHGQHLLRLQVRTQRPSSWRPAAWGTHRRVPQPHHYGICVRWTQGLWIVAAQQRHGGGRVQGQTARHHHGLGRLREDDVREDEGHGVE

SEQ ID NO: 151164 - protein, 210 aa, Heterodera glycines
  Coding regions on vcDNA: vcDNA=SeqID_77587; Strand=-; Position=1 -208,254-362,731-906,959-1097
MAIVGGGETAGAIRARDAKRTHAIARDFEVEVVWECEIADQLEDDPAMRAYFDNCPDSGPIDFHDAFFGGRTGPEWLAATVINPKNGEWKSRTIKVKDFNSLYPSREEFTGFSTSVTHIELEAALRSGYKVTHVYRAYIWPLVCDWSDSVFHSYMNKFLKIKFESSGYPAPCREVGIDEEERERRQQDYINKPWEGNKVCLDASKIMPNP

SEQ ID NO: 151165 - protein, 539 aa, Heterodera glycines
  Coding regions on vcDNA: vcDNA=SeqID_77588; Strand=-; Position=1 -126,196-377,450-576,1072-1480,1525-1666,1710-1812,1861-2023,2069 -2283,2327-2479
  Homolog annotation: Hit_ID=NP_507780.1; Match level="QueryCoverage =54%, HitCoverage=20%, E-value=8e-22, Identity=29%"; Hit description =predicted CDS, DNA polymerase type B, organellar and viral family member (5T899) [Caenorhabditis elegans]
MKFVLPQQRFSEYKKDERRQLENVQALCRACNIDMDLPFYCVDYYQRLHPGLFWLYCFETSGRMKPSWKSCAGDREHELCVLFTEDVNGENGHYDAVKSVGKLVRCRTFNTLNIRPNANGNVTIASAWAGRSEETVTIIKTSLSLVNFCFAHVTCTRCIEKGVWDQELERACALCGRFRTYSWAPFEFWRTDVECANVVDDPLAAFTKWLLNFEAEVLGMELGAKKRRKRKNAENNNDGEAMEGDEEDDAVDLDAENNWMLGYDEAGEKPESVTTYAYAHAGSRYDHVLIYGEMLRMGVRPELIRQGNHLLEMKARKRGAITTTVFRDSYKLIPIKLASFVKTFDLEIEGVDNKKYFPHKYNKAKNYGTVLDTLPPMEEYYPGSLFPAERTKFEQWYEENRETEFDLCEVIADYCKTDVQILAHGLVKMRQLFLSQTKHDITDSITIPSACMKFFVVLMHCDNERIAIIPHLGYEKRGKQSTVARKYLKWRSEEEKREFDRTIRHVESPGGEFKYGNYSLDGMVERPEEEKDLAIEVNG

SEQ ID NO: 151166 - protein, 206 aa, Heterodera glycines
  Coding regions on vcDNA: vcDNA=SeqID_77589; Strand=-; Position=1 -168,245-317,1141-1277,1462-1533,1594-1671,1714-1804
MSNLNPGNWWYYFERQGKATAKCKAEYLRDQKIKSRADPSLYWEVNSQKWPMIGAVMTCERVLPENLAKLLFLHHNLLLTAMAQSNPFKHSFVLFLFTALVIVIAITLAENNTTDAENVTDADNAAVAAVMPSAITDGMTCVANNLTNEADTQRMEKLEKEQEYVDILNEAQNYWTAVVHENFALMDEEMLRNMVGSLETPRYNAN

SEQ ID NO: 151167 - protein, 78 aa, Heterodera glycines
  Coding regions on vcDNA: vcDNA=SeqID_77590; Strand=-; Position=1-235
EEKSMGRHNHQATHSHIGFTFFENDIEKAKRKSFISRPEASFSKNKKKFIIQRGGNLPTLKVSFGSPMVTWVPLLCKG

SEQ ID NO: 151168 - protein, 53 aa, Heterodera glycines; identical to SEQ ID NO: 125524
  Coding regions on vcDNA: vcDNA=SeqID_77591; Strand=+; Position=1 -47,231-345

SEQ ID NO: 151169 - protein, 147 aa, Heterodera glycines
  Coding regions on vcDNA: vcDNA=SeqID_77592; Strand=-; Position=1 -130,351-475,580-630,698-835
MRLKQLACKSTGGRMPRKQTAYKCAGGRPAKRSFFITQWKMKKVVNEDLSNGKELNKLRVLNTYNDEEMDSFEYITSTEKGENVVDIPNTNGPIMRPSGRYQVYFKDPEIGWALQTLEDIDAGTPLFEYAGMLENSKSVGTTAENDD

SEQ ID NO: 151170 - protein, 153 aa, Heterodera glycines
  Coding regions on vcDNA: vcDNA=SeqID_77593; Strand=-; Position=1 -43,120-250,296-583
MDRNKIEILQKSRKLRPWEEPVVRRALFPIPYWNVHSHAASALARTNNGLEATHLHFAKGLCHHPALSDFIYEVSRSIDKKVDAARSARNFIHKRHKRYVLQDAVIMRILADATYDNDAEIHDVMTALGLQVEGYAGKLKDYENFDDSTMHVP

SEQ ID NO: 151171 - protein, 170 aa, Heterodera glycines
  Coding regions on vcDNA: vcDNA=SeqID_77594; Strand=+; Position=1 -78,487-667,819-981,1032-1120
  Homolog annotation: Hit_ID=XP_313558.1; Match level="QueryCoverage =66%, HitCoverage=18%, E-value=1e-16, Identity=38%"; Hit description =ENSANGP00000013381 [Anopheles gambiae]
MDEHQIPVWYVMDEFGVRIGHSLQPNSGRLLDLIPSGDQSPTVNFQKSVDDPDILVCASDLQLIGHLRRFRVQETNDPMKAHIIWRPAVQSFVENCQDVHPDQQLVDELSLRWSPEWFPLTFNLHIELPQFVAYFQRRAAKNLDNCWIVKPWNLARAMDTHVTRNLNTII

SEQ ID NO: 151172 - protein, 42 aa, Heterodera glycines
  Coding regions on vcDNA: vcDNA=SeqID_77595; Strand=-; Position=1-131
CHFTYTNSLASPGADEEEWCANDTLVEMEPDNAIKPVIPLYP

SEQ ID NO: 151173 - protein, 284 aa, Heterodera glycines
  Coding regions on vcDNA: vcDNA=SeqID_77596; Strand=+; Position=1 -727,1122-1250
  Homolog annotation: Hit_ID=CAE70527.1; Match level="QueryCoverage =97%, HitCoverage=93%, E-value=3e-17, Identity=21%"; Hit description =Hypothetical protein CBG17156 [Caenorhabditis briggsae]
VQQVHREVSRLQKFEERLSPDQKHDKLNKNDRKTSATSKKDETKLKIKPTFEQNQDQNATRSSSKTKQKKGNEKPINDQRPSRNLEQTTSIASNSDQAKSKKEINLANRQGSGQISQNATAASKSDQIKDKGKKPISEQIKSSNEKKSEKHDTTEQEMNVNRKQKQKKFIRTTSFASPSTRQISKKTKNFQKNENNYVQKQITSAKKRRYENLKMEMENGRNGRSPKRLKMENLNEKTDGQQDKKSEYGANDRKEKTDEEEEERDGREEEKGAAKTITIIGRAN

SEQ ID NO: 151174 - protein, 621 aa, Heterodera glycines
  Coding regions on vcDNA: vcDNA=SeqID_77597; Strand=+; Position=1-1866
  Homolog annotation: Hit_ID=XP_319741.1; Match level="QueryCoverage =63%, HitCoverage=87%, E-value=3e-43, Identity=29%"; Hit description =ENSANGP00000006515 [Anopheles gambiae]
MDPNQLKLILEAVLKASAEQNNSSAALATSIDARLSTFEYDPELGHTYDVWLKRYGQTIAQDGQALSDQSKVQLLIGKLGEVEYKRYIDSIAPKSQNDFNWDETTAKLKHLFGETRSLFLRRFDCFQIRQDAHQDVQSLIALINSSCENADLSLSKEELKCMILIIALRDEFTDLRQKCLQRLEDSRTSGRSTSLQELGEECRKYQILKESALSLGSNPCSTSAIRAKPQQIRDKQKSKTKPQQSHKGHFQPNNSTAIKKEVGLPDQPCHSCGGKNHWQKDCWFKNSTCEKCGRIGHIAKRCKNGTETRRVRAVATNSGNDMHIHTVSLQPTCMAIEGSSNKWWRIVTEINGMENPMNVDTAAQITVITADSWQKLGKPKLGKTTIAVKNCNEKAFAIKGKFNCQVSYNGRTAKLIAYVSDEIHQDLLGMPWIEELEIIPKELMFPNSSQITNSVPMKHQKMPAVNFKNFGKFQQKHQNMERQFNDKYGAKPITFQNGEPVFIWNLKGNKANWLPATIIERVGNSPTYRVDVPTLRCAVHRLANQIRRRFPVELEIPQIGQANGNVLIGNQPNRTPIKEIKKAKSPIGQSQNAPRRSTRAKTAPQRLDMDPSKSKYDVIRP

SEQ ID NO: 151175 - protein, 290 aa, Heterodera glycines
  Coding regions on vcDNA: vcDNA=SeqID_77598; Strand=+; Position=1-872
  Homolog annotation: Hit_ID=XP_313035.1; Match level="QueryCoverage =92%, HitCoverage=32%, E-value=4e-34, Identity=33%"; Hit description =ENSANGP00000011760 [Anopheles gambiae]
MDPTQLKLILEAVLKASAEQSNSSAALATSIDARLSTFDYDPELGHTFDVWLKRYGEIIAQDGHALSDQSKVQLLIGKLGEAEYKRYTDSIAPKSQNDFNWDETTAKLKQLFGEIRSLFLRRFDCFQIRQEAQQDVPSLIAQINSSCENADLSLSKEELKCMILIIALRDEFTDLRQKCLQRLEDSRTSGRSTSLQELGEECRKYQILKESALSLGSNPCSTSAIRAKPQQIRDKQKSKTKPQQSHKGHFQPNNSTAIKKEVDLPDQPCHSCGGKNHWQKDCWFKNSTCE

SEQ ID NO: 151176 - protein, 135 aa, Heterodera glycines
  Coding regions on vcDNA: vcDNA=SeqID_77599; Strand=+; Position=1-408
MENDDTKEWHGNEQMAFGQQMGGGLRQFEMFENLEHARGGQERVANNRAFGEQRPLLSRPQLPPQQSFIHRQYIQSVQPLPPSLPYANERITSAPTYPQPNFEQQRYQPQQNSANPTKILMFCMASNSSRTGKNF

SEQ ID NO: 151177 - protein, 295 aa, Heterodera glycines
  Coding regions on vcDNA: vcDNA=SeqID_77600; Strand=-; Position=1 -146,322-1063
  Homolog annotation: Hit_ID=XP_318550.1; Match level="QueryCoverage =35%, HitCoverage=11%, E-value=5e-17, Identity=37%"; Hit description =ENSANGP00000020240 [Anopheles gambiae]
MQLPGKFERHPKPNAIGRKFTLFTDHKPLFAIFGSKKGIPNYSASRLQRRKPIIFQSRHDKSRNRQPKMTLQKIVNFVIYGWPTKCNEPKISQFHPKRNEIFGKWRCLLYKSRVIIPNQLRGRILKALHFAHPGIVRMKALACQYVYWPGMDSEFERVVRQCDEYQGAQKSPIKAPLAHGQSSTRPSNACTSIWLDPAKMDLFILLWWTPSPNGQKSIKCLQLRPRMAKQFDGRHGAKEKVFSPAEPVLLLNYRNQKTYSNQLRRNYVFKENSKHNPGADHQPIPPATQPSSLCL

SEQ ID NO: 151178 - protein, 501 aa, Heterodera glycines
  misc_feature (246)..(246): Xaa can be any naturally occurring amino acid
  misc_feature (251)..(251): Xaa can be any naturally occurring amino acid
  Coding regions on vcDNA: vcDNA=SeqID_77601; Strand=-; Position=1 -62,327-436,496-528,582-623,817-887,977-1053,1288-1449,1720-1761,1821- 1961,2312-2415,2904-2939,3005-3025,3080-3148,3404-3463,3510-3551,3601- 3642,3801-3872,3926-3987
  Homolog annotation: Hit_ID=NP_508973.1; Match level="QueryCoverage =96%, HitCoverage=72%, E-value=2e-96, Identity=42%"; Hit description =twinkle (XG415) [Caenorhabditis elegans] pir||T16375 hypothetical protein F46G11.1 - Caenorhabditis elega
LHMLTQFDNRVVHTNERDALAVYDASNGIPALSLPKGERFDQSVLSYLEDFDLVYLWPSIHERFAKDYASYMNATRCYIYASYMNATRCYIITAPLRPVELLRDGRAKEVLHNIQGDAVRVRYKGFRSVGDLRDAVRSEIVQSKSRLGGIAQWRRYTLLNNYLRGFRPGEITVISGGHGKTTFLCEYSMDLYSQGIRTLFCNFEMPEDKILKWMIIQFAGYMSLILKWMIIQFAGYMSLMIVFFMXKSKSXVYKNIYTNYVKFFLTFIRYHSSVEMWLDKFERTQGDLLIMKSDEFRDKTLKEIAIRDQVITSGIQHLHLVIDNLQSLVDLATVSIDTMSASQSLVDLATVSIDTMSASERIHQQDRFVSMLRRLANNQELHITLVVHPVREPNEVEFVVHPVREPNEVEFRLQHIGGASAKIAQERLQHIGGASAKIAQEADNVLVIQRRRDFDDRRRFRKFLYILKNRYGGRCIEVDQILKNRYGGRCIEVDQVEKIFG

SEQ ID NO: 151179 - protein, 226 aa, Heterodera glycines
  Coding regions on vcDNA: vcDNA=SeqID_77602; Strand=+; Position=1 -327,721-1071
  Homolog annotation: Hit_ID=NP_502797.1; Match level="QueryCoverage =46%, HitCoverage=29%, E-value=9e-14, Identity=36%"; Hit description =HASI (4P602) [Caenorhabditis elegans] emb|CAB16520.1| Hypothetical protein Y57G11C.19 [Caenorhabditis ele
MTDVQVDLADLQSLSRHNKGYRYLLVAVDVLSKRLFVVPLRSKRADEMLLAFKQLVEQMPMTPHRVFTDKGTEFRNRMLKEFFEEHDIAKHEPVHSAVKASVAERAIRNKQYGLKLRRKATGKIEHVLKLRGITLNYDVTVNQNLQYTAFRERVLQYAENRDVEPISVFNPCAIRPNIKKGEVTLIPTTKIYRPYVGKGIVGPDYRILDFGYTPFTSFPIEILIIF

SEQ ID NO: 151180 - protein, 220 aa, Heterodera glycines
  Coding regions on vcDNA: vcDNA=SeqID_77603; Strand=+; Position=1 -280,523-585,840-988,1297-1467
EVFRGHRGLYDFNIGMFYDQHEHQLHPSFLPKVALEYVNNCPQDFLLSTLLSEHFQNHKIVVIDVNSFGPDASCRSETEAFLARRIVNKLSAADLLVGTVDAAQGKEFDYVIVSVGRNNTSTLGFLADSYHPTLRMWKNGRVNVMFSRHRKALIVLCDASSFLANPLLTINTAPEGTEAVAFESGIEAGRFMPYTKQSFMVFLKEARREGLIFDAKDLEL

SEQ ID NO: 151181 - protein, 140 aa, Heterodera glycines
  Coding regions on vcDNA: vcDNA=SeqID_77604; Strand=-; Position=1 -65,338-695
MTLILMQPCISSTAGRGWVPNSSVLELKVLGIENEPFTSCFFQENHEALFGVGHKATSFDAGLECNGLSSFRSSIYRQQRILNIMIPTIFQEFMEQIMRHIFIVILNRNDICYSGFVRHIYDNNHIRRHTILFPNAAPKC

SEQ ID NO: 151182 - protein, 146 aa, Heterodera glycines
  Coding regions on vcDNA: vcDNA=SeqID_77605; Strand=-; Position=1-442
YVIYHLIVDNGQRSEIAYKLRYNEFKVAKVVGTGENTVRMCPLLDSKTDSTDAWIGWSNRLYKLTKRLRIYVEQHQQKLSAVSAPQITEHDYLFRMPQNPLRGISRKHLNEALRTFFGRFRDVNPIPFTLHKIRAIVASQSVNYAR

SEQ ID NO: 151183 - protein, 139 aa, Heterodera glycines
  Coding regions on vcDNA: vcDNA=SeqID_77606; Strand=-; Position=1-420
  Homolog annotation: Hit_ID=AAN87269.1; Match level="QueryCoverage =77%, HitCoverage=4%, E-value=4e-15, Identity=41%"; Hit description =ORF [Drosophila melanogaster]
MHNSLHYRHAPFQSIGIDFLGPTTISLAGEKIKAWILIITCLATRAVYLEATLDLTSESFINFLRRFISRRGKRDIIWSDNATTFKLAQKTLELLSAPGPDQEVQNFLTQNRIKWRFIAQISLGQEAFTSASSYNYFQH

SEQ ID NO: 151184 - protein, 302 aa, Heterodera glycines
  Coding regions on vcDNA: vcDNA=SeqID_77607; Strand=+; Position=1-909
MATNMHDKKTLLNQILGEADITVSNSGITVSGPRLSTPRFVPFDEIGRCHCCKSTEVEVDTMFTKEGVTIWCSRIDKVQFVPFDVVYDLPGHCFFRLKNKARVFNIPYGEPPPMTCKNQNSQSDQRELKRKAKVALDLLETGLMADALQDSESWKKAKTAMNVLGNVLLAESLPTVKKENKNSPASPVDQNIAQPKAEPQKETTKKREASEEKKAPTKSHHSQRQSSGTRKSSKELMNEKPSSPRAESIPVQHLDSASTQIDDVSVPKADKIPKSNNEEDLGDIDKTLDEFFASIKAATTGM

SEQ ID NO: 151185 - protein, 831 aa, Heterodera glycines
  Coding regions on vcDNA: vcDNA=SeqID_77608; Strand=+; Position=1 -1508,1613-2598
  Homolog annotation: Hit_ID=NP_502797.1; Match level="QueryCoverage =35%, HitCoverage=82%, E-value=8e-44, Identity=33%"; Hit description =HASI (4P602) [Caenorhabditis elegans] emb|CAB16520.1| Hypothetical protein Y57G11C.19 [Caenorhabditis ele
MANKFILVPQEIYRGLTSAPSTGDINLDTVRHDLDRTRGERANPSTKNVRYNQQLRRYLQMRREVADRPSKVELTKGISVLLKRGGEDGDGQVVDTPPRPPGPPPPPPHRPRGPPPPPPPPGRPPSPPGPGPSPPGSPPPRPQRPPRPSRAAPPRRNRRLEQWRKRRYDIQQRRQPAVRDFLAEAAAAPLPESDEEADYMLENGFALPAPSQYYGDLPVLPDNADEIEEMDTVQQRLASRRKLKKDDDDDDDDWQDKKYKIYYPPPPARRPPSRPAKIEPMHPPRPNPKREPQPKVDPRPSTSKQADIKPKREPKFEPDPRPSTSRQAGYNPAPPAPKKEPKHEWKQTKRRHSPPRTAPHRIPKREPEIEETPQEQPPAAAAPADVEMPHVPPPRRGTKRRYPPENVEDGQPRLRKRVRQARRARVYYSPEPGPSTSAQSDEQQQQRELFSIPTNQLTMAQRVELICIKCNRYSDRMGVRGNAIINTKNGQPLVRSNLRMAISSTKETITEYNHQDGIENQKRVSPEKMELINATLDKLYNDPSSPAAFSGVTALWKEARKKIKQLSKKEVQNYLESHRTYTLMRPRRVHFRRAKTVAAGFMTDVQVDLADFQALSRQNRGHRYLLVAVDVLSKRLFVVPLKNKRAEEMLEAFKELVKQMPMVPHRIFSDKGTEFKNQLLKKFFDEQEIQKHEPVHSSVKASVAERAIRNVKQRLYRYFAEKETLNWVDIVEEIVEGINHSPSRVHGMRPIDVNFKNAQRVWKRMYQTRPPIRRPPRFYKDDFVRMTREKGQFEKGYLPNYGDEILEVDEVLKGVQPVRYKLRDDHGEKFR

SEQ ID NO: 151186 - protein, 135 aa, Heterodera glycines
  misc_feature (4)..(4): Xaa can be any naturally occurring amino acid
  misc_feature (92)..(92): Xaa can be any naturally occurring amino acid
  Coding regions on vcDNA: vcDNA=SeqID_77609; Strand=+; Position=1 -23,219-392,945-1129,1646-1673
  Homolog annotation: Hit_ID=XP_417415.1; Match level="QueryCoverage =99%, HitCoverage=32%, E-value=6e-29, Identity=48%"; Hit description =PREDICTED: similar to ADP-ribosylation factor 1 GTPase activating protein [Gallus gallus]
SGLXNHFSFVRSLTMDKWKDAELARMRAGGNAHAREFFESQPDFRPHWTIQEKYNSRAAALLRDKVATEADGRVWSYDTSLARNYQPLLSKXGTMKLRGIFKFKVFLEDETYQNRVTEWYRIWQKSSSSRYTGFG

SEQ ID NO: 151187 - protein, 164 aa, Heterodera glycines
  Coding regions on vcDNA: vcDNA=SeqID_77610; Strand=+; Position=1 -49,418-598,721-793,1257-1448
  Homolog annotation: Hit_ID=NP_741042.1; Match level="QueryCoverage =61%, HitCoverage=24%, E-value=7e-19, Identity=49%"; Hit description =human PTB hnRNP homolog PTB-1, human PTB hnRNP homolog (49.6 kD) (ptb-1) [Caenorhabditis elegans] emb|CAD
MRVTASKHIVVQMPKEGQPDAGLTKEFTNSSLHRFKKPGSKNYMVLNALGILKFGFSNYRIFIRQVRLCTCQIFQTEKDHKMALLQLEDVENAIDFLVTMHVRFWTWIQAWIFSESRSFLGSGFSGAFVQEIQVKINLEIQAQVFAKCRTLFALLCVRKIFFFV

SEQ ID NO: 151188 - protein, 60 aa, Heterodera glycines
  Coding regions on vcDNA: vcDNA=SeqID_77611; Strand=-; Position=1 -47,134-190,248-289,1525-1563
LILKIKLLTHIREKEVYCDADFFEVPEDYDFTTRVTSHIDHVELTETRHYELDGCCFVNF

SEQ ID NO: 151189 - protein, 238 aa, Heterodera glycines
  Coding regions on vcDNA: vcDNA=SeqID_77612; Strand=-; Position=1 -244,291-537,596-821
MQNVEFGSSSDNPIMFFDDESEQTVQNWQMKRPMKSSELLEETEKQTKRDGKRTAEEAEGEEKQRQNRESTRRLLGIKKAFLNEIWQIVTVSFAMLGIAVEPIEQQMNGGKWPQFELALRQIGTAQALLVLDKEQLQTTWNFGAKTITAINSESQTFLGSEIFKIMEVGGRDENVKFIGVMDTNGDKKLKMLFFFVRLIRKLAGELETPYESYSQKDTVRTSTVYSSVSVQMIKEKQH

SEQ ID NO: 151190 - protein, 283 aa, Heterodera glycines
  Coding regions on vcDNA: vcDNA=SeqID_77613; Strand=-; Position=1 -161,662-834,1145-1395,1674-1763,1813-1989
  Homolog annotation: Hit_ID=AAQ06662.1; Match level="QueryCoverage =22%, HitCoverage=9%, E-value=8e-16, Identity=61%"; Hit description =acetylcholinesterase [Meloidogyne incognita]
MTDQQQRDGAVCASMTSPVAVDQQKSLIPSLSISPASTLFSPFITQRSNKDKVMILNCFPIYQRFALQRMRKKRRKSRQIKQKQRRRQMPRDKPVPAAAAEVPTDQCGMPRKRQHQSIFLFDGRRQFVANHHHHLLLLVVLFILLCFCSPSVRAIPSASSTQQRHHQQRLTAPMLNGDEPPLVVTKLGKIRGFNQKFNGKTVRTFLGVPYAQRPIGGLRFAIPKMIDRWEGELEATSSARTCFYPIGKICTKLRQFDLIVESINGERRLIRTQKLRSIPDVEH

SEQ ID NO: 151191 - protein, 150 aa, Heterodera glycines
  Coding regions on vcDNA: vcDNA=SeqID_77614; Strand=+; Position=1 -326,436-562
MFVPFLHQTFFHCATVCIFFILLGVFFRCQQVTRGTLALCAKLSLSSTRSIRSMKNDARSVADFDRSGNNKIGESPISMPLPVGAARSPFEAFVQVNAGVVDAGKTRFGVECSVSSCTRNSRLVVSALRPLFSNSVSFGIANLLTLLQVE

SEQ ID NO: 151192 - protein, 105 aa, Heterodera glycines
  Coding regions on vcDNA: vcDNA=SeqID_77615; Strand=-; Position=1 -176,437-578
MMCQVKLPAPSDVLSLLLFLISVTIWSRSRPNSSFMDQKSPTNPTTIQMSMETKTETAKGRETMRYEELIGGTKCRLPIRALRRSFLAAFHDHPRAVQRTNWALH

SEQ ID NO: 151193 - protein, 34 aa, Heterodera glycines
  Coding regions on vcDNA: vcDNA=SeqID_77616; Strand=+; Position=1-103
RFAPSADHSSPHSMITREQSNERIGRCTETEPHR

SEQ ID NO: 151194 - protein, 102 aa, Heterodera glycines
  Coding regions on vcDNA: vcDNA=SeqID_77617; Strand=+; Position=1 -111,484-528,615-767
MFVFPCCQYDVDVMLEDLNGKVLYKEARKQLDTHTYKKGLCHHPALSDFISEDAVIMRILADATYNSDAEIQELMTALGLQVAGYAGKLMDYENVEDSVQAP

SEQ ID NO: 151195 - protein, 136 aa, Heterodera glycines
  Coding regions on vcDNA: vcDNA=SeqID_77618; Strand=+; Position=1-411
MSLSSGSFSDSICKQRNKGSTRQALNDLSICLTRGNNWWSKMAFGYPPKSDHLTCTPGTVQSKFGRNSETFPDFGREFRAENCSRAKPKRELGNTPSHSEVGTRHSAKHLPMYNTVLMWAIIFGVILAKCESESHR

SEQ ID NO: 151196 - protein, 304 aa, Heterodera glycines
  Coding regions on vcDNA: vcDNA=SeqID_77619; Strand=-; Position=1 -79,314-805,858-1189,1390-1401
MPSAAMLAFCLLLALFGALNLPTECKVSFSTTYELLETGTMLLDEVKKQTDNERVEHEADDELDSQKAKALEEKGDKFLIAVENLCNSEIEVRKPVAEKIKPKEDANLLAVKNVCQNWKNRKSIRKEQKEAENGSVAPAMSNLKVNPQIHESFLRTLSEIKILNPKNKEEFGKLAKVGIDLLPKVTKILKELKTIADSPSDQTSASPADQPKGISKRREKKDNDRWNLFKKRVHDRERCSLYVVLALTSSILFTDMTVRLTQQHTFSIGNSSRTDEHRTGVETFFQVLELVAWIYSLLTILNEI

SEQ ID NO: 151197 - protein, 16 aa, Heterodera glycines
  Coding regions on vcDNA: vcDNA=SeqID_77620; Strand=+; Position=1 -41,274-283
MDTKFQLNSERFLSKF

SEQ ID NO: 151198 - protein, 135 aa, Heterodera glycines
  Coding regions on vcDNA: vcDNA=SeqID_77621; Strand=+; Position=1 -152,212-337,706-819
  Homolog annotation: Hit_ID=NP_609089.1; Match level="QueryCoverage =93%, HitCoverage=37%, E-value=2e-40, Identity=63%"; Hit description =CG10399-PA [Drosophila melanogaster] gb|AAF52467.2| CG10399-PA [Drosophila melanogaster]
SLGDTIGVGTAGTVAHLLDEVLRAVPCKSVAVHFHDTYGQALSNVLTAIDRGIRVRGIRVADSSIGGLGGCPFAKGATGNLATEDLAYLLHGMGFHTGIDLDKLIGTSVWICAQMGRKNESKVTNAMQNSRKCGE

SEQ ID NO: 151199 - protein, 242 aa, Heterodera glycines
  Coding regions on vcDNA: vcDNA=SeqID_77622; Strand=-; Position=1 -54,343-870,1068-1214
MSREIDQFNNAILLDKGDESVRRVGSSAFAGADEKEQLRFVGLVLWHLVFRDCPIIDPTADEFVFIAKVEPSIDATDPNVAMAFCAELDNELARKSQPKEQKEEKKVAEEMQEKIEKEFELFERLEDKILKDTAFKGVELEKYNELHEKFELLRMYWDWQKGKRRRRNIPFYGIIDRAFIAFGSEAPVLIVFIRVLLEGAIGWTDFSEYIQYPTRNTIRIKDIEKYYQMMRQLEEIWDGYGL

SEQ ID NO: 151200 - protein, 745 aa, Heterodera glycines
  Coding regions on vcDNA: vcDNA=SeqID_77623; Strand=+; Position=1-2238
  Homolog annotation: Hit_ID=XP_320889.1; Match level="QueryCoverage =98%, HitCoverage=88%, E-value=1e-117, Identity=34%"; Hit description= ENSANGP00000012033 [Anopheles gambiae] ref|XP_313651.1| ENSANGP00000013044 [Anopheles gambiae] ref|XP_31
MAADIGQILQQLVKNQTEAFQALLQNAQTNQNSNNHSTIYATINSQLSQFTYNPELDLTFQAWLDRFGPSIQVDGKDLPDAMQVRLLLGKLGQEEYARHAERVLPKLPTDFTLAQTIDKLKILFGETKSIFTRRYECFQLTKSFSQSPLDFASQVNAMCERSKMDLTKDEIKALIFLTGLSDEDRELRERCLRILEEAKKKTPPEVITFEKLTEECRAFLSLRNTSQSLATVSGTNAITLKPQKLKEQQLKKRSTSQRPSTKAQSNNNRSPSPFQRQPKPPSPCRFCGQMHWVRDCSRAPTCSKCNRRGHYSSECRSSSSSRPNSQRYNATMSVFNITDDDLSEWIMINCSINNIDVVLMADSGSRLSVIQIGLWEKLGKPKLISGIKKAKSYSGHFFEILGFFVCSVTYQGCTLQLKCHVAPDGPMNLFGLPWIKAFEMALQRPIATTLNLAQAHAVTVCDDPNTLAKNLKQKFSKVFSSSLGLCTKMRAHLQLKPDAQPIFCRPRPVPHAAKAAVDDELDRLLACGAIKSVDFSKWAAPIVVVKKKCGNVRVCIDFATGLNNSLELNRHPLPRIDDIFASLEGCTVFSQIDFRDAYLQVELDEESKELVDINTHRGLFQYQRLPFGVKSAPSIFQKLMDELTAGLHGVFGYLDDFIVATPTLEEHDALLKLFFGRLQDWGLRVHLNKCKFLCPQIKFLGHIVSAEGIRPDPDRSAAIESMPPPHDFATLRSFFRCTTFITTLH

SEQ ID NO: 151201 - protein, 282 aa, Heterodera glycines
  Coding regions on vcDNA: vcDNA=SeqID_77624; Strand=+; Position=1 -511,758-869,960-1184
  Homolog annotation: Hit_ID=XP_318550.1; Match level="QueryCoverage =59%, HitCoverage=16%, E-value=2e-31, Identity=42%"; Hit description =ENSANGP00000020240 [Anopheles gambiae]
MIYGRRFTLLTDHKPLIAIFGSKNGIPIYAASRLQRWALILANYDFEIKYISTNCFGQVDVLSRLVAQQRETVEAEERVIANVDKTSLQISDDSALDESETAAVDYIFMANIDQLPVTADEVAEHTQLDTTLRKVFDFCRNGWPKKSPSDLSAFFTHRHKLSEVNGCLLFGPCSDGNLYLIIVDAFSKWPETFQVKSTSADNVIVQLEIKGIKQTFSPPNHPQSNGQAERFVDIFKRQMKKCSHGDKKWITNSLFAYRNTPNAALKGQTPAELFLGRSPRTQ

SEQ ID NO: 151202 - protein, 35 aa, Heterodera glycines
  Coding regions on vcDNA: vcDNA=SeqID_77625; Strand=-; Position=1 -74,320-353
MDQLLSTLIQYDGKHRRVITVNGKRLNAKFFFYSV

SEQ ID NO: 151203 - protein, 79 aa, Heterodera glycines
  Coding regions on vcDNA: vcDNA=SeqID_77626; Strand=-; Position=1 -111,182-310
MFYKIIIIIIVIHFLTFRQSKAWSFWEKQLEMARPNEDGIYEFDLTIEHGMTMVTTQNDGITPIIDYSPEQVYYFIINS

SEQ ID NO: 151204 - protein, 103 aa, Heterodera glycines
  Coding regions on vcDNA: vcDNA=SeqID_77627; Strand=+; Position=1 -298,462-475
MRLNIFLLLIVHLLFVCSDVFGDEQSAEKQRQIQQNGIASLKSMNSYTSREFEEIFGITPIKPGKLNKNQKKELKKLRRTEEKKAKEFKKDLKYLPFNKERVN

SEQ ID NO: 151205 - protein, 43 aa, Heterodera glycines
  Coding regions on vcDNA: vcDNA=SeqID_77628; Strand=+; Position=1 -39,183-275
MCTFGTEFHLFLKSCYNARVRLGGARPNQHTLSLHQHAPLVVS

SEQ ID NO: 151206 - protein, 127 aa, Heterodera glycines
  Coding regions on vcDNA: vcDNA=SeqID_77629; Strand=-; Position=1 -97,148-280,331-440,507-765
RGVLMKGKRVLIWSSSAETDPGIVSFAEIWTPILQNLGATLVGIGPGEPFASKSSANLEEKMEFCSKIEPPVDVLLAETDCQAEVAKLVEERGGLAVSSEWVIQAIVTGSLPDLGEPGGEKFRYDFV

SEQ ID NO: 151207 - protein, 52 aa, Heterodera glycines
  Coding regions on vcDNA: vcDNA=SeqID_77630; Strand=-; Position=1 -60,107-131,183-255
MCFGRKKKGKRQSSPEYTKVTDEAPPDFSVPSSLLSDASSAEQKVKLPGNTK

SEQ ID NO: 151208 - protein, 180 aa, Heterodera glycines
  Coding regions on vcDNA: vcDNA=SeqID_77631; Strand=+; Position=1 -39,102-144,202-300,361-437,801-890,966-1055,1110-1214
  Homolog annotation: Hit_ID=CAE68486.1; Match level="QueryCoverage =94%, HitCoverage=67%, E-value=1e-13, Identity=43%"; Hit description =Hypothetical protein CBG14288 [Caenorhabditis briggsae]
MDALKRLASRARQKSAEIILSAEKTEIGAELEQLLTKTDKTEEHMKKLVHAIEVYLQPNPAVRALDPRKDKSGRQNTLDGLGEAMKKERSVLNKKRLDLDATKSRWKRASDDKKPAVEAELRKAQDEFDTQLETISTALEALQTAVDRQAEQLVQFVAAQIEYHSSSLKLLKDLKRDLGA

SEQ ID NO: 151209 - protein, 48 aa, Heterodera glycines
  Coding regions on vcDNA: vcDNA=SeqID_77632; Strand=-; Position=1 -68,1044-1122
MQPLWRKSGTWSCECKCGGGEWRPQSRKVPKFRNFFTTQLLAHFLNLA

SEQ ID NO: 151210 - protein, 93 aa, Heterodera glycines
  Coding regions on vcDNA: vcDNA=SeqID_77633; Strand=-; Position=1 -94,336-406,519-635
MLFHIFKFIFIFLVITTQKQQFVDGQQYFCYEVVRDITTGANDCPPPLVYQPSVQLCCGQQPIPNGTIQQTFDQLPQPGSPDAIPDGCERPLN

SEQ ID NO: 151211 - protein, 15 aa, Heterodera glycines
  Coding regions on vcDNA: vcDNA=SeqID_77634; Strand=+; Position=1 -42,772-778
KYGYAEKLTIQKLCE

SEQ ID NO: 151212 - protein, 228 aa, Heterodera glycines
  Coding regions on vcDNA: vcDNA=SeqID_77635; Strand=-; Position=1 -135,283-458,532-654,1557-1622,1669-1855
  Homolog annotation: Hit_ID=NP_497098.1; Match level="QueryCoverage =96%, HitCoverage=42%, E-value=5e-25, Identity=43%"; Hit description =D111/G-patch domain and cell division protein FtsJ (2P323) [Caenorhabditis elegans]
EFESFLNNELENKPVEEAPEWLKCEEEQRNCLIGQLSDSWIMLGAPITKDEQLMKQDKYCPSELIAELIEAKNVFDTMDRKEVEAARSRANPYETVKAGFFQNRAAMKTANLDKIFDWRLSWEFDDERRLAKNPLNENERDNVERYLSFDRVSLHKPITSRPANSERYIFCENLNLFGSTKVKKYLMEVNKRMESMDRKKEDIMELVPDEVISEDDTFMAYIRQSIEQ

SEQ ID NO: 151213 - protein, 23 aa, Heterodera glycines
  Coding regions on vcDNA: vcDNA=SeqID_77636; Strand=+; Position=1-153
LRQIFILIISINIYVTIHKRQYM

SEQ ID NO: 151214 - protein, 94 aa, Heterodera glycines
  Coding regions on vcDNA: vcDNA=SeqID_77637; Strand=+; Position=1 -61,342-563
  Homolog annotation: Hit_ID=AAF99925.2; Match level="QueryCoverage =93%, HitCoverage=50%, E-value=8e-16, Identity=42%"; Hit description =Collagen protein 111 [Caenorhabditis elegans]
MRRIVRSDPQGPTGKEGMPGLNGEPGLPGPPGISGVQFGEQMFSRPCIQCRQGPPGKMGRRGDVGQSGPLGPPGVPGAPGRMGNPGKEGKVGEQ

SEQ ID NO: 151215 - protein, 247 aa, Heterodera glycines
  Coding regions on vcDNA: vcDNA=SeqID_77638; Strand=+; Position=1 -455,1426-1714
  Homolog annotation: Hit_ID=NP_501560.2; Match level="QueryCoverage =73%, HitCoverage=25%, E-value=2e-19, Identity=48%"; Hit description =PDZ/DHR/GLGF domain containing protein (4J749) [Caenorhabditis elegans] emb|CAB54213.2| Hypothetical prot
AQSFFAFLLRWCWLRMGKLFLVESTLALSFPRAQRYTPIPQVLSKQCVSIADSKFFSRWFYKKLQLELNDVTARSSTAGRIIHGIQIRDLEAGMNSPVVNNVRVESFQLSEDDPDLFEELVLLLDVDYRGGFQMSVDANMAFGKFAQLSVKSTHFCFVLFVLLYTLKLKEPNSHELRVANVEPGSNADKSGFRVGDTLVAVNNIPVRNERQATRLLTGTAGDLLVLVERELNESVKGSEESAGEETE

SEQ ID NO: 151216 - protein, 53 aa, Heterodera glycines
  Coding regions on vcDNA: vcDNA=SeqID_77639; Strand=+; Position=1 -105,671-724
KTGTGTKFFDRDRDREKTRDRDFCFSKNRDRDRDRDLKNPGFPAPVPVSRSTL

SEQ ID NO: 151217 - protein, 103 aa, Heterodera glycines
  Coding regions on vcDNA: vcDNA=SeqID_77640; Strand=+; Position=1 -82,127-356
MTFAGRFTLSPNQSIRWIIFIQLSFVKAKMEKQGKRREIALGKEERRKRKRGKGKIRRKEEEDERRMKQKREEQQQIDTFENFEVGPKPKSTDIVRFGLRRKK

SEQ ID NO: 151218 - protein, 109 aa, Heterodera glycines
  Coding regions on vcDNA: vcDNA=SeqID_77641; Strand=-; Position=1 -206,268-391
MVPFEFLNEWTKEKLTLAKAKELGNRWIMKRCKIIGETAAVQQQKKDENWGNNCNNVFIWLYICNNCIGPLSPPPFAEESGQSITKGPSSADKMSDGQNNKNSDQPQKK

SEQ ID NO: 151219 - protein, 289 aa, Heterodera glycines
  Coding regions on vcDNA: vcDNA=SeqID_77642; Strand=-; Position=1 -379,771-982,1235-1514
  Homolog annotation: Hit_ID=EAA19671.1; Match level="QueryCoverage =38%, HitCoverage=51%, E-value=4e-21, Identity=45%"; Hit description =Ran-binding protein [Plasmodium yoelii yoelii]
QKRKKKEEDKKEQIEEEKEEEKETKEKEKEYKKEQTGEEKEEEKEKKEEEKEDKKEKEEEKEEEKEDKKEQTEEEKEDSNLISDKRSGKEESKNEQKMEEDAHEKGNSNLNYVLLEHENLMAFVERYSNFIVINCVAEQKNVYDNLCKFLKGKIRTKLMDKIEIKNIKKIEIGVMDTEANREVTLKIVDELVNRGFSINFGKVWLFGIKIPANGNENLKEHLMNFDIEMKMEYLQQLGLLSVEMDETEIINEFQKLGANVLSTVAKKWFLMDILEDKKHWENDEVTIYE

SEQ ID NO: 151220 - protein, 129 aa, Heterodera glycines
  Coding regions on vcDNA: vcDNA=SeqID_77643; Strand=-; Position=1-387
  Homolog annotation: Hit_ID=NP_702308.1; Match level="QueryCoverage =93%, HitCoverage=3%, E-value=3e-19, Identity=34%"; Hit description =hypothetical protein PF14_0419 [Plasmodium falciparum 3D7] gb|AAN37032.1| hypothetical protein [Plasmodium
MKQTEKRTKKEKCKKGRKKRRTKRSRQRKKRKRKRRPKEKEKEYKKEQTGEEKEEEKEKKEEEKEEEKEDKKEQTEEEKEDSNLISDKRSGKEESKNEQKMEEDAHEKGNSNLNYVLLEHENLMAFVER

SEQ ID NO: 151221 - protein, 79 aa, Heterodera glycines
  Coding regions on vcDNA: vcDNA=SeqID_77644; Strand=-; Position=1 -157,737-819
MSMSFSTFLTREEKELDQAFDKLKQIREQINKRKGVKVEATKNAKGEVIIAQGLFNGNFRIPKKKPRMDDQEFGVEFFK

SEQ ID NO: 151222 - protein, 186 aa, Heterodera glycines
  Coding regions on vcDNA: vcDNA=SeqID_77645; Strand=-; Position=1 -36,99-177,221-335,413-511,675-862
  Homolog annotation: Hit_ID=NP_077008.2; Match level="QueryCoverage =97%, HitCoverage=35%, E-value=1e-43, Identity=50%"; Hit description =solute carrier family 25 (mitochondrial carrier; phosphate carrier), member 23 [Homo sapiens] gb|AAU95077
LEVLKTRLALRRTGEHRGLTGEHRGLCHFAREMYHREGFTCLYRGYAANCIGYAANCIGIIPYAGIDLAVYETLKNLWIRRKNSPGTDPGVVVVVVILGCGLVSSSVGQVITYPIALIRTKLQARAGQVPNCECSLMSLFAYIVKHEGYRGLYRGLAPNFMKVLPAVSISYLTYEQCRKWLGAKMT

SEQ ID NO: 151223 - protein, 66 aa, Heterodera glycines
  Coding regions on vcDNA: vcDNA=SeqID_77646; Strand=+; Position=1-198
MAARSNTNKETLKNHQTSKTIATKKLVVQDYKNRLKDSIKSLNDNFECILGASKVLLLLIRGFVGI

SEQ ID NO: 151224 - protein, 90 aa, Heterodera glycines
  Coding regions on vcDNA: vcDNA=SeqID_77647; Strand=+; Position=1 -143,306-435
MLKVNCDDATHRSNSAGKLGEHYAIRNEAIARAALLVKATNELKMLTKAEEDFKKRLKQYENDYSALRMSISTMASEIDRELVENSLYRF

SEQ ID NO: 151225 - protein, 94 aa, Heterodera glycines
  Coding regions on vcDNA: vcDNA=SeqID_77648; Strand=+; Position=1 -137,249-396
MSESINVRDLWREFNEIKSALQKKMLKKPNFHEAIVQCRRIATLLDILCKDWKSFYGATAFAEGGKIILLCADDDPTNEFGMYLGKGLIVAMGG

SEQ ID NO: 151226 - protein, 119 aa, Heterodera glycines
  Coding regions on vcDNA: vcDNA=SeqID_77649; Strand=-; Position=1 -159,231-431
  Homolog annotation: Hit_ID=CAE73097.1; Match level="QueryCoverage =96%, HitCoverage=15%, E-value=2e-34, Identity=59%"; Hit description =Hypothetical protein CBG20476 [Caenorhabditis briggsae]
MFPGKSNIQMLKFMMDLRGKFPNKVIRKAVFKDQHFDYNCNFLYHETDKVTGKDKVTVLTNIKLLRNLPAELSGDQELDRDGFAKVDHFRSLLEQMTALDPSKRISCSDALKHPFIVEK

SEQ ID NO: 151227 - protein, 218 aa, Heterodera glycines
  Coding regions on vcDNA: vcDNA=SeqID_77650; Strand=-; Position=1 -198,241-328,497-644,810-888,938-1079
  Homolog annotation: Hit_ID=NP_492008.1; Match level="QueryCoverage =64%, HitCoverage=17%, E-value=1e-25, Identity=49%"; Hit description =yeast splicing factor PRP related (90.9 kD) (prp-4) [Caenorhabditis elegans] emb|CAA95814.1| Hypothetical
MAKQAEEYEREEKMRQFLEEKQREKIERCKGESAEVVEESEQQQKEADTADGSLQFDMFADDAPVELLSKAATIQSLDTTTAALKDNWDDTEGYYRVRIGEQLDGRYRVYGYTGAGVFGNVVRATDTHRSNSKVAIKIIRNNDMIFTGNFTIGITCVWSSKISGVFFCRHFGSAEEVRQQRRPSHESGPQLCTTITFGNETAEKMQHFACGHKAGQYF

SEQ ID NO: 151228 - protein, 683 aa, Heterodera glycines
  Coding regions on vcDNA: vcDNA=SeqID_77651; Strand=+; Position=1 -197,234-339,465-649,791-956,1084-1410,1486-1569,2160-2327,2370 -2491,2523-2691,2753-2971,3015-3186,3233-3313,3360-3415
  Homolog annotation: Hit_ID=CAE69369.1; Match level="QueryCoverage =89%, HitCoverage=73%, E-value=1e-137, Identity=43%"; Hit description= Hypothetical protein CBG15465 [Caenorhabditis briggsae]
MTGIISTEPSVNTVDDSKSSGSSASKRFSANGLTDTLLIQTLKSVLNRNSVYMNLKHFLILLALACNYFPPKRAIYDSGDVHKFTHALEKRITHYDKSILKKMTETTDHQVQEESKELLKRSAEIVRYRRLHRNANIAIQQLSMCLPMLENYTHLQKLMEQKKYLQALKILEELEHNYLNQLHKYRFAHQFVKSIKPIRDQIREKSYSELTDFLEKLITEKFYTQFHSNSAEKTQKANQMGSANILVGKMELLDIEISEDGSLLRKTANAAKPMQRDNEGKTTEKPKPMARKMLPANKQQHQHVQFHSQDKLELGPVHRCCQIFNVMGDRDKFEAYYRKQRCDQLQLIVGRQISMTDSVEVFVPYLNEIVGFFVIENRIAQIQSSLVTAGHKDEAWELALNSISDSINAHFGSCQNVSLMLAMKKLILLFTLTTKSCGYDPTTLYSLLQNFSFFFWDKYNQILIEEYSEQFENALENDDYTPIQVKDEREYRKVVEEFPVNKRSVDQEDAFPRKFPFSRFVPKVYCQAKEFVANCVRFMEDLQLSHSEVSDTVRRYANILLAKWSNALRKFVSSRKRSLIQLIQITINMGYLERSCEFLERFIAEMARNLSGEFVGSLGNSGGTLFEGGGHLVALKNQLFRDSRSEVEQLIDEAFREKVQVFLDNSHYVWELEQSSGVASEFM

SEQ ID NO: 151229 - protein, 147 aa, Heterodera glycines
  Coding regions on vcDNA: vcDNA=SeqID_77652; Strand=+; Position=1 -326,372-489
  Homolog annotation: Hit_ID=NP_509496.2; Match level="QueryCoverage =97%, HitCoverage=15%, E-value=6e-35, Identity=53%"; Hit description =exocyst complex component sec15a (XJ452) [Caenorhabditis elegans] sp|Q18286|SC15_CAEEL Probable exocyst c
TCKFLADRMSSMLLSSEHRSVSIGALEQFSLDVMQCELFTAQCPVPGFEDNALAITFAHLRQLLDLVMGPDWTTFFAERDEGNSHRKGGSSGTKYARVKASSAAALLEKVIEFEKKNSGFFAIGRADSRDKQKLYETILRKLRSFTD

SEQ ID NO: 151230 - protein, 162 aa, Heterodera glycines
  Coding regions on vcDNA: vcDNA=SeqID_77653; Strand=+; Position=1 -107,177-334,378-499
  Homolog annotation: Hit_ID=XP_214834.2; Match level="QueryCoverage =95%, HitCoverage=13%, E-value=7e-22, Identity=41%"; Hit description =similar to protein kinase D2 [Rattus norvegicus]
SNTIGAGQFGTVYAGTNVKDGHRVAVKVIRQITYFICCVGSLRNCCVGSLRNEFILLKKLKHPGIINLEMLTESSKEIFAVMERADKDMLEFILSQENRRLDERHTKFLLRQILSAIHILSQENRRLDERHTKFLLRQILSAIHFLHGRRVAHCDLKPGKDK

SEQ ID NO: 151231 - protein, 473 aa, Heterodera glycines
  Coding regions on vcDNA: vcDNA=SeqID_77654; Strand=+; Position=1 -132,229-330,443-569,619-671,728-856,904-1027,1074-1096,1149 -1259,1301-1341,1399-1567,1613-1656
  Homolog annotation: Hit_ID=CAE68065.1; Match level="QueryCoverage =100%, HitCoverage=47%, E-value=1e-115, Identity=52%"; Hit description=Hypothetical protein CBG13687 [Caenorhabditis briggsae]
LAVRNILRYVPNRFHHFLGPEFADELVHCGHIYAFRFMPYFVLKAPPLDKIAPPLDKIETRSRQAAAIILMLLNNLDPEVAQFPQELVTYGGNGQVFSNWIQFRLTLRLLAQMTDEQTLAMYSGHPLGLFPSHKDAPRMVITNGLFPSHKDAPRMVITNGMMIPNYSTKSLYDKFFALGVTMIPNYSTKSLYDKFFALGVTIYGQMTAGSYCYIGPQGIVHGTTITLMSAIRKYLGKGISPAGKVFGTTITLMSAIRKYLGKGISPAGKVFVTSGLGGMSGAQAKAAVIAGCVGVCVGVIAEVSESALKKRHGQGWLDTFSAVSESALKKRHGQGWLDTFSADLEVIVRWVRESRSNRRAISIGYLGNAISIGYLGNVVELWERLAEEPELIVELGSDERLAEEPELIVELGSDQTSCHNAFRGGYCPVGLSFDEANRMLTEDKPNFDRMVRQSLLRHILLRHIAAIEKLFAR

SEQ ID NO: 151232 - protein, 256 aa, Heterodera glycines
  misc_feature (4)..(4): Xaa can be any naturally occurring amino acid
  Coding regions on vcDNA: vcDNA=SeqID_77655; Strand=+; Position=1 -232,294-407,450-566,615-797
  Homolog annotation: Hit_ID=NP_502964.1; Match level="QueryCoverage =94%, HitCoverage=27%, E-value=3e-60, Identity=52%"; Hit description =urocanate hydratase (4R480) [Caenorhabditis elegans] sp|Q9NAE2|HUTU _CAEEL Probable urocanate hydratase (U
DRLXVELQTFNGLLAKPLSVSEWRREQYEDNLLWIKNAEKHQLVVGSEARILYSDGMGRVELARAFNAAIRERKLEGPIVISRGPIVISRDHHDVSGTDSPFRETSDIGDGSAYTADMAIQNVIGDSFRGATWVSINVIGDSFRGATWVSIHNGGGVGWGDAINGGFGMFLDGSAEADQRLSSMLAWDVANGVAREADQRLSSMLAWDVANGVARRCWAGNEKAMETVKRMEGMDPVLKVVVPERVDEELLDGLKF

SEQ ID NO: 151233 - protein, 212 aa, Heterodera glycines
  Coding regions on vcDNA: vcDNA=SeqID_77656; Strand=+; Position=1 -134,181-310,355-423,719-886,937-1074
  Homolog annotation: Hit_ID=CAE69210.1; Match level="QueryCoverage =100%, HitCoverage=100%, E-value=9e-71, Identity=56%"; Hit description=Hypothetical protein CBG15250 [Caenorhabditis briggsae]
MSGQIKTPTNQKLLTNVAIVRMKKCGKRFEIACYKNKVLNWRNKTEKDIDEVLQTQTVFVNVSKGQLAKRDDLQASFGTEDQLEICKLILEKGDLQISDKERQVTSESSFKALEMIPKLRESLKIDRAKMRIRVSVPAKNAKMLHPKLKAFFDTTEVEDWDKGDLEMVGLIEPGSYKTIVELVKGDKKEKVEQIGLELLSLKVIGENEVEIS

SEQ ID NO: 151234 - protein, 278 aa, Heterodera glycines
  Coding regions on vcDNA: vcDNA=SeqID_77657; Strand=+; Position=1 -105,205-488,538-646,802-906,1122-1355
  Homolog annotation: Hit_ID=NP_507133.2; Match level="QueryCoverage =99%, HitCoverage=58%, E-value=1e-138, Identity=79%"; Hit description= protein phosphatase 2A, regulatory B subunit (5Q845) [Caenorhabditis elegans] emb|CAB07297.2| Hypothetic
MVSKNIFRVLPPSDNSEFDPEEDEPTLEVSWPHLQLVYELFLRFLESTDFQASIGKKYIDQRFVLQLLELFDSEDPRERDFLKTILHRIYGKFLGLRAFIRKQINYMFLSFVFETESFNGVGELLEILGSIINGFALPLKQEHKVFLVKVLLPLHKPRCLNLYHAQLAYCVVQFIEKDSSLTPQVFDSLLKFWPKTYSSKEVAERALYFWNNEYILSLIEDCSAQVMPIMFPALYRISKEHWNPTIVALVYNVLKTFMEMNGKLFDELTTNYKLERQK

SEQ ID NO: 151235 - protein, 207 aa, Heterodera glycines
  Coding regions on vcDNA: vcDNA=SeqID_77658; Strand=-; Position=1 -54,129-698
  Homolog annotation: Hit_ID=S52407; Match level="QueryCoverage=84%, HitCoverage=75%, E-value=4e-22, Identity=35%"; Hit description=TATA box-binding protein - Entamoeba histolytica
MQKTVLFTPLTNLVMTGAKGYIKGVKGPFDWYIVSKIQKPIIVNIIALTNLGTGIKLNSLTITEFEFKYNPRKFNAAVIKCTSPIKATALLWESGKMICLGTKSLIDCENAIKKFIEIIKSSGCPGASYTGHTVENIVSTFKFGREIELNEFRKNRRAFYEPEIFCGLNFKRGKSMAALIFWTGKVVITGTKNNSELRKCIMIFSPI

SEQ ID NO: 151236 - protein, 242 aa, Heterodera glycines
  Coding regions on vcDNA: vcDNA=SeqID_77659; Strand=-; Position=1 -56,1371-1800,2677-2919
MLLLVVVLMFICLLEEVTMCIDHSVITFLRSNQKIWDNGTKLVLNVRCSHKTGTDSQPIWDIWARQIWPIFVPNIRRFQFLNADNLDNLRRLISTTILTDLNLNSMHSGNLLPDLIADDGPNATAGQALSKWLHTPRKDGQPRRLRCRIMNTPKDWVNDFKEAFLHATTSTSYIISFALFGSMPIEPFELVNERTGEKLTLMSKKTNNFYIWWLKRCPIGEEATVWQNEENLNNVYFYLSAH

SEQ ID NO: 151237 - protein, 252 aa, Heterodera glycines
  Coding regions on vcDNA: vcDNA=SeqID_77660; Strand=+; Position=1 -420,766-1103
  Homolog annotation: Hit_ID=CAC70157.1; Match level="QueryCoverage =55%, HitCoverage=6%, E-value=1e-11, Identity=31%"; Hit description =polybromodomain protein [Brugia malayi]
MVDSDFEEEEEYPMDNHHHHHKQRACMQNNHRHQPNNLKNGDISAAVPSSFSSTTTAPPVGATSANASSSSVSHKRAPRRLNADGTPAERLKPGRKSVDELREKFAQKLTAVWQDVHNLKVGNAFLDPWMYNQIEHHTRAMGDRALAEPFEYLPCDKTFPDYYRTITKPISLMCIQRKIKEQRYADSDELLADLRQMFANARIFNKPDAQICADVTILESVAVGSMRTHTEGVTLFYPYRRTDKGWSEKASI

SEQ ID NO: 151238 - protein, 216 aa, Heterodera glycines
  Coding regions on vcDNA: vcDNA=SeqID_77661; Strand=+; Position=1-650
  Homolog annotation: Hit_ID=NP_727425.2; Match level="QueryCoverage =89%, HitCoverage=8%, E-value=9e-10, Identity=30%"; Hit description =CG17255-PB, isoform B [Drosophila melanogaster] ref|NP_572631.2| CG17255-PA, isoform A [Drosophila melanog
SLSTNADGTNLSSVPSTTAATAQQLAAHHQRQQQQSLPQLQQPTHNQQQHHPSAICAQQQRSLAAASSSAVYVAPPLPPSSVCQTLNNNNNNNAIASTSGAVYYAAGGGYLVPQQQQQFILHHHNVMPMAQAQPPQQFAAPHSVVHVQQQQKYLHQQQQQPMALATSVKHLQQQQQCHQSQQQQQYFSSTSALINGGGIPPNAALQQALHNGPIAA

SEQ ID NO: 151239 - protein, 187 aa, Heterodera glycines
  misc_feature (161)..(161): Xaa can be any naturally occurring amino acid
  Coding regions on vcDNA: vcDNA=SeqID_77662; Strand=-; Position=1-563
  Homolog annotation: Hit_ID=NP_500227.1; Match level="QueryCoverage =85%, HitCoverage=15%, E-value=3e-36, Identity=49%"; Hit description =predicted CDS, reverse transcriptase like family member (4D351) [Caenorhabditis elegans] gb|AAK68554.1| H
SLCRVMERILSQNIYNFLLKNNKISEYQFGFVRNRSTTSQLITVVEDWYEAIINGKNVDCIYIDFQKAFDSVPHNLLLYKLEKIGIRGKLLMRIKGFLSNRTFRVKIGDSLSSSKKVTSGVPQGSVLGPLLFLIYINDLPDALPSGVKIKLYADDVKLYIXYKARADTEIMHKSKHNLFEWANKWQI

SEQ ID NO: 151240 - protein, 136 aa, Heterodera glycines
  Coding regions on vcDNA: vcDNA=SeqID_77663; Strand=+; Position=1 -236,1041-1215
MTKLIIDDQYLFVNITCQVEVNPGQIGGPGAATAVSKCHRKMLDKVEIMHVKKLPILAKAFVPENRPGPGIARTLYQACLIFRLSLDEAGDYSLYFDGTKRVALVHMAYGYLPEHYPEKDFDLRVMMERSTAIVQI

SEQ ID NO: 151241 - protein, 52 aa, Heterodera glycines
  Coding regions on vcDNA: vcDNA=SeqID_77664; Strand=+; Position=1 -123,195-230
MVRPFEKPHQEEVNSEMGIYGSLIGDQSTGKVLVNSVNGHLQMRVNSALSFH

SEQ ID NO: 151242 - protein, 64 aa, Heterodera glycines
  Coding regions on vcDNA: vcDNA=SeqID_77665; Strand=-; Position=1 -67,134-211,882-931
MINLIFPLFIYGITMLSELADHENDFPTSLDLRYTRRGERRIPYPQNQDFVLSNDTKKIGFVRA

SEQ ID NO: 151243 - protein, 79 aa, Heterodera glycines
  Coding regions on vcDNA: vcDNA=SeqID_77666; Strand=-; Position=1-240
  Homolog annotation: Hit_ID=NP_586311.1; Match level="QueryCoverage =98%, HitCoverage=11%, E-value=3e-11, Identity=44%"; Hit description =hypothetical protein [Encephalitozoon cuniculi] ref|NP_597511.1| hypothetical protein [Encephalitozoon cu
MGKREKGRGKEKEEKEEEEGKLKWKKKRGQRIWIREEKRKGRKRKKEEEKERKMEEEKEEKIGRKRDKGREKKKREEER

SEQ ID NO: 151244 - protein, 124 aa, Heterodera glycines
  Coding regions on vcDNA: vcDNA=SeqID_77667; Strand=+; Position=1 -21,71-115,363-441,511-572,646-719,804-834,1462-1524
  Homolog annotation: Hit_ID=NP_508201.2; Match level="QueryCoverage =83%, HitCoverage=66%, E-value=5e-46, Identity=71%"; Hit description =neuronal Calcium Sensor (ncs-3) [Caenorhabditis elegans] gb|AAK82907.2| Neuronal calcium sensor family pr
ELRKWYKDFVRDCPSGELRLDEDGHISFKEFIAALSITSRGTLDEKLDWAFSLYDVDKDGFITKAEMANIVDAIYSMIGNMLELPKDEDTPQKRVEKIFANMDLALTMEMNGAAGEEQTPQKAA

SEQ ID NO: 151245 - protein, 34 aa, Heterodera glycines
  Coding regions on vcDNA: vcDNA=SeqID_77668; Strand=-; Position=1 -48,98-154
DFNVVQKINQVPVYEKSGRPREEISIISISLKSV

SEQ ID NO: 151246 - protein, 245 aa, Heterodera glycines
  Coding regions on vcDNA: vcDNA=SeqID_77669; Strand=-; Position=1 -66,111-189,243-345,398-501,550-656,1031-1064,1853-1920,1981 -1996,2165-2221,2275-2342,2402-2437
  Homolog annotation: Hit_ID=CAE63553.1; Match level="QueryCoverage =93%, HitCoverage=74%, E-value=4e-39, Identity=55%"; Hit description =Hypothetical protein CBG08039 [Caenorhabditis briggsae]
MAVDAPNDQQKSEPSSESIPKNEFRRPADPNIKENGGRAKKARVEQQKTLKHEEVYLRAIPRSDQYEKSFMHRNVITHVKCTENDFIITASEDGHLKFWKKKHNEGIEFVKHFRCHLKGFSDIAINHSGTLMATCCAHDKSAKVFDVANFDMIYTAAFDVAISFATSVKVEAADNPNLRINEPDPMLVTCAHRNNRFYLFTNVEPYAEEADGSTHSRDVYNEKPLKEDMITAIEEEAPQSKLCNK

SEQ ID NO: 151247 - protein, 179 aa, Heterodera glycines
  Coding regions on vcDNA: vcDNA=SeqID_77670; Strand=-; Position=1 -369,465-635
  Homolog annotation: Hit_ID=NP_493413.1; Match level="QueryCoverage =93%, HitCoverage=97%, E-value=9e-32, Identity=46%"; Hit description =NuDiX hydrolase (15.9 kD) (ndx-4) [Caenorhabditis elegans] emb|CAB63351.1| Hypothetical protein Y37H9A.6
MSNSLIESLVRAAGFLIYRKNTAGQIEYLLLQVSYEPFHWTPPKGNFDANLEKRPIIVIQNVKLSLGPILGHVDPGEDEWTAAIRETMEEAGIDVNKLRIHKEFMYEMRYLSKSTKYGEEQKKVTYWLAESTDPEVKVMLSDEHQNWKWAELKSALELAKFDEMKKLLNKAEMFIAENL

SEQ ID NO: 151248 - protein, 105 aa, Heterodera glycines
  Coding regions on vcDNA: vcDNA=SeqID_77671; Strand=-; Position=1-318
GFCVALEGSRFKGTEMLRDFVTDEATSEKYQRIADEQPMASAFYEVMFSSLNESGEAENVTLIAIDEEEGMGTTPNGNRTKKREEQNEGKEMERTAENGTVPTNN

SEQ ID NO: 151249 - protein, 280 aa, Heterodera glycines
  Coding regions on vcDNA: vcDNA=SeqID_77672; Strand=+; Position=1 -294,531-691,850-1236
  Homolog annotation: Hit_ID=NP_499115.1; Match level="QueryCoverage =99%, HitCoverage=64%, E-value=8e-61, Identity=37%"; Hit description =CEll Death abnormality CED-7, ATP-binding cassette transporter, cell corpse engulfment protein (191.4 kD)
VFVLLGHNGAGKSTTFAVLTGSVRASGGDVLICGQQLEHNLRDCQRRIGFCPQYNPLFDKLTVREHLLFYGRMKLSQGEGAEELRRQLDVEVAELVAELAKNLSGGQKRKLCLAMALVGRSPVVLLDEPTAGMDPGARNEAGKVLERIKRDRTILLTTHYMEEANTLGDRIGIMVQGRMVCNGSPEFLKQRFGVGYVLSVVVRAGADFPRAVGKVFDAITKHSPGAKLEQNQKPPEFSIVLPLGDKRKFGDIFAELEQCTDEFGVDSFGVSSNTLEQVFL

SEQ ID NO: 151250 - protein, 234 aa, Heterodera glycines
  Coding regions on vcDNA: vcDNA=SeqID_77673; Strand=+; Position=1 -135,707-1276
MLKDLFKDVMGNMGAAMSVITAFSIMTATMVMPLVEERGSRFKHQATKAFSALMCWFMVGSMLSTIGTALLKLNAGAIGERTALLLNMLLGIVLPTKALSGGILNLALIATYQQLIGQHFDDGSDNSFFGTAGPIGELWKEFRRELFAMGIAGLIFWVLLALLQSRRVAWAWHKMSNNIAVRDNAFGVPSPDNATAFRWSSTAIGRCLRRTKTKTYGKSGTECYGRPTRATPLP

SEQ ID NO: 151251 - protein, 556 aa, Heterodera glycines
  Coding regions on vcDNA: vcDNA=SeqID_77674; Strand=+; Position=1 -345,678-1086,1309-2225
  Homolog annotation: Hit_ID=XP_470219.1; Match level="QueryCoverage =20%, HitCoverage=7%, E-value=2e-26, Identity=51%"; Hit description =Putative retroelement [Oryza sativa] gb|AAK98731.1| Putative retroelement [Oryza sativa]
MMLDQNIIRESESEFASPIVMVPKADKKSWRFAVDYRALNKMTKKRVFHLPNIQELLDLMGAKKYYTCMDMQQGFMQIPMAKEDIEKTAFISHLGIYEFITMPFGLTAAPDTFQRSLDGKGKYKKVHQEKVKKFHGPATLPLREADEPINWEKYVHDPNLEQEEAEESEEEGFEIVLSKEKEMSGEMIGKSKKFSKFGFESSEEEENGNTIAFVQNQEEISDDEGPEIFFENRNFVFENDETPTLLAVMLNEKWSLKTENERESYWEIISGINGVMYEINQIPEIFISEKENYDDQNEFRMSINVIRSEKNEEMGQFMKNKERNKQLLGLIENMNKKGRLNEPKEKNGKIYESHSFFKMELLSKEEEESLKRLKRKLEHQLLKVQQSLTESEKWKSGTSDDDPVGPQEREENEEETTKKGKGMEKKEEEEKKGREEKEKETEKKKEEMKQKDETETKRSLSVGTTKDDEISIVDSEEKERDAFENPPKPTNERMAFWESTLNNEAKKDLREDKEKALQNTGQGIVVSSRKRTINEVDPPTLSNEAATKFGEKCGKH

SEQ ID NO: 151252 - protein, 92 aa, Heterodera glycines
  Coding regions on vcDNA: vcDNA=SeqID_77675; Strand=-; Position=1 -181,1181-1278
MLKTFAARKVYAPYNYGSVDFELRAQESSTVALIEALPKAKPSNEEKAFFTFLSHKFSFAAGVLTLTSYDESALVRHNDKTITYELTEIEYP

SEQ ID NO: 151253 - protein, 81 aa, Heterodera glycines
  Coding regions on vcDNA: vcDNA=SeqID_77676; Strand=-; Position=1 -45,83-283
MQQQKCKKPKYLIFMERKIALDLMRTTEEKKRNTIHGSRSMDHPIRSLCIRILIHGFFDPRISDSWITIRGSDPDLYAYGY

SEQ ID NO: 151254 - protein, 286 aa, Heterodera glycines
  Coding regions on vcDNA: vcDNA=SeqID_77677; Strand=+; Position=1 -451,746-1155
MAARFNEAMVARLIELVQSRQDDLNPPTRTAKANEKQKEAWKFVTDSMNREFPQEVPQGGLTIAQIQTKFKNLKQRAKDERQTEKKLIICAPVLGFSIFFRHQRATGGGKKFEMTEVSRNVQDDLNPPTRTAKANEKQKEAWKFVTDSMNRVPGGVQTGLNIGDTIFFEGKEQEESAEFSSQQVVVEEGKSYAVLGTVPRGEAVKTPKFESSTSRVPFRSRAGTASTVTAADVMELQRSVLEMQFEEMTKKQEIFKKFEDVLDDAKTFFTEGREFFRGKHSNEKET

SEQ ID NO: 151255 - protein, 341 aa, Heterodera glycines
  Coding regions on vcDNA: vcDNA=SeqID_77678; Strand=-; Position=1 -129,223-1119
  Homolog annotation: Hit_ID=EAL50634.1; Match level="QueryCoverage =99%, HitCoverage=74%, E-value=1e-50, Identity=38%"; Hit description =hypothetical protein 19.t00007 [Entamoeba histolytica HM-1:IMSS]
MRMEIKVECVREESISLEREEEIRIAINVQQKDSNGQVTAVLERKKKAEEINEKAEAGRESCGSAEVNEEKERKEAEANGKRDAEEKAKKEAEAKKKEEEMKKQKAKPEEKPAAPAEAKALVPEQKKAEETKEKLKQEEKAAEVPTSPEEKKRKEAEAKAKRDAEEKAKKEAEAKKKEEEMKKQKAKPEEKPAAPAEAKALVPEQKKAEETKEKLKQEEKAAEVPTSPEEKKRKEAEAKAKRDAEEKAKKEAEAKKKEEEMKKQKAKPEEKPAAPAEAKALVPEQKKAEETKEKLKQEEKAAEVPTSPEEKKRKEAEAKAKRDAEEKAQKRGRSKEKGGKK

SEQ ID NO: 151256 - protein, 243 aa, Heterodera glycines
  Coding regions on vcDNA: vcDNA=SeqID_77679; Strand=-; Position=1 -130,180-521,567-826
  Homolog annotation: Hit_ID=EAA21352.1; Match level="QueryCoverage =88%, HitCoverage=10%, E-value=1e-10, Identity=30%"; Hit description =hypothetical protein [Plasmodium yoelii yoelii]
MPNLAEFQWMVNNFEVKDGKNVEIKQMVENHEQITFKKPIEGRVEVHAVNKLGKDSQGTKVIVDYEDGVVEEQQQKDTKTGKGKEMVEEGTVESGNSMMEDTVEGEDGRIKDTVEREDGKIKDTVIVKEAEKGTEKASEAEEKQQQKADLISIEKEEERYAVLVKVAESVAEQMMLKIIVNAMEEAAEELKWEEEEQLRRGKEEEEEQLEMEVRLGRDEEQKEEVQAKVEVIWDTGQQNELLQ

SEQ ID NO: 151257 - protein, 275 aa, Heterodera glycines
  Coding regions on vcDNA: vcDNA=SeqID_77680; Strand=-; Position=1 -142,464-730,1320-1544,1659-1852
MNLLFKFFIIFVILHCECETLGSCAPGGGININFLSKLRKKPIASSTETSADNRPTISAAEFDQRLKKIEQMLGPLLKFENADQVLAQLEKRIESLAKRMEALETKITAWNVTFEIKEKQMMEQQRKQLHEEGLSVVASSQGRQSTATAADHHSHKLVLNKNSIVPQTATTTVVGQQYGNGKMPIYGMASAQMGRRNTVAHPGQRHPPHQRDALNMPSQHSIIQSDALNTPSQHLPTVEKNDQRLESQRSGPSNLEEHTEDMDKLWIVSSDEEKH

SEQ ID NO: 151258 - protein, 79 aa, Heterodera glycines
  Coding regions on vcDNA: vcDNA=SeqID_77681; Strand=-; Position=1 -85,120-274
MAPQLTEADGHNDAIPWALIQFRLRKFGMFALGFEHFLYSIPKNGFSNDIFNENPKIFRKWMYVYRCNRPNSTKPLDRN

SEQ ID NO: 151259 - protein, 82 aa, Heterodera glycines
  Coding regions on vcDNA: vcDNA=SeqID_77682; Strand=-; Position=1 -127,906-1027
MQNFFLNRYAKFGVDLTNRKKVKQDEVNVVLYIIKNEEIVRKKNRRDMQRYYPPASNLKKSNHCQTPHTPRNKIFLITPSNS

SEQ ID NO: 151260 - protein, 31 aa, Heterodera glycines
  Coding regions on vcDNA: vcDNA=SeqID_77683; Strand=-; Position=1-108
ERPFSSHVPLTKMLLAQKVKGEKEYKSSDQG

SEQ ID NO: 151261 - protein, 84 aa, Heterodera glycines
  Coding regions on vcDNA: vcDNA=SeqID_77684; Strand=+; Position=1-255
MPFPPIFALRRAPDFSTVDFSTEDFSTEVLFDSKGHFDRNIIKMGAGLFDSGFFDRGLFDRRTFRQQRTFRQKYYKIQEGTFRQ

SEQ ID NO: 151262 - protein, 57 aa, Heterodera glycines
  Coding regions on vcDNA: vcDNA=SeqID_77685; Strand=+; Position=1-369
TSSGPKAWKICFLVIVKQLFELLALILSFLFSLNPKKFNKTYFDLFCFCSKFMNKNV

SEQ ID NO: 151263 - protein, 45 aa, Heterodera glycines
  Coding regions on vcDNA: vcDNA=SeqID_77686; Strand=-; Position=1 -59,295-371
MTEVVTSPNIEKEAVSPWRRAPPIVSNKRTEVTDFPAFTADCPFC

SEQ ID NO: 151264 - protein, 152 aa, Heterodera glycines
  Coding regions on vcDNA: vcDNA=SeqID_77687; Strand=+; Position=1 -240,283-371,421-445
  Homolog annotation: Hit_ID=NP_499743.2; Match level="QueryCoverage =73%, HitCoverage=18%, E-value=1e-28, Identity=56%"; Hit description =amino acid transport protein (51.0 kD) (3O401) [Caenorhabditis elegans] emb|CAA16336.2| Hypothetical prot
LANNSNNCLYFETAADPSSLNSSNSAAVESMDSEGVYLFADRTQSSNSLTPEQAFVHMVKAMLGTGLLSLPYAFSHSGLYLGLILLVLICLVCMFCMRQIVHSGLYLGLILLVLICLVCMFCMRQIVFAAHYICTKNGREIIDYNGREIIDY

SEQ ID NO: 151265 - protein, 528 aa, Heterodera glycines
  Coding regions on vcDNA: vcDNA=SeqID_77688; Strand=-; Position=1 -529,1210-2264
MVITRRRRQAEETLQSAEGDRQRGGDQRLGESDREEEEINAEEGEAATQPINYVLGVPLLDTIGESFHCRLCVPIPKIFKRHGDLSKHLKRYHPNQRIVFQCNTCLIVFDTVKKCKAHQQKTPACRNARAVPEEMPQRPLAAPGAAIVQRNFFNPRARQVENVDRPQPIQRLVTPARKRSAQSDPNIDLSVGSAQNRTEQGDESGELGEEDVAHQYVLGVPIALPLPCRFCAGRSFNTHAGLSKHLKKDHTPQNTWNLAFRCNGCRQTFTQLRTCNAHQKKSAQCQGAQPIQEERHQPQHANVVRQVRPRAPRLQEPVSPAQPAAADQSGTTPSGTGARTDRMQCRRESDVPSGRSTPPALVAQRHSAGTASPNGSDRSARTAHSRTARQNQTPPTQLVVNAQPEQHDDQAVPVVAPRQPNAQQREWVGRFNAVTSAQQLDDLLNEFINAVRQQAQVAFTQRPAQQKRRPRPPPNQHGRRRNQMNADDGPPFDPAAAARIQKLYRASRARAYREITEQTSPLCQLSAE

SEQ ID NO: 151266 - protein, 61 aa, Heterodera glycines
  Coding regions on vcDNA: vcDNA=SeqID_77689; Strand=+; Position=1 -51,558-1144
FNDPPPPAGFSRRSPPGALIANNFRHFPRPYSMPHLSDFISNSSTVRKLVFFKCNFLSPPQ

SEQ ID NO: 151267 - protein, 193 aa, Heterodera glycines
  Coding regions on vcDNA: vcDNA=SeqID_77690; Strand=-; Position=1 -80,632-790,913-1070,3024-3209
  Homolog annotation: Hit_ID=AAQ81276.1; Match level="QueryCoverage =90%, HitCoverage=35%, E-value=2e-41, Identity=55%"; Hit description =Temporarily assigned gene name protein 24, isoform b [Caenorhabditis elegans]
AMADLLVGLLVMPLTLIYEIVGVWVLGSVLCELWLALDVLFVTASILHICIISLDRYWSVTQPLSYPAKRTPRRISIMIVSQGLSISLSRFPAKTNTDQSGPWDQCHRFPIGFVQPEISSNDDVIESDHSYTRPGECTVSSELDYVLYSSLGSFYIPVAILVVVYMRIYMITKRAQSAATEGHPTGWAKRCAN

SEQ ID NO: 151268 - protein, 129 aa, Heterodera glycines
  Coding regions on vcDNA: vcDNA=SeqID_77691; Strand=-; Position=1 -262,732-858
AAPLSSSSSSIFTNPNSTLVVVVKQYQQQQQLNNHHHNHRNNHAAAAAAAVLLPFNNNNNLTDEITELAHATVRGDGDRHSDYFADGTIILFHGAAEWCPNVSNAVVWPSCITLAEALAMALFLLIVML

SEQ ID NO: 151269 - protein, 76 aa, Heterodera glycines
  Coding regions on vcDNA: vcDNA=SeqID_77692; Strand=-; Position=1 -160,181-313
IFFFQFLGGVFSKKFSSRFLGVYFSFFVNEFSGNPEKFVKNGEIGIKHKKSKIGKVRHYKSHRRHAKSSGKCVFRA

SEQ ID NO: 151270 - protein, 179 aa, Heterodera glycines
  Coding regions on vcDNA: vcDNA=SeqID_77693; Strand=-; Position=1 -102,150-183,232-284,363-514,557-752
  Homolog annotation: Hit_ID=NP_503683.1; Match level="QueryCoverage =97%, HitCoverage=37%, E-value=5e-25, Identity=37%"; Hit description =putative endoplasmic reticulum protein family member, with at least 9 transmembrane domains, of ancient o
MLVYGLISTLSTLFTPMTVKFGGFFPLLFLQFLQGIAISIGWSGAGVISSSWSPPDTYGIFLSFGPVITMPLAAALCTSEKFGWPTVYYVLGTSTLLFSAIFLLFYRDTPRQQKNVSKAELALIEQTELALNNAEKVRQKIPYKAIFTDLMIWAQICVHVTRNMGYMIPLVYGAIYFNK

SEQ ID NO: 151271 - protein, 24 aa, Heterodera glycines
  Coding regions on vcDNA: vcDNA=SeqID_77694; Strand=-; Position=1 -34,462-502
MKKWKSPRLAVAVGWLLISPSFAW

SEQ ID NO: 151272 - protein, 81 aa, Heterodera glycines
  Coding regions on vcDNA: vcDNA=SeqID_77695; Strand=-; Position=1 -126,180-299
MSVPTPNWPIWLSSSENKLAQLTPTVLRWAFMLGKSAWALSRETIRKCMTLRVCLVTLAPAGLTSAFKCIATIPMMSSFVD

SEQ ID NO: 151273 - protein, 82 aa, Heterodera glycines
  Coding regions on vcDNA: vcDNA=SeqID_77696; Strand=+; Position=1-249
MEIFRKIIMTSIPRDPAGLVKWSGGIPVRDPDEIPIPINPDEFKKSFWTDPEVGIPNLIPRDPVEILRDPYPVRSLVNNKSA

SEQ ID NO: 151274 - protein, 93 aa, Heterodera glycines
  Coding regions on vcDNA: vcDNA=SeqID_77697; Strand=-; Position=1 -71,1301-1395,1453-1568
MAYNFETQMDFGEEKPLTGLRALKHDLHQSVRVFAMQMEQYAGDDQPHHAMGLFLDVEEEFCAATKRGNGGSSDNKCSTAAPTVTTASRNCVK

SEQ ID NO: 151275 - protein, 73 aa, Heterodera glycines
  Coding regions on vcDNA: vcDNA=SeqID_77698; Strand=-; Position=1 -42,178-357
MPEISQMCDRGNVMDWASERLNALKQRHREQKGMVWVISRLLLNKKGLGFASISSIKMKNFGISLWDFKKPLS

SEQ ID NO: 151276 - protein, 140 aa, Heterodera glycines
  Coding regions on vcDNA: vcDNA=SeqID_77699; Strand=-; Position=1 -166,290-348,421-552,839-904
MNLWLFKIRGKHNAKNVYKQSLVTHWQSVLFWASLANSFVEALRLGGLIHPVISMGAQAACRPVYQGQEPSLNCQKNAHSWESQSWYLALFKLGSIATRIRQFVQKATRRIVNSYKSQKTLFFRMIPKIRVCSNMNKVTV

SEQ ID NO: 151277 - protein, 98 aa, Heterodera glycines
  Coding regions on vcDNA: vcDNA=SeqID_77700; Strand=+; Position=1 -160,584-643,1162-1237
  Homolog annotation: Hit_ID=AAH72862.1; Match level="QueryCoverage =96%, HitCoverage=21%, E-value=2e-11, Identity=40%"; Hit description =LOC397713 protein [Xenopus laevis] pir||JC5391 presenilin-beta - African clawed frog sp|O12977|PSN2_XENLA
QPPHKSASDSRVAALSADAAQQQQNQQGQEGATNGGRTGGGNGRRRQQSQPQHEEEYAALKYGASHVILLFVPVSICMAVVTMTVASVGFYSKNDGLY

SEQ ID NO: 151278 - protein, 83 aa, Heterodera glycines
  Coding regions on vcDNA: vcDNA=SeqID_77701; Strand=+; Position=1 -18,351-450,605-736
  Homolog annotation: Hit_ID=CAE63601.1; Match level="QueryCoverage =53%, HitCoverage=9%, E-value=1e-10, Identity=81%"; Hit description =Hypothetical protein CBG08092 [Caenorhabditis briggsae]
MCMSRSDLVAVLSPKGPLRILVETTQERNEPILPALIYSSTVTVLYSYVLHGVVSSAFIVAAGVGTNGDDEDEQQQRQPQPND

SEQ ID NO: 151279 - protein, 80 aa, Heterodera glycines
  Coding regions on vcDNA: vcDNA=SeqID_77702; Strand=-; Position=1-241
MVVNSVLPNLLNVAQIVNIVTPSQNQVTPSQNQQQQQQQQQQQQQPNGEIFVEFPSQNIMPAQQMPITVDNNEQFQNTHY

SEQ ID NO: 151280 - protein, 69 aa, Heterodera glycines
  Coding regions on vcDNA: vcDNA=SeqID_77703; Strand=+; Position=1 -193,297-313
MAKFLSGIMFCALLALLDTTSAWKREFLRMPKSNEIGTADDSSESGKNLKSQSELIASMLPKRKILIFF

SEQ ID NO: 151281 - protein, 72 aa, Heterodera glycines
  Coding regions on vcDNA: vcDNA=SeqID_77704; Strand=+; Position=1 -97,145-266
MFRTTRGTEGGAFEEVKCDDEDYDRCLIGKCKGQNFVEVRKFCATKDGCAAFGCAVEEELECKTCFGELCNL

SEQ ID NO: 151282 - protein, 100 aa, Heterodera glycines
  Coding regions on vcDNA: vcDNA=SeqID_77705; Strand=+; Position=1 -94,186-394
MFPAGPKKKFCSICRATIEVFDEKVMTERHIVHKKCFNCGICNTPLLIGRCAMDDVLYHQFGHIFAYFVGLEWNPMGLEMSAPGQSISDGQSVSGQTIRQ

SEQ ID NO: 151283 - protein, 85 aa, Heterodera glycines
  Coding regions on vcDNA: vcDNA=SeqID_77706; Strand=-; Position=1 -102,390-545
  Homolog annotation: Hit_ID=AAH57950.1; Match level="QueryCoverage =92%, HitCoverage=21%, E-value=2e-09, Identity=44%"; Hit description =Serpinb6a protein [Mus musculus] ref|NP_033280.1| serine (or cysteine) proteinase inhibitor, clade B, memb
MGMPTAFTDNANFEGISGKKTLLLSEVMQKAVIEVNEEGTVAAAVTEGEVSDCGSSKEYRFVADRPFCAFLIRDDTVLFSVIFRK

SEQ ID NO: 151284 - protein, 206 aa, Heterodera glycines
  Coding regions on vcDNA: vcDNA=SeqID_77707; Strand=-; Position=1 -157,486-697,937-1019,1315-1423,1495-1554
  Homolog annotation: Hit_ID=AAB42377.1; Match level="QueryCoverage =99%, HitCoverage=52%, E-value=6e-29, Identity=32%"; Hit description =BmSERPIN [Brugia malayi]
AQADFALKLLREVSTDDRSCIVSPFSAAVTLSMVYAGAKEKTGEEMGQLLANGAPESEVHKYFGALLKSITSGTNSSNTLETANKLYVRKGSKVKDAFKEQIEGNYGGQFETVDFLDGKGTAEKINKFVKEATHKKIRDLVTPDNFDGNTRLVLINALYFKGTWADKFDSKFTKKAKFHVDAKNFKELEMMHLEAYFIYYKNDQVV

SEQ ID NO: 151285 - protein, 126 aa, Heterodera glycines
  Coding regions on vcDNA: vcDNA=SeqID_77708; Strand=+; Position=1 -196,289-473
MPLPLPPSNAEVVAEPNATTSITTAAKVIASRNTGCSTSSTALTMVTRSAQRRAAEEEAVPALAIPPPPPAGCSSSSSTAANVPQPSSSSLSAEEITRQKKRDKNNKNKFNKKQASFNKKFKFHSI

SEQ ID NO: 151286 - protein, 28 aa, Heterodera glycines
  Coding regions on vcDNA: vcDNA=SeqID_77709; Strand=-; Position=1-86
TICQQLAHFFAGLFLGARVNLGQSDGGR

SEQ ID NO: 151287 - protein, 208 aa, Heterodera glycines
  Coding regions on vcDNA: vcDNA=SeqID_77710; Strand=+; Position=1 -129,508-708,1223-1330,1761-1951
YRELKCKVGRAQAQTNSKKLEEVKTGKCAFEQYFCLMITCVVVGNPSYAFTDWQCSYSNNAEVCAERTEQKLRELNQFKNPRCKCEFGKFNEEMANEKPAAQLPTTPLPNLFCLRGAYDYKGYGIVEDRECAREDRHCFIANCKTADSKDGIMAWGCAESDNCTAITEKLSTNKHKNYECRCAFGGFGGNMTNENMTIPSWIPPPTLP

SEQ ID NO: 151288 - protein, 51 aa, Heterodera glycines
  Coding regions on vcDNA: vcDNA=SeqID_77711; Strand=-; Position=1 -48,313-420
MCKFNFFFNKNYRKFQVNPRVKKTLRTYVGNGELAVEAGRYSVAASGGGDK

SEQ ID NO: 151289 - protein, 126 aa, Heterodera glycines
  Coding regions on vcDNA: vcDNA=SeqID_77712; Strand=+; Position=1 -162,204-422
MFLKIKIESSGWPDNTTTEKQKNEFMSMYKRKYDIELDPNNINKNPGLLLIAKLGLNSLWGKFSMRNSLCQTKVIDSSAEWYNLLLDDSIELSSPIIINDEMIRVIYRKKDSFIKEHGVSNIIISL

SEQ ID NO: 151290 - protein, 177 aa, Heterodera glycines
  Coding regions on vcDNA: vcDNA=SeqID_77713; Strand=+; Position=1 -436,1312-1401,1435-1442
  Homolog annotation: Hit_ID=AAA93443.1; Match level="QueryCoverage =62%, HitCoverage=5%, E-value=3e-10, Identity=38%"; Hit description =Uncoordinated protein 44, isoform a [Caenorhabditis elegans] pir||T15347 ankyrin-related unc-44 - Caenorhab
MSTFAGFPGGGSVGIGVPIRIESASPHQATAQPQNANHQQRQNGAAAQPSSSSSSSVVDRLQRLEAEMDAEAVAGAIHLPDDRELTARLAAFLAERFPDADLQLTVSSVRRTITTKQQYETETPGMVGLPVDQLQELQRKLMAKISAQPFEHAKSTEKGEESEEKREEWARRGPEGA

SEQ ID NO: 151291 - protein, 42 aa, Heterodera glycines
  Coding regions on vcDNA: vcDNA=SeqID_77714; Strand=-; Position=1 -22,351-457
MTDRQTNEFNYKLWQSVNSITFVCFYDHPLNTVPIIKRILKR

SEQ ID NO: 151292 - protein, 71 aa, Heterodera glycines
  Coding regions on vcDNA: vcDNA=SeqID_77715; Strand=-; Position=1-651
ALVVQWLERNTHCVKARVRFRCSLTFCFFQTVSFLSDPLSIFINIWSIFENSFPFLMIFLKFTVFKCFVSY

SEQ ID NO: 151293 - protein, 454 aa, Heterodera glycines
  Coding regions on vcDNA: vcDNA=SeqID_77716; Strand=+; Position=1 -44,943-1988,2555-2791,3559-3596
  Homolog annotation: Hit_ID=I51116; Match level="QueryCoverage=97%, HitCoverage=60%, E-value=1e-20, Identity=25%"; Hit description=NF -180 - sea lamprey gb|AAA80106.1| NF-180
MRREADEVVQREAGRQLKAEDESPISPIKGTDEQIVTIVTQPIESHAEELATQAQAVPAQHQQHRHGEEEDHQAVQEEEPKPEKIRNEIEIIQQEAIETPGSVEVKEIESPKLISRIEPIITVEPPSGVFEESPPESPTRDEMKTVQAEQAERHDTEVEKYVPEEEEAFEKRVPEETFEKRLPEEMIERRVPEEKEAFEKGVPEEEAEEETFERRLLEGEPKEEEAVERRIPEEAFERLIHEEDKPFERHVPEEKGAFEGHRVDEAFEKRFPEEEEISEMPLTKMEKPTDLSVKEEVESELETKTQKEVEAVPEEPHVKSEAVIGKYLPFGAETPGRDEKALVEEEEIEQKGTEEITLKGAEREKPNKSNLVVGARKRKKHISSSLIPIKQWKKGDKKLAKMPKIDAAFKGAKKSFIPKPKKVAKIQKPKVMSCRIKLAVIKEESSLGTDVVKK

SEQ ID NO: 151294 - protein, 240 aa, Heterodera glycines
  Coding regions on vcDNA: vcDNA=SeqID_77717; Strand=+; Position=1 -113,337-454,740-1231
  Homolog annotation: Hit_ID=CAH86572.1; Match level="QueryCoverage =97%, HitCoverage=62%, E-value=3e-10, Identity=24%"; Hit description =conserved hypothetical protein [Plasmodium chabaudi]
MTPVEQQIEQEMPSVVEPSTIEQLQQIQGQQRLDETESPITEIAEKKEEEAPMIHVLHQSQTEHKPIVWLEETPLEQAPYEAEDVAKLQALHGVQSESAAQQPKEAPDASSSTKPWFSAVIGGIAGAVAAVGIATDKAKLNENGEEEQIEAVQERNLELEDSLAFEDQHHPTEEEVKFPEHVKTDEVPEDLRTVEEYPEDVRTEEIIPEEHLENVVSIANHPEEETTPKHVTAVKSFRKT

SEQ ID NO: 151295 - protein, 42 aa, Heterodera glycines
  Coding regions on vcDNA: vcDNA=SeqID_77718; Strand=+; Position=1-129
NCRKLTSFLKKKLKKFPTFHQKFRKSEFRPQKCRKPEVFPCH

SEQ ID NO: 151296 - protein, 80 aa, Heterodera glycines
  Coding regions on vcDNA: vcDNA=SeqID_77719; Strand=+; Position=1 -110,198-330
  Homolog annotation: Hit_ID=CAE68894.1; Match level="QueryCoverage =95%, HitCoverage=6%, E-value=3e-32, Identity=86%"; Hit description =Hypothetical protein CBG14865 [Caenorhabditis briggsae]
MNNFISAFYDAVLLYAIALNETLAEGLDPRNGQSITSKMWNRTFVGITGNVSIDNNGDRYSDYSLLDLDPDQDKFVVRLI

SEQ ID NO: 151297 - protein, 68 aa, Heterodera glycines
  Coding regions on vcDNA: vcDNA=SeqID_77720; Strand=+; Position=1 -12,361-555
MTWKIKWEELDGEDVRREKKKKRQQNSSTKLARFDAAEQSEALLRCNSRMSVGSDKVQYRLALELTIK

SEQ ID NO: 151298 - protein, 248 aa, Heterodera glycines
  Coding regions on vcDNA: vcDNA=SeqID_77721; Strand=+; Position=1 -583,628-791
MNLLYLIFILIFFIFVIDSDKMRPNFDEIFGNGWDKKESEQTVKIEQNERNENSQSAAVDQMGEEMGNDRNDQMKNDHKKREIIRKFEAIKEKLKQKGKYENKNRTKIERKIAKLLGAKITLISKWKNELNLNKNKIKKEFYEMKKSEFIERFDEFKELYGQGKQKEFAKELGISEDTFRRWKKEMLPKYHKSQKHHTNDDKLMKMKQYYEIKEANPKVTDKIIAKKLGIGWTTLKRWKKECSHPIDQ

SEQ ID NO: 151299 - protein, 33 aa, Heterodera glycines
  Coding regions on vcDNA: vcDNA=SeqID_77722; Strand=-; Position=1-332
IKPLNLVIYTNSTLVYEIPEKIWRKFWAKFLEG

SEQ ID NO: 151300 - protein, 90 aa, Heterodera glycines
  Coding regions on vcDNA: vcDNA=SeqID_77723; Strand=-; Position=1 -112,558-718
MIKIEQNENSEVDQLGEEMANGPIDQMRNYTDQNHSKTPNKYSNEDQLEKMKHYFEIKEANPKVTDEIIAKELRIGITTLIRWKKKCLSI

SEQ ID NO: 151301 - protein, 76 aa, Heterodera glycines
  Coding regions on vcDNA: vcDNA=SeqID_77724; Strand=-; Position=1-230
MPSPFVGTFTHLSRNCSALGCQRDGQPFDTTAPLKCQVLFWRQSDGKVPRDTGCKVRQVQHQIVLLEDGGATHRHF

SEQ ID NO: 151302 - protein, 50 aa, Heterodera glycines
  Coding regions on vcDNA: vcDNA=SeqID_77725; Strand=+; Position=1 -142,177-187
MAFLEAFARFSYYEFIWKVKLSYEDAKVFAKYKNVNPVKWMDQKSLLINH

SEQ ID NO: 151303 - protein, 99 aa, Heterodera glycines
  Coding regions on vcDNA: vcDNA=SeqID_77726; Strand=+; Position=1 -174,267-392
MQILQQKTGPEPANVELVLTEDLSNGAEPCKVRVLNQVNAEQPKPFEYITSRENASDLEDDCAHKLSNIARPDSFFQVVNRTSDVIIYQKIFITINMQS

SEQ ID NO: 151304 - protein, 85 aa, Heterodera glycines
  Coding regions on vcDNA: vcDNA=SeqID_77727; Strand=-; Position=1-454
  Homolog annotation: Hit_ID=EAK91016.1; Match level="QueryCoverage =95%, HitCoverage=75%, E-value=2e-18, Identity=62%"; Hit description =hypothetical protein CaO19.6835 [Candida albicans SC5314]
MVRLVFRPYTQVRRSICTSESLRTSTRVSSGFILLRNSSPSFGSQRIRSVSAPSHAIETGLCCAPTPQCQGSHISSVRSLHFHCA

SEQ ID NO: 151305 - protein, 387 aa, Heterodera glycines
  Coding regions on vcDNA: vcDNA=SeqID_77728; Strand=-; Position=1 -366,419-637,687-806,860-1006,1149-1316
  Homolog annotation: Hit_ID=XP_420031.1; Match level="QueryCoverage =97%, HitCoverage=52%, E-value=4e-72, Identity=39%"; Hit description =PREDICTED: similar to Hypothetical protein FLJ10871 [Gallus gallus]
KTVPICCQSRDLDLSAVDAILVSNTASLVALPFYTEGTGFTGTVYATDPTYQLGKLVMEDLCDMFERVDRPAEDVSWAWKTLCRSFPNAPLSDPNEWRTFYTRETMEKSLARIRRVFFREEIVVNGELRVSAFSSGYAIGSSNWIVVNGELRVSAFSSGYAIGSSNWLLQTEHHRIGYLAPSSLRHSHTKPMELTAFGQLDSLLITSLSTADTPDLTVYKFSSAVIETLVYKFSSAVIETLKMGGNVLIPVTPTGLVYDMFECVLKTIEQNVSRNIPIYFVSTQNVSRNIPIYFVSTVAESSLQFAQIFPEWLSEDKSSRVYKPEEPFFHSELARTGRIRVYDSLHGPFSRECRQPCVVFAVHPSLRIGEIVHLDLWGDVAHAIIMI

SEQ ID NO: 151306 - protein, 118 aa, Heterodera glycines
  Coding regions on vcDNA: vcDNA=SeqID_77729; Strand=-; Position=1 -46,315-533,870-961
  Homolog annotation: Hit_ID=NP_510486.2; Match level="QueryCoverage =100%, HitCoverage=23%, E-value=3e-22, Identity=50%"; Hit description= putative prenylated protein (50.8 kD) (XP595) [Caenorhabditis elegans] emb|CAB01745.2| Hypothetical prot
MPVPLIEPRLTTANSGNVYVWGDFDQPLPGMPPQGTHVRILRVRNLNMTGPPKYDQQPQQQMPMGGGGGYGWQAPPGGASGAPPYPAAGGPAPGGGYGYGQGAAGGAPPPPYSYQQKQ

SEQ ID NO: 151307 - protein, 235 aa, Heterodera glycines
  misc_feature (223)..(223): Xaa can be any naturally occurring amino acid
  misc_feature (233)..(233): Xaa can be any naturally occurring amino acid
  Coding regions on vcDNA: vcDNA=SeqID_77730; Strand=-; Position=1 -38,198-323,607-741,876-1006,1049-1221,1351-1481
  Homolog annotation: Hit_ID=CAE63275.1; Match level="QueryCoverage =97%, HitCoverage=50%, E-value=1e-44, Identity=41%"; Hit description =Hypothetical protein CBG07652 [Caenorhabditis briggsae]
KCEIRKLNFQLFSLKMNFHCVGRVKFLFALKVQSQAGGTAFALVSQSEDYGQYVMHVWRLNLSADGMQMASAASLLQAPLVIDEEWICTMREDAPELVVVHGPGLNVVRVHADAYGPQQPIDRFSVPGSQLSHFYDGFLSRGSIYFVSSIYFVSASPDGHFGHSRIHALNLDRGPALLPLRGFPAARWRAALVSVSGAVLLAGGGGVARLEVLPLDLTNFTSXCKPAQMPVPXIE

SEQ ID NO: 151308 - protein, 18 aa, Heterodera glycines
  Coding regions on vcDNA: vcDNA=SeqID_77731; Strand=-; Position=1 -18,308-346
MSEKSILYFELILFLIFG

SEQ ID NO: 151309 - protein, 30 aa, Heterodera glycines
  Coding regions on vcDNA: vcDNA=SeqID_77732; Strand=+; Position=1 -3,141-230
MRHRIEKKNGVTVLVKAVPTCPQNIASSPL

SEQ ID NO: 151310 - protein, 16 aa, Heterodera glycines
  Coding regions on vcDNA: vcDNA=SeqID_77733; Strand=-; Position=1 -34,115-131
MLYITRELNGQYKSIL

SEQ ID NO: 151311 - protein, 48 aa, Heterodera glycines
  Coding regions on vcDNA: vcDNA=SeqID_77734; Strand=+; Position=1 -94,305-357
MFLFQFSPIIMIFMFLLCPSDQMMQGRNGINDFCLILNYFDVFFAIFF

SEQ ID NO: 151312 - protein, 183 aa, Heterodera glycines
  Coding regions on vcDNA: vcDNA=SeqID_77735; Strand=-; Position=1 -165,293-439,608-846
MERAMLPRMDQSAPARQCHGGLQPVPPLRFGRTANIAAHCGVPPEHPAAPVSIVRGMEPIANVEKHRAEFSELHNQCFPGRPKRLSNITIADESRRAKCRGCAQTISKKRRLLHLLEKHLKKPIYKCKYCLFTSTHDKATVDTHQKEKHSGKAPHVLSTLSRHKAELKRLATECFNEPDLKLE

SEQ ID NO: 151313 - protein, 231 aa, Heterodera glycines
  Coding regions on vcDNA: vcDNA=SeqID_77736; Strand=-; Position=1 -68,320-453,675-876,1017-1308
MALRRRAALRWSTQKQFERRTVRFVQMPPLRIHKFEFRVGSAKAQPRAARQRRATDQSGGEAQVGNSAAKRSEKHGPIAEEEGEEEDEQQQESGTTEEQTEEDEWRDNASPSDKAPTTAADECAAGNDRLCHLCMEESKYPGRHIAQRHLKRPLYECPICAKFGSYESCTVSKHINKVHPKEAKNAMPISNLEKYADEIRELQALTKLMACHFLTHSLDTFYRFAASPTDK

SEQ ID NO: 151314 - protein, 151 aa, Heterodera glycines
  Coding regions on vcDNA: vcDNA=SeqID_77737; Strand=-; Position=1-456
MNSEKSEKANTILVEAAKKETERAWRDVAALAEEVGDFAKSSRETLNQAIKSREKAPYANGVRELYLKMSDSIWEIFKIEDQINLESVKAESAWREFERCKTFDQATKFEEQAQNSLMEARRLHFESRRVQSQMLNYENRLKTIVWEHVGI

SEQ ID NO: 151315 - protein, 79 aa, Heterodera glycines
  Coding regions on vcDNA: vcDNA=SeqID_77738; Strand=-; Position=1 -207,536-568
MYSFQKYFEEALEKEAFFWPKNREEVEALLFDSSDYKIAIHRDYDSAYSDYITMYNRTSIFCFTMVERNRVGWNMGATL

SEQ ID NO: 151316 - protein, 155 aa, Heterodera glycines
  Coding regions on vcDNA: vcDNA=SeqID_77739; Strand=-; Position=1-468
MSKKNFQETSKEIRRSKNTKNYFKNSANLGKCFEEVESHTNENKKFGIKEHVTTFYFKCPENEDPEQMFKKILKKLMTDAMNREAEPDWKIEKISVDLYCSALSDPVIIPARPFQHSNPDIVFNEFMHRQQSFGEVNLLDQRISIIIATYSFPVK

SEQ ID NO: 151317 - protein, 878 aa, Heterodera glycines
  Coding regions on vcDNA: vcDNA=SeqID_77740; Strand=-; Position=1 -135,181-1237,1281-1648,1885-2086,2129-2682,2725-3045
  Homolog annotation: Hit_ID=NP_001004509.1; Match level="QueryCoverage= 91%, HitCoverage=59%, E-value=2e-86, Identity=27%"; Hit description =si:busm1-180o5.3 [Danio rerio] emb|CAD60788.1| novel protein similar to DNA polymerases [Danio rerio]
MVLELMEKAGISMGDKTFGIQQLEAVQKFWDAQYPDNFRIVAFEMKTRLKPIFKGEGVRRNEVCVIREGNHWDGIKSASWFFGVRNFCVACEVTYDRTERHRMECKDRCKKCCRMGFGFPCVDVCDEIHCGECNLKFYNRECFEAHKKMACKEYKKCEKCGEVYQTRSKHVCGEKFCKICKVNHPGRQCFIKPIKVRPQKAYRIVAYDLETTVDGGEHRPNLVSASHTCSICAGEERECEICEGPKKITWSVADGFDPMSEFVAWIMGFQRFETVAFAHYAGRFDSHFVLSELTKKEIATELMMADLKIYQIKAGKVYFRDFWMLSQNKLGDLPKTLGLNIAAKLYFPHKYNKNENFGKRLSHLPPLGDYCPDSMKEEEAAKLEAWHNENFQTEFELGEQLRVYCENDVEILMAAILKFRQLFLGITGDLDVMKDSVTIAGVFMKIFRAKFLKDRHIPIMPEGGYERAENQSKIAVKYFEWLAQRKGVKVRHACNGGEVEFGGLKVDCVIGAEKKIIEFQECDVSEELKKNKEMKKFFESVPDKGPINPRDAYAGGRTMPFCLYAKATEEMEISMFDIISLYPFVNYDTPYPVGVPKIVVSRNFNVNWTVPDDVPYDGLLKVKVIPPKNLLYPLLPMHIDDMLLFPNCWACAKRAKNEFVMAKDVKKCNHRPAQRAFLGTFTSIELRKALELGYRVTGFYRAYHFEQFDRQLFKGYVRMFLKIKVEASGWPTEVKSEEEKRAFLEMYKAKYDINLDYDKIGLNPGLRMIAKLGLNSLWGKFSMRNTLSNTEIVGSMERWMELGRDNTIEFGRPVKISEELSRVVYRKKEAFIKEHKVSNIVLSLWTTSAARIKLYEYMEQVYREEGSKLLYCDTGRQE

SEQ ID NO: 151318 - protein, 188 aa, Heterodera glycines
  Coding regions on vcDNA: vcDNA=SeqID_77741; Strand=-; Position=1 -63,120-623
MQQPLPLRALPQFGIPPPNVPAVRVQPQPLRDFPPIHHPPRNVTSIWIKLWLLFLSLWVFLQAIHVRQIQREYAVPQFAHPPRNVPYHPPENVPVMLGLVFVRFSYFPDVSSGHSTSTTMATTAAAERRATIRPTVAKWTGNFRPCLLPNTKTSFLKPIHPNPPRVLEVIRRLGEWRGRPRDPRRPPQ

SEQ ID NO: 151319 - protein, 235 aa, Heterodera glycines
  Coding regions on vcDNA: vcDNA=SeqID_77742; Strand=-; Position=1 -102,159-248,306-377,432-512,701-1063
  Homolog annotation: Hit_ID=EAL47359.1; Match level="QueryCoverage =70%, HitCoverage=25%, E-value=3e-09, Identity=28%"; Hit description =hypothetical protein 106.t00024 [Entamoeba histolytica HM-1:IMSS]
MFPDDDGYESEDDEILLPPPPIPPQLGHPPPNVPAVRVQPIHVGQQRLPLRDLPQFDYHPQNVPAVRVQQPIPLRDLPQIHHPPPNVPVIRVQQVHQPVPLRALPQIHHPPPNVPAVRVQPQPLRDFPPIHHPPRNVTSIWIKLWLLFLSLWVFLQAIHVRQIQREYAVPQFAHPPRNVPYNPPENVPVMLGLVFVRFSYVPDVSSGHSTSTTMATTAAAERRATIRPTVAQWDR

SEQ ID NO: 151320 - protein, 93 aa, Heterodera glycines
  Coding regions on vcDNA: vcDNA=SeqID_77743; Strand=+; Position=1 -19,101-243,639-755
MEIENVENWSCKSSATLRIVSQKNGTEDLIGRIGDRIFNKEWSIYGFNYFISFAELLDPGKGFYDKDEDKVTLAIDVNDATPIWGWNDFISFL

SEQ ID NO: 151321 - protein, 25 aa, Heterodera glycines
  Coding regions on vcDNA: vcDNA=SeqID_77744; Strand=+; Position=1-75
HVKSIAKVTLSSSLLYNPLLGSINS

SEQ ID NO: 151322 - protein, 320 aa, Heterodera glycines
  Coding regions on vcDNA: vcDNA=SeqID_77745; Strand=-; Position=1 -115,196-419,462-637,1329-1776
MNQQQQIKTKRNKVKLEHDGALYVFDQLSADGLKKFWRWRLHTDLNNVVQKLVGVHSSDMNAAHVECQRLVTGLKRRAAETCEAPATIRAQVLQNTCTPVLAAFPSKSATKKWVIKRLRRDENAPRTEPLNLEQLEIPNTYRIYKRTEIDEEQFLLADTGVFQIQGQNGPQRFLDNYMGRMRFNVPMAAPLFHPHEWNVHQRTLDGADRTNNFAEAFHRKLQRQFSCTHPTIWRFIDTIRCEQKAIDADISRCVMGESAPQKKKKYREADARILRLVHRYNEINNIHLPQNDHNYANANVNPENIINFLTGVSRNYEMRP

SEQ ID NO: 151323 - protein, 214 aa, Heterodera glycines
  Coding regions on vcDNA: vcDNA=SeqID_77746; Strand=-; Position=1 -327,532-665,820-1003
  Homolog annotation: Hit_ID=CAE71970.1; Match level="QueryCoverage =81%, HitCoverage=2%, E-value=8e-27, Identity=40%"; Hit description =Hypothetical protein CBG19042 [Caenorhabditis briggsae]
MPFKVPVMPSSGPGRQPTIKRGPSPLKKRFISSKKRHPLESANSGLSAAQIARTQSVLAPMSSSAFMQQLEQQQMSDSGGIGQRLSLGTGEEGGPVLDDVQAMQEMGDQIDEYYYGVRIFPGQDLSNVWVGWVTPQFHAYDKLFDANASVRKCRTEYRNCYMLNAVELLNAVADVSNTKVSGLQVIEYQWECNQPNDKSLLHEMPKAFRRLAIH

SEQ ID NO: 151324 - protein, 155 aa, Heterodera glycines
  Coding regions on vcDNA: vcDNA=SeqID_77747; Strand=-; Position=1 -353,506-620
  Homolog annotation: Hit_ID=CAE71970.1; Match level="QueryCoverage =96%, HitCoverage=2%, E-value=4e-46, Identity=59%"; Hit description =Hypothetical protein CBG19042 [Caenorhabditis briggsae]
MTLAAGQRGKFNFGQDSNSLKFFTTCGLQEGYEPFCVNMFRTMPFWYAKRLPRFEEIDERSKLDVQRLPATATMPPCLKLCQKTGSNDGTGGQQEKTRMEFIRLSLPVNCNRVFVKNKEKEALRSRMEELQQRRNASLSSILKGKEPEEERPRVR

SEQ ID NO: 151325 - protein, 264 aa, Heterodera glycines
  Coding regions on vcDNA: vcDNA=SeqID_77748; Strand=+; Position=1 -81,140-200,271-417,471-559,609-669,728-880,932-1085,1300-1348
  Homolog annotation: Hit_ID=XP_371074.2; Match level="QueryCoverage =92%, HitCoverage=15%, E-value=2e-27, Identity=31%"; Hit description =PREDICTED: putative ankyrin-repeat containing protein [Homo sapiens]
MNDPRNGQQFALLIAIMKGHTEIAALLLEKGADVHQTTVRQVNHVNMAVTPLWVAVNMRQLEMCRVLIAHGANVDLGSDASLTPLLLACDKGSTEIVTLLVENGADVNLGDSEGMMPLMVICRAGRIELARFLLSHGANVEQMDNSGMRFALLYAASKGHLEVCRLLVEEWAADVNQQATDGITALMGACIRGRLDITVFLIEHGAHIDHADMDGYNALMWAVKQKKTEVARHLLAIGANADQVGIDGGQQDEQPQQQKEMPCN

SEQ ID NO: 151326 - protein, 111 aa, Heterodera glycines
  Coding regions on vcDNA: vcDNA=SeqID_77749; Strand=+; Position=1 -102,182-364,888-940
IEIKNGKKKLFENKRKRTVKYLKINDVDNPKETAPLIANNQMPTQSKGKSSLLKRYLENKEKFPRRTLRGHAKDLCVKLKTLKNVRNKLKNKTHYTKEEICKKEAFVIEDF

SEQ ID NO: 151327 - protein, 300 aa, Heterodera glycines
  Coding regions on vcDNA: vcDNA=SeqID_77750; Strand=-; Position=1 -99,271-598,818-912,968-1073,1346-1426,1720-1913
  Homolog annotation: Hit_ID=T29898; Match level="QueryCoverage=76%, HitCoverage=30%, E-value=1e-37, Identity=39%"; Hit description =kinesin protein OSM-3 - Caenorhabditis elegans
MYKDKEDPLLHVYTSTQEKLDALVQQYNQEKQKEEAGYLFCTLYKKWLITFLKKVQALESDMHDLSSEFELNRLDYLETIRKQDQQLKLFHQILERIQPAIHKDSNYANIERVKREAAWNIEAEQWTLPELTFRQALPSASAVSQNAKNGLKNGQMEKSELQNEPEEEESRLKKRLNESMDNDFVQRYFKPISRQNILDKYDPEKHRMLEAKKVAEFKKRNQFASGVVYTDALYGNENWQQQNGTKQSKMPSNHQRNGTSKAGTSDASPAVGVNRPISGMQRKPPPRLEAIQVVRNKSFT

SEQ ID NO: 151328 - protein, 51 aa, Heterodera glycines
  Coding regions on vcDNA: vcDNA=SeqID_77751; Strand=-; Position=1 -30,241-366
MCIFDELNKTGIIFGIFFSILGVYFLKFLGHLLTYQVFSTVVDFDSDWFRQ

SEQ ID NO: 151329 - protein, 268 aa, Heterodera glycines
  Coding regions on vcDNA: vcDNA=SeqID_77752; Strand=-; Position=1 -535,1203-1474
FVTLNNQQLNGLQFVTSTTVLRDCANLRGIEFHRLPYLGEIMDEFDSDIEMMDGDGGGGEHIYVIEDNNDDELAEEIDQQFIGIMANFGGNNSGGAFGAENWINGLGVIANDDDGHEDQEHMAVDQYQPVEMDEDEPLWPCRALYQWLHKGREDGQPKLLKYIERGHVTPADLAPLKEAFLNNRSSPISYIIRLEATLVDIEPFELENRWTREVLVLRRFFEDLWLFERGPMGRAESACDSDRVVLKCGWEDHQNGMINVALYGDRDV

SEQ ID NO: 151330 - protein, 33 aa, Heterodera glycines
  Coding regions on vcDNA: vcDNA=SeqID_77753; Strand=-; Position=1-99
MLRFGLQQPKKVSSWDPDEKALTPRLSSITLIE

SEQ ID NO: 151331 - protein, 193 aa, Heterodera glycines
  Coding regions on vcDNA: vcDNA=SeqID_77754; Strand=+; Position=1 -201,247-395,441-671
MDNADNNICDYLNISTTTKSDVGNLTGKFAILDASKNLTVFEWLFSSMIHQLIVAKCAYQFKVAQVASDWYHNTVLMFFDKLNCISPVLPWIVFPNIFTPISILFNLSLIWVTCTKMTDHKVCNWLIAFDSLCQLFVVAPFGVNLLGVIFQYSTIDYRCCLATLMAATVASYASIMAMYLISLERLLIIMYPI

SEQ ID NO: 151332 - protein, 93 aa, Heterodera glycines
  Coding regions on vcDNA: vcDNA=SeqID_77755; Strand=+; Position=1 -190,302-393
MRKMLRSVFLLLLVLLIGWLISSAARNLITVFFRDSITLIINSLFSDTDTQNRLITDITSWVIVTIIGLRTKKRWAEETIRRELGRFLAAKLL

SEQ ID NO: 151333 - protein, 116 aa, Heterodera glycines
  Coding regions on vcDNA: vcDNA=SeqID_77756; Strand=+; Position=1-351
MVKKLTTVGTENANGKRMKEDKEKEREKERMDEEQRGEDREAEGGKERCQFSERWLNNFKRRYGIQTTMEGTVNAEGDEETEDDEAERERRGGDTILVEGTEEKNSENEGKGKGAQ

SEQ ID NO: 151334 - protein, 62 aa, Heterodera glycines
  Coding regions on vcDNA: vcDNA=SeqID_77757; Strand=+; Position=1 -139,939-988
MDSLYCTVPYILAGIVAPGEEQNARVVLLPVAGNEHELDRDQNGEQRFYETPVKINWIFKKK

SEQ ID NO: 151335 - protein, 239 aa, Heterodera glycines
  Coding regions on vcDNA: vcDNA=SeqID_77758; Strand=+; Position=1 -91,152-329,612-762,1303-1485,1544-1660
  Homolog annotation: Hit_ID=NP_495838.1; Match level="QueryCoverage =84%, HitCoverage=10%, E-value=1e-51, Identity=50%"; Hit description =carbamoylphosphate synthetase 2/aspartate transcarbamylase/dihydroorotase; rudimentary homolog, PYRimidin
MPKKLMSMRWQLGAVCWSVPSLNMLRMRVGGIHSGDATLITPPQDLNAFTTRKIHEIIRHIARRFNVTGPFNLQLIAKDDNLFVIECNLRVSRSFPFISKTLDIDFVALATRAMMWTQEPTKFIQSFTRPEQSNNKVGVKAYLKALLSTGFQLPKRVIFLSIGYKQRAEMLESVRMLDRLGFTLYGSKGTADYYASENNIRIKNLEWPFEEKDNYHVYGAKMNTVDEFVEKKIIDFMMG

SEQ ID NO: 151336 - protein, 65 aa, Heterodera glycines
  Coding regions on vcDNA: vcDNA=SeqID_77759; Strand=-; Position=1 -97,621-721
MRRVTFAPTAEGGADGKAPEFRSFKMRRMSIIIPKEPQFGDAMKEKGNAFIISTADSANCANNYR

SEQ ID NO: 151337 - protein, 218 aa, Heterodera glycines
  Coding regions on vcDNA: vcDNA=SeqID_77760; Strand=-; Position=1 -144,843-1254,1818-1918
MELAPSEDGTKVSAKEEEEEESEEDEPQWDEEAEFGEDEAPNAVAKRNRAVRRWHRKLWCLSPKSAKWRSPLSAAQSSAAPPPFSNCAYASNANGGRDGERQWGEERTEEKGTEEKAKGGGGRRRRGSGGGAAVAERGGGGRGGRPRHDGTYHGTVTAGDRSAPIHQSLRRHRQNSTAPRVGNEAIPKEPQFGDAMKEKGNAFIISTADSANCANNYR

SEQ ID NO: 151338 - protein, 99 aa, Heterodera glycines
  Coding regions on vcDNA: vcDNA=SeqID_77761; Strand=-; Position=1 -210,581-670
MSRLRLNSLNFGLCSTDRSRANSGVEGNSDNLNGSPLRTAMSPTSLSGPLTQSTTVTGEETSDGSVHPIQEIVSKNNPKTQLRIKITEKSQKSVSRNPS

SEQ ID NO: 151339 - protein, 69 aa, Heterodera glycines
  Coding regions on vcDNA: vcDNA=SeqID_77762; Strand=+; Position=1-210
MNPFMITLISGMPDPEQKRAIVMPKWTEQTTDRLGGDVFADQSGGTDKNDKKADPRDESRQRKAKGNWD

SEQ ID NO: 151340 - protein, 77 aa, Heterodera glycines
  Coding regions on vcDNA: vcDNA=SeqID_77763; Strand=-; Position=1 -111,162-284
  Homolog annotation: Hit_ID=CAE57847.1; Match level="QueryCoverage =68%, HitCoverage=7%, E-value=5e-09, Identity=52%"; Hit description =Hypothetical protein CBG00882 [Caenorhabditis briggsae]
LALRVFADHAHEPAERRRLLELCSAQGATEFTKFVRQPNNSLVELLCTFSSLTPPFIYSSNKSPKEGTKAAYTFGRE

SEQ ID NO: 151341 - protein, 755 aa, Heterodera glycines
  misc_feature (726)..(726): Xaa can be any naturally occurring amino acid
  Coding regions on vcDNA: vcDNA=SeqID_77764; Strand=-; Position=1 -1577,1806-2071,2546-3019
  Homolog annotation: Hit_ID=NP_509552.1; Match level="QueryCoverage =96%, HitCoverage=39%, E-value=1e-111, Identity=33%"; Hit description= reverse transcriptase RNase H-like protein family member (XJ813) [Caenorhabditis elegans] gb|AAA85753.1|
PPFNFGLCFGRLRSVFNTLSAKPDLLQKYDSIIQEQKNMGIVEIVKNPFEFSPPLHYLAHHPVISPLKTKVRIVYDGSAHVGKELSLNECLFPGPIILPDLIGLLLRFRIPPIVITTDIEKAFLQVNVHPAHRDCTWLKNTSLPPSKANTQILRFTRVSFGLTCSLFLLAATILHHLSAFPSNLSTEISQNIYVDNILISASNSTEGQKKSTSAISLFQKAGMPLREFACNYPEAISHLPSQLKLPGTEQKFLGLKWNTEKDFLILELSVPPPDFPTKRSVLSFIASHFDPLGLISPLILPLKLFLQSLFELKLNWDERFPTEIITNWQTIESWKRTDKVTIPRSPISSPLSAREYQLHCFTDASTLAMCAAVFLRVSHPKFSPETFLIFSKTKVKPIHNVPLTIPKLELIAVEMGTRALKFTQAQFPSLNLDPNLNLWTDSAIVLSWLNCHKSTEIFVQNLLKAIKSVDHLVRHLPGPENPADIGTRGISSAPTLSALSAWWSGPQWLSLPANHWPNKISFNEQRKALQELILREQTLNPPSDQVTKILGLYSDPQKIIRAKGRLGKSQLPPSAKNPIFLPKSPLTNLIVHEIHLNNVHSSPLLTRRGGHYERLISLVKHHLHTSFRPRAVPLAQLMTSLSEIEMIVNSRPITFHSANPMDPNALRPIDFLRPLNPNQNPLSHLIIPINAETELRTQKSLQKWETASQQTERFWTNGSLIIYRPXENGTKNRPDNKIEIGELVLVIIHTRSLWK

SEQ ID NO: 151342 - protein, 289 aa, Heterodera glycines
  Coding regions on vcDNA: vcDNA=SeqID_77765; Strand=-; Position=1 -379,719-891,1053-1261,1454-1562
  Homolog annotation: Hit_ID=NP_499115.1; Match level="QueryCoverage =88%, HitCoverage=61%, E-value=9e-47, Identity=40%"; Hit description =CEll Death abnormality CED-7, ATP-binding cassette transporter, cell corpse engulfment protein (191.4 kD)
MNSLILSHPYHLLYLLAVPHKLTSEGLPPNENIETDRASSKDQADIVVDKLCKRWRQPFSSSSQFSLARLSFKAYKGQITVLLGQNGAGKTTTFSILTGLLKYNSGRVLICGIDQKKHMRECQNKIGFCPQYNPLFDYLTVREHLEFYAGTKTGHFNGPYGKKALIQEIHTVANELHIEALLDMPARALSGGQKRKLCVAIALIGKSSVVLLDEPSAGMDAKARRDLGDLLKNIKQDRQGILWPSYLIQTIAMLTILLTTHYMEEADTLADRIVIIANGRLKSNGSPQF

SEQ ID NO: 151343 - protein, 166 aa, Heterodera glycines
  Coding regions on vcDNA: vcDNA=SeqID_77766; Strand=+; Position=1 -142,198-511,749-793
MFVDAPAEKFGPKVRKNPKQGKYEVQAILATTTYKKDGQLRRIFYVQCYSQKDYSWVLNEWMDTQELVTEFTVNSVISWVFKAIRGEEVPEEIAEKLRTNPEYISRSFYGEIDEIINKFNCLMNELRRNVDIRTTPIGFSSTLAGDVRQQRIAAERLKEFLKKKKS

SEQ ID NO: 151344 - protein, 450 aa, Heterodera glycines
  Coding regions on vcDNA: vcDNA=SeqID_77767; Strand=-; Position=1 -231,334-435,895-1086,1238-1331,1448-1702,1967-2219,2344-2568
  Homolog annotation: Hit_ID=EAA58694.1; Match level="QueryCoverage =99%, HitCoverage=9%, E-value=3e-23, Identity=25%"; Hit description =hypothetical protein AN6310.2 [Aspergillus nidulans FGSC A4] ref|XP _410447.1| hypothetical protein AN6310.2
MPRRRAGKRYRQSHPKTEDAIHLIEKRCKTIEIVEIEEPTTATDVQQIVAQIEEPTTSADVERIVALFTTKKLVILQGPHGCGKTHTANCVAKQRNVPLKVLQINEQYDSKFLQRDCVILWENWDHGGSDLASAIVGLAERGHAVLANGRHIPMGSQCRILGTISREEHQHHTAMIWRDYPFTVRMAPIQPAQMDSILAQMTKSHHELFNIRSKLLQTFVTVSALINHRKASMDRALNAKDLFRVISHLVNSTDQQHSPNSLVSDRNALFGELFDAWAAHLSGDELRRCVAAVIGEALSLSPEQQQCHIDVRFPDVSILENNNNENIRSSRRIPKQAQHQQKRVQFQFGRVVLEQRTDAAQQEQQQSNNDNRSGKSCAGAVAPFVLTRDAAQLLERVAACVSRSPPEPVLLTGDTGVGKTATVQHMARLLRVPLHVVNLSQESEFSDLVG

SEQ ID NO: 151345 - protein, 24 aa, Heterodera glycines
  Coding regions on vcDNA: vcDNA=SeqID_77768; Strand=+; Position=1 -42,616-648
MIQKFIIAIQMNPNIGKDHLFLFW

SEQ ID NO: 151346 - protein, 426 aa, Heterodera glycines
  misc_feature (423)..(423): Xaa can be any naturally occurring amino acid
  Coding regions on vcDNA: vcDNA=SeqID_77769; Strand=-; Position=1 -60,120-161,208-304,404-579,633-718,765-919,975-1042,1089-1165,1220 -1424,1564-1617
  Homolog annotation: Hit_ID=CAE71899.1; Match level="QueryCoverage =98%, HitCoverage=97%, E-value=1e-117, Identity=58%"; Hit description= Hypothetical protein CBG18957 [Caenorhabditis briggsae]
TSQPIRVLVTGAAGQIGYSLVLQIAKGDVFGKDQVLQIAKGDVFGKDQPIVLVLLPIVLVLLDVPPLAAVLTGVHYELVDCALPNLVGVVETVTTEEAAFQDIDYAFLVGAMPRKEGMERKDLLAANVKIFKSQGEALAKFSKPTVKVLVVGNVLVVGNPANTSAFICAKYAANKIPANNFSAMTRLDHNRAMAQVAQKCADGNFSAMTRLDHNRAMAQVAQKCADGTTVGMVKNVIIWGNHSSTQFPDIRHAKIVKGGSETLAYDAVKGSETLAYDAVKDTAWIQDQFIKTVQKRGAVIIEKRKTVQKRGAVIIEKRKLSSAMSASKAACDHMRDWFFGTDHMRDWFFGTPSDGRWVSMAVPSDGSYGIPEGLVFSFPVTIEQKEWKIVQGLDLDDFAKQKIDITKKELLAERDEALAACKXCKR

SEQ ID NO: 151347 - protein, 59 aa, Heterodera glycines
  Coding regions on vcDNA: vcDNA=SeqID_77770; Strand=-; Position=1 -154,354-379
MFLSPTVRRDSSKICATFYCGKSKYLIGQLRVNEHSRLWPVVERKNGNIRWEQIILLGD

SEQ ID NO: 151348 - protein, 30 aa, Heterodera glycines
  Coding regions on vcDNA: vcDNA=SeqID_77771; Strand=+; Position=1 -29,256-319
MVNLAIKFICFFRIKTIFEPKIFIKKNVLN

SEQ ID NO: 151349 - protein, 24 aa, Heterodera glycines
  Coding regions on vcDNA: vcDNA=SeqID_77772; Strand=-; Position=1 -50,245-269
MLRRIILEIRDEFPKIIKTFILDN

SEQ ID NO: 151350 - protein, 247 aa, Heterodera glycines
  Coding regions on vcDNA: vcDNA=SeqID_77773; Strand=+; Position=1 -126,473-598,726-767,825-983,1327-1597
  Homolog annotation: Hit_ID=CAE71587.1; Match level="QueryCoverage =95%, HitCoverage=33%, E-value=2e-75, Identity=59%"; Hit description =Hypothetical protein CBG18544 [Caenorhabditis briggsae]
QFRRRVSADIMGVLEHEHTWQFDVIQLERVTDHHPLANLGAKVFERWNVCEALQCPSQVIVRWLTVIEANYQAGNAYHNATHAADVLQATSFFLNSDSVGQMIQDQHASAALVGQMIQDQHASAALIAATVHDLDHPGRGNAFLMNTRQRLALLYNDQSILENHHVALAFQLTLSSGVNIFAKMPREEFTQMRQAIIDMVLATDMSRHFEHLKFQQLMATDNTEEEDANSLIICRMVRDSRINRAKE

SEQ ID NO: 151351 - protein, 114 aa, Heterodera glycines
  Coding regions on vcDNA: vcDNA=SeqID_77774; Strand=+; Position=1 -171,548-721
  Homolog annotation: Hit_ID=CAE71587.1; Match level="QueryCoverage =58%, HitCoverage=10%, E-value=2e-11, Identity=54%"; Hit description =Hypothetical protein CBG18544 [Caenorhabditis briggsae]
MPREEFTQMRQAIIDMVLATDMSRHFEHLAKFQQLMAIMPDNTEEERDANSLIICRMCTFVDMFAREAFTLWCEFADLPHLPVQLEENYAQWKTRSAEWDPKKDNDNLLKRTER

SEQ ID NO: 151352 - protein, 93 aa, Heterodera glycines
  Coding regions on vcDNA: vcDNA=SeqID_77775; Strand=-; Position=1 -97,583-621,1239-1384
  Homolog annotation: Hit_ID=CAE67303.1; Match level="QueryCoverage =53%, HitCoverage=11%, E-value=1e-13, Identity=74%"; Hit description =Hypothetical protein CBG12756 [Caenorhabditis briggsae]
MGHQNCGKSEFTPKQTLIFPDGKPLNMILDDGEIDPINALQAAMEELYTKYGTPDAYKTGLYLLPKQLDEEVARLHLDKLGAKLTKLSKDQAE

SEQ ID NO: 151353 - protein, 349 aa, Heterodera glycines
  Coding regions on vcDNA: vcDNA=SeqID_77776; Strand=-; Position=1 -118,563-705,820-983,1395-1542,1601-1738,2048-2149,2438-2674
  Homolog annotation: Hit_ID=NP_506370.2; Match level="QueryCoverage =94%, HitCoverage=55%, E-value=1e-109, Identity=56%"; Hit description= flavin-containing monooxygenase (64.9 kD) (fmo-14) [Caenorhabditis elegans] emb|CAB01214.2| Hypothetical
MTLNNGIWKVQLSVGQLRQFDAAMICTGHHCEPLMPQITGLENFKGQILHAKQYRDYKGFEDKNVFIVGIGNSALDIGVELAKIAKNVTISTRRGTWVFNRVIQNGLPYDVVYQSRFYDWLMRTLPWTIANDFHEHRMQQRIIRFRENIITSKSRDHDIYGLRPAHRFFQQHPAVNDCLANLLASGRITITDDISTIGEHSICVKDGREFSADVIILCTGYTFGFPFIRPAELIPIRKQNEIDLYKYVFPPSNYVAKRLAVIGLVQPIGSVAPIAEMQSRWAAAVFAGRLQLPDNGTMCEDIAQTRAQMRRQYFESAKHTVQVPFIPYMDELAELVGCKPNLAKVVGTL

SEQ ID NO: 151354 - protein, 57 aa, Heterodera glycines
  Coding regions on vcDNA: vcDNA=SeqID_77777; Strand=+; Position=1-171
MAREEYCFDATAAAAAEQSRPSATTSTLVQGDGLSSSFVDAIIRKVRQSPVQRFTDE

SEQ ID NO: 151355 - protein, 301 aa, Heterodera glycines
  Coding regions on vcDNA: vcDNA=SeqID_77778; Strand=-; Position=1 -208,248-754,800-990
MNRKKIENLQKCRKRKFLDNNDSENETLSADHREQNENNNDRDDDFEEHAIVNFELGETKRGGVCIWFNGFRFTHKQNELWRCSVRDCPARVKIVSKSDNGMSGYQMQKDHSHLPEPQKQQVWMVNIESAKEIQAEKRRQQILERVRDKPRVKPTRLLAEMRRSAADETYVAMGSDNALSCMMRRQKKKILGNGLCRPIGIHNSGQIAAEGWRGHSALRQSHGQNWRKGRCACFWERTDFGHFEQKQCNLAFGRDIQGSTKHVGAVLCCGRVCQPPNVHWSLGSSARETSTLLRGSAELST

SEQ ID NO: 151356 - protein, 163 aa, Heterodera glycines
  Coding regions on vcDNA: vcDNA=SeqID_77779; Strand=-; Position=1 -112,414-793
MATLLRKAIFNFMHCPKDVSVLLIFSIVRQISKNLANCPPSHSSARFAHHLSTLTTYVSLRIKCPASVIRCSLAVCLLGKMMLLRCACTISNASHSVPDPLRNTCDGCQNNSVAAREETKKIRDLDVKNAGIRDLDVKNAGIRDLDVKNAGIGGEKCRNYGFG

SEQ ID NO: 151357 - protein, 114 aa, Heterodera glycines
  Coding regions on vcDNA: vcDNA=SeqID_77780; Strand=+; Position=1 -160,849-1033
MPEIALTLTVPASRGEYEMMMLQLEKERFGKERKPYNALAQEEREKIAKERIKESQVGAGGGAVGRFGHPETGPATRGALRLAAVGAQVHSELLLRLRDAQGLPLVLHGNGRIF

SEQ ID NO: 151358 - protein, 232 aa, Heterodera glycines
  Coding regions on vcDNA: vcDNA=SeqID_77781; Strand=-; Position=1 -210,294-510,685-956
MPLPPELLFEIVEALPSSKLSTVFLSNHLMSTWAKKRIRGTFNSLMSQKQEWRNLLKISRLVFESHNGLNQKCQNFSFSFWVSLLPCFSCCVCWFRWCSLFFVQHGIIGQKKNNQKNLMIFQNTHRLINEIIFLLKCVMKKLGIFYALEFAKLYQTIGREISRNKFRHIMQTGKKQHELALVLMEKAGINTQEKAFGLKHLEFVQNFWDKEFPDIFRIVAFDMVNEDFLNCL

SEQ ID NO: 151359 - protein, 36 aa, Heterodera glycines
  Coding regions on vcDNA: vcDNA=SeqID_77782; Strand=-; Position=1-108
MTTVTPQQTAATAAGGNCDKDPVDLMFIIDTSTSVQ

SEQ ID NO: 151360 - protein, 50 aa, Heterodera glycines
  Coding regions on vcDNA: vcDNA=SeqID_77783; Strand=+; Position=1-171
LFEYHKRALEKIDFFVFGAVPPNRCAQIYGETESFRNSFPIACTLIMRWI

SEQ ID NO: 151361 - protein, 151 aa, Heterodera glycines
  Coding regions on vcDNA: vcDNA=SeqID_77784; Strand=-; Position=1 -93,154-315,608-695,823-928,1172-1178
  Homolog annotation: Hit_ID=NP_444506.2; Match level="QueryCoverage =94%, HitCoverage=19%, E-value=7e-12, Identity=32%"; Hit description =vitrin [Homo sapiens] dbj|BAB71279.1| unnamed protein product [Homo sapiens]
MSSQVDLMFIIDTSQSVQEAFEQQLQFAVDLVKRLPDQDFAQRVQVGAVSFNKKAQLQFTMGQLKEKPVILDALLHINHTGGGTSVVSGVNLAMDQVAKHRRKGTRLMVVLISDGTSQDPWADVIRSAVRLRAAEADVYAVTVSHDYFFRI

SEQ ID NO: 151362 - protein, 38 aa, Heterodera glycines
  Coding regions on vcDNA: vcDNA=SeqID_77785; Strand=-; Position=1 -104,168-180
MILFCCFIKKKKIDFLTLLRRNWLDEFAPTAIGAASKF

SEQ ID NO: 151363 - protein, 66 aa, Heterodera glycines
  Coding regions on vcDNA: vcDNA=SeqID_77786; Strand=-; Position=1 -98,901-1003
MLFSNPFILCLLLNFLIIGPSQFIGQFITLLVNVFCSHFSIMFTQHFFSYFNSNIDINFYQKVLAS

SEQ ID NO: 151364 - protein, 160 aa, Heterodera glycines
  Coding regions on vcDNA: vcDNA=SeqID_77787; Strand=+; Position=1 -48,108-201,291-377,418-474,1052-1107,1218-1358
MATFNVAHLITLIGVGSIASSVVADEQQNQNKTQNGAGGLKHLFGSDVFTELRDKQNAMAEKMSGTEAKLEKQNENGMRETQTLLSTKLEKQIENGIQNNQKALSLMKNMATLAFFHFPLPIYHRWNASDCHPKIVINESTNAIQRNGTESDQKSLKLNA

SEQ ID NO: 151365 - protein, 816 aa, Heterodera glycines
  Coding regions on vcDNA: vcDNA=SeqID_77788; Strand=+; Position=1-2451
  Homolog annotation: Hit_ID=NP_920205.1; Match level="QueryCoverage =98%, HitCoverage=53%, E-value=3e-73, Identity=29%"; Hit description =putative DNA helicase homolog [Oryza sativa (japonica cultivar -group)] gb|AAP52492.1| putative DNA helica
MFTDRFDMWMRVWCSKIAVFHQELYEKSFFGTILGSGESMEFQGRGGPHAHIVAQTDLDAVPEVIQEYIWAHIPPLPDKDDDSPIAQMHREVRDYMHMQLHRCSDSWCGPRDPNFGRCKKGFPAPYSKCTILHPDRPALYYRPSPTDGGAKIEVNGLIYDNSQVVPYNPYILLRYRVHYNVLFAYGNKANIKYALKYPFKGPGHCYVECKEESGSKIGIDEPAQYAKMNFRGATEAFAVVHSMQFAKLSHHVVQLSIHLPNQQPVVYRAFQLVSKAEEIQRGELPETPCSAYWKQWQNEWQHVPSLKDMLFEKVPEQFRWAKDRWVPYKRKPTKRPPIGRVVPVAPKDIERFALYVLMRHFPGDPDHLKLVNGQQYSTFQEAALQHGLLEDDQIWHKTLGEAALHRWPDQMRWLFVSILVFGQPSNSLELWNKYKDQMYNPQGIISAAIRQAREQEALADIDWRLHFFNSSCMHCGLPDPPNSKAKNINLAIEEYFYGDDGLNMPPGQPKQRPQQNTPPPLNSDQQKVFDAVVRAIQSDPKDQTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIAVIDRVCKEMAIRQHKDLLFGGKTVIFSGDFKQSLPVVPHEGLTAQVTACFQTSPLFGQFSTMKLTINQRLGQGQQAYLQMCRQIGLGETGEHFWIPPQFLVKSREELIDFVYSDFQKLLGNDMELLNRLILAPHIDTCDEINEIMMANVPGQVREYLSSDSRLTSVTGHR

SEQ ID NO: 151366 - protein, 34 aa, Heterodera glycines
  Coding regions on vcDNA: vcDNA=SeqID_77789; Strand=+; Position=1 -22,506-588
MIGHLIYLHHEHQINTPSNFCPPHQFCCKNTRRR

SEQ ID NO: 151367 - protein, 89 aa, Heterodera glycines; identical to SEQ ID NO: 132504
  Coding regions on vcDNA: vcDNA=SeqID_77790; Strand=+; Position=1 -156,204-317

SEQ ID NO: 151368 - protein, 175 aa, Heterodera glycines
  Coding regions on vcDNA: vcDNA=SeqID_77791; Strand=+; Position=1-528
MALGNSSGINFRCLKKCASVGHSSAAPAEEAMEPPPPTPGPVPTPEMDEEILEFCFSLPSASVTPIGDLVPFSTTPTAPMDTGETTPPPLAIDERSERIEQLEKQLKDRDDTIKFLRKQVRNREALISDLRRQLEQCAAPPTATPTHSMKNSLRNMDIESSKFSKSFNFPECSSI

SEQ ID NO: 151369 - protein, 481 aa, Heterodera glycines
  Coding regions on vcDNA: vcDNA=SeqID_77792; Strand=-; Position=1 -1377,1427-1465
  Homolog annotation: Hit_ID=NP_494149.1; Match level="QueryCoverage =96%, HitCoverage=32%, E-value=1e-90, Identity=39%"; Hit description =predicted CDS, putative protein of ancient origin (2C297) [Caenorhabditis elegans] gb|AAF39854.1| Hypothe
IVVYPKGTKRIKEIYALDKCVDPMCYPLLYPSNIEGYNVNIKRHQEKRCRYVTTVNFLFFRENEKFFPHFYASKLFRQWLVDQAAKIEWDRLEYIRTHQAKLWSSNYLNVEDFLKNRASKTGAEIRKKVILPSTFSGGPRSMHEHFMNAMAIVNESGKPDLFITFTCNPNDPDILKCLLPGQTPSDRPDIVTRVFYLKKTHLLDLILNKHIFGEVIANCWVIEYQKRGLPHLHLLVTLHPKNKWHSTADIDKFSCAEIPSEKEDPVLFKIITNCMMHGPCNEKSMCWNKLKKKCGKKFPKTFRENTELNEDGYPLYKRPDNGRFIYRKGQKLTNQYVVPYNPFLSKTFNAHINIERDSATVECIQIEENGTKKILKYDEVGAYLEARYLSPCEACWRILKYPMQGKSHSVDLLDVHLENMQRIFYKNASEEQIEEASVKDTTLTAYFKFCQQNPTLKENGSIQDKTIKENGSIQDKTIKKR

SEQ ID NO: 151370 - protein, 325 aa, Heterodera glycines
  Coding regions on vcDNA: vcDNA=SeqID_77793; Strand=-; Position=1 -378,467-1063
  Homolog annotation: Hit_ID=NP_494149.1; Match level="QueryCoverage =77%, HitCoverage=18%, E-value=7e-22, Identity=27%"; Hit description =predicted CDS, putative protein of ancient origin (2C297) [Caenorhabditis elegans] gb|AAF39854.1| Hypothe
MVRTKQNFPKDSACCSSSLQYLDAEPVQSSGKQKRIEPVQSSGKQKRSETNLTNEKNGNKESINLDEMNDFSYTSDEEHTMKSYVAQRKAKQRKLMDNDEKEKELFENRFRIGLKRAKMTEEEISYLYKKIPENAKGNFVRYTISPRQNIKIPNFINLASLILNVWNNPFYKNFIKNIRRYNSIFACASISCFKFKFPTPGPPCYKIQGQIYHKFNPSAMPKNEKDLPTNGQLYFIDSEEAINIRCEIDKECLPDLLEYIEKYLRKNNPFAQSYLMMKEVYEQEEKKCKERGHKMPNIKLLFSLKENYDQRRYNIPLSNEVCAIM

SEQ ID NO: 151371 - protein, 50 aa, Heterodera glycines
  Coding regions on vcDNA: vcDNA=SeqID_77794; Strand=-; Position=1 -142,831-841
MSENSKINENSSLSKSVTVEISHCRNPLSKSVTVEISHCRNVTAPSFPGT

SEQ ID NO: 151372 - protein, 93 aa, Heterodera glycines
  Coding regions on vcDNA: vcDNA=SeqID_77795; Strand=-; Position=1 -39,217-459
MQNEEVLVHDAGGGWHSTWNVHLRGNQRPSSFARKMIEEDELWRIRVADYQIAPADGIKGPHRQDQNLEALVQDFFNRDPIQFLRACAYHLHF

SEQ ID NO: 151373 - protein, 393 aa, Heterodera glycines
  Coding regions on vcDNA: vcDNA=SeqID_77796; Strand=-; Position=1 -84,135-311,887-1540,1582-1848
MALLRFAETKTNRGKILLSRSGYDYTFEAVSKTEDGMEYWRCPNRPPYCPGRACVQCRWEVDADGSRYKIGRTTGQHNHPPVLGGHMTCPRGFTQVYTMAVVIDHCAVPAVYGLLPSKTLATYTRFFETIRQSVGNNWFPYRIMSDFESGAITAAGNVFPNSIRTGCLFHFGQAIWRRIQRLPNLLTRYRDDEVVRTSLRSLQALAFVPVDFVYNYFCIAMSILEPTPELQELIIYFINTWIGPRRIMQNEEVLVHDAGGVADNWIRGRIEALNLAQTDALFPIELWNVVDRVAEGLGRTNNSLEGWHSTWNVHLRGNQRPSLFARKMIEEDELWRIRVADYQIAPADGIKGPHETRKAKYIRQDQNLEALVQDFFNRDPIQFLRACAYHLHF

SEQ ID NO: 151374 - protein, 64 aa, Heterodera glycines
  Coding regions on vcDNA: vcDNA=SeqID_77797; Strand=+; Position=1-633
PIPSFMRHQLHSFLVLPNCLKCIPKNALKMIKPVFSRIYCQYFPIRNDTVNSFASLIHSCFASD

SEQ ID NO: 151375 - protein, 28 aa, Heterodera glycines
  Coding regions on vcDNA: vcDNA=SeqID_77798; Strand=-; Position=1 -55,98-129
MKGCKKAILGKNIAKKYLDIFLSVKWLI

SEQ ID NO: 151376 - protein, 87 aa, Heterodera glycines
  Coding regions on vcDNA: vcDNA=SeqID_77799; Strand=+; Position=1 -47,92-165,494-747
  Homolog annotation: Hit_ID=CAE62184.1; Match level="QueryCoverage =98%, HitCoverage=95%, E-value=1e-20, Identity=52%"; Hit description =Hypothetical protein CBG06231 [Caenorhabditis briggsae]
MEKIEVKETDMKSNLIDQTIEIVRDGLQKYGQDKDIASFVKDTMEQRFAGTWHCVVGRSFGSRVSYELESFALFKVNQHTVLIFKCG

SEQ ID NO: 151377 - protein, 173 aa, Heterodera glycines
  Coding regions on vcDNA: vcDNA=SeqID_77800; Strand=+; Position=1-519
  Homolog annotation: Hit_ID=NP_867827.1; Match level="QueryCoverage =98%, HitCoverage=27%, E-value=5e-19, Identity=37%"; Hit description =hypothetical protein RB7455 [Rhodopirellula baltica SH 1] emb|CAD75374.1| conserved hypothetical protein
MGVPAEKERATHRTMGVPVEKERATHRTRGVPVEKERATHRTRGVPAEKERGATHRTTGVPAEKERATHRTMGVPAEKERATHRTMGVPVEKERATHRTRGVPVEKERATHRTMGVPVEKERATHRTRGVPVEKERATHRTRGVPVEKERATHRTMGVPAEKERAIHRTRGMP

SEQ ID NO: 151378 - protein, 125 aa, Heterodera glycines
  Coding regions on vcDNA: vcDNA=SeqID_77801; Strand=+; Position=1 -217,268-428
MQRKQTNNVIIIIQNCLFFKFGLVTRFAERQRQPWECRRRRNAPHTEPGECRRRNAPRTIARAWHFRDAKRGGDGIGNQGPDVGDESTHDDDADVFVGCAPNEGDDLNRHPNEAATDPFGGHSGP

SEQ ID NO: 151379 - protein, 175 aa, Heterodera glycines
  Coding regions on vcDNA: vcDNA=SeqID_77802; Strand=+; Position=1 -157,334-392,608-664,798-914,1050-1184
  Homolog annotation: Hit_ID=NP_740864.1; Match level="QueryCoverage =100%, HitCoverage=24%, E-value=2e-54, Identity=59%"; Hit description= hydroxyacyl-Coenzyme A dehydrogenase 3-ketoacyl-Coenzyme enoyl -Coenzyme hydratase (1G784) [Caenorhabditi
MALACHYRIAVSSPKTQFALPEVMLGLLPGAGGTQRLPRLISLQNALDMMLTGKVIRPDKAKKMGLVDQLVQPLGPGLSDPISGTHRYLEEVAISACEQLAAGTLKINRERPLMERIQNVLLTRKPLLDAVVMRMARDKVMKQTHGNYPAPLRILDVVRTGLVDGQQEGYEEETK

SEQ ID NO: 151380 - protein, 20 aa, Heterodera glycines
  Coding regions on vcDNA: vcDNA=SeqID_77803; Strand=-; Position=1-62
MATFYGLEFGTQTMVYARET

SEQ ID NO: 151381 - protein, 131 aa, Heterodera glycines
  Coding regions on vcDNA: vcDNA=SeqID_77804; Strand=+; Position=1 -111,162-446
  Homolog annotation: Hit_ID=NP_493461.1; Match level="QueryCoverage =55%, HitCoverage=20%, E-value=2e-09, Identity=39%"; Hit description =traf Tnf receptor associated protein like (1O690) [Caenorhabditis elegans] emb|CAA21707.1| Hypothetical p
MTRPLMPQLNELMAPMYNIVVSDVYNPDYFCVTLISKNIKINHSEVIRFPNTQMGRSMTVIQGQWQRLRLALVNTHLESTREVGEERKTQFKLCMEKIRSMSGTDSEETLAVFGLFLVVFRFEGNSRFHRR

SEQ ID NO: 151382 - protein, 98 aa, Heterodera glycines
  Coding regions on vcDNA: vcDNA=SeqID_77805; Strand=-; Position=1 -11,75-360
MNRRWICNDVWMDIFPSFDRAQLGLKLALLSPRFNALVDKHFNGKSELTIWRPIEIRRKDKGPEPNLSVRMDDRFVPFPWPEDRPLPSKIRFKDLRIE

SEQ ID NO: 151383 - protein, 134 aa, Heterodera glycines
  Coding regions on vcDNA: vcDNA=SeqID_77806; Strand=-; Position=1 -11,58-451
MNRRWICNDVWMDIFPSFDRPQLGLKLALLSPRFDALVDKHFDGKSELTIWRPIEIRKDKGPEPKLSVQMDDEFVPFPLPDRPLPSKILFKRLQIEYLKAALLQFTGHKKRHDHKLFLSTLVHPFSRSIQIKHY

SEQ ID NO: 151384 - protein, 268 aa, Heterodera glycines
  Coding regions on vcDNA: vcDNA=SeqID_77807; Strand=-; Position=1 -46,740-885,972-1121,1166-1266,1419-1567,1640-1723,1899-2027
  Homolog annotation: Hit_ID=XP_424792.1; Match level="QueryCoverage =93%, HitCoverage=29%, E-value=6e-31, Identity=34%"; Hit description =PREDICTED: similar to mitochondrial elongation factor G2 isoform 1; elongation factor G2; MSTP027 [Gallus
MQLGQPSRALVNANTAVEDPSIRVIEEEETGQTILEGMGELHIEVMRERLLREFDLNAFFGPLRVNYKEIPQKRAVSTEHMENVIDKRQWCTMKLEIEPIPFVNTGTVVHQFRKVSIDLDREEDVEMADQALKNLLFHPDWLKSINAGALSTSGHKIPVTLLNACASRCLSKALEQANLVLYEPMMLVEVVVLSESAEMPDPDTVVRALSERRATILDVSMDGAKGRIAVVQANIPLAETQGLSRILRTVSSGMASFHLQPNGYQQMD

SEQ ID NO: 151385 - protein, 99 aa, Heterodera glycines
  Coding regions on vcDNA: vcDNA=SeqID_77808; Strand=-; Position=1 -60,795-1034
MAAKELFLAQQPDLFKPIQSSRENLDASSHFHFTHSFKIFLVAQVACYAIPVLIIYDRSRTDGPAAAGHEQIANVHPFGVTTDGCEQHYQSMQHERPIV

SEQ ID NO: 151386 - protein, 164 aa, Heterodera glycines
  Coding regions on vcDNA: vcDNA=SeqID_77809; Strand=+; Position=1 -210,275-322,515-637,822-917
  Homolog annotation: Hit_ID=NP_491767.2; Match level="QueryCoverage =92%, HitCoverage=21%, E-value=8e-36, Identity=49%"; Hit description =OligopePTide/Peptide transporter, proton H+/oligopeptide symporter (77.9 kD) (opt-3) [Caenorhabditis eleg
PLPPFVLCFSIFNLLYLLPQPVELVRPNSVNILWQMPQVFVMTVGEILLSVTGLEFSYSQAAPSMKSVVQALWLLTALWLLTVFFGNIIDIVVISQVQISDPVEEFFIYAALMFAVIGLFVLLAMRYKYVDGNDDRLELGRGPRRGASARTDRKSGQMSSERKW

SEQ ID NO: 151387 - protein, 95 aa, Heterodera glycines
  Coding regions on vcDNA: vcDNA=SeqID_77810; Strand=-; Position=1 -102,467-652
MAFAEAFSFFASHGMAFRRWMNDDQTAFSDRKQKGSQITILQSLSWHPKNLILGSKSLIFTKFIQNTFKIFKCYICDVHDQFGQFFIRNKHFMKF

SEQ ID NO: 151388 - protein, 46 aa, Heterodera glycines
  Coding regions on vcDNA: vcDNA=SeqID_77811; Strand=+; Position=1-139
MDVNAELPPDFEFDSILRPINNSPFFSPHYGRWYHNQIAGHLSSVI

SEQ ID NO: 151389 - protein, 105 aa, Heterodera glycines
  Coding regions on vcDNA: vcDNA=SeqID_77812; Strand=+; Position=1-319
KCAIFLVVLLFYRLPLFAPTAEFFGQFTDPQRVISWAAFAMFFLRYLYIFLHVLVAINRATAIWIPLKYDKVISVVQPTGTKENLFTLSKMKSSKFCADISSPMP

SEQ ID NO: 151390 - protein, 33 aa, Heterodera glycines
  Coding regions on vcDNA: vcDNA=SeqID_77813; Strand=+; Position=1 -56,172-217
MIWNTVIANRIQYFKLYIIYWSNDLNIPSLISS

SEQ ID NO: 151391 - protein, 364 aa, Heterodera glycines
  Coding regions on vcDNA: vcDNA=SeqID_77814; Strand=-; Position=1 -201,324-452,637-1141,1328-1398,1880-2068
  Homolog annotation: Hit_ID=NP_503141.1; Match level="QueryCoverage =94%, HitCoverage=69%, E-value=1e-105, Identity=51%"; Hit description= splicing factor 3b (68.4 kD) (5A609) [Caenorhabditis elegans] gb|AAG24205.1| Hypothetical protein W03F9.
MSEAVNEIDSGFEAEGGTNETEEEKDVSEVVKESNETETKEKKAQKGEEGKKQKGTAGDDLLVEIEYIKTEEELKREEQFRQVRTEIPEDTLSKAAISEQILQEELNQRRSTPRADVVEWADVTSRDPFLLVELKSYRNTVMVPRHWNAKRKYLAGKRGFERPPFELPEFIKRTGIMEMRETMWEKEEHQSLKNKMRERTRPKLGRIDIDYQKLHDAFFKWQTKPQMTKMGELYYEGKELEAQMREKKPGTLSDELRIALGMPVGPVTRQQIVPRVNSTGGWGKPPVDEYGKPLYGDVFGLTVPQVADDVDESRIERRHWGEIGSDEEESEEESEAEEDDEEGTGALPPPPPEGGYVTPAPTEG

SEQ ID NO: 151392 - protein, 58 aa, Heterodera glycines
  Coding regions on vcDNA: vcDNA=SeqID_77815; Strand=-; Position=1 -18,198-356
MSDDERECECRKGAIGPQSEEKDGGGTAAEKAHSDAPPGDEADGGGSRVGGGAGGAAE

SEQ ID NO: 151393 - protein, 131 aa, Heterodera glycines
  Coding regions on vcDNA: vcDNA=SeqID_77816; Strand=-; Position=1 -58,234-430,823-960
  Homolog annotation: Hit_ID=NP_498596.1; Match level="QueryCoverage =50%, HitCoverage=11%, E-value=5e-23, Identity=80%"; Hit description =prolyl tRNA synthetase (65.8 kD) (prs-1) [Caenorhabditis elegans] gb|AAA50660.1| Prolyl trna synthetase p
MVQITQGFAYQNQPMVQCCGHTAYATKEEAEEEVYDILNLYARVYTDLLAIPVVKGRKSEKEKFAGADFTTTVEAYVPVNGRGIQVVVIPVGITVKLSDEKRVELIEKSEALVKMLKEEHGVRAGLDQRDN

SEQ ID NO: 151394 - protein, 111 aa, Heterodera glycines
  Coding regions on vcDNA: vcDNA=SeqID_77817; Strand=-; Position=1 -123,292-501
MAGGFEKLNPSKAQKAVFLELWGPDFEFFPINALHALFLAWVRRATVRVSLLRRFNGFCVLFDYVESAIGPVTQRSLYETVKGQRQRLTADCTTTDIYIEDLALLSADRDK

SEQ ID NO: 151395 - protein, 99 aa, Heterodera glycines
  Coding regions on vcDNA: vcDNA=SeqID_77818; Strand=-; Position=1-475
VPSQCSPSALPNCPVPTPARPPRTAALLVAPDGSAICRLFIGLGGQRSSRTEVSQRGRLRMRLLTEEKALRRYKRPPGRTQKIPQKWDAPKIGKEINTP

SEQ ID NO: 151396 - protein, 906 aa, Heterodera glycines
  Coding regions on vcDNA: vcDNA=SeqID_77819; Strand=+; Position=1 -318,370-1105,1167-2530,2561-2758
  Homolog annotation: Hit_ID=XP_318550.1; Match level="QueryCoverage =99%, HitCoverage=99%, E-value=1e-142, Identity=42%"; Hit description= ENSANGP00000020240 [Anopheles gambiae]
LKVGVFVNKKKTKFVADSGTEVNIIDEEAYDKIGRPKIQECEEKGKLFDGTKVAFIGKGIATFQFGDIAIDQEFYVAKRGSLNLLSISTMDAFGLLDDLKRKISNSAADKFIRELKATFSTTFEEAADKFIRELKATFSTTFEEGLGLCTKELAHLQLKDGATPIYRKARPMPHHSKEIVEMELDRLEQLGIIRKAEHLTWAAPILVVKKGDGSARLCIDYSTGLNDALLDFQHPLPIPDDIFATLNGGKLFSQIDLKDAYFQIQLDDDSKKICGISTHKGNYLMERLPFGVKSAPGIFQSIMDKMLAYKPIVDMPAPTNISSLRSFLGMVNHYQQFVRNMRFIRKPLRSAQARSKMELVRQLSQIISKIVSAIVSADASELGIGAVISHRFANGTIKAIAHASKSLAPAEKNYSQIEKEGLALIFAVQKFHKMIYGRKFILQTDHKPLLSIFGNKKGIRQCSVNRLLRWSLILLAYDFKIEYVKTTDFGQADALSRLIAKGGEEENERVIALITAEPILEEILHSASKNLPIKFEDLVIASKNDYNIQKVIKFIRQGWPNEKKIEKESDTIKLFHRRKSDLTILKGCLMYGERVVIPRIFQAKILRLFHKGHPGMKRMKQLARQYIFWPKLDKEIEDYVQNCEPCQLAAKAPIKTDLHSWPKPTGPWQRIHIDFAGPFFGKTFLIVVDSFSKYPEVFEMANSTASATIEKLRYLFTRHGIPETIVSDNGTQFSSSEYAKFVAANGITHLFSAPYNPMSNGQVERFVDIKRTFRKLKGEGKPNKEIIDTFLITYRTTPTDLKCPAELLLCRRPRTTIDLLRPPMERQFNKKFGTKNRRFIMERQFNKKFGTKNRRFILNEKVFARHRSSQHWKTGVISGTSGVIFEVKFPDGSFGRFHANQLRNRK

SEQ ID NO: 151397 - protein, 130 aa, Heterodera glycines
  misc_feature (27)..(27): Xaa can be any naturally occurring amino acid
  Coding regions on vcDNA: vcDNA=SeqID_77820; Strand=-; Position=1 -26,2215-2396,3257-3437
  Homolog annotation: Hit_ID=NP_495744.1; Match level="QueryCoverage =99%, HitCoverage=19%, E-value=6e-24, Identity=44%"; Hit description =tyrosine DeCarboxylase, Aromatic amino acid deCarboxylase (tdc-1) [Caenorhabditis elegans] emb|CAA88862.1
YRNFIIKISDLNSKILFVLVILFFAFXGLQRYIREHVRLAKYFVSLMSADPTFEIVGDVIMALVCFRIKGSEEVNENLLKELRLSSHIHVIAAAPDNRTTIRFCVNKEDANEQDVLFAFKVIKETALYVS

SEQ ID NO: 151398 - protein, 159 aa, Heterodera glycines
  Coding regions on vcDNA: vcDNA=SeqID_77821; Strand=+; Position=1 -239,311-551
MANACCFGLLLLYVMFGGLLLLRFERGQSERAKDELIRRKTECIRHFLRYQRHFFNKIKLAFAIFIAINIVLKSKKLLAGDGIFNGQDRSNESAAKAPTLISAAERITEHCLFGIVDPAEGRRRQTWNFRNAILYGFGILTTLGECETGESAVNTANCS

SEQ ID NO: 151399 - protein, 342 aa, Heterodera glycines
  Coding regions on vcDNA: vcDNA=SeqID_77822; Strand=+; Position=1-1029
  Homolog annotation: Hit_ID=AAM51225.1; Match level="QueryCoverage =73%, HitCoverage=92%, E-value=1e-23, Identity=32%"; Hit description =polyubiquitin [Chlorarachnion CCMP621]
MKKHFGFSLFSVGISAVLIIMLMLITILPPSIADDYLEIFAKPPIADANPKSVRLKKTDSVETLKKEIGKKLGITPRTLTHNSPYALQLDDKKTMQDYSIEEGDIIYYFLYGVIKIPEGEFEVFVKNGEKKYSIKVKITDTVEILKKKVQKATDIPAENQTFAHYPVRGRVLDEDNKTMQDYGILEEATVQMVFPFEIAVCCAGKTYSVKVKETDTVVTVKEKIETIIGIPPKRQLMSKQQSDVLDDKKTMAYYGIVKGKTVDVCWDQFEIYVQNGDEVITVNVQAIDTVATVKEKIQKKTGILTEKQTLRPKHSRALSKDNYRYGEINPNAILALGENTKQ

SEQ ID NO: 151400 - protein, 54 aa, Heterodera glycines
  Coding regions on vcDNA: vcDNA=SeqID_77823; Strand=-; Position=1 -8,216-372
MAPHNKFKIRLYLAIVTIISAFYGCFNSFKGLNDGNFHANFSFCQSSVLLYVFW

SEQ ID NO: 151401 - protein, 91 aa, Heterodera glycines
  Coding regions on vcDNA: vcDNA=SeqID_77824; Strand=-; Position=1 -228,427-474
MQNDGQKIKAHTFITADAAKSVEQICFNFKLFICTNFLVTVKAFKWEIVPKPDNDDEDDGDDLWGYQIKLKYDFPPIKKQTLFFAEIQEGG

SEQ ID NO: 151402 - protein, 44 aa, Heterodera glycines
  Coding regions on vcDNA: vcDNA=SeqID_77825; Strand=+; Position=1 -54,575-655
MANEAPYTHIVTEQMHEYVKIIVPPAVILSPASVSCQLKISKTC

SEQ ID NO: 151403 - protein, 70 aa, Heterodera glycines
  Coding regions on vcDNA: vcDNA=SeqID_77826; Strand=-; Position=1 -126,569-653
MANGSDKFSKLPQLASPSLYQICLSVDVDTCKFKGKETIHLEITKPTNFLTLHAGALEVEKASLKLEDGT

SEQ ID NO: 151404 - protein, 146 aa, Heterodera glycines
  Coding regions on vcDNA: vcDNA=SeqID_77827; Strand=+; Position=1-441
MINRLARPLRGLASFSWLFLQSPRLNPPTFQSLELNPPAFQSLGLNSPAFQSLALNAPTFQSLELTQPTSIPITGTQFSCISITGTQPTNISITGTQPTSIPITGTQFCISITGTQPTSIPIARTQPTRINHRDSILWHFKQRDSN

SEQ ID NO: 151405 - protein, 19 aa, Heterodera glycines
  Coding regions on vcDNA: vcDNA=SeqID_77828; Strand=+; Position=1-59
MENLNFRLFVRNCLKWVPD

SEQ ID NO: 151406 - protein, 87 aa, Heterodera glycines
  Coding regions on vcDNA: vcDNA=SeqID_77829; Strand=-; Position=1 -120,403-546
MIVGEEPAPAQAGAAAEDAANKSAKRAALAAQKRQLALDRSSFKSQHPDLAEGSSTASGGSGTPKTGQQQQPVDMASGGALDECEPA

SEQ ID NO: 151407 - protein, 111 aa, Heterodera glycines
  Coding regions on vcDNA: vcDNA=SeqID_77830; Strand=+; Position=1 -8,106-314,365-483
MLSAIDFGFAVREQTKLDGLIMKGASIYSSSGSFWCNGSSTAGKSYGAGATVGIGFSFTNRQIIFTKNGVLLDFFTLLDDSSFSTNSLFPFVSLCIMVKLRRILGRSSNSI

SEQ ID NO: 151408 - protein, 104 aa, Heterodera glycines
  Coding regions on vcDNA: vcDNA=SeqID_77831; Strand=-; Position=1 -240,343-417
MAGQQKIGPDFVGQKCLVQIQTVQGYQNGVGVVFAWAVFAWGEFLNYNFFLCQPNPIILVSFDSPKCSLLAYKIWKNFVKANSASEGLSKDIKNIGFGWQRKKL

SEQ ID NO: 151409 - protein, 272 aa, Heterodera glycines
  Coding regions on vcDNA: vcDNA=SeqID_77832; Strand=-; Position=1 -82,176-483,715-847,908-1203
MKKIIYYFVLQCCLISTLLADFVERGKEKIPLYYARQSNPKSSIAPIEKEFLADSSEMDKNEQTMADLITLYLNEKKKPSTESNGKTMAELFNMESIEKKEFNEFLNEITENEHLIDIVFEPHQTGQSNKLETQQKINEKMTEKLRKLSAIKENDPVMSQIIEKLSIFIKEVKSGNVLNSLKEYLLFVIKICIMREQIPLSEIITNKKFETKLMAKLVKLLLEEKRKNNQHKKEKNDERTNKSNGKQILGLMHSAVENLNIAANIKYECKNN

SEQ ID NO: 151410 - protein, 182 aa, Heterodera glycines
  Coding regions on vcDNA: vcDNA=SeqID_77833; Strand=+; Position=1 -102,406-852
  Homolog annotation: Hit_ID=P02894; Match level="QueryCoverage=81%, HitCoverage=39%, E-value=4e-09, Identity=36%"; Hit description =Circumsporozoite protein precursor (CS) pir||OZZQAK circumsporozoite protein - Plasmodium knowlesi (strain H)
MKLKKIAQIFQNFSSFYLLHPPLLHRPPYDKGGGQQQTGRGGVGAVQQRQSEGGVGAVQQQQIGDGVGAVQQRQIGEGVGAVQQQRTVGGGVRAVQQQQIGEGVGAVQQQRTVGGGVGAVQQRRTVGGGVRAVQQQQIGEGVGAVQQQRTVGGGVGAVQQRRTVGGGVRAVQQRQTGGEVPF

SEQ ID NO: 151411 - protein, 766 aa, Heterodera glycines
  Coding regions on vcDNA: vcDNA=SeqID_77834; Strand=+; Position=1 -363,1098-1543,1675-2501,2611-3274
  Homolog annotation: Hit_ID=CAE69952.1; Match level="QueryCoverage =60%, HitCoverage=42%, E-value=6e-14, Identity=25%"; Hit description =Hypothetical protein CBG16341 [Caenorhabditis briggsae]
MSKNIGQNGRNRTEQLTVGEEAAAAPMGGNWAQRKTTPPGVWRESGEGPESVRRTLKKEVGTGGGPSAGQEITGWFQRHSVEANRSEQQPRKGKALEEFDYCWRGDKAKRTESDDGMGNEWLKRQFAAENIRKRENEQKTEIIERQRERCENGEEKGNPWDYLGRKNETNGEKKLEEEIDKLFEQLGLLDRKHLMNNGEFKSIFESMRKHLPTKETQQKQQQQSIGQGQQSFCFTTNGAQKTERQQNAYKKGRRETLLGRSASNNALAERANGTTTTQSSSSASASLLLSSLSNGEKRQQQRRQSLPKNQPKYGGNLENFWQSVGVSFTSFYPNHSQMVKTRAAETSPSKQRLPLGLSSVEKLQGICQFTNQTVEEPNQPINVYPRRYGGVIETVAMRRNNYLMEAARTASPSGTSTPTTNSGRATPNFSCGRFGPNRLNGQNVRISIQQSIQIGLSVDRRSIKHGLFGLGDSVRKRMSKERENRKGCGRFPTVTEEEKGEAVEALANQNGTIIISIGQPQKIGNGNLRMDSQRQQRTSRSPDNVSAKPTTLPQPTPKHNLRDKLISAGFPISCQTTSFFGGNAKNPFYGQKQPDDHQKQKQQSNSAPNFPLTNTVISRVNLFESQQQVDKSATDTERVPIKPTSVASEVGNLSQHSLETNRQHLDIVNGTTSGNGQLSPRSSVFRTKSVIVFDFDNLGGTPTKAMAKEQAEENKRKSGGKTKEQPKAKQQKKEEQRRTTAKGEEQNAKKVKLIKQIEKGSKEKRK

SEQ ID NO: 151412 - protein, 226 aa, Heterodera glycines
  Coding regions on vcDNA: vcDNA=SeqID_77835; Strand=+; Position=1 -93,368-491,819-1082,1466-1665
MITAGGSIQTEMQNPNNFISKMSNQINRMPQNSLAFADENHNPNLNNENTPPNTRTNTSSSEQNGRPGRTRRVTPVASPLRPINANNDGGNDAVHQPRQSTNIGNLSNNNNNYIEEIVQHYMRNNMEYMITTYSGLNDQTLQSAMNEQQQQQQRSVATTTGSADSSNSIEYLKQQMQDNECCDSENNDGETNCTICLEKITPTSHAKQLTSCQVFKIWKKLFIKEN

SEQ ID NO: 151413 - protein, 107 aa, Heterodera glycines
  Coding regions on vcDNA: vcDNA=SeqID_77836; Strand=-; Position=1-324
  Homolog annotation: Hit_ID=NP_702308.1; Match level="QueryCoverage =83%, HitCoverage=1%, E-value=5e-09, Identity=40%"; Hit description =hypothetical protein PF14_0419 [Plasmodium falciparum 3D7] gb|AAN37032.1| hypothetical protein [Plasmodium
MQQHWNNSSKQKDIGKLKKKTKKKKEKMEENWERKSKKKRKKKLKKEIEEEKNKIGNLETKIKTNKEKAKRETKSIWEKFKEMKKHFANKLEANNSNVGEGGAKEIA

SEQ ID NO: 151414 - protein, 42 aa, Heterodera glycines
  Coding regions on vcDNA: vcDNA=SeqID_77837; Strand=+; Position=1 -49,103-179
QTERASLALSISLIWAVEVCSLRSSDKSCRKAPEVMLKWAPI

SEQ ID NO: 151415 - protein, 39 aa, Heterodera glycines
  Coding regions on vcDNA: vcDNA=SeqID_77838; Strand=+; Position=1-120
FVRAAFFCEAANRFLLNCAPKLKDGKVRHKKTNERSIEG

SEQ ID NO: 151416 - protein, 163 aa, Heterodera glycines
  Coding regions on vcDNA: vcDNA=SeqID_77839; Strand=+; Position=1-492
MDSYILQDQFSFPVNLYSFYHFKRAENANAKSVLTDEAATTAMHCQAHSFCCNEGASVAHKLVIGVSANSFEDEKKMAHKKLEEENNENRTNGKGVVGTAKAEETAKEEKGEEKQCQTEEAAKCQQTQQQRQQPFCIRLNSSPMSPKLEAKNGQRFKKAISDF

SEQ ID NO: 151417 - protein, 45 aa, Heterodera glycines
  Coding regions on vcDNA: vcDNA=SeqID_77840; Strand=+; Position=1 -51,425-511
MPKSAAKEAPVGGRQQHKTMNAKNGSGGGSTELMRFILDDKLETS

SEQ ID NO: 151418 - protein, 86 aa, Heterodera glycines
  Coding regions on vcDNA: vcDNA=SeqID_77841; Strand=-; Position=1-261
  Homolog annotation: Hit_ID=CAG84038.1; Match level="QueryCoverage =89%, HitCoverage=18%, E-value=9e-14, Identity=53%"; Hit description =unnamed protein product [Yarrowia lipolytica CLIB99] ref|XP _500107.1| hypothetical protein [Yarrowia lipol
MKTRSFDWEPENPTLENPTLENPTPENPTLENPTLENPTQAENPTPVENPTPENPTLEKPTLENPTQAENPTPENPTLEKPTPTKF

SEQ ID NO: 151419 - protein, 35 aa, Heterodera glycines
  Coding regions on vcDNA: vcDNA=SeqID_77842; Strand=-; Position=1 -12,252-347
MTFLKYSLRNEKFSKIRLKNLFIYFLDQLHLCCRN

SEQ ID NO: 151420 - protein, 22 aa, Heterodera glycines
  Coding regions on vcDNA: vcDNA=SeqID_77843; Strand=+; Position=1-66
MGALSTHQISFGNPTDTWGPSF

SEQ ID NO: 151421 - protein, 414 aa, Heterodera glycines
  Coding regions on vcDNA: vcDNA=SeqID_77844; Strand=+; Position=1 -69,129-595,672-864,960-1322,1375-1524
  Homolog annotation: Hit_ID=CAE70198.1; Match level="QueryCoverage =96%, HitCoverage=85%, E-value=3e-42, Identity=30%"; Hit description =Hypothetical protein CBG16672 [Caenorhabditis briggsae]
RWLDSDCASSDGNGFHIICIALQELPFAQFLRVTDINNTWSLHITSWMNAHNLALASELYVASNALLIYFSWNMLNMVLHIIEFYYYKYLYSTNTDFPPKVDSIEDRWIRDSIFGKGTMSTKIAFRNKTVLVFVTSHFFADTKFHMERIKQYQVGRRCTFPEEKSAKKFVIWQGDLNSRIEGIANATELIQRLNSMEEGDEMKAEIAKLLQSHDQLTKARAKREAFGEFTEAEIGFKPTYRTLVRSGAYDSLRVPSWCDRILCEGDMDALRITKYSSCPSITLSDHFPVSAQFELHFQKEKRHQLSEVEQRLQTLSLMEAEHRQSSPWLIRVEHIPTWEEFIPLVCRIAIPNDIWADLCSYRDWIGIYHNSLNSITKPLEWMYTFSCPTDDERRIDTERTLIVEFQPLKSGFYR

SEQ ID NO: 151422 - protein, 416 aa, Heterodera glycines
  Coding regions on vcDNA: vcDNA=SeqID_77845; Strand=+; Position=1-1251
  Homolog annotation: Hit_ID=XP_320889.1; Match level="QueryCoverage =66%, HitCoverage=33%, E-value=2e-21, Identity=25%"; Hit description =ENSANGP00000012033 [Anopheles gambiae] ref|XP_313651.1| ENSANGP00000013044 [Anopheles gambiae] ref|XP_314
MILIIALRDEFTDLRQKCLQRLEDSRTSGRSTSLQELGEECRKYQILKESALSLGSNPCSTSAIRAKPQQIRDKQKSKSRPQQSQKGHFQPNNSTAIEKEVDLPDQPCYSCGGKNHWQKDCWFKNSKCEKCGRIGHIAKRCKNGTETRRVRAVATNSGNDMHIHTVSLQPTCKAIEGSSNKWWRIVTEINGMENPMNVDTAAQITVITTDSWQKLGKPKLGKTTIAVKNCNEKAFAIKGKFNCQVSYNGRTAKLIAYVSDEIHQDLLGMPWIEELEIIPKELMFPNSSQITNSVPMKHQKMPPVNFKNFGKFQQKHQKMKRQFNDKNGAKTITFQNGEPVFIWNLKGNKANWLPATIIERVGNSPTYRVDVPTLRCAVHRLVNQIRRRFPMEMETSQIGQANGNILAGNQPNRTPH

SEQ ID NO: 151423 - protein, 387 aa, Heterodera glycines
  Coding regions on vcDNA: vcDNA=SeqID_77846; Strand=+; Position=1 -66,118-303,369-998,1273-1452,2043-2146
EQHKLSSLPLELLFHLFDSATVADLQNISLISHSHLFKMLGYLTSINFSKRFASLLNASFVSSGGTDNSKKHCDRIEKSVSEYARLIRICHIFRTREECICFTVNLFSKLNYVINRKGFECFGAIWGILITEVNGLGGGFRLSCPLVSQISANWSQKEFFTLMQTLINSFGLAERVDPVLRSEVDLIKFPMCSIVSFSKDTLWGEELLLRRLLRGLFFDHRCPSSSVSVPCQTPRRFSPHNASFRLSALLRLLAPDSLLTAHRLLLIVGAPIGVSVAHGQINDTENNEISAGKEFVDYQRIYTEPIGDLDSAHAILGELPSMVSLLLETSDAVESEELRWNDLEVFNCLEMLTMAGQLFDMDLLRIALEISRQVAEMFLSHLHFILV

SEQ ID NO: 151424 - protein, 87 aa, Heterodera glycines
  Coding regions on vcDNA: vcDNA=SeqID_77847; Strand=-; Position=1 -118,218-393
VSYGICAALFLWQFFTRFRHNVLLSEHISAGFSSEGCVRLGFSFWLLISAVLAQFAPCVLLFWALKGRKKQTNEEQKSKEQDTVFLY

SEQ ID NO: 151425 - protein, 127 aa, Heterodera glycines
  Coding regions on vcDNA: vcDNA=SeqID_77848; Strand=+; Position=1-384
  Homolog annotation: Hit_ID=NP_988306.1; Match level="QueryCoverage =87%, HitCoverage=16%, E-value=2e-11, Identity=30%"; Hit description =Eukaryotic thiol (cysteine) protease, active site:ATP/GTP-binding site motif A (P-loop):Sigma-54 factor i
MAISRAYFMARQICQNEEFFLRHEIKIGLNPDISLTGNSIGAAAMLATVSLAKKRPVRMDTIVTGAVEHNGDIDGVGEIIPKVEGAVQHGLSRIVVPLLNGHEVADLAGIEIIPIVDCQEVVDEMMC

SEQ ID NO: 151426 - protein, 50 aa, Heterodera glycines
  Coding regions on vcDNA: vcDNA=SeqID_77849; Strand=+; Position=1 -17,799-934
MSGSTSCLASDDVPTFCTGTMGAQPDGTETACRLAATARQALLDEGRIGG

SEQ ID NO: 151427 - protein, 98 aa, Heterodera glycines
  Coding regions on vcDNA: vcDNA=SeqID_77850; Strand=+; Position=1 -202,262-356
MIYRRQLWKDIKKEKTREKFIETSKKLEYEIKKYLTNRENKFLSGLDPKQRCHVISSEVISPVIDFANYVKKLYTFWGPVVPIGTAVENFENLSDITL

SEQ ID NO: 151428 - protein, 119 aa, Heterodera glycines
  Coding regions on vcDNA: vcDNA=SeqID_77851; Strand=-; Position=1 -127,350-476,797-900
FSQSVPEASFFEARPHLSNFVVPAKECSRASHGQKRLASHKPELKDMMRRYAEVTYADAHKKPNEGFVCFANRDDMRRAIDKFQAVLVRRVLVLAHLVPARLVLAPALLHLLAVTRVRP

SEQ ID NO: 151429 - protein, 76 aa, Heterodera glycines
  Coding regions on vcDNA: vcDNA=SeqID_77852; Strand=-; Position=1 -162,1030-1098
MADVSQDDILVVEGAIDNDQVNSINWHTLMTCTIKTLKNLVERTYNKFGQIDVLLSDYTYYSTIKNALGCEKRKMV

SEQ ID NO: 151430 - protein, 68 aa, Heterodera glycines
  Coding regions on vcDNA: vcDNA=SeqID_77853; Strand=+; Position=1 -141,462-527
  Homolog annotation: Hit_ID=AAH59701.1; Match level="QueryCoverage =100%, HitCoverage=14%, E-value=2e-20, Identity=76%"; Hit description= Succinate-CoA ligase, ADP-forming, beta subunit [Danio rerio] ref|NP _998191.1| succinate-CoA ligase, ADP-
SELDLKIPIVCRLQGTRVEDAKALIANSKMRILACDSLQEAAKMAVKLSSIVTLAKEAAVDVKFELSI

SEQ ID NO: 151431 - protein, 88 aa, Heterodera glycines
  Coding regions on vcDNA: vcDNA=SeqID_77854; Strand=-; Position=1 -41,558-783
MNCSNLWRNRWHFGNGSGNALCTRLWLVGIELEPKRPNNSFKGKMKANLKKKFDERVKSDFQNGLFQNVWLKSEIAERKDLQKWWAKA

SEQ ID NO: 151432 - protein, 232 aa, Heterodera glycines
  Coding regions on vcDNA: vcDNA=SeqID_77855; Strand=-; Position=1 -433,847-1113
YFDHSVITFLNANKQIFDRIGTKLELCVTNAQQSLDAFSREVLPIFAPTIRHFIFNDVHDLVNLRSLISPTILTNFTRLSFIESICLCPAGVFADDFGGPNATSAGQILSKWLHTPSKDGQPKRMRCSDYLDGSKLAWVNNFKEAFRRATTSVSYNIQITVYKETTPIEQFKLMNERTKEKLTLSKESSENNWMLKRCQNIGKTNQKQQQKKDENLEHLNRVYIRLYENCIG

SEQ ID NO: 151433 - protein, 252 aa, Heterodera glycines
  Coding regions on vcDNA: vcDNA=SeqID_77856; Strand=+; Position=1 -64,112-177,221-304,442-651,697-852,905-973,1024-1133
  Homolog annotation: Hit_ID=NP_014050.1; Match level="QueryCoverage =69%, HitCoverage=15%, E-value=8e-09, Identity=30%"; Hit description =Ymr317wp [Saccharomyces cerevisiae] emb|CAA90835.1| unknown [Saccharomyces cerevisiae] sp|Q04893|YM96_YEA
QKKAKEPLKAMPTQKAEEASTGSEKTGQSVVSVRPPNVPTTAPVASNPPISAEQNIASITLTPSDVKTPAPVYTTFLVTSKTPIKAGQNAASVRPPVPANTSSRTIFECRQIILVLASSKHVKAQGTVSKKPSKASSSHTSLKVPDDLVSAIKSHVPSFLHDLASQITGRMDQSSASAMSSDSESSTEESSSSEMTERTDRSAISVRHSSVKKSVPVPPRPPVKAGQNAVSVRPPNVKTTTPGRLNQQEIIY

SEQ ID NO: 151434 - protein, 131 aa, Heterodera glycines
  Coding regions on vcDNA: vcDNA=SeqID_77857; Strand=+; Position=1 -220,392-484,536-618
MPPKKDHSVVQKPVKTDQSVAYRSTTASSLIIFLRERNRIISAVQKAGPSDLSAVFIQNSLQVSDSDGSRREKVNDPNYETLELIDHGIFMGENTNDTDLKAVGAQNPNYATLRNLDLNIFVRGPTPSKPK

SEQ ID NO: 151435 - protein, 147 aa, Heterodera glycines
  Coding regions on vcDNA: vcDNA=SeqID_77858; Strand=+; Position=1 -126,468-577,622-829
MLLALTSVDTRNALLCAAVPSIGAFVGSTMAIKDQELVQFLKVQVQPFKLTANAVVLAGLSVATSVAFYNIDKISAYWTMPFTLWAIFCAGLTVKANCCAGTNSKLMTNEAASCASEKGTNSKLTNYEAASCASEKSENKNEGSCYV

SEQ ID NO: 151436 - protein, 31 aa, Heterodera glycines
  Coding regions on vcDNA: vcDNA=SeqID_77859; Strand=-; Position=1 -37,316-374
MNKNDSNFGWTKKEFTAKFKLNETLYKGAIY

SEQ ID NO: 151437 - protein, 144 aa, Heterodera glycines
  Coding regions on vcDNA: vcDNA=SeqID_77860; Strand=+; Position=1-437
NHEDGRSERIELEALKVFEEVFCGTLEEFDGLNRELNVDELAKAFEELLCGTLKEFDGFNRELNVDELAKAFEEVLCGNGKVPDELNPAEVLEGFDLKKVFLDWNGLLDEPEAIDGCWSKNANLIGIEPTFCFNVLLLELSGNR

SEQ ID NO: 151438 - protein, 197 aa, Heterodera glycines
  Coding regions on vcDNA: vcDNA=SeqID_77861; Strand=-; Position=1 -217,295-671
MYHQCPPFCASHLFDIICHLCHCAKDGKDKQKGEKIDVEMLKKLMDDNEYLRLSVEQQYSVYKSAKSGNIMSTSYKAHGRTTIETDIFVWWKEVGAQFPDLFLLARIIHSIPATSVSSERLFSKAGLIYGNSLRNRYFRFLISVKPRNLSLSGEMAQKILLIKANMDQLFLAPSTEPDAEGKELEIDYLEINDDDFC

SEQ ID NO: 151439 - protein, 25 aa, Heterodera glycines
  Coding regions on vcDNA: vcDNA=SeqID_77862; Strand=+; Position=1 -63,153-167
MSAIICIKAHEIEKADFPIHLTNFY

SEQ ID NO: 151440 - protein, 438 aa, Heterodera glycines
  Coding regions on vcDNA: vcDNA=SeqID_77863; Strand=+; Position=1 -63,110-190,252-328,488-752,851-1111,1455-1839,1883-2067
  Homolog annotation: Hit_ID=NP_501354.1; Match level="QueryCoverage =85%, HitCoverage=74%, E-value=1e-109, Identity=56%"; Hit description= golgi reassembly stacking protein 2, possibly N-myristoylated (53.7 kD) (4I879) [Caenorhabditis elegans]
MGANESVPIPGGGSEGYHVLRVQENSPGQMAGLEPFFDFIVAIGNTRLDKDNDSLKEILKQNINKPLELTVYNSKTQTVRETQIVPSQNWGGQGVLGVSIRFCSFEGANQNVWHIISVSPNSPAELAGLHANSDYVLGAESVLQQADDLIAFVQANIGKPLKLYVYNVDSDSVREVILTPNGSWGGEGCLGCDIGYGYLHRIPISVDRSKPCGDMQPLLPSHQMEMPKQSSSSLPPPQTGIPQMDQLISSQSYDSGNAAKFELHGLPPHQPTPRQVDEPIGPPSFGQLRETPISAPTPSVMSMVQPQLHSSSLDSVPLSVPPVTHHQHQEQQQPQIQPLHQTPPPPIHTSTYQPYLAYGAPPMHAFQPPQQQQQYQVGCESNVCFAFYVSGAKCATAHSIGTATISCAKSAVFLLPSFISAPTATETDVFKCLLSIST

SEQ ID NO: 151441 - protein, 127 aa, Heterodera glycines
  Coding regions on vcDNA: vcDNA=SeqID_77864; Strand=+; Position=1 -72,496-807
  Homolog annotation: Hit_ID=CAI15554.1; Match level="QueryCoverage =79%, HitCoverage=19%, E-value=6e-39, Identity=74%"; Hit description =OTTHUMP00000045234 [Homo sapiens] dbj|BAD04854.1| SMU-1 [Cricetulus griseus] gb|AAH57446.1| Smu-1 suppress
MSSIEIEAADVVRLVQQYLKENNLIIVELAELRELGSARLILRQTDPMALLKQADPERYTRLENLLAKTYFDPREVYPEGGSKEKRRAAVAQSLSAEVHVVPPSRLLSLLAQALKWQQHQGLLPPVG

SEQ ID NO: 151442 - protein, 159 aa, Heterodera glycines
  Coding regions on vcDNA: vcDNA=SeqID_77865; Strand=+; Position=1 -133,425-571,629-828
  Homolog annotation: Hit_ID=NP_610891.1; Match level="QueryCoverage =91%, HitCoverage=16%, E-value=3e-27, Identity=44%"; Hit description =CG6197-PA [Drosophila melanogaster] gb|AAF58348.1| CG6197-PA [Drosophila melanogaster]
VQSQFWESWKEFEVKHGNEDTIREMLRVKRSVQATYNTNVNYMSAQMMATLGSQTEMAGELSAADSMAQLEARAAQIAQEEALIAAKKVLPATDGRISFVRGEGRTTTEARAENPEEIDIDQIVDDEGGEEEDDENAMDHGDGTAAKSADDGQRETAEA

SEQ ID NO: 151443 - protein, 41 aa, Heterodera glycines
  Coding regions on vcDNA: vcDNA=SeqID_77866; Strand=-; Position=1-125
MEYVLKLRGLTLNYDVINNQGFRYKNSKSNVMLKQERLNQL

SEQ ID NO: 151444 - protein, 68 aa, Heterodera glycines
  Coding regions on vcDNA: vcDNA=SeqID_77867; Strand=-; Position=1 -114,239-331
MAEQSAFQSKLMLLRLKKVTHLPIDTDIKGNGEKEAEFPLTDFTSIMMYLILENIWDNSSIDVMAIED

SEQ ID NO: 151445 - protein, 63 aa, Heterodera glycines; identical to SEQ ID NO: 130392
  Coding regions on vcDNA: vcDNA=SeqID_77868; Strand=+; Position=1 -97,316-410

SEQ ID NO: 151446 - protein, 216 aa, Heterodera glycines
  Coding regions on vcDNA: vcDNA=SeqID_77869; Strand=-; Position=1 -46,675-731,790-1059,1109-1256,1329-1458
MVLQQKINPTEELLGVNRSVQSNGDEGMEMVGMTEIRYEQKQQVAAGGLCCCCIPCGFFKESSHEEPPKIFKFFMTKKKTPQPPPAAEVVQPQNSVPSPPKALPVENYTLNATFTKEAARGYAKMTFKKSKKRAAPTKQPKLVRISIFFAFPLAKFPLLLGFVLQSAQRNFGVGKHQKPSVNGKPCRFVEKQTRNGFSLRKTLTTHLSSAIIFKIV

SEQ ID NO: 151447 - protein, 47 aa, Heterodera glycines
  Coding regions on vcDNA: vcDNA=SeqID_77870; Strand=+; Position=1-144
GIKNDDQLKRNKIRRRMEEQRERRANDEGENWAEGDDDKPPEEQQLY

SEQ ID NO: 151448 - protein, 115 aa, Heterodera glycines
  Coding regions on vcDNA: vcDNA=SeqID_77871; Strand=-; Position=1-348
  Homolog annotation: Hit_ID=CAE66730.1; Match level="QueryCoverage =73%, HitCoverage=74%, E-value=8e-13, Identity=51%"; Hit description =Hypothetical protein CBG12079 [Caenorhabditis briggsae]
IFGNADKILTGKLGRRNGQSDDEKEEEEEKQEAEGEEFVGEENEDEEEEEDRMEALLEELEGTTDEMEEEGEEEELFDSEEEEKRTTEEEEALGGKKGTILLSNNKTTMLPMAKN

SEQ ID NO: 151449 - protein, 229 aa, Heterodera glycines
  Coding regions on vcDNA: vcDNA=SeqID_77872; Strand=+; Position=1-690
  Homolog annotation: Hit_ID=NP_701480.1; Match level="QueryCoverage =79%, HitCoverage=5%, E-value=1e-09, Identity=28%"; Hit description =hypothetical protein PFL0575w [Plasmodium falciparum 3D7] gb|AAN36204.1| hypothetical protein PFL0575w [Pl
MKILLLYFLLFSIFQLNQSESENKKLQQQKSFDEIFGEKWEEKEEEKRNELKKREIIGKFYKIKEKIKQKGRKYSRKEWNKIEEKIAKKLETNRKKIYEWIKELGLNQKIQKSYKRKTDEEKLEIVQKFIGMSNEYKQKERNYSPKEWQKIYAEICKKIGVSLSVIKKWKKQFGMSKFITEKEKLEKMKIYWKIKRENPKMSDKEIAKILKIDRTTISKWKKQFGEELF

SEQ ID NO: 151450 - protein, 84 aa, Heterodera glycines
  Coding regions on vcDNA: vcDNA=SeqID_77873; Strand=+; Position=1-257
KEWHQNYAEICKKIGVSKGTIIKWKKQFGMSKFITQKEKLEKMKIYWKIKRENPKMSDKEIAKILKIDRTTISKWKKQFGEELF

SEQ ID NO: 151451 - protein, 42 aa, Heterodera glycines
  Coding regions on vcDNA: vcDNA=SeqID_77874; Strand=+; Position=1-126
MAPRDDSSNNTNGQPVIQFDQQIRQDPGLNAVFDFVREQGAR

SEQ ID NO: 151452 - protein, 28 aa, Heterodera glycines
  Coding regions on vcDNA: vcDNA=SeqID_77875; Strand=-; Position=1 -64,217-239
MAASSSLFLAVALACLVTSAYTYDSKYV

SEQ ID NO: 151453 - protein, 107 aa, Heterodera glycines
  Coding regions on vcDNA: vcDNA=SeqID_77876; Strand=+; Position=1-324
  Homolog annotation: Hit_ID=E86336; Match level="QueryCoverage=84%, HitCoverage=35%, E-value=2e-15, Identity=41%"; Hit description =hypothetical protein F14O10.11 - Arabidopsis thaliana gb|AAF88160.1| Contains weak similarity to an unknown pr
MGGDEQQQKQRLGEGQKMIETKKEEEIGQKEEEEKKEQSEEKKEEQREEKREEEGEKEENREKEEPKEEEEKEAQKEQWEERQQKRRFVKQRKCQNSVPLANWAFNI

SEQ ID NO: 151454 - protein, 121 aa, Heterodera glycines
  Coding regions on vcDNA: vcDNA=SeqID_77877; Strand=+; Position=1 -98,148-316,391-486
  Homolog annotation: Hit_ID=CAG13118.1; Match level="QueryCoverage =100%, HitCoverage=22%, E-value=3e-24, Identity=47%"; Hit description= unnamed protein product [Tetraodon nigroviridis]
MSAPGSLACAKMLYPETEQSQLVNVDELELPAGEESSALECISNGAIMAVELVLAIVANIIVFLALLALLNSVLSWLGHLVGQSDWTFELILGYLFFPLAFVMGITNPEETFRVAQLMGTK

SEQ ID NO: 151455 - protein, 167 aa, Heterodera glycines
  Coding regions on vcDNA: vcDNA=SeqID_77878; Strand=-; Position=1 -89,154-309,390-648
MTSAGFLQILRLLLAVSLLVTCCHGQKERKPKTGTTKTSTTTTTTTTTTTTTLPKMTTPNNTAANGGGGSGNTLLFILLGVGVFVALAVAVVVAVVVWRRRQARTDSYAVDGGDAAKGAPAAAGANGAKKDAAKGGSSSSQTASVEKFSAVSSVPSSLKSTTAEDKK

SEQ ID NO: 151456 - protein, 213 aa, Heterodera glycines
  Coding regions on vcDNA: vcDNA=SeqID_77879; Strand=+; Position=1-642
  Homolog annotation: Hit_ID=Q16992; Match level="QueryCoverage=95%, HitCoverage=35%, E-value=7e-10, Identity=27%"; Hit description =LWamide neuropeptides precursor [Contains: LWamide I; Metamorphosin A (LWamide II) (MMA); LWamide III; LWamide
MVRVERDREFGQNRDLGGPGIWAKPRPRRTGNLGKTETSEDREFGQNRDLGGPGIWAKPGPRRTGNLGKTETSEDREFGQNRDLGGPGIWAKPGPRRTGNLGKTGTSEDREFGQNRDLGGPGIWAKPGPRRTGNLGKTGTSEDREFGQNRDLGGPGIWAKPGPRRTGNLGKTGTSEDREFGQNRDLGGPGIWAKPGPRRTGNSRPGPAQLYLW

SEQ ID NO: 151457 - protein, 176 aa, Heterodera glycines
  Coding regions on vcDNA: vcDNA=SeqID_77880; Strand=-; Position=1 -219,1187-1405,1453-1544
MAADTENEVLAACPQIVFAKLLYVDNCRFLFADHLDGVSALPEAQLRTKLAKIQWPTRTFWNIDRQRRLTENGSLEAAELAFLLQHNKRRRTTLIAPNDDHNEDDDDDNYAVATFRFLLDERHTLDQFLCQFSLMIDEMPQTEAEMLQISSTKFDIDEKWAQHLANALTERRFAMT

SEQ ID NO: 151458 - protein, 126 aa, Heterodera glycines
  Coding regions on vcDNA: vcDNA=SeqID_77881; Strand=+; Position=1 -152,355-376,703-909
MSPVGVAAVPSLLYCSKLMAQRRPWTNRMPSAPISSRVPINGWPMGTKLCGFRYGLDVVLKYLFTLYVGAFKAMNGCPAADFGQSVHIEHRHGTRLRQVIFDQIQREIVAADQQRLDGRIWPENVP

SEQ ID NO: 151459 - protein, 33 aa, Heterodera glycines
  Coding regions on vcDNA: vcDNA=SeqID_77882; Strand=-; Position=1-98
AVGSLPPQAPQIVPSSCRRPQFGRLPDRKTAHL

SEQ ID NO: 151460 - protein, 97 aa, Heterodera glycines
  Coding regions on vcDNA: vcDNA=SeqID_77883; Strand=-; Position=1-294
MKKVIPYPTPTSGVQPFELKREGPTDGVRSIHMYFVAFFAFKALDGSVPKAFGHFRSGSVTLQGLVSAKIFFRILQLQTERYQMIYMSAILASGAYD

SEQ ID NO: 151461 - protein, 263 aa, Heterodera glycines
  misc_feature (251)..(251): Xaa can be any naturally occurring amino acid
  misc_feature (257)..(257): Xaa can be any naturally occurring amino acid
  Coding regions on vcDNA: vcDNA=SeqID_77884; Strand=+; Position=1 -121,626-777,822-923,982-1101,1156-1345
  Homolog annotation: Hit_ID=CAC80545.1; Match level="QueryCoverage =92%, HitCoverage=18%, E-value=5e-84, Identity=69%"; Hit description =putative Na-K-Cl cotransporter [Meloidogyne incognita]
FFFLRPYMRKQSIQNKFTAKLGGLALFKDEDEDDISMAAGGASFISAYTTPGPKERATSAKKKANLGVMFGVYLPTIQHILGVTMFIRLFWVVGVAGIWVVGVAGIWHTMLLLLLCCACTLLTSISLSAVATNGVVESGGAYFMISRGVVESGGAYFMISRNLGAEFGSAIGILFYLANTVATSMYLVGGVEVFLLYIYPGMTVGGVEVFLLYIYPGMTIGGEAVHSDVCKYEMDLNRFKIYGKIFIFLCXIKFILXYFILFI

SEQ ID NO: 151462 - protein, 367 aa, Heterodera glycines
  Coding regions on vcDNA: vcDNA=SeqID_77885; Strand=+; Position=1 -32,135-304,646-747,822-966,1021-1129,1180-1206,1659-1770,1998 -2134,2239-2445
  Homolog annotation: Hit_ID=CAC80545.1; Match level="QueryCoverage =97%, HitCoverage=31%, E-value=1e-153, Identity=76%"; Hit description= putative Na-K-Cl cotransporter [Meloidogyne incognita]
SDSMFGMMSHNYRIYGTILLLLECVIVALGVRFVQLLAPVSLLCVILSILACFAGGIEKAVVGDGQHVCMLEDHLLNSRILNLPPGEDILNICNYCKKGDHIADQFCEGNTTTEVCQTYTGGSLKCVNAFPGFNSALMHANMNPKYMQAGQAVEREPKADRSGQAVEREPKADRSREVFQDVSTSFFLLLAIYFPAVTGIMTGTNMSGIMTGTNMSGDLKDPQRSIPSGTITATLTTSFIYYALAILFGASIIGPVLRDKNGKSIDGSLVVASLSWPSPWVVIVGSFLSTFGAALQCLCSAPRLLQSIAKDNVIPMLAPFARVTKNNEPFLLLITTVIAELAILLGGIEFFRFFIIPFTFRITFFLN

SEQ ID NO: 151463 - protein, 42 aa, Heterodera glycines
  Coding regions on vcDNA: vcDNA=SeqID_77886; Strand=+; Position=1 -82,244-289
TRTAPELFPRISESSFCKRRDEAVIVKKSNLSFLKIKMKRKF

SEQ ID NO: 151464 - protein, 79 aa, Heterodera glycines
  Coding regions on vcDNA: vcDNA=SeqID_77887; Strand=-; Position=1 -52,384-571
MRHKRQKFANSILHMKYEFDYLSNNWPEIFEKNSKWDLPGTEKPGQEKTEPEKLGSEKPAPKSRDRLEAGTEKSGPEKL

SEQ ID NO: 151465 - protein, 401 aa, Heterodera glycines
  Coding regions on vcDNA: vcDNA=SeqID_77888; Strand=+; Position=1 -105,187-299,341-406,502-700,821-897,1001-1030,1106-1295,1531 -1679,1727-1774,1829-1891
  Homolog annotation: Hit_ID=NP_872147.1; Match level="QueryCoverage =93%, HitCoverage=33%, E-value=1e-57, Identity=34%"; Hit description =cation transporting ATPase, N-terminal and E1-E2 ATPase-associated region and haloacid dehalogenase-like
AGQRRGKVAATRQSQFGKETDKTENERKKKMAINGSYVEHHLSYVEHHLTLDELRDVHPDSFIDVTSPEKSDGLSSEEAKKRLLDGGANVLAPPKKRLLDGGANVLAPPKRISNLQFNNYLSGAALCTIFTYFINLYHGTEELLNLYCAFILIVIVVVMSFMSFWQERKAIQVKKRRTELEIRNCSVIRDCEEKSLQPDNLVVGDVIIIRSGQQVPADIRILQSTGVKIESSAITGEPQPVDYTHEPAAAHISLFDARNVALRGCYCTEGEAVGLVIRAGKYTMLGNFTHLQSTVKLTETLLQKEIAKFVQFVSIVALSMGVIFFLIGCIVTKFENVLYHFVTGFLFENVLYHFVTGFLIIIVANVPQGLPAMLISQMAIIVANVPQGLPAMLISQMAIIA

SEQ ID NO: 151466 - protein, 399 aa, Heterodera glycines
  Coding regions on vcDNA: vcDNA=SeqID_77889; Strand=+; Position=1-1199
  Homolog annotation: Hit_ID=CAA82797.1; Match level="QueryCoverage =80%, HitCoverage=49%, E-value=1e-21, Identity=26%"; Hit description =gag protein [Ascaris lumbricoides]
MSGPIQKGIINALKALDNAKSATSLILHPDPDLSNWENAVNLEAQFDRVVKEIRTMEMQMDSLRDSSNAWIELLARLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQAPRTPNQRSRRPNQPMALRDMTFIASSLDEGHRHQ

SEQ ID NO: 151467 - protein, 43 aa, Heterodera glycines; identical to SEQ ID NO: 131356
  Coding regions on vcDNA: vcDNA=SeqID_77890; Strand=+; Position=1-505

SEQ ID NO: 151468 - protein, 120 aa, Heterodera glycines
  Coding regions on vcDNA: vcDNA=SeqID_77891; Strand=+; Position=1 -244,441-491,542-610
FDGADELCRPIDGTPFHEHCRHSAVVKHKGFVPRHLRSPWLNSPLFDDNELSSGENTCYACYKGTKASNGMAPGEEYCACTMPGCGNKYYDHVKHCAMVNFYENEPDKNPKEDPPNERRN

SEQ ID NO: 151469 - protein, 60 aa, Heterodera glycines
  Coding regions on vcDNA: vcDNA=SeqID_77892; Strand=-; Position=1-267
SHLSQCVHQRRDGIPGLDHPMGPFLREFMSSFPMFPISPSALPNCPVPTPARPPRTAALL

SEQ ID NO: 151470 - protein, 33 aa, Heterodera glycines
  Coding regions on vcDNA: vcDNA=SeqID_77893; Strand=+; Position=1 -64,396-433
MRLFNCPNAIGEKVAKQLLRALSKSKHPLMGTV

SEQ ID NO: 151471 - protein, 1227 aa, Heterodera glycines
  Coding regions on vcDNA: vcDNA=SeqID_77894; Strand=-; Position=1 -714,813-3782
  Homolog annotation: Hit_ID=NP_508324.1; Match level="QueryCoverage =46%, HitCoverage=21%, E-value=3e-32, Identity=24%"; Hit description =predicted CDS, peptidase family A16 and RNA-directed DNA polymerase and Integrase, catalytic domain and Z
MDEILPLRPVDFLQPEVQINWDTNGEEFDPSDRNLSSHQKLVALFQATKESHEFFWEMWQKEYLLLLRERGKWDHKSPRLQDKTEPKEGMIVLIHEEFTPRNQWSLGKIIELNGRPGAIRSVQLELPIHGIKSKRYGTMPRKIIITRPVNKIFPLEVGLDNPIENEEKFEESSNETPQITNEKEISHLEAPMDEKETETLQLVDQPIDQNRHGMITRSKAKMGTVLNCLSILFAMFALLCCAENCYIHENVKKLTYELPKEILLNDFKCEGHFWMDSKHMFKKDILCPAVDECELIECYFCIEQLANPTCYPLISSMLAGGLCLSFMSISFVAFSILKVLFSGLYMVIWLIIQFIRPIIYLAGPNRPPKERRPRATASQNWTSRRVYRTMAFVVLMANSLQDLTGAETIAVMAKSEKCIKNATSMRCIVENSATLTLLPVGQTNTLLLKTEEGVLLGSINVVLKALALECQSFTKAWLRSYAINVLAGKRCPKMGSCEGKYCGEVRHNTSIPELKDANDYPGNSFCLDSTAFWGNKCLLGGSACLFYRWFARKKSKTVYEIMGCNSWEFIVYTIIRLETLGEKPKSTQVFLYPGRTLRWNNISLTPIGVTFPPAPVLNSDFVFDGSNMALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCYRCSTGAQFRYVCSTNFGNSLAEINCDDGTHFSTKCDSNASIYQTILAFDKARIETKCQTKCLAGNTSFVLRGTLHYVQPEQIEDYSPNHSERVINSQSSWPNWNFDWKATLWSLIGLQSSLIFIMIICVGIVCLTIFMKLSPFYRLWKFISWSITRKGYGNVPIVLAILYLAGGGSFGCGVESRPILSAVKKFCESSLVVGNDSSLPSNGGIKGWRICHPNTLFKSSFHGMPIPIREGPYFSASRVVIPENAEILNDRLFGDENPHRDPWFEEDWEPVLPLVPDHVDRRLRDPRLEEEEEERANDAHLRRERRVHGRIEPLSSWIERYHEPRWYETALDRRAVEERLRGELREGATLFSEHVGPIRDIHFDGFTCYGPENLYLFRGRSVMDHYQRMGHEIDPFMPCLQEYVGFSPHEGGMLVDLYLVELVNIRNRVGVAWRAPAVVEEPHLPPPDQAQLPDGRLENRPPRVARRLQMNRR

SEQ ID NO: 151472 - protein, 211 aa, Heterodera glycines
  Coding regions on vcDNA: vcDNA=SeqID_77895; Strand=+; Position=1-633
  Homolog annotation: Hit_ID=NP_504186.1; Match level="QueryCoverage =100%, HitCoverage=25%, E-value=4e-12, Identity=24%"; Hit description= vglm uuk m polyprotein like family member (5E780) [Caenorhabditis elegans] gb|AAB63927.1| Hypothetical p
CLLGGSACLFYRWFARKKSKTVYEIMGCNSWEFIVYTIIRLETLGEKPKSTQVFLYPGRTLRWNNISLTPIGVTFPPAPVLNSDFVFDGSNMALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 151473 - protein, 29 aa, Heterodera glycines
  Coding regions on vcDNA: vcDNA=SeqID_77896; Strand=+; Position=1 -42,1176-1223
MDLKCFIHLPCGLVLGCSINKKPKGTTIN

SEQ ID NO: 151474 - protein, 37 aa, Heterodera glycines
  Coding regions on vcDNA: vcDNA=SeqID_77897; Strand=+; Position=1 -67,613-659
MSPFRFLMMLLVALVAAMAMGSGVAEQLRTCVKNDLE

SEQ ID NO: 151475 - protein, 27 aa, Heterodera glycines
  Coding regions on vcDNA: vcDNA=SeqID_77898; Strand=+; Position=1 -72,127-138
MTYKTEQIQNFQQFLQKKEKQWTKRST

SEQ ID NO: 151476 - protein, 96 aa, Heterodera glycines
  Coding regions on vcDNA: vcDNA=SeqID_77899; Strand=+; Position=1 -51,99-122,535-636,1221-1334
  Homolog annotation: Hit_ID=CAE74019.1; Match level="QueryCoverage =63%, HitCoverage=16%, E-value=9e-09, Identity=40%"; Hit description =Hypothetical protein CBG21667 [Caenorhabditis briggsae]
RDPAVINLKWVLQMISARLAATSAQRFMVDIVPELSFIFKSNAFKAGDHCQRLEEFDRKKAVPPVAHFLHPHLLLPQKPRKRKKRTTFHADLYENK

SEQ ID NO: 151477 - protein, 123 aa, Heterodera glycines
  Coding regions on vcDNA: vcDNA=SeqID_77900; Strand=-; Position=1 -88,530-780,1077-1109
MRLGRVRPGARPFAKPMLRPALRFQVLRKTLEIFVETLSFFSLHRCVDSMKRLAYMYCKRIYLKVKPAQLIQIDDCEKAAKSCDCGWYSCIPHPGQSSTPCCAEHYNFTCCVKANRASERAFE

SEQ ID NO: 151478 - protein, 192 aa, Heterodera glycines
  Coding regions on vcDNA: vcDNA=SeqID_77901; Strand=-; Position=1 -94,188-331,459-799
MVNLVDFDKSYGQFFVENFHLMVFYLICPTNGGPNSRDKRQGEPGGNTGGDGKKTDGKGGKNPKKAGKGKGGDGASFSLGDASVFLPDGKLGDTMCNYHLSKGKSMLLGPFENAPFIGTAFDFVVSAALPQMPHSGDENDKDKLAGPMCKADHGCDWGKCHPSAGKTASTCCADGFVFICCKDVGGDKDTCG

SEQ ID NO: 151479 - protein, 125 aa, Heterodera glycines
  Coding regions on vcDNA: vcDNA=SeqID_77902; Strand=-; Position=1 -136,190-431
MAKINSLSTFSLLIALISALDSAVVRQQRAADAAASKPEPNNEKPGTVDSDKAKPDKSQGADTEEKDPEKPKESQEVEEDGPDPKKPKESQEVEEDGPDPEDPNKQESQEVEDTGNDPENPKILN

SEQ ID NO: 151480 - protein, 37 aa, Heterodera glycines
  Coding regions on vcDNA: vcDNA=SeqID_77903; Strand=+; Position=1 -97,274-290
MTKDCIPGMTSEQGFTQLDFNYGNPSSIKLVKKALLK

SEQ ID NO: 151481 - protein, 15 aa, Heterodera glycines
  Coding regions on vcDNA: vcDNA=SeqID_77904; Strand=-; Position=1-8,70- 109
MSDVCTRDGMKFRQF

SEQ ID NO: 151482 - protein, 47 aa, Heterodera glycines
  Coding regions on vcDNA: vcDNA=SeqID_77905; Strand=+; Position=1 -77,298-364
MGFMIANVFIFVLTSSFYDHSVNAERDLKLVEMDVTFVISDPHDPRE

SEQ ID NO: 151483 - protein, 23 aa, Heterodera glycines
  Coding regions on vcDNA: vcDNA=SeqID_77906; Strand=+; Position=1 -21,202-252
MQIVWITRVSAFLCQTFDSKIFR

SEQ ID NO: 151484 - protein, 99 aa, Heterodera glycines
  Coding regions on vcDNA: vcDNA=SeqID_77907; Strand=-; Position=1 -40,132-199,319-402,564-623,1204-1251
MKMRHASAKQSIMTATQRVAGNKQADCDAENRICWNKSPPKPDNNCPFNTTYVFVPSEGYEKMQEKACKKQKKTFKQIPADDELCRQMPQLIHDAIPFP

SEQ ID NO: 151485 - protein, 43 aa, Heterodera glycines
  Coding regions on vcDNA: vcDNA=SeqID_77908; Strand=+; Position=1 -30,176-277
MNSKTAENQKVNGRPNGKSKKINRPKRNAIGKENIEPNGDTNR

SEQ ID NO: 151486 - protein, 52 aa, Heterodera glycines
  Coding regions on vcDNA: vcDNA=SeqID_77909; Strand=-; Position=1 -22,105-241
MATRHFLAHGGYIMRNWSTNARAVVQPLIIAFLSRFAAYQNSFKIDLAMMSV

SEQ ID NO: 151487 - protein, 123 aa, Heterodera glycines
  Coding regions on vcDNA: vcDNA=SeqID_77910; Strand=+; Position=1 -93,147-423
MSTTDGVFTQFYKAMTVKNGGWRSSKCLKEGPPPHSLFEQGMPPQLYDTAYVPKRRRDKPYEKRVGTFVFPLDIIEPCRSLLPDAVHADGVTGRAVKKRKTEEWTEGGVAWKERGNESKSERK

SEQ ID NO: 151488 - protein, 250 aa, Heterodera glycines
  Coding regions on vcDNA: vcDNA=SeqID_77911; Strand=+; Position=1 -249,294-499,547-673,718-886
  Homolog annotation: Hit_ID=XP_422593.1; Match level="QueryCoverage =99%, HitCoverage=17%, E-value=3e-15, Identity=27%"; Hit description =PREDICTED: similar to RIKEN cDNA 2610101N10 [Gallus gallus]
MDIDGEPMADTGKKYNPSEENIGIFAGREDIDGIPMDGAEEAAAEEDIDGVPMEEGEAAMSKSEATKVNLESDDRFTVRSWNTVEIEAGTTADTNLAVGGEIGSGSDVKSKWESIDLHSRWERHEGVAREFVQQQQREDEDGENSPRRKRHRLSRLSPDDEHSKPNGATAADSVTSSAVSTDDEDRRRILREIEVKVMKLQDQLETEGEMPSSEINAELAKYRQRLMAKLDEKTTKTKGERKKATEQKEN

SEQ ID NO: 151489 - protein, 230 aa, Heterodera glycines
  Coding regions on vcDNA: vcDNA=SeqID_77912; Strand=-; Position=1-693
SNATAIFTNSGTKSEVESKRTSEFCATKSGHRPSFRQKWKKVEWTPKNIPPNVENQIIRNCDEKGHKKFSPKEQLGKNFEVRKGGGENSEKCGRIFLGKKSEVQLGTIEILEGGEELKRKRMNLDRKNQQEKVRLNVSSGGSQSNFGENGKNLNSFRRKCVFWPMRAEADQMSRETLPFDRGWVELTASCPDSTSTSADRQPMMRGLRCNGSELIPNGPHLSTAGCGMCS

SEQ ID NO: 151490 - protein, 32 aa, Heterodera glycines
  Coding regions on vcDNA: vcDNA=SeqID_77913; Strand=-; Position=1-98
PLDPGLEEPGFFLDLDFCPGNQGPGPTWNPGP

SEQ ID NO: 151491 - protein, 25 aa, Heterodera glycines
  Coding regions on vcDNA: vcDNA=SeqID_77914; Strand=+; Position=1 -75,151-153
MNGVGQRNGATFAKAFALCELARPQ

SEQ ID NO: 151492 - protein, 105 aa, Heterodera glycines
  Coding regions on vcDNA: vcDNA=SeqID_77915; Strand=-; Position=1-315
MPWQMSPRFSVQLRSLWTGPSSPLLQPTPILCAVSDDRQQQQQQPQQRSLSSCSPTHFGNKQSPHLPPDEQPNFISRAEFDQYKEEQERKLAALQDELKELRDKM

SEQ ID NO: 151493 - protein, 18 aa, Heterodera glycines
  Coding regions on vcDNA: vcDNA=SeqID_77916; Strand=-; Position=1 -4,373-425
MVSHRANDFLANLFVLSI

SEQ ID NO: 151494 - protein, 627 aa, Heterodera glycines
  Coding regions on vcDNA: vcDNA=SeqID_77917; Strand=+; Position=1 -355,398-600,641-803,844-959,1062-1235,1285-1500,1541-1771,1812 -1916,1956-2276
  Homolog annotation: Hit_ID=AAL93203.1; Match level="QueryCoverage =97%, HitCoverage=98%, E-value=3e-46, Identity=24%"; Hit description =transposase [Bactrocera dorsalis]
MSNLNPGNWWYYFERQGKSTAKCKADGCSYSKTLNASLSTTVLASHLKNHHPQLYKQREDFVQEEKQKTEKKGQSGINPLKRAFANAFCGSSQQITDDEEKEEPISSKSPILIGLNAKSQWSTDGDATIGANRALMEMLATQLLPFNLVDGVGFRQFVGKLQPKYKIPRRNHFAQYELPNCFKAMKKIVTDELLPVNKIALTADGWTSKDNRHSLISVTGHFLDQKFKPKFFVLSTKPIRGRHTAEAIVSFIREALNDFQIQEEKISALTRDTENTMKKCIKEGLRSIEEEERLKNLLENVKRFVRKVRKSRVLTEQLAELQQKEEVPPTVLIKNVEVRWNSSYKMIERFIRNRSAVNLLSIEHYQLPKFNADDWLLLSSISVLSPIYEATVLLQDRNSSCSTIIPLFKAISFGLREDKDNRFSNIKKTIANAIELRLKQAEEQKNLVLATILDPRFKTIYLDSSRLNQYKDWLISEVESYHAKTDEIDLQNDVRDCSGSSSGDIFSRFEKDAEFDQLINNATSPSPSALETRQKAEVEVNEYLRDQKIKSRADPSLYWEINSQKWPMIGAVVRKFLSPPATSSETERLFSTAGLISDDLRKSLLPENLAKLLFLHHNLLLTGFSIE

SEQ ID NO: 151495 - protein, 91 aa, Heterodera glycines
  Coding regions on vcDNA: vcDNA=SeqID_77918; Strand=+; Position=1-276
MEHDLTSYSATNRGQTRTVMELLELLDKFPGSIRIISLYAGQAAQIGIELKERGLESKIASMASDAMQAHDADLTIIIATVSRHLDRLAAI

SEQ ID NO: 151496 - protein, 232 aa, Heterodera glycines
  Coding regions on vcDNA: vcDNA=SeqID_77919; Strand=+; Position=1 -178,494-527,950-1130,1357-1662
  Homolog annotation: Hit_ID=AAS47831.1; Match level="QueryCoverage =59%, HitCoverage=46%, E-value=2e-14, Identity=32%"; Hit description =metalloprotease IV [Ostertagia ostertagi]
MLREMEEEREEDEAQEIVLVEEGTARRRRRRRQAQTGHDFPHNQWDPARPVSFVFDAKIVKWEKFFTKESNPQMAGQFVKQSNENNDNFGVKYDYGSVRGKSEFKANLIDQIMHYSDTDSATSRVTMLAKEMNLYYKCTDKCKLSGAQCQNGGYRWEKCQINAEIPLSSPVPLDSHPRNCSKCLCPSGFGAFDCSGRGPPENGAPADCGETVQVKEKPSAKGKGVAGQHLGP

SEQ ID NO: 151497 - protein, 177 aa, Heterodera glycines
  Coding regions on vcDNA: vcDNA=SeqID_77920; Strand=+; Position=1 -200,244-352,488-649,1105-1167
  Homolog annotation: Hit_ID=CAE58355.1; Match level="QueryCoverage =99%, HitCoverage=100%, E-value=2e-59, Identity=53%"; Hit description= Hypothetical protein CBG01476 [Caenorhabditis briggsae]
MQRIFGSSKPKAPPPNLADAITTIDARGESVEKKIEKLDGELVKLRVQLKKMRDGPAKNMVTQKAFRIMKQKRIFENQRDQLAAQSFNMEQSNFAIQGMKDNQVTVAAMKEGLKSMKQEYKKLDIDKIDTLQDEMEEMLEMNSEIQDALSRQYDTPDTVTDQGVAVDEFGLPKIPAQ

SEQ ID NO: 151498 - protein, 91 aa, Heterodera glycines
  Coding regions on vcDNA: vcDNA=SeqID_77921; Strand=+; Position=1 -66,931-1140
MFIYLGITKKILCSDRTWRRSMLYAIVRVKRFEPSQLAGSQLGQQMASKMGQQMATHIRQQLATKAGQQMAAEMGKKIGTNLGKNIVKKGT

SEQ ID NO: 151499 - protein, 206 aa, Heterodera glycines
  Coding regions on vcDNA: vcDNA=SeqID_77922; Strand=+; Position=1 -53,404-520,606-791,917-1103,1691-1768
  Homolog annotation: Hit_ID=AAC95573.1; Match level="QueryCoverage =84%, HitCoverage=37%, E-value=2e-16, Identity=30%"; Hit description =orf 48 [Ateline herpesvirus 3] pir||T42963 hypothetical protein 48 - ateline herpesvirus 3 (strain 73) ref
MTKMYLTINTIETIVKLSRTHRKARHGTNTDEESDGTEEGENSGREKNLNNLRNKKRDEEEEEETEGEKEEDGDENDEEDDESDEEEEDDEEEEHRRKRRPPALSDKEEDNRSFDEFNCAPASAPNADKSEVMDNEFEEDKSGGEEEEEEVGRKVENKLIRSNFQFRAPKEKANVDNRPKTSPKRKSKKKTTEEGAYCNNCPTVCI

SEQ ID NO: 151500 - protein, 45 aa, Heterodera glycines
  Coding regions on vcDNA: vcDNA=SeqID_77923; Strand=+; Position=1-254
FRFAYLMKRYWMPSLYWMFLLNGYWEGPANLRKAFGLFSRRPSGK

SEQ ID NO: 151501 - protein, 311 aa, Heterodera glycines
  Coding regions on vcDNA: vcDNA=SeqID_77924; Strand=-; Position=1 -57,102-257,301-386,491-615,746-1257
  Homolog annotation: Hit_ID=NP_505497.1; Match level="QueryCoverage =23%, HitCoverage=26%, E-value=2e-13, Identity=43%"; Hit description =C2H2 type zinc finger containing protein (5K172) [Caenorhabditis elegans] emb|CAA94802.1| Hypothetical pr
MFNCQICISECVANASNSPRFSSFDQLEAHLAADHFSLLPYECEHCQFAKFPTEFAVMKHNELDHDSRNYSFRCRITPEVKEKRSKMREFLTREKHLNERAEKEQFASSPMEVEKKRKAKDGQTKNAQIKGNDGKEEEKPKRMCLRPRPFNSDGNTTAKNFESANETTVVSFGGEEEEDDEDEDMEGEGSSLTDELKEQQAIGDGQTENRTKIQANVQEILRATAAAVSQFGGPKKQIIPPTNKRRSANNVCPFARQFMCAFLPVQSYSLRPNRFKPYALLHNGIPILTDCENDVLQNAEDSPEMEPSPVN

SEQ ID NO: 151502 - protein, 143 aa, Heterodera glycines
  Coding regions on vcDNA: vcDNA=SeqID_77925; Strand=-; Position=1 -195,244-323,373-526
  Homolog annotation: Hit_ID=CAE71758.1; Match level="QueryCoverage =95%, HitCoverage=32%, E-value=5e-28, Identity=43%"; Hit description =Hypothetical protein CBG18748 [Caenorhabditis briggsae]
IEGLPSGTESVLLSPSISSIYFPDGAKKTLEELKNFSTGEAVFTFPSTHIKCAGAPLKICFLAEEILRRKGVRSNCSVHYYTALGRIFGVPKYAASLERIVKERGVGLHPRHNLVKVNPEKHEAEFELLDEKGKGTGQRQIVE

SEQ ID NO: 151503 - protein, 436 aa, Heterodera glycines
  Coding regions on vcDNA: vcDNA=SeqID_77926; Strand=-; Position=1 -520,1320-1644,1692-1959,2253-2450
MALLIMLISIVGTFGCQPSIRASGMDPNLPFREGPRVPCTTECAERGVTNVSGREFNKIEIRCDDGCWATMPKSTDVNYGLPAKKLMHGYPCHDKSWWGSNAPFNTTRRNANRKTGSKTRCYNSWTHASELQLSRGAAGNVANFFIGDEKAGQSPPIAQMNGTGLNRSKKNEGFPFPLALENPGVGPERQRISSSSDSRSRSLADRCQSPASRSSRRDGANSRRRRNQAGQRRKEEPSGAKPSTEGQARSSPLIPPAGEARIAGVSLPPAGASTGGDGSRNPFPQPESRGSVSVSRQPEHPPQETGVKTRFIESRAKSNSRPFGAAQRVGQAPFTTNLVEQLPPVRSCSKGSDKPFTKILSVVPLSKQQIAPPTIGLRATNRSTSDQRARIREANGKLVPLAGGNCSHQQSVYERPIGLRATNEHEFEKLTANWCR

SEQ ID NO: 151504 - protein, 137 aa, Heterodera glycines
  Coding regions on vcDNA: vcDNA=SeqID_77927; Strand=+; Position=1 -68,119-260,409-609
  Homolog annotation: Hit_ID=NP_496566.1; Match level="QueryCoverage =52%, HitCoverage=14%, E-value=3e-11, Identity=47%"; Hit description =ATP-NAD kinase (55.4 kD) (2M349) [Caenorhabditis elegans] emb|CAA19456.1| Hypothetical protein Y17G7B.10b
MEDLRMRHKLQLHYLDTIVEELERHKIEWKIVRRRQYSDALAQWADLIISAGGDGTFLTASKRISDGRKPVRGFSLSYGQIASAGGRSDQTISRGEFKTELPMDASPAHPGDHFEIDGSPRRTVTFLLIHQPAGELT

SEQ ID NO: 151505 - protein, 141 aa, Heterodera glycines
  Coding regions on vcDNA: vcDNA=SeqID_77928; Strand=+; Position=1 -113,168-300,641-728,1012-1100
  Homolog annotation: Hit_ID=NP_496566.1; Match level="QueryCoverage =57%, HitCoverage=26%, E-value=3e-18, Identity=41%"; Hit description =ATP-NAD kinase (55.4 kD) (2M349) [Caenorhabditis elegans] emb|CAA19456.1| Hypothetical protein Y17G7B.10b
MAQCEQMELPRKDSICDDQGDQTDDDEVSNMSKKSKFSSDDEEQLNERADAYINGETSHRLALNEVFIGESHAARVSYYDVQVDNGPLTKQKSSGMTICTGTGSTSWSAILQMAFSVRDPVFNATFPKTLIRGFAHKIFLK

SEQ ID NO: 151506 - protein, 51 aa, Heterodera glycines
  Coding regions on vcDNA: vcDNA=SeqID_77929; Strand=+; Position=1-155
LQIYWLKLHMRYISKFFDSVRRFDKDGFRLAISRSTFGNWSRIFSAITCNH

SEQ ID NO: 151507 - protein, 104 aa, Heterodera glycines
  Coding regions on vcDNA: vcDNA=SeqID_77930; Strand=+; Position=1-315
MALKCHNLFFKCHLWHFEGLLEVAYGLGYVLGPPLGSALFEFGGFGLPLYSVGLSFVVVLVPSIILFSNRRRHYLSIGMCLSIIMGWEGQKMQGYENLATKMPG

SEQ ID NO: 151508 - protein, 99 aa, Heterodera glycines
  Coding regions on vcDNA: vcDNA=SeqID_77931; Strand=-; Position=1-300
MARVPLPCQLTEAFHAEAEAKSERKAVILAAKEAAEGTKARSRGEKRAESRWSGRHCRGFGQRLASIAWGWAVGSVSDLFIFGLPTFFVLLGILIGTLA

SEQ ID NO: 151509 - protein, 238 aa, Heterodera glycines
  Coding regions on vcDNA: vcDNA=SeqID_77932; Strand=+; Position=1 -531,603-790
  Homolog annotation: Hit_ID=CAE71422.1; Match level="QueryCoverage =86%, HitCoverage=41%, E-value=6e-37, Identity=44%"; Hit description =Hypothetical protein CBG18333 [Caenorhabditis briggsae]
PMRKWDPETKTKSHSFVQKIAALSSTSNCNPLFFQRSAAALELHHWLDECMEQYRLLEKERKKTEAELARHHLGKRISSANSLPIPRLPPAPSRVDRLIVDFFREHARVVTLLAKMEQLRGAPMCEEVHRVSGVCPRRFLHSVPPSDPSPIPRLNSHAPAESSQRTHGHSAAIARRKTANLTNALVCVCKAVLRSRSANWCSLAWTVEANGAEQQVQLQRIVASGFELAPPEIKLRPI

SEQ ID NO: 151510 - protein, 492 aa, Heterodera glycines
  Coding regions on vcDNA: vcDNA=SeqID_77933; Strand=+; Position=1 -132,197-478,539-698,904-1055,1106-1222,1284-1572,1792-1911,1961-2028
  Homolog annotation: Hit_ID=CAE56591.1; Match level="QueryCoverage =95%, HitCoverage=13%, E-value=9e-63, Identity=33%"; Hit description =Hypothetical protein CBG24338 [Caenorhabditis briggsae]
LKADFGAETKIAIQSKGANYTDGRMHLVRVIRKDGEVHLQVGTDGDHLSITLTDSEALLGDHLSITLTDSEALLDISESDHFVGGVPPDFPRARFTQDHDIHFDGFFGCIQSVQPNQVAELDLANPERAQRKGTDCTYREGRLSTTERVIGFKNNGGFLKSRGILLDTSSTFSFNLRSRRENAVLFYQSKELHRQKRHKRHGEGDGGSFLAIYLLDGRLSFHLGFESQHSSKRPLVVSSHRYNDGLLHSVFLSRLGKEVQVRIDDREVLVQVRIDDREVLATVLDDDRPIGGIGWAMLIGGFPARLKDPTSNSITSAFCPTSNSITSAFCFGSLSQILLRWLPVLLEAHRGAVLGSCPFEGGDLRTPWSSGGGGGTFATSPSSSLSDELSSDESPLSMDVPMDEAKEEQQMEENVNCWPKMASMRNGVHFGLGDYSHSRLNFESPFPTMTTITFEMRSKKRGIDGLLWTWITFEMRSKKRGIDGLLWTWANY

SEQ ID NO: 151511 - protein, 91 aa, Heterodera glycines
  Coding regions on vcDNA: vcDNA=SeqID_77934; Strand=-; Position=1-276
MANSALKPSRERVKREWERRRRTWPQWPGQMINGGSEEDEEEREEEERDGGEEREEEEREDRERDSFDGVEPSKRKSKWTRHLTRWMDSDS

SEQ ID NO: 151512 - protein, 198 aa, Heterodera glycines
  Coding regions on vcDNA: vcDNA=SeqID_77935; Strand=+; Position=1 -210,434-718,799-897
  Homolog annotation: Hit_ID=CAE68470.1; Match level="QueryCoverage =91%, HitCoverage=79%, E-value=6e-09, Identity=26%"; Hit description =Hypothetical protein CBG14269 [Caenorhabditis briggsae]
VSGVVLFSFALWLQFDPAREFLLRLVHFSESTPFFEIAVYLMLGTSLFIFIAVGIGFSGIWKLERCLLSGFPDDTVMTEYLSKMAQHHYHRDKWVNSAIHTNAFPQNVILGDTSDGFHPILCKFCLSISKHIFMHSTNVAEETVRKTIRSHFGTKRTPKWECQQTAQDARAWHLQPIDSMCNQYKYGSRPFNDSVNWT

SEQ ID NO: 151513 - protein, 136 aa, Heterodera glycines
  Coding regions on vcDNA: vcDNA=SeqID_77936; Strand=-; Position=1 -104,146-298,825-978
MTVTSNTEFRLIECVPILEEVAREFGCITPLPNLGSHRDYRVSGCMMIRTLTSLNRLYIFDAEDCIEVNGKYVSYFIAILGEGFLRLTIRLHGNLEHLGNPSAGYVPLKYLFVAGFSKRSLSMNLLSITNSSLSQE

SEQ ID NO: 151514 - protein, 92 aa, Heterodera glycines
  Coding regions on vcDNA: vcDNA=SeqID_77937; Strand=-; Position=1-278
TLKCFSTILAHPIPSTIAFIHPIMNAKIIRVPKIACDLSLAKNGVSKNRNYAQKASQTILTLPIPSTIAFIHPIMSAKIIRVPKIACDLSLE

SEQ ID NO: 151515 - protein, 47 aa, Heterodera glycines
  Coding regions on vcDNA: vcDNA=SeqID_77938; Strand=+; Position=1 -41,605-707
MSGSEPVSNEILNNTFCADYGNTRIGNKQDRLESASHWQIGRLMARN

SEQ ID NO: 151516 - protein, 409 aa, Heterodera glycines
  Coding regions on vcDNA: vcDNA=SeqID_77939; Strand=-; Position=1 -24,1976-3226
  Homolog annotation: Hit_ID=NP_502721.1; Match level="QueryCoverage =97%, HitCoverage=30%, E-value=4e-75, Identity=39%"; Hit description =endonuclease/exonuclease/phosphatase family and RNA-directed DNA polymerase (4O953) [Caenorhabditis elega
DRLQKPDSKKAISKGRNSIYKYIQKFNVNPFEIPNLIYENKCYHNSAEKCELFATLFANSFNNSETDPSNPCLECFISDINFNIIETQNLLKKLPNKNGTSPDNISYKILKICHSSLSTVITDLFRISLDTGSLPDIWKESIVFPLFKKGDKNNPENYRPISLTCSLCRVMERILSKDIYKLKNKKISEFQFGFVRNRSTTSQLITVVEDWYEAIINKNVDCIYIDFQKAFDSVPHELLLYKLEKIGIRGKLLMWIKDFLSNRTCVKIGDDLSSSKKVTSGVPQGSVLGPLLFLIYINDLPDALPSGVRIKLYADDVKLSRVDTEIMHKALHNLSEWANKWQIRISIKKTFVLYLGNKNPKEIYKIDGNIINVVDTIRDLGINIDNKLQFSNHVAQIIKNHIRMRSLFR

SEQ ID NO: 151517 - protein, 414 aa, Heterodera glycines
  Coding regions on vcDNA: vcDNA=SeqID_77940; Strand=+; Position=1 -711,762-1292
MDNHPRKRFTNFSIDHILSEPKKPRQSLLINEHGIVHFQAEGASKVVKDYVKKLEKNIEHMAKFHYVKVKSKFIITDLPSTPEAMWTWTFKHYIEEAFADSRERNIEPTHLGCMISSPMLEGGDIPTPVRQMTNNTLDTILNQFKKVAQSKQQKNVSLWGEPFTVTITTLDRNGLPSKRRVNGGARRPIKTAVHHRINDQCLIKIRNNDNQYCLFYALQATMVAKTCNWPRWKFFDYLMQQVNAPMDLVGYDADTFVPQVVDYWNNAQRQHRFAVFIFGSLGQYKPIYKYIDNTYDTPLLLYFNEDHFDGVQKQGGLFGKPYCLECERPYDKMSTHNKTCKARCMLCSRVGPLFPCPSSAGFIKKCKECNKKFTNNGCYQHHLLSGFCKRSKKCKDCGAVWDVVNNTQKGRKGH

SEQ ID NO: 151518 - protein, 59 aa, Heterodera glycines
  Coding regions on vcDNA: vcDNA=SeqID_77941; Strand=+; Position=1-253
KLMIYLYKLLLKLSVRVIDDDDSSIHPSFLSLSGKCYSFCRLNVSLTHCLSLIMPMARS

SEQ ID NO: 151519 - protein, 156 aa, Heterodera glycines
  Coding regions on vcDNA: vcDNA=SeqID_77942; Strand=-; Position=1 -109,448-562,732-798,846-1022
MVHGFQKRRNLLKHSCTRCEKTIGFNVIYVKCTRCKGDFCPDSRPMVPPLVIFCTYFLDHCKTYMPYRDLYQIEGSPAEVEAVTKQFLAPNKSYPKLDAFPPAVISACVNKFLMQIRDPLIPYSYGKEICALLDRCLAIDGPILEGFAGIVEDVPV

SEQ ID NO: 151520 - protein, 21 aa, Heterodera glycines
  Coding regions on vcDNA: vcDNA=SeqID_77943; Strand=-; Position=1-64
MTSQPIRVLVTGAGWTNWLFS

SEQ ID NO: 151521 - protein, 653 aa, Heterodera glycines
  misc_feature (111)..(112): Xaa can be any naturally occurring amino acid
  misc_feature (216)..(216): Xaa can be any naturally occurring amino acid
  misc_feature (397)..(397): Xaa can be any naturally occurring amino acid
  misc_feature (403)..(403): Xaa can be any naturally occurring amino acid
  Coding regions on vcDNA: vcDNA=SeqID_77944; Strand=+; Position=1 -1882,2438-2548,2723-2749
  Homolog annotation: Hit_ID=NP_510671.1; Match level="QueryCoverage =99%, HitCoverage=68%, E-value=4e-99, Identity=34%"; Hit description =predicted CDS, endonuclease/exonuclease/phosphatase family and RNA -directed DNA polymerase (XR69) [Caenor
RIALLYRPPNTSASLTKKILNIICNYLEEFIIMGDFNLNAKDITWTEHLLLNRKRDFCEFFNKYGLFLMMNGPTRGSAWLDLIFSSSPDFVNNVLIDIFSSDHLTTNFSQXXNTNTFTVRNYNSTKLNLLNKLIFNFTLQITQKFTIEDKFNHFYHLFREYVELYLPKITVGQTRKPNYPLSLKLSIKEKARLYKLQKINRDKYKHLYAYKNSNKXLFSKNENNFLNKGKNAIYKYINKFTKNFEQIHSINYENQTIFDDYLKAEIFANIFQESFSNSDVPQISSCPSQGPFITDVEFNANEISNILKSLPNRESTSPDEISFKILRNCHLTLSPVISELFRISMDTGKIPEIWKKSIVIPLSKKGDRNDPHNYRPISLTCCLCRVMEKIIAKKHLXLPSSEXFISEHQFGFVKHRSTNTQLITVLEDWYDSIYGKKNIDCIYVDFRKAFDSLPINILINKLHNIGIKGKLLSWFSEFLRDRSYRVKINNKSSNLHPIQSGVPQGSVLGPLLFLIYINDLPQVIPSGVSIKLFADDVKIYGDERSKLNIALENIGKWANAFGLNISQNKTFILFIGKNNSKQYKLFNNIIINEVESISDLGILIDNKLRFSNHYTKITKAGLFKDSQYGQNFKIPSNGENFFLFNCYFNSLYF

SEQ ID NO: 151522 - protein, 212 aa, Heterodera glycines
  Coding regions on vcDNA: vcDNA=SeqID_77945; Strand=-; Position=1 -187,234-408,459-614,887-1008
GNKENMENAEVSQCFSKFDNKFLFIIGHDNQYRKFKKTNERTDTIYLYCMNCENYNKQNSAGVIGSAIIREGQLDRTHQIMHHLQCKGVPLEQLTAEQIDRNQRRELIQCSADSKSIWREGSDRAREHDTAEDIEIDDPSGISFNYPNWQSVRRAYNRRKMNQIGDCSDPFNQIWTIHGLVRLYLYFYLGILKIETTSGAEWAPLLMALMKR

SEQ ID NO: 151523 - protein, 98 aa, Heterodera glycines
  Coding regions on vcDNA: vcDNA=SeqID_77946; Strand=-; Position=1 -71,383-605
MRRRSPPPLSGHLTLTEVLKNGIRIRPRLSVLKRIANSVLSYPRANYRPWPAQDSRVSTPCRKFNAEHAVGQTLRLAGPKKGSGLLRSNSDWANCAPR

SEQ ID NO: 151524 - protein, 41 aa, Heterodera glycines
  Coding regions on vcDNA: vcDNA=SeqID_77947; Strand=+; Position=1 -60,413-478
MGEYCKTKITVLNDFVARLKIPSTENRTKQQRKGIELLQAN

SEQ ID NO: 151525 - protein, 101 aa, Heterodera glycines
  Coding regions on vcDNA: vcDNA=SeqID_77948; Strand=+; Position=1-306
MRLGPAGRALLQRMSSITDPGQIRLDYGTSGWADCRQAQCGHGEGVQVRHGGSRIFGFFVESEIVTSDSCGICFPPGISERCNLTIRNRKAGNVRERNSEN

SEQ ID NO: 151526 - protein, 128 aa, Heterodera glycines
  Coding regions on vcDNA: vcDNA=SeqID_77949; Strand=+; Position=1 -231,290-446
KDRKVCNWLIAFDSLCQLFVVAPFGVNLVGVIFQYSTIDYRICLATLMGATIASYASIMAMFLISVERLLIILYPIRMNSIKKTTVCQCSFASAILCTLFGLVMNLEVFNVWTIINISYDRRLTFEIN

SEQ ID NO: 151527 - protein, 192 aa, Heterodera glycines
  Coding regions on vcDNA: vcDNA=SeqID_77950; Strand=+; Position=1 -245,311-404,500-739
MLRSVFLLLLVLLIGWLIASAARNQITDFISFITPLIVNLFIAEPVAHSVMCTNIKSVLIGIVTCVPILASASGAPILLLNSSDYRTAYKKAIMRRKGNSSTVGPLFRPRQIVKNDSLQNFVICSLRFLLYYFLNIYHFFQCQECLIWLTLTKVMGVFVQNFHLMIFHITLLFERGGRILLTLTLPLHHEDR

SEQ ID NO: 151528 - protein, 158 aa, Heterodera glycines
  Coding regions on vcDNA: vcDNA=SeqID_77951; Strand=-; Position=1 -55,403-620,820-1023
MTTNNAIIHDHPPTARTKTASAQCFPRKIGSFIQCLAQSADQIGGPLIAFPQNFEFGGDFNRTDGTEINGQFQRIKTGKIRKLNLNRQTNYLEWCPILGIEANGNEMFLRDELAAERQGLRRWHGFFAGTNQCRKGRRNGHRKCQICGAIGWPTEKDY

SEQ ID NO: 151529 - protein, 90 aa, Heterodera glycines
  Coding regions on vcDNA: vcDNA=SeqID_77952; Strand=+; Position=1 -96,283-459
MFTATGPPKGFINADPFRSPFSDSFAACAGWKSLHLYQTKHGQSQPHANGTADGGDESPKGPHVTLLQLEVLEGAPDQLDRSDRWGGQKQ

SEQ ID NO: 151530 - protein, 132 aa, Heterodera glycines
  Coding regions on vcDNA: vcDNA=SeqID_77953; Strand=+; Position=1 -247,742-893
MATPSRVRVANEAKDKKRKASVDPCRKRKAAQTVFAHRTLWPTPSAEPVPFRQPNPRRCGAATSRTFAACVQFLHSVARVWAAIGGAKVASPQSFSMSVLSPSILSPSFLNKGTGNIKVSLLSNSSIYSHLS

SEQ ID NO: 151531 - protein, 88 aa, Heterodera glycines
  Coding regions on vcDNA: vcDNA=SeqID_77954; Strand=-; Position=1 -193,287-357
  Homolog annotation: Hit_ID=A34043; Match level="QueryCoverage=63%, HitCoverage=48%, E-value=2e-13, Identity=70%"; Hit description =hypothetical proline-rich protein 1 - polychaete (Owenia fusiformis) (fragment) sp|P21260|YPRO_OWEFU HYPOTHETI
MRSSGVRARRRAAHPPLRPPPPSPRPPPPSPRPPPPSPRPPPPSPRPPPPPQKSHGHGNGPYWCLGLWCRYRRSRTGPDDVESQAPVA

SEQ ID NO: 151532 - protein, 143 aa, Heterodera glycines
  Coding regions on vcDNA: vcDNA=SeqID_77955; Strand=-; Position=1-432
MPCKSCTHCRKGKLQQQAKKVAQEEERQRRKMLRENRRSANECRQRALCRLRQDCRTLRQAIREGRFTVTYNGKSSYWNITSPSVNLAVDQNGQSTNSSSGFGCSSSSSGISELNSDGSWPIPDYYPGGFYVEHETDRNEYEE

SEQ ID NO: 151533 - protein, 187 aa, Heterodera glycines
  Coding regions on vcDNA: vcDNA=SeqID_77956; Strand=+; Position=1 -138,223-355,738-1030
MSLSPYQMKSAKRKNLKNDQSLPVFVQVDDISSSVDLGNDGINPEQHSNTNSMESNSKEMEMREHLEEIESQTTTQNKSVFVSRFRQELKEWHIYKQFCIYGTITFVRTFPTAFRVDFAHKRMAAIAIRAMNGQDYGKDGKVFICDWWSWKKAKKGKGKSRATPKGIVKLRIRLGEGEVFGSQTKPM

SEQ ID NO: 151534 - protein, 154 aa, Heterodera glycines
  Coding regions on vcDNA: vcDNA=SeqID_77957; Strand=+; Position=1 -222,265-358,503-607,656-699
  Homolog annotation: Hit_ID=XP_392209.1; Match level="QueryCoverage =90%, HitCoverage=90%, E-value=5e-24, Identity=37%"; Hit description =similar to CG40410-PA [Apis mellifera]
MNAARSVVSALIGRKFSEIDFDKTGMITSLKLQRALSNGTLRPFNIDACRLIIFQFDPMRHGFVGIERFESLWNYINDWKFEFVELSENMGFLTMRQLQSALTKYGCLYFDDFIYLCIMLQRITPPFRYLDRNANGRINIHFEEFVIMILSAQI

SEQ ID NO: 151535 - protein, 110 aa, Heterodera glycines
  Coding regions on vcDNA: vcDNA=SeqID_77958; Strand=+; Position=1 -165,351-518
MSGLNRFQIAASPKKRFADEFPPSCKDLHDVKKFNAPGIFYVRAKVTDLQFALYKDCNDPEINQQATLFAFCAESYLDIKVEQFAAMVNNDLKSSRLCFNRKLAQTFPSN

SEQ ID NO: 151536 - protein, 135 aa, Heterodera glycines
  Coding regions on vcDNA: vcDNA=SeqID_77959; Strand=+; Position=1-408
MKRIEEPRSAAVTQGQHKLEAETNAQDGGGGEATIKRARRKSWDFKTMAHFDRGETDHQQHQKAPLFEQKQHYVHRVERFALQRHVTEFVLNGQHDEPEEALFLAFKHIIDRAIRNAENSPSHQQQKQTSGGAEF

SEQ ID NO: 151537 - protein, 263 aa, Heterodera glycines
  Coding regions on vcDNA: vcDNA=SeqID_77960; Strand=+; Position=1 -519,567-839
MAELDKLGQSDGDEDVHGGGISKRALLLSEPIEVVVTCIAPPVGAAPRFHHYQHWGYDERHMIRVMNMDDNFCLFHALIATRAYTDHEFLKLSSRRVADVDADDGTLADVPAEISRRVITRADFCAGHEALNRLLSSRERMKAAVTELMRDAGIPTNEDAYGMEHIEQIQQLWDQTYAGLYRIVLFEDRSEKLLRPIWKGPMGRRLCVSLFVSEGHYYGIKRINCFFKLGRKYCLDCECAYNRDTKHTISCKSRCPQCAKGRL

SEQ ID NO: 151538 - protein, 71 aa, Heterodera glycines
  Coding regions on vcDNA: vcDNA=SeqID_77961; Strand=-; Position=1-216
NENANDLNYALNLFDYRIKRDYLRYNYAKVSADGSAEKPYKAMEAEEIEGKMEQLKVGLKSIVTNREGLTD

SEQ ID NO: 151539 - protein, 57 aa, Heterodera glycines
  Coding regions on vcDNA: vcDNA=SeqID_77962; Strand=-; Position=1-171
MATRLLGICNLGTRHLGTRHLGIPTFGDPTFGDPDIWGPDFWGSDIWGSRHLGTERQ

SEQ ID NO: 151540 - protein, 442 aa, Heterodera glycines
  Coding regions on vcDNA: vcDNA=SeqID_77963; Strand=-; Position=1 -192,248-793,912-1036,1305-1505,1571-1837
NEEISQNPSENETILSTIVEEFNDDNGTKCEESNGNDEEIENDELSVEHNSAEKISINISALNEFRNETFLHEKYEEYFENENDANETKFLLDAGIFVFELQKRLKMVDELRKLSYFDNLNLIKNIEKENAQFLLYCMQIEEFDQNEFFQKTYKILKIYSKNLEKDKNEEIPSEKQLKQIKRQMHQNNLSNLIVTDKQFGEKWKKYDEEWKNKKFIILFGVKTFELKRFEKIKMRWKKLKQQITLDTDLYEQFLNKNEQNNYLSANFSEISQQIHFHHSDSAYDSNESTGHARVGISGSLLLGTHTADSDVDLICIVPGQTMGVENFFGNKNAICEKNKCSDGTNDSLYCKLCENKSVAKLLKLMHSSIFLIKFHMDNVEIDITFVAIPGKSVLQAELNEQMLTDYINCLTNEKEEHRKMLRTISSQSKKVGINLNMKVFKV

SEQ ID NO: 151541 - protein, 249 aa, Heterodera glycines
  Coding regions on vcDNA: vcDNA=SeqID_77964; Strand=+; Position=1 -394,771-1128
  Homolog annotation: Hit_ID=AAS45395.1; Match level="QueryCoverage =92%, HitCoverage=18%, E-value=5e-10, Identity=20%"; Hit description =similar to Plasmodium falciparum (isolate 3D7). 10b antigen, putative [Dictyostelium discoideum]
HLGSRKKSKRSRVVSSISQASTIPTTTTTTTIVATAAADVTTASNFISSSGHSSLYNYTNNNNNNSIIKLNGAELNGHCGTGGGVSSSNHLQHHHHQETDNNHNSSNECALLRENAQRLSEIRQLQKERQTLELSLDKTKVELKSARSAENELRVQLKNVQQREQSCREEWKQFEREQKQRVDQLESKCKQLAKQNDYYKMNTQALERRVGELQLKKSEVERELTNERLRNSTRDEPPVGRQQQQHNNA

SEQ ID NO: 151542 - protein, 77 aa, Heterodera glycines
  Coding regions on vcDNA: vcDNA=SeqID_77965; Strand=-; Position=1 -158,448-523
MTQEKLTLTKDEEIWLLKRCPIVGETAAVQWEKDENLDNLNGVIFHLYHDCIGPLSPQDQSDEKVFSTPGPSDQRKE

SEQ ID NO: 151543 - protein, 224 aa, Heterodera glycines
  Coding regions on vcDNA: vcDNA=SeqID_77966; Strand=-; Position=1 -79,682-771,938-1011,1062-1077,1121-1224,1278-1323,1367-1462,2322-2489
  Homolog annotation: Hit_ID=NP_492020.1; Match level="QueryCoverage =80%, HitCoverage=38%, E-value=4e-95, Identity=57%"; Hit description =tissue factor pathway inhibitor precursor family member (100.0 kD) (1H712) [Caenorhabditis elegans] emb|C
MAWFILSVGRMPLCQQPAAISNPGWPSFACIQPPNEGFTPPGGGSSLNHWYHDPITGECRELKYQGYGGNANNFATKDHCESYCKQTCSRGLPLYRDRTMGVKQEPVYCQGADNGCTSPNYVCTAMGTLQQCCPTFMHICSRNGAIPTEVYNTAGGLPTEYFDVGVPDVLCSAGEPLKDSSGERNMECSPTGSGTNSCPSTHSCESPPAHNIWWNLLSRTHMFA

SEQ ID NO: 151544 - protein, 61 aa, Heterodera glycines
  Coding regions on vcDNA: vcDNA=SeqID_77967; Strand=+; Position=1 -58,126-250
MALSRKAARSMFVLQIDVLKITNKKNVSATLPNIRSAQCPVESKKRDKFYHKKKDFSNNFM

SEQ ID NO: 151545 - protein, 139 aa, Heterodera glycines
  Coding regions on vcDNA: vcDNA=SeqID_77968; Strand=-; Position=1 -13,77-232,285-434,661-761
  Homolog annotation: Hit_ID=CAE72700.1; Match level="QueryCoverage =75%, HitCoverage=15%, E-value=2e-12, Identity=40%"; Hit description =Hypothetical protein CBG19924 [Caenorhabditis briggsae]
MDLEGFHFALRNAAVGGSLEVCRLLVEEWAADVNQQTIQEQYTPVICAASEGHLAIVNFLVEHGADLQHVDVDGHNALMWAVKNGKIEMARHLVAIGADINQRNMEDSKTINSRCDSTERANQWPKAADGFLRKTLIDH

SEQ ID NO: 151546 - protein, 80 aa, Heterodera glycines
  Coding regions on vcDNA: vcDNA=SeqID_77969; Strand=+; Position=1 -81,159-320
MQSCLMDSTTRCIGILPIVCCLARSQKVVDDCVVLNPGRFDRGKGTGTFSVLDLDLSSAIGATSVSPFCEVSLFSTQQQQ

SEQ ID NO: 151547 - protein, 96 aa, Heterodera glycines
  Coding regions on vcDNA: vcDNA=SeqID_77970; Strand=+; Position=1 -64,1077-1303
MVLEISVPSLRLTDFRNFYHKKEINKFSRTAVEVLQQRWRFSWALMATQHSLCASKVMRRKTNSSSSNSSIRIWPSAAAAPAAARICTSPGTSAVV

SEQ ID NO: 151548 - protein, 43 aa, Heterodera glycines
  Coding regions on vcDNA: vcDNA=SeqID_77971; Strand=+; Position=1 -93,331-369
MIGLFSVLVCNAFVLLPFAIHLLVLLIHNCLFYKKIIIKLICY

SEQ ID NO: 151549 - protein, 63 aa, Heterodera glycines
  Coding regions on vcDNA: vcDNA=SeqID_77972; Strand=-; Position=1 -85,135-188,323-375
  Homolog annotation: Hit_ID=AAP30834.1; Match level="QueryCoverage =87%, HitCoverage=17%, E-value=5e-18, Identity=83%"; Hit description =putative gland protein G10A06; Hg-G10A06 [Heterodera glycines]
MLRNALLISILALFGDCMDKGKRKLGGISINEPSEYGTKEKEAIATNLNIMDTTEHIAQMGKI

SEQ ID NO: 151550 - protein, 141 aa, Heterodera glycines
  Coding regions on vcDNA: vcDNA=SeqID_77973; Strand=-; Position=1 -76,578-694,1768-2000
MLYIKFITIEKSFFSFSDLSALGLPSKYYPSWYTPVAKTTPSFAARLRVGQLSLFVAFLVPLAIEFDIFQKPGPVFFWTKIQETQVQEKPKVSKNGLGLNAGKPSLGRRPIDFPINNAFQLDTELDTRPTFSGLPTQPGKL

SEQ ID NO: 151551 - protein, 113 aa, Heterodera glycines
  Coding regions on vcDNA: vcDNA=SeqID_77974; Strand=-; Position=1 -49,429-721
MWFSCISRRVKAAEKITFRQRIRLAILSPVQCHHLHPIPMGHRSLHFGVVQLAAVVHKRQISAPINWHFFAKMPFAVNEGTKCCCSIGQKQCLNYSAALSFIKMGSEMTEADN

SEQ ID NO: 151552 - protein, 62 aa, Heterodera glycines
  Coding regions on vcDNA: vcDNA=SeqID_77975; Strand=-; Position=1 -113,330-405
MIWISNIYGRKITKFGHKTWTKIKNMAMKEPNMENKKIKRCKLILGIEILKIYLIFFYHSEM

SEQ ID NO: 151553 - protein, 127 aa, Heterodera glycines
  Coding regions on vcDNA: vcDNA=SeqID_77976; Strand=+; Position=1 -36,419-601,1216-1380
  Homolog annotation: Hit_ID=CAE58728.1; Match level="QueryCoverage =68%, HitCoverage=11%, E-value=8e-15, Identity=44%"; Hit description =Hypothetical protein CBG01914 [Caenorhabditis briggsae]
MHLHKYWCHLTQLTGIASLALAAFLEFENAQLALRQEYYRIVLDQLSAVLAIGSAIADLYAGYNKVHGTLNLKVSIALSTLAAVWSFKSVDNNAFPFYKMDINQYRVAVHTSRKHFVDWFLTKKNIF

SEQ ID NO: 151554 - protein, 189 aa, Heterodera glycines
  Coding regions on vcDNA: vcDNA=SeqID_77977; Strand=-; Position=1 -81,149-251,323-445,507-619,912-932
  Homolog annotation: Hit_ID=NP_499162.1; Match level="QueryCoverage =99%, HitCoverage=36%, E-value=2e-45, Identity=53%"; Hit description =ubiquitin-specific protease, possibly N-myristoylated (46.6 kD) (3K867) [Caenorhabditis elegans] emb|CAB5
KGTTASSQLEKELSADHVSNEHFYGLFGNTCYANSVIQALFGNTCYANSVIQALYFCKQFREKILAYKQTHKKSGMQRDNLLTCLADLFSMQRDNLLTCLADLFSNISSQKRRVGTIAPKRFVTKLKRENELFDNFMQQDAHEFFLFDNFMQQDAHEFFNYLLNAISEVLMEEKKKEQLGGSHYALLQK

SEQ ID NO: 151555 - protein, 215 aa, Heterodera glycines
  Coding regions on vcDNA: vcDNA=SeqID_77978; Strand=+; Position=1 -183,1023-1292,2386-2577
MLLSQETDSLTPFSGSKYPSLLVQATICSICSSNSAKYKCPKCLVRTCSVPCFTTHKESGKLSNADSALTSPTLVHFVKPIVDYNGSDDEEMEKDAGNDFDVLQAESSLKLGLSHHDDGIGAETNNSDGSSADSTGDEDEQQTPLEWVDFTVNGHPCFVVVLSRHTEFGELELPLICEEEQKHLQKRNSEREQTMNGQRGEGHWDDAEPYQNGWL

SEQ ID NO: 151556 - protein, 88 aa, Heterodera glycines
  Coding regions on vcDNA: vcDNA=SeqID_77979; Strand=+; Position=1 -45,121-342
  Homolog annotation: Hit_ID=AAH08305.2; Match level="QueryCoverage =85%, HitCoverage=11%, E-value=5e-09, Identity=48%"; Hit description =Chromosome 18 open reading frame 8 [Homo sapiens] gb|AAH02950.2| Chromosome 18 open reading frame 8 [Homo
MEFFLILKQKHIKVQETYVSELLVKILVAADMFNRLQQLLQYSVIEKSKFLAYELIALSSRCPPLYQIGLDMLKRRNDWEQIVEASGI

SEQ ID NO: 151557 - protein, 277 aa, Heterodera glycines
  misc_feature (199)..(199): Xaa can be any naturally occurring amino acid
  Coding regions on vcDNA: vcDNA=SeqID_77980; Strand=+; Position=1 -224,310-451,544-633,1297-1502,1613-1771
  Homolog annotation: Hit_ID=CAE63244.1; Match level="QueryCoverage =98%, HitCoverage=62%, E-value=1e-42, Identity=36%"; Hit description =Hypothetical protein CBG07609 [Caenorhabditis briggsae]
FSLLFLFVYSTVYLPYSVATSPAFSDFLTVAYGDKIEESIARRDLGSLGSFGGGTKMPMFTRKRPIVMVHGCESTFAATFAAEYENIRQYFLMNNYTDAEVYASSYGHGPVNWTHDAMKCEHVQRFRFRWLMLAVANYTSSQIDVIGYSMGSPIARKAISGGVCVDTGEHLGVPLTPLVHTFVGVAGANATVCICAAFXQMSPAMPCNSINGMACHSRFLRDINKRQHFEATHRVYTIYSRHDDVVGYLDCDGLLVSSIPLQDNHMRWKKFINDLPG

SEQ ID NO: 151558 - protein, 303 aa, Heterodera glycines
  Coding regions on vcDNA: vcDNA=SeqID_77981; Strand=+; Position=1 -31,677-1557
MTHTTNKDPIECKVDFIIENLPANPESMLRALFAHCMSTALDESQQNGITPDQLGSTISSDLLNPSIWIPIRRISDNTADSIMNRFLEVAQSKSREGSLWGSPFTVTITTLDVAQLPQRQQVRGSGKRTTNSVQHIIKESALLRINNSDDAYCLFYALETSRKYHSKEMSRQTFSKYINRQNGRRLEDVFGLMSSANIRTDLREYDAVVYVPIVVDYWNRKYATANQRFKVFIFGATGTYRPKFQYVPDNYNVEIPLYHHNGHFDGIRCGVGKAVFGRDYYCFSCECPYDNANDHSCSVKQSA

SEQ ID NO: 151559 - protein, 52 aa, Heterodera glycines
  Coding regions on vcDNA: vcDNA=SeqID_77982; Strand=-; Position=1 -72,144-230
MKEVDFNEKSPLSEIGELWKLYRVAKEEVKIFYWYILKYLARNEANFKSHKF

SEQ ID NO: 151560 - protein, 60 aa, Heterodera glycines
  Coding regions on vcDNA: vcDNA=SeqID_77983; Strand=-; Position=1 -25,476-522,565-673
MASLENFVELLTAVHSDVRQNIAEKFANPQQNCWEDTACSNELEIFGNESLRIHYKGDGS

SEQ ID NO: 151561 - protein, 52 aa, Heterodera glycines
  Coding regions on vcDNA: vcDNA=SeqID_77984; Strand=-; Position=1 -58,133-233
MSISFNSTSNDDFTPAADEEEVKGEVLENKETFAERRIGKLEREKVSLEDRN

SEQ ID NO: 151562 - protein, 157 aa, Heterodera glycines
  Coding regions on vcDNA: vcDNA=SeqID_77985; Strand=+; Position=1 -219,1404-1658
MPVPEFGLSALSAKQLFWHEIEEKVSARNSDHVLVHRWTGTTDADFWTELGCDMDTPVVLTLEAIEEDPNHIKRDGHLSLLSSLHFLEEYMGRMRSRTFVAEQNQCIICQKLTELVFQPCGHATYCKKCERKSAKDPRCPICRLHGFYFCIFVLANA

SEQ ID NO: 151563 - protein, 51 aa, Heterodera glycines
  Coding regions on vcDNA: vcDNA=SeqID_77986; Strand=+; Position=1 -66,477-566
  Homolog annotation: Hit_ID=NP_498886.2; Match level="QueryCoverage =98%, HitCoverage=12%, E-value=8e-10, Identity=50%"; Hit description =putative protein, with at least 4 transmembrane domains, of bilaterial origin (43.8 kD) (3J669) [Caenorha
MADEMHKAFTDGVPFPVLKVLEYFSMGQQSFAWGRQFRNAGNFTGTMLWFD

SEQ ID NO: 151564 - protein, 230 aa, Heterodera glycines
  Coding regions on vcDNA: vcDNA=SeqID_77987; Strand=+; Position=1-695
ILELLFSATLCSLQSLRLYSLNTVLSASLDNSVGPPKCRFGGGRQSIDAENGQHRGGSQKRRFGHILSPITPCPSGKTSLTLSHCSLNNSSPAVSSRSTARISPGRHQRTFVSAPLSSSSTSDEGPVSNSADSNKQSVASSIFSISGTSFGSTAPPTMAPESDGTGRGEVTNRRSRSSLISSSRRTTAADQQQQRIDIGDDEEDDSDELISDDIKHFTMRSGAKGEDCWH

SEQ ID NO: 151565 - protein, 113 aa, Heterodera glycines
  Coding regions on vcDNA: vcDNA=SeqID_77988; Strand=+; Position=1 -131,635-695,737-886
MSNIIFSHFPWEKLKFVFVLPSLMFLSVIYKNYSFSYDNSTLFSFAYLQNNSGELSSEECFGEKMVYTLKMNDSRIIRGKKFNCSLTWLLERYKLSDKYAIKEKIEVCFLIYF

SEQ ID NO: 151566 - protein, 97 aa, Heterodera glycines
  Coding regions on vcDNA: vcDNA=SeqID_77989; Strand=-; Position=1-294
MANEYKQKRKYSTKEWRQNYNEICNKIGVSRSLIEKWKKQFGIRCKRIMVKEKMEKMKIYWKIKSENPKMSDNEIAKILKIHQNSIFNWKKQFGEEI

SEQ ID NO: 151567 - protein, 23 aa, Heterodera glycines
  Coding regions on vcDNA: vcDNA=SeqID_77990; Strand=+; Position=1 -52,245-264
MYVNTVESESVTRQLGHAKQKEE

SEQ ID NO: 151568 - protein, 868 aa, Heterodera glycines
  Coding regions on vcDNA: vcDNA=SeqID_77991; Strand=+; Position=1 -596,1026-1933,1981-3083
  Homolog annotation: Hit_ID=NP_502797.1; Match level="QueryCoverage =39%, HitCoverage=96%, E-value=2e-58, Identity=37%"; Hit description =HASI (4P602) [Caenorhabditis elegans] emb|CAB16520.1| Hypothetical protein Y57G11C.19 [Caenorhabditis ele
MFIAPFTLILSGATGSGKTQWLMKLLRSYAELIDPPPAKVLYCYSEMNQSVIELMKRGIETHNGVPDQALIQSQPKPLLLVLDDLMLNVGNDFLDLLFTRGSHNWNVSVIFVTQSLYGRNIKTARANSHYLVLTRNPSGQLQVRTVGSQLFPKRLNYFMEAYNEATSQPFSYLVINMHPNAPENERLTSKIFPGENREVRTGVNNKNNMKHTKKMVLVPESEYLALINMLKGGAGRSDSLLNEKAALDAQIQSNLSDSKAGADVKIKRHSWLYKQRHQLKDMIENKPQKVIVENATGTAPANIAPYMGIQKPTVNKLDAVDSQDDDKKIKGPKKVRRKAMNAATSRIRMSAGGITSYGEETDDYTSAPETDLLPMSKKRQQKFLELKTSKEHYAKMMSMIAKDPDKFGVDKGTGEILTNFKRPILRSNYMDSLLYITGQRSEAPKGHRFFAQKLAADPRMMKFFETNQKGEGKGTNRKRDRTMKKKIVLVRANAIKTDGLSPDFMGKTLAAEKLLEQVYYDLRSPASYAGIQKVLAEAQRRNPSITYKDVHQFLHKQRTYTLFKPRKNRFRRLKTVPSGLHTDWQCDLCIMDALKEHNDGFRYILVCIDVLSRKILTAEVESKKSEHMIEAFEKIFKKAGVLPNKLYSDAGLEFQAKKMKDYWIQKQIIKHVMYSPHLHAGVVERANRTIKERLYKYFSEKNTKRWVDVLDRIVHNLNISANRTTGIRPVDVNFKNAAALRNRLYKHSEVDKNSANSSKLQLGDIVRISKEKGDFSKGYFPNFTDELFRISKVNPTDPPSYRIRDLDGEDIKGIFYEQELVKTVAETSHRAEVLKTRRRNGAKEHFVRWIGYSDKHNRWIRDEDLVRN

SEQ ID NO: 151569 - protein, 659 aa, Heterodera glycines
  Coding regions on vcDNA: vcDNA=SeqID_77992; Strand=+; Position=1 -1084,1413-1543,1686-2450
MALFSILLMLLLLLLHLSGGEWINVELSVDPPNFFDRTFRSLSKTSPIQHWFGYNRNTACHVERETNINRLYNSADMWNIALTDVDNFMSMGRQTIELLSSALPWACFGHDRHSFVIFDLRNDANEVAVVRGHQHKIARNLSAYGRILFDHISGRLYMVDKHERRIHELLITDFVRWWTLNNTDGGGGGGGHNGGGENSTATHSLRSNFVGFLPEQKTDFFIAADHVYLIWRRRVYKFRVGHYFNDPSSQLQFLTNSSDIRFNFLIFERDDDAKLEDSTDRRNSRAAAEASAGLTPSSQMMNSIERLLLALMYLFDVAVICIAVCVIRILRRTTSNSGPDNTSQARSNDVVHTTEMMALTSEEILSSPGEYYPNPLAEFVCVHIANEDHADQPVLVNGTLDLIEGERADVRGAERPAHLSSQFAAMSLRTTSEQQQPTAEAAAGTVFDPLDGGSGRGGRPSPSHQSPPEFMLARQRRRHRRRQRKLSNLVTALCDFNKCGPARLPMLLRKRRAENLDFLSRLCLQTVHLKGDRNVHFSAAALSNYGANRTFAYRGLLSITVEQHLFTRHRVRLRHPFLPCVVQAGGNNHCYFYPLELVRVCQSPSSGSHTDNNKNNISNNNNNKTMRRMPMQRNQRLSRDRLHQQPKRSSVCLRDVYDP

SEQ ID NO: 151570 - protein, 147 aa, Heterodera glycines
  Coding regions on vcDNA: vcDNA=SeqID_77993; Strand=-; Position=1 -311,412-544
MHRSDNQESEDNKNGGRSNEMEKGGGKEGGGDAGVGRADEDAGDALKTSSPSVSSSSSSSSGGPDQPSTSSGSRKRRYGPPPGVVSASWLLGAMKARERQRCEWLEALEAKYSRMERELGAEDDDDDAVVDFARDSLETVVSKCDLF

SEQ ID NO: 151571 - protein, 117 aa, Heterodera glycines
  Coding regions on vcDNA: vcDNA=SeqID_77994; Strand=-; Position=1-354
MTNVRSGEVKYVQKIRGITFDVRNSQSLQFECFRNKVLSYGGVEGRRADRGGGDDDDDDDEDGDVAVQQSAAVFTYDKIQPTRESRIITRKQRKHYLPVCQKGIINEQLEVLPFGYR

SEQ ID NO: 151572 - protein, 273 aa, Heterodera glycines
  Coding regions on vcDNA: vcDNA=SeqID_77995; Strand=-; Position=1 -209,265-313,419-522,678-886,967-1076,1118-1258
  Homolog annotation: Hit_ID=NP_001004509.1; Match level="QueryCoverage= 92%, HitCoverage=18%, E-value=1e-25, Identity=27%"; Hit description =si:busm1-180o5.3 [Danio rerio] emb|CAD60788.1| novel protein similar to DNA polymerases [Danio rerio]
MKLDERLLFSCCHRCASQFRTLNTRCRHECAHSDAQRAYTGNYTHIELAMALRYGYRVDRFWRAWHYEQWSDQIFKEYVRLLLKLKIEASGFPDGITTEAQRHQFIDAYATVYAVTLDVGPGKFSMRNELGTNKVITRPQEFYSLVLDHKVEISAIIPLSDTAIRVMYRHKKSFVEEHSSSNIVLSLWTTSRARLKLFEYMMQVQNTDGAELLYTVSYRRRTYAFVTDTDSVIVLHKRDRVPILTGEYLGQMSEEYAGFEIQTFICGGMRYAN

SEQ ID NO: 151573 - protein, 766 aa, Heterodera glycines
  Coding regions on vcDNA: vcDNA=SeqID_77996; Strand=-; Position=1 -622,680-1272,1322-1509,2381-2468,2520-2767,2829-2927,3107-3149,3380 -3526,3818-3932,4020-4105,4163-4231
  Homolog annotation: Hit_ID=NP_502882.1; Match level="QueryCoverage =15%, HitCoverage=23%, E-value=8e-14, Identity=36%"; Hit description =DNA polymerase like family member (4Q408) [Caenorhabditis elegans] emb|CAB60306.1| Hypothetical protein Y
MQPSSSSSSSSKRGVTQAGTASSGGQRKQQRRKIGDADDDTAAAAAPVTATPGRWDFRSMAYFEQYIPPPPPSPPTSSFEAASLASNFGTQQQHRHRTKHVQFGAGPTTVAAPIDESDHERDDDDDDDDEQHQQQKMFRETANYVHKLDRFSMTRHISEFELNVEHEEPDEQLRNAFSQLIRRALRNAQQQLDGRSVQKIGIALHGKGLYDPIVLPLRPPEQNNADVLMGELDKLGQSGTDGGGDDDQGGGGADPDAGIMDKRTLLLSEPVQMTITCVAPPQGSGPRFHPYQHWGYNDRYRIRIRNTGEAERRFCMFYALVAGRAYHDRTLFIGLNNDNNMNNNMIIQMALLMPDFCRTHELFNRLVASDEAMRMAATRLMRDTGITADLPAYGMDHLQQVQAYWDERFPGLYRIVLFEDRPEELPRPIWKGPMGRHFDVPLFLSNSHYDALTKINCFFKLARKYCVESEVDGHEPVSEFVEWILYAWDKRFTTYVWAHNASRFDGHFVLKYLGETRRRPDVVMNGLKIFEIRLQGSRVHSMLIWRDSCLMMPIRLESLKNTFDLNCADKPFFPYAFNKRENYNVHLPNLPPLVDYCPGSMSKDKMEKFMAWYLLMCKVTSGYDVLPAIKYLDWRAKSEGLQIQHAGNGGEKRIRNHKLDGWIQSQNKCIEVLGWYECEINALLSDAANHQMRAFFGDIGNERGPIDPRSAYFGGRTGPLKLFAEPKEDEKISVYDIVSLYPWVNYDTEYPIGVPKIIYPSAVQML

SEQ ID NO: 151574 - protein, 108 aa, Heterodera glycines
  Coding regions on vcDNA: vcDNA=SeqID_77997; Strand=-; Position=1 -52,1136-1410
MIGLKWHKCSAKCSKVPALFTGGAAGLVLSLICSLAGLVQSCANICCGCPSKFKPNEGCLSGLITGFGLVGYAALWLIEVPFTFNSPISDHKDLREKLQEALDDIIDY

SEQ ID NO: 151575 - protein, 149 aa, Heterodera glycines
  Coding regions on vcDNA: vcDNA=SeqID_77998; Strand=+; Position=1 -153,1059-1352
MPPLPAMGLPNVVPKNVAKTPTNGIIAVPPIPATVPAANVMAFGMRNSIARKGTTAVPGMAQRRGALTKSAAAAACAHGVCGINVARAGGGAAARPANNGAAAKTWQMMHQRREQRQALSMRRAAAIPPSAAYLSAGSKLYQQQQQQQT

SEQ ID NO: 151576 - protein, 81 aa, Heterodera glycines
  Coding regions on vcDNA: vcDNA=SeqID_77999; Strand=+; Position=1 -40,604-806
  Homolog annotation: Hit_ID=CAD91444.1; Match level="QueryCoverage =93%, HitCoverage=40%, E-value=1e-18, Identity=61%"; Hit description =Hexokinase A-like protein [Crassostrea gigas]
MELDFKKGLDPLTAPTASVKMLPTYIRAIAVGEEHGEFLALDLGGTNFRVLLITLEGDCRSTMQSKIYRVPDHIQKGTGTA

SEQ ID NO: 151577 - protein, 54 aa, Heterodera glycines
  Coding regions on vcDNA: vcDNA=SeqID_78000; Strand=+; Position=1-163
MAKLWLLSLAFGIGIAPFLFAVSLQKAKGTTRKWLAEHMDEVISEMDLAKAYGA

SEQ ID NO: 151578 - protein, 270 aa, Heterodera glycines
  Coding regions on vcDNA: vcDNA=SeqID_78001; Strand=+; Position=1 -252,312-512,562-921
  Homolog annotation: Hit_ID=NP_492133.1; Match level="QueryCoverage =97%, HitCoverage=97%, E-value=8e-66, Identity=55%"; Hit description =dual specificity phosphatase 1 (25.6 kD) (1I234) [Caenorhabditis elegans] emb|CAB01700.1| Hypothetical pr
MAPLCFQVNEYYAQISELVPGLYICGVTGLTPANMKAFRIELIVNATREVPNLKSLGHIQRMKLWVEDTTDEDLFPHFDIVADQIHAVIQDRGAVLVHCVAGVSRSAAICLAYLLKYRTRSLRAAYHLMCSKRPMVRPNLSFWRQLIHYEQQVKGNVGSVRIVRDEAQPDKLLPDVSLGSGTRESGHLFPFKVYLKIVIPDQLSRPLSPTNATDASSPQSVPKSPFSDEPAPVSQLPLSRHRRNSSGGSARVKFVPVLEVLTEMAAESPA

SEQ ID NO: 151579 - protein, 384 aa, Heterodera glycines
  Coding regions on vcDNA: vcDNA=SeqID_78002; Strand=-; Position=1-1155
  Homolog annotation: Hit_ID=NP_491240.1; Match level="QueryCoverage =86%, HitCoverage=23%, E-value=5e-58, Identity=40%"; Hit description =zn-finger, CCHC type and RNA-directed DNA polymerase  and Integrase, catalytic domain containing protein
MFPKWTFGRPMRQGAGMETEKQIANSKKENWKFTNWNGHESELRFLFKTDVAVDGKDIKFVLDSGAEIIVIDELSHEVIGSPRLRKCTESGCMFDGTQVKFVGKGVANFKFRDICIKSEYYVAKRGSLNLLSVQMMDAFGLLNELKAKINAPVNLCRVGEETRGFTKTPKSPQNSTVQSHIDHLKASFPEIFKNELGRCMKFKAHLTLKADAAPVYRKARPVPYNAQEAIDGELERWEKMGVIGKVEYTEWAAPILAVKKADGSARLCIDYSTGLNNALQDHQHPLPLPEDIFATLNGGKYFSQIDLRDAYLQIELDDESRKLCSISTHHGNYEVKRLPFGVKSAPAIFQSVMDQILAEFEFATAYLDDVIIVSKSVKESTLIT

SEQ ID NO: 151580 - protein, 140 aa, Heterodera glycines
  Coding regions on vcDNA: vcDNA=SeqID_78003; Strand=-; Position=1-421
MAQANIQQLLDAISQLVTAQQQQQNNQPNPNNNVPVLPDISVFEPTDEKGRISEWIERFSFAMDCSAPNATDAVKVKALMNKLSETAFSEYSKSCLPSKVTDFDFTQSIERLQKLFAKPQSVFIDRYECLMASKTEGEDF

SEQ ID NO: 151581 - protein, 469 aa, Heterodera glycines
  Coding regions on vcDNA: vcDNA=SeqID_78004; Strand=-; Position=1-1409
EQYEAKTLSWTLACAGDEHKCCSDVVVADLDAVLDRSGIGLTKIENPLKALLAMFLLKSEAVASASAAKKLISQILDTDADWELATYCSAREDDVKNGTFPSESDVESVLRIWIGHCQIARKEVEKSAFGPISIELPQGLSLLPETEREGMRKSLESAPFLLEKLRATEIQKKTLVTAERVILGDSNAYQLKKLWPRSAFVGVQEGSTAEVIRQFDQVGLASKVKWLIVMVGKDSILAGDSVDSVIEKVKRLRQLCLRFAHVKIFWLLPPFIYNKKAESEEFCGRMRALFRKKSEIELVAVTEEGRSLLEIWRFGKSFNNEHVNHNGWMTEKGLKTLNAWLTSLVPNFPGDRELGIRTVKSKVVKIGAVKGGGPGDPSLIRGNAPERNVRGEGPGDPSPSRTIGISDNGPTGSARPMTNQNRGFEFGRVGTGYRSVPPPTFRGPSSRFHPYQQSRGRPAFHPTPMNRRN

SEQ ID NO: 151582 - protein, 64 aa, Heterodera glycines
  Coding regions on vcDNA: vcDNA=SeqID_78005; Strand=+; Position=1 -50,124-268
MGTPPTEVKIKYPPDYFKTNKDSQGLRIPSLTMIFYIFKLTTSNPRSPDTLAFVRENHFALCDK

SEQ ID NO: 151583 - protein, 218 aa, Heterodera glycines
  Coding regions on vcDNA: vcDNA=SeqID_78006; Strand=+; Position=1-657
MPLIFKPTKTSNSRALVEPSRLLTDDEIWKQIRSASRHFVRPQAQNAVIVSPPSAPQIVEESEAAIDQGGSIQNLGQVSLSPAVNSVREVPKEYPALHPRYFSPNFRGRSPVRHRSTPIRAPPPRRRWSPPRRRLSPFRKSPRPAQRHGPPSHRSEIDTRHSSVTRFFPPPPMPLNRVGSSKAQMIPPFLTPEQPPSRIQNFEMTYNHCTMTQNFSKM

SEQ ID NO: 151584 - protein, 144 aa, Heterodera glycines
  misc_feature (13)..(13): Xaa can be any naturally occurring amino acid
  misc_feature (34)..(34): Xaa can be any naturally occurring amino acid
  Coding regions on vcDNA: vcDNA=SeqID_78007; Strand=-; Position=1 -79,1324-1463,1929-2140
  Homolog annotation: Hit_ID=CAF99203.1; Match level="QueryCoverage =98%, HitCoverage=9%, E-value=3e-40, Identity=59%"; Hit description =unnamed protein product [Tetraodon nigroviridis]
EFTDKKLVGTEMXVGIQGSGRRNVIAPPSPSHFXAGYMRGHGTFPHENALHSQLAGIVVQTNKLISVKPIKSRYHGDVGDVVVGRIVEVQQKRWKVDINSRQHGVLLLNSVNLPGGELRRKSIEDELLMREYLREGDLVSAEVQ

SEQ ID NO: 151585 - protein, 26 aa, Heterodera glycines
  Coding regions on vcDNA: vcDNA=SeqID_78008; Strand=+; Position=1 -37,271-314
MLILEVKPANFYDFLFIVTNKGIKDF

SEQ ID NO: 151586 - protein, 211 aa, Heterodera glycines
  misc_feature (186)..(186): Xaa can be any naturally occurring amino acid
  Coding regions on vcDNA: vcDNA=SeqID_78009; Strand=-; Position=1 -21,702-849,1111-1234,1710-1933,2767-2891
  Homolog annotation: Hit_ID=NP_509296.1; Match level="QueryCoverage =92%, HitCoverage=39%, E-value=6e-35, Identity=36%"; Hit description =putative protein family member, with at least 7 transmembrane domains, of ancient origin (55.3 kD) (XI293
LFIIITIHSIGTAFAMLMFKWSPVDVVFYDSLAHAVRGVVALLVYVAYIIFDCGKKLNDRIVCLFSLVALFLFHLLTYSWPFLSNQVQLMHHKTTGNCDLSKYAWCAGLTRVNPWLYYGAIVLLIGPAFPNINVAMNTLFSRIIGPRMQSTEQGLLEMHGAIGRLVGPLLISIFKLYSTNIPTLKXVLNLKICINFPGSKKEKIFKFKKIP

SEQ ID NO: 151587 - protein, 76 aa, Heterodera glycines
  Coding regions on vcDNA: vcDNA=SeqID_78010; Strand=-; Position=1-228
MSLNRFCAICCSQMYRRHWSQIISKYLLAIILLFALAIAAPILWHSVCFRLSEVRTPLGQGQHKMDGPVFMEIPTQ

SEQ ID NO: 151588 - protein, 53 aa, Heterodera glycines
  Coding regions on vcDNA: vcDNA=SeqID_78011; Strand=+; Position=1 -45,336-452
MVMISRVVNYMDKKTGCIYCFSCIFLVKIRQKWPKYGNKKAKMVKYGFIPENP

SEQ ID NO: 151589 - protein, 272 aa, Heterodera glycines
  Coding regions on vcDNA: vcDNA=SeqID_78012; Strand=-; Position=1 -483,536-722,773-918
MTAFPSPVCDCRREHLISSAKCQLRSVQELERQADQFQQLTQGGDKATAEARALTMGIVCAPLLPSINFEQMLLAPFHVFQGLGNALIKELETGENAEIAQQFFRRIGARREAFRKRDMTGNSIRKILVHADQMEALFETEWAKTICQTMAHLGKIQIFTKAQPLSPGDLDGLETAVDQFKAFINQQPMVQNLLSKKTKAHLLLHHFVQFARQHQFLGLLDEQGDEALHSVWRRLEQLWKTMPDDEQMRQQLEHHFVSNWLLDTGRLDELKL

SEQ ID NO: 151590 - protein, 122 aa, Heterodera glycines
  Coding regions on vcDNA: vcDNA=SeqID_78013; Strand=+; Position=1 -121,256-503
MENDKDGPNDYVLLEEVGAANKKLDLCETPSFLRYFQFKREFTRNLFWQSTAKCVQKRTSFFDESTSQKPTKQLCLENFREKEKWTNAHRKSQKIDSLKLRFICLSVEPIQLTEKKGFFETL

SEQ ID NO: 151591 - protein, 159 aa, Heterodera glycines
  Coding regions on vcDNA: vcDNA=SeqID_78014; Strand=-; Position=1 -211,270-538
MDTGETTPPPLAIDERSERIEQLEKQFKDRDDTIKFLREQVRNREALISDLRRQLDEHMVPPMAPPTTSKTPPNRGRPKKRLDQLQRSARRDIVDQIVGVIDRDRSRSASRASLDRIYREIRHKFSHYTPKGQKLQEGMEAEDGLLLLAQLGTQMAYNG

SEQ ID NO: 151592 - protein, 167 aa, Heterodera glycines
  Coding regions on vcDNA: vcDNA=SeqID_78015; Strand=-; Position=1 -152,201-280,1580-1708,1761-1903
MIFMEFHQSLCLDDDHQIKTFQNLLTEMQIIGIRHDEINQTIKYLEKKKNDIEEIFKQEKEMISGAYQFGKALISENYLMAKRTLLRKRQTKNARHTRENKREERKAQTQRARQGRWAKKTATQPNPNAEIALQDEAGPSTSAASTEEAMEPPPPTPGPVPTPEMDE

SEQ ID NO: 151593 - protein, 56 aa, Heterodera glycines
  Coding regions on vcDNA: vcDNA=SeqID_78016; Strand=+; Position=1 -18,66-218
MWGGGRLRLIKSNSNLVVPKFASISSPTPHIETNGYKETGEGGKAQSNTESVKNIQ

SEQ ID NO: 151594 - protein, 40 aa, Heterodera glycines
  Coding regions on vcDNA: vcDNA=SeqID_78017; Strand=-; Position=1-122
MASNLMIKGFMYDIVTFPTSAGSIVRKCNGTREFLCIGWK

SEQ ID NO: 151595 - protein, 227 aa, Heterodera glycines
  Coding regions on vcDNA: vcDNA=SeqID_78018; Strand=+; Position=1 -77,400-576,644-773,947-1015,2162-2392
  Homolog annotation: Hit_ID=CAE58814.1; Match level="QueryCoverage =63%, HitCoverage=26%, E-value=2e-33, Identity=44%"; Hit description =Hypothetical protein CBG02021 [Caenorhabditis briggsae]
PMQRNSRVPLHFRTIEPADVGKVTISIVVYCEQFFIAFPFDECYRIPSTQFHANHNLFLANFYAKHLSVAYALDGAYRLLGKKAKFVRIYSKIWRIMEVLHYFTSRGWVFESQNALKMWERLSEEDKKLYCFDVRKVDWDKYLFDYLMGIKEAIKKTTLGILAQRLSAELCLPKCQPLVASCCSAAQFGGVQADGAALLLGGRRTEKWERRRESAAAAESGRKRQKQ

SEQ ID NO: 151596 - protein, 145 aa, Heterodera glycines
  Coding regions on vcDNA: vcDNA=SeqID_78019; Strand=-; Position=1 -102,193-417,473-581
MEEAPEEKEEEKVVNEEKEEEEREEEEEEEGAAENGDENRRSEANELDSAFPAMISNLFGTHPLRTEIKKKRPSQRRGNAEEETFHSTNDCHGKFDAKDTRNFNSSLVEEVSRHPALFDFTRDEYKSTEARNRHWAEVAEEMQQS

SEQ ID NO: 151597 - protein, 111 aa, Heterodera glycines
  Coding regions on vcDNA: vcDNA=SeqID_78020; Strand=-; Position=1 -45,93-383
MLFLSIFALIRLNEAQYTAPGAYYVYAPGYNFNPPPPGPGGPGTVGKRNAEAPANETTNGTTVTKRSALATEAHINGTEKTKRSAGTVQIGNGRGNATEQGERGRGMEKKG

SEQ ID NO: 151598 - protein, 138 aa, Heterodera glycines
  Coding regions on vcDNA: vcDNA=SeqID_78021; Strand=-; Position=1 -190,1303-1527
  Homolog annotation: Hit_ID=NP_497483.2; Match level="QueryCoverage =90%, HitCoverage=29%, E-value=1e-30, Identity=50%"; Hit description =membrane bound O-acyl transferase, MBOAT family member, possibly N -myristoylated (54.1 kD) (3D42) [Caenor
MFGIVATFADYISVREDAVRLILSVLAGYPLAAVHRTFLFNKPAVIQHSYFASIGLLLYLFNCGSSAHRLLVRLSFICQISWKQTNSLSPHFGHAESTTYDITWTTPFCIMTLRYIGLVMDVYDGQQAVAQQVAKPRK

SEQ ID NO: 151599 - protein, 37 aa, Heterodera glycines
  Coding regions on vcDNA: vcDNA=SeqID_78022; Strand=-; Position=1-113
FTHRVNFEPPVQKLIDLLSQWSVSLPPKRESQVQSHL

SEQ ID NO: 151600 - protein, 290 aa, Heterodera glycines
  Coding regions on vcDNA: vcDNA=SeqID_78023; Strand=+; Position=1 -237,295-452,509-635,682-771,819-928
  Homolog annotation: Hit_ID=NP_509584.1; Match level="QueryCoverage =93%, HitCoverage=71%, E-value=4e-63, Identity=52%"; Hit description =short dehydrogenase (33.4 kD) (XK51) [Caenorhabditis elegans] emb|CAA86312.1| Hypothetical protein B0272.
QMFSFVKITHRFYSTEPLVKKLTVIGSGLMGAGIAQVSAQANVKVVLVDQSQSIVEKAKSGIENSIKRVAKKQFEDPGVKQNELVTRALSNISLKQNELVTRALSNISLSTNISQAVSGADLVIEAISENLDVKRKLFAEVESALPQNGKMNGKMATNTSSLTLADIAANLKRKDSFGGLHFFNPVPIMKLLEVVRFDGVVRFDGTGEETFNVLMDFGKTVGETTVVCKDTPGFIVNRLLVPFMLEAMRMVVCKDTPGFIVNRLLVPFMLEAMRMFDSGDATKEDIDVAT

SEQ ID NO: 151601 - protein, 112 aa, Heterodera glycines
  Coding regions on vcDNA: vcDNA=SeqID_78024; Strand=+; Position=1 -243,685-780
  Homolog annotation: Hit_ID=NP_507845.1; Match level="QueryCoverage =72%, HitCoverage=11%, E-value=7e-20, Identity=50%"; Hit description =transposase family member (5U321) [Caenorhabditis elegans] emb|CAB81975.1| Hypothetical protein Y116F11B.
APDVCWNAPFKEAIRKLYNDWMAHGEKATTSGGNLKAPPMEVYLEWIANAWDSLPKQMIADSFLTCGISKEEKGRHDDKIHKCATEIELSNPLTGSSTTACLCSEAKSKEGG

SEQ ID NO: 151602 - protein, 53 aa, Heterodera glycines
  Coding regions on vcDNA: vcDNA=SeqID_78025; Strand=-; Position=1 -42,301-351,858-926
MLGWTFLNISKFKTFLHFLLVWTTRRGKSEALNVRFARWTNALTEVNKFDLIE

SEQ ID NO: 151603 - protein, 834 aa, Heterodera glycines
  misc_feature (17)..(17): Xaa can be any naturally occurring amino acid
  misc_feature (117)..(117): Xaa can be any naturally occurring amino acid
  Coding regions on vcDNA: vcDNA=SeqID_78026; Strand=-; Position=1 -118,256-796,845-1344,1392-1796,1843-1963,2013-2305,2366-2497,2546 -2638,2688-2774
  Homolog annotation: Hit_ID=NP_508848.2; Match level="QueryCoverage =96%, HitCoverage=66%, E-value=1e-102, Identity=24%"; Hit description= major antigen like (273.8 kD) (XF611) [Caenorhabditis elegans] gb|AAM69078.1| Lin-5 (five) interacting p
CFWRVRHRSEASNRLLXKQPKIEKPTPSFPSVRSLPTKSPVRRRICNSIAGRSVGKSGRSRPLRHGFWVPLGDDSLIKALSAEETEEYLKGDRSERREKEAEEVRKLGQKQREKHGXIGKCSRRTAQNGRRTSENAVGRETARIFYRVSKGRERTERQGQNPSKFSDELISDFESSLAGRARLGRTQEDLGKYRQRIDTNAEHQREYSEIIATMQNKLLEYRRHILLEYRRHIADLQRHECDDRRLVAVPVGRLAIPAGAGDMTTTDWSARYGRDANYNYDAILMRGRGTPGKTTTRAEREKGETGERVKNTVLLLQLKKGRSTVWESITADLDCFLLLSVDELRVQLESERTQSDRLKADLVHLQRQFEQEMQEKDNQFRNRETNLTQYLNEEQKKVTDLWNELQNRETNLTQYLNEEQKKVTDLWNELQRVRRQFADLRDQTERELSEQRHEFSRIMRNVRTMGDGSEGKADKSDQKKEKPNDRRRTIVNTDNVLIELIRRIKERGGAEAAGKLGPDLELLNKLRGETTATVEPELYRELIKKYEEATEYEEATERNIQLETDGDENARRVAEVEKELRKTQEKLAECQKAIRKVNEMSKAIRKVNEMSTHGTHEGTRSRSLSPAGNALVLSPAETVRNVRNALRNRDNEIQQLEQRLKGNGRQIEELGTKLSQNEETRRRVEKELNGARRENGEMLRQLEEALRQLEEAERSRKRTEEKLKSMQNEKAIAETAQNNLENEIRRLKQELEKAISELEKAISEGKRKAHEEADDYAISMETDYKNRIDELNKRIGTIQEEKQGLKIDELNKRIGTIQEEKQGLKNRIDTVKSK

SEQ ID NO: 151604 - protein, 148 aa, Heterodera glycines
  misc_feature (145)..(145): Xaa can be any naturally occurring amino acid
  Coding regions on vcDNA: vcDNA=SeqID_78027; Strand=-; Position=1 -76,329-453,702-836,1191-1317
  Homolog annotation: Hit_ID=AAF01032.1; Match level="QueryCoverage =95%, HitCoverage=33%, E-value=4e-65, Identity=83%"; Hit description =casein kinase I epsilon [Xenopus laevis]
MELRVGGRYRLGRKIGSGSFGDIYLGENIMTHEEVAIKLECVKTKHPQLHIEAKLYKMMSGGVGIPQVRWCGFEGEYNVMVMELLGPSLEDLFNFCSRKFTLKTVLLLADQMLARIQYIHSKDFIHRDIKPDFTLFGLVKKHSFXTFS

SEQ ID NO: 151605 - protein, 277 aa, Heterodera glycines
  Coding regions on vcDNA: vcDNA=SeqID_78028; Strand=+; Position=1 -572,1047-1308
MAPSCQCSSCTRPSSFSSAHPSPCHGSEIGFSTCDSSSAQFSTFDTNSNNHFGDGCSSTASCSEANSASASSVGGEPTSYREEEAVQGVEHEENSAGQQQQAQIEQQQYFPAFPIGPQGQFPALPIEPQGQFVPQEIPSAPQQQSFAVENANNGPAAPSFVCQSNEDDKGGRENNMINSIPQHMLFQKEVFQIAAFASAQGVCLPDGRPANSNNGTIPPMCGQGATSNGEMYEEKHQQLRDGDKCAGAEEKRTVPEAEEDYQLTEGTGRSETNADEQ

SEQ ID NO: 151606 - protein, 95 aa, Heterodera glycines
  Coding regions on vcDNA: vcDNA=SeqID_78029; Strand=+; Position=1 -136,502-650
MAIVMVDEQQQHHHHHQQQPVSAAAIGPIETQQSAEVSTSSSTIQEISVTQIGQLIHSIVAICTDYYAGSRLVGVWAPLLVASVLCIAIGTTISM

SEQ ID NO: 151607 - protein, 77 aa, Heterodera glycines
  Coding regions on vcDNA: vcDNA=SeqID_78030; Strand=-; Position=1 -49,98-282
MKKWDKKFGIKQNISKGRKHYTIVEKMEKMKQYFELKNQNPKLTDRKIAEILNITKRSLERYKAEFKRKSEGVLNTE

SEQ ID NO: 151608 - protein, 229 aa, Heterodera glycines
  Coding regions on vcDNA: vcDNA=SeqID_78031; Strand=-; Position=1-688
MKILLIFIFLRVLILENAIDQIEAGKINQEKSFDEIFGQKWDERTEENICQIDEIMQGQNVDQNIQAGPNDLQINQKFDESLEVKEEESDEMSTDCDELGGQLPMPTNNGQIYDQIRILNDKQKREIVEKFHKIKEKVKQMGKKYSKKEWKKIERKIAKKLGVSQEKIYKWKREFGLIKNRHSDEERRKMLKQFDQIYSKLKMKLNGKLEGKKKKCKKIIAKHLGINIS

SEQ ID NO: 151609 - protein, 190 aa, Heterodera glycines
  Coding regions on vcDNA: vcDNA=SeqID_78032; Strand=-; Position=1-572
MKILLIFIFLRVLILENAIDQIEAGKINQEKSFDEIFGQKWDERTEENICQIDEIMQGQNVDQNIQAGPNDLQINQNFDESLEVKEEESDEMSTDCDELGGQLPMPTNNGQIYDNFSKAIDKNKRETVEKFHKIKEKVKQMRKKFTRKEWTKIEIKIAKKLGTNREKIYKWKRELGMMTKKNHSIEEKRI

SEQ ID NO: 151610 - protein, 265 aa, Heterodera glycines
  misc_feature (249)..(249): Xaa can be any naturally occurring amino acid
  misc_feature (260)..(260): Xaa can be any naturally occurring amino acid
  Coding regions on vcDNA: vcDNA=SeqID_78033; Strand=+; Position=1 -29,1897-2629,3461-3497
  Homolog annotation: Hit_ID=XP_308960.1; Match level="QueryCoverage =93%, HitCoverage=51%, E-value=2e-31, Identity=33%"; Hit description =ENSANGP00000022672 [Anopheles gambiae]
NVLLLFFGILRCQGRLENTDLPNESKHPTFLPAEAWTTKLIVIHYDRALKHCGPRTLLSKLREKYWIPKGRQTVQHILNSNKFGCLKCRRERLKPYAYPDAPDLPEERVTETQPFNHTGVDYFGSLKVKQGNTTVKVYVALFTCLVIRAIHLEVVGDYSAEAFESLPAIFCTARHSSLMMSDQGTNVTAGAKTIQENWTAQLFPNEISGQLAHQGVTWLFNTAHAPWRGGAWERLVGITKNALRRSIGXNLLTFQMLYFXLSISD

SEQ ID NO: 151611 - protein, 360 aa, Heterodera glycines
  Coding regions on vcDNA: vcDNA=SeqID_78034; Strand=-; Position=1 -910,975-1147
MKMLLKFLLLCALIFENAIDQIEAGKISQEKSFDEIFGQRWDDGAEENICQIYQIMHGETVDQNQYDQQFDHLEVKEEQSEEISRNCDELGGQLPMPTNNGQIYDNFSKAINKKKREIVEKFHKIKEKVKQMGKKYSKKEWQKIERKIATKLGANQMKIYKWKRELGMMTKKNYSVEEKRIMLKQFDQIYGKLKMKLNGKLEGKGRKCQKIIAKHLGTNISSIQRWKKEIKVGKMVKNQKTDDEKREIVEKYLKVKIKFMQNGKHSQKEWKAFNAKIKQMFGVSYWTIEKWAKKLGIKQNNLKERKRFTIVEKMEIMKQYYLMKKETPKFSDVKIAELLNIELMSLIKYKSEFKEKVEMF

SEQ ID NO: 151612 - protein, 102 aa, Heterodera glycines
  Coding regions on vcDNA: vcDNA=SeqID_78035; Strand=-; Position=1-439
LFINGNYKFKCPFASAQFSRFVQSLASRSVAKINSESNDRFSLFPLEVLSAKSQVVAGIQYQLRIKVGRSNCSKNVSERANSATQVQQFPSNNKYFYFLYLK

SEQ ID NO: 151613 - protein, 61 aa, Heterodera glycines
  misc_feature (2)..(2): Xaa can be any naturally occurring amino acid
  misc_feature (13)..(13): Xaa can be any naturally occurring amino acid
  Coding regions on vcDNA: vcDNA=SeqID_78036; Strand=-; Position=1-204
VXNGEIITMSSFXADLSIDGRKIFLSRIDHFYCLPLLISLFSMSLSVGYIMFKNYNFKTYT

SEQ ID NO: 151614 - protein, 67 aa, Heterodera glycines
  Coding regions on vcDNA: vcDNA=SeqID_78037; Strand=+; Position=1 -112,155-246
MIETVIYLAKTGQPFRGNKDYGVLSVPKTVGEINAEQGLFRASLQYRCLSGDEKLKLHLETGGQIKS

SEQ ID NO: 151615 - protein, 181 aa, Heterodera glycines
  Coding regions on vcDNA: vcDNA=SeqID_78038; Strand=+; Position=1-546
MVLVIEFCAQILGCSPKSLRDKLNHPEDRVKALKELVGKKVRTTYKDRNGMQKTFFVDGISDKGAALTPAYGRLRQPYNINIAAHFYALHRIKLHLPYVPCVVEKYSGCGEDRYYPMELLEIVDDDYNQQKRRGLANCLPKSRTTSFPVKRFGRVEEVEEIDDNDDWGGRYECSQPSYVYW

SEQ ID NO: 151616 - protein, 161 aa, Heterodera glycines
  Coding regions on vcDNA: vcDNA=SeqID_78039; Strand=-; Position=1 -177,223-531
MQKVIRTLGCGLLYTDTDSLIFVHPIGMNRLETGPHLGQFTDEYPKHEIVEYCSGGAKQYGLKLRRNGQDEFVLKLRGITLNYDVMQNQSLCYDTFKEEVLRYAQTGEYEPINVMYPNFLRPDIRDGGHVTSGPLQKCYRPYVGKGIVGPNYDVLNFGHTL

SEQ ID NO: 151617 - protein, 171 aa, Heterodera glycines
  Coding regions on vcDNA: vcDNA=SeqID_78040; Strand=-; Position=1 -132,1467-1574,1807-2007,2250-2324
MSDELQWMVDDDDEDEHQHTNGTINRTVTVANRLKLPYTNAVICQWDNDNTEPTDFVEAFLKEKTKRDGRKRRRSDAPVQDTITNTLSWGIAYLNHHVQIQAKMSDELQWMVDDDDEDEHQHTNGATNRTVTVANRLKLHYTNAVICIFENPTAILSRTIPGRECKAKASE

SEQ ID NO: 151618 - protein, 80 aa, Heterodera glycines
  Coding regions on vcDNA: vcDNA=SeqID_78041; Strand=+; Position=1-243
MSEQNHESDDVLPTWAMVDFHEMSRRERLRIQQQEELKRQNQKKQTLEQFRQQRVEQKLQWEKEETEKKTPKHGRRGPMR

SEQ ID NO: 151619 - protein, 138 aa, Heterodera glycines
  Coding regions on vcDNA: vcDNA=SeqID_78042; Strand=-; Position=1 -99,268-585
MNETEKILDDPERLLDQIVGIVDEEDTIPLGAEAGTLNKEKRLKKNRRGGKKVQKLRAKSMEMDKISVTTYFYFCQQNFNLLCVSVYGSKTLESLNINMGPKFTVADVPLPIIETAGFSILRPVVSKNTNQTFTMFCK

SEQ ID NO: 151620 - protein, 269 aa, Heterodera glycines
  Coding regions on vcDNA: vcDNA=SeqID_78043; Strand=-; Position=1 -66,186-320,368-460,1182-1373,1478-1536,1579-1654,1860-1947
  Homolog annotation: Hit_ID=CAE71479.1; Match level="QueryCoverage =83%, HitCoverage=55%, E-value=1e-86, Identity=63%"; Hit description =Hypothetical protein CBG18398 [Caenorhabditis briggsae]
FSREHLWGKTKAAFKYAYEQYLNDFDWFLKTDDDTFVIVENLRFLLMAHSPEEPIYYGCKFKPFVEQGYMSGGAGYVGYMSGGAGYVLSRMALKKFVEEGLPDAKKCRSDEWGHEDVEMGKCLDKIGVKAGDSRDAEDHHRFFPFVPETHLSPDHMDKSFWFWKYTYYPMEEGPNCCSDYAISFHYVKPNSMYSLEYLVYHLHLFGNEIELKVSKNYSLEYLVYHLHLFGNEIELKVSKNGIILRNAYKLAIQNIGADDVFKNNEKTID

SEQ ID NO: 151621 - protein, 82 aa, Heterodera glycines
  Coding regions on vcDNA: vcDNA=SeqID_78044; Strand=+; Position=1 -213,1736-1771
MPNILEAQLPNDYFFYILRLFAVKLDEEAKERHGLKTRNLLNNEILVSRLVALGAELSQRQELLSCVPIMKVYYKFNWPLFL

SEQ ID NO: 151622 - protein, 83 aa, Heterodera glycines
  Coding regions on vcDNA: vcDNA=SeqID_78045; Strand=-; Position=1 -51,221-348,431-501
MAILKGITLPNCPLLNFTENSFFMGQIKSFAVISSVEIAESQQQSSGSFMATSFGRRRHWIADLAHPAKSCAISKSLTGVMTT

SEQ ID NO: 151623 - protein, 81 aa, Heterodera glycines
  Coding regions on vcDNA: vcDNA=SeqID_78046; Strand=+; Position=1 -152,297-390
MAGRAPDFSTVDFSTEDISTEGLFDSKGLFDRNILNLRRGLFDSGLFDSKICFNIPFTDTNTYESIDPRVRVGYSNNYGER

SEQ ID NO: 151624 - protein, 63 aa, Heterodera glycines
  Coding regions on vcDNA: vcDNA=SeqID_78047; Strand=+; Position=1 -61,142-272
MLLIQAALFYLPKWTLDKLLTCLLAIAVAQFAVVNALTGRGHRWWGIEMGKSLRSGDEIQVEN

SEQ ID NO: 151625 - protein, 77 aa, Heterodera glycines
  Coding regions on vcDNA: vcDNA=SeqID_78048; Strand=+; Position=1-234
TNFTSSNSAASSVGSRCDDFVRNSVGSRYKEFNSDPYTCECFFGGTGANLSNKNVHLPVTHPRPETDDAGTTAAGRI

SEQ ID NO: 151626 - protein, 30 aa, Heterodera glycines
  Coding regions on vcDNA: vcDNA=SeqID_78049; Strand=+; Position=1 -87,237-242
MGNVRCGKMNVVKHQSDAQHGHSVIDAQRD

SEQ ID NO: 151627 - protein, 52 aa, Heterodera glycines
  Coding regions on vcDNA: vcDNA=SeqID_78050; Strand=-; Position=1 -29,228-357
MLRFIYSWSKFRTATPKPFSMLMYKTPQLEASFSPIPGLDTKRLNLKMLALF

SEQ ID NO: 151628 - protein, 55 aa, Heterodera glycines
  Coding regions on vcDNA: vcDNA=SeqID_78051; Strand=-; Position=1 -3,591-755
MIFQQNNVTNLGLGQALRIASSIFPGTQASSRQTQVYKWTSNEIIFGIKARMEVQ

SEQ ID NO: 151629 - protein, 50 aa, Heterodera glycines
  Coding regions on vcDNA: vcDNA=SeqID_78052; Strand=-; Position=1 -68,541-625
MSELNSEGIFWTDSNGRQMMKRRRNDSSFFEGTEPVAANYYPVNRQNLIT

SEQ ID NO: 151630 - protein, 32 aa, Heterodera glycines
  Coding regions on vcDNA: vcDNA=SeqID_78053; Strand=-; Position=1 -46,683-735
MDQYTIGLDLLNASYGKTCRTKSAGNDLECFR

SEQ ID NO: 151631 - protein, 44 aa, Heterodera glycines
  Coding regions on vcDNA: vcDNA=SeqID_78054; Strand=+; Position=1 -105,262-291
MIREQCQKRASIKCYLIWWLFWGYTFSLKFQSFFNGCTRIIFIT

SEQ ID NO: 151632 - protein, 53 aa, Heterodera glycines
  Coding regions on vcDNA: vcDNA=SeqID_78055; Strand=-; Position=1-159
MTSGFIVYKSLLKGNMTNISTIKGLCAKTFNEGDSDYFTVHANISDLKMQTYK

SEQ ID NO: 151633 - protein, 126 aa, Heterodera glycines
  Coding regions on vcDNA: vcDNA=SeqID_78056; Strand=-; Position=1 -35,858-982,1023-1243
MELGYKIDKFYSEMSHENNGNKILEFVSGGSKQYSIKFENEIDGKIWYKTKMRGITFNKKNNFDHEDFKGMILNYKDEKRKYFNYDKFGPSRDSKILSQKMTKEYKPVQKKGIIDENFDIIPYGFW

SEQ ID NO: 151634 - protein, 243 aa, Heterodera glycines
  Coding regions on vcDNA: vcDNA=SeqID_78057; Strand=-; Position=1 -66,443-538,677-838,967-1318,1758-1813
MRKIFIEITKDSETPNGYDVFKGCVFHGLLYQNLCKYDIKDVKNVSNLFKLGSMECEVRRKLNPRDKENYDIEMKKYFDSIPDKGGVVKTKSNLTNIYDQSTPGMLLRVNYFTPYPVKTPKIIIPKSQDVLWQCPEDIPYDGNRNRIQKYKYFIGLLKVRAIPPKKLAIPLLPYHYDSILFFTNCSKCCQRAKSNFVFMKNVKKCNHSDSERGLHGVFTSIELKLECEISCRKQNNKPAFRVF

SEQ ID NO: 151635 - protein, 102 aa, Heterodera glycines
  Coding regions on vcDNA: vcDNA=SeqID_78058; Strand=-; Position=1-309
MLFVLLFLSLLAFIRAQFAATNPPAPEPAYVPPSNYQWGLNPWRRENWADASPHNQMYVDSSGRQGMRNVPMQVISGAMSDQADQWTTKGSTNHVVANNGIS

SEQ ID NO: 151636 - protein, 92 aa, Heterodera glycines
  Coding regions on vcDNA: vcDNA=SeqID_78059; Strand=-; Position=1-279
MRQELVDVWKKMRKKTTEIENGRERNIEEKVNGKKKGREGKGNCCKCKSWKGKQTEEKGTQTEKEMPKVAKGAIKGDKKRLKSGDDQNGQIA

SEQ ID NO: 151637 - protein, 61 aa, Heterodera glycines
  Coding regions on vcDNA: vcDNA=SeqID_78060; Strand=+; Position=1-183
MAIKRAFERLRTDGAAAEERLARLAAETAEVNATAGGITANLSERQWRKRKSGQMRTADRK

SEQ ID NO: 151638 - protein, 100 aa, Heterodera glycines
  Coding regions on vcDNA: vcDNA=SeqID_78061; Strand=+; Position=1-303
MYIKLNKLISETKLIYEQIKSDTNPVDKKKKIGEICKITQAFCTDVNDDNCLYSPNILKNVKEIETSIIMLKSNNTKVFKDCKDLQKLIEVIEKQNGSKD

SEQ ID NO: 151639 - protein, 200 aa, Heterodera glycines
  Coding regions on vcDNA: vcDNA=SeqID_78062; Strand=-; Position=1-603
KGSKELFGEIDAQTNPEAKKANLDEICQKTQEYCTYVQNSIKDNKNIFSVYEIFDQLKVIEESIPKLKSNDPKLFEDFAKLKEVIGENSNLGTNPKLTNVLENLEELKSKIKNLKDVRPATNDNPVALKKQILQEIFAKTKNFCNIFREILGEFDIKTDNIENGIKQIEQNITELKMHNYQVVEDLANLQQMIEDKIENA

SEQ ID NO: 151640 - protein, 33 aa, Heterodera glycines
  Coding regions on vcDNA: vcDNA=SeqID_78063; Strand=+; Position=1 -69,1034-1066
MEATKAVYRHLFLWGNGNRLKTEAVHRKLILKN

SEQ ID NO: 151641 - protein, 78 aa, Heterodera glycines
  Coding regions on vcDNA: vcDNA=SeqID_78064; Strand=+; Position=1 -62,275-449
MSTPYSLPKIPKKSLQMNGCICFNCLFLYLKVMRGVVCLPHICSRLKGMSIYHTGYKRTRRNQHHMIMEHTMMFLLPK

SEQ ID NO: 151642 - protein, 165 aa, Heterodera glycines
  Coding regions on vcDNA: vcDNA=SeqID_78065; Strand=+; Position=1 -90,130-364,567-739
  Homolog annotation: Hit_ID=NP_495467.1; Match level="QueryCoverage =60%, HitCoverage=11%, E-value=2e-13, Identity=40%"; Hit description =adenosylhomocysteinase 3 (2H392) [Caenorhabditis elegans] gb|AAA82421.1| Hypothetical protein F10E7.8 [Ca
MENKESLLVHLFEMMPSFVRGKTPHFPIKKILLLSWKVLLATLGGTDFLRKEKARKRAEAGLSPVTDTVQVAMKMKPLLSCDGSVGTGALLGLNSASGGDGKAETDSGTHDEPNRREESNKTFPVDKKGEGGEAFGGMSEETKQIAEEVDEAIVGGRNQENEVRP

SEQ ID NO: 151643 - protein, 228 aa, Heterodera glycines
  Coding regions on vcDNA: vcDNA=SeqID_78066; Strand=+; Position=1-7,53- 182,232-390,451-512,573-675,723-948
  Homolog annotation: Hit_ID=CAE67540.1; Match level="QueryCoverage =99%, HitCoverage=22%, E-value=8e-58, Identity=48%"; Hit description =Hypothetical protein CBG13065 [Caenorhabditis briggsae]
QRKKHFHFQLPPGDSTTVFALPEPIVRGSLPALRRNLYVPLTELQLESEDRYNRFPFSQKEFIEDCPAERLYVRILPEMTEYVIALLKVILASLPSSKAKIDAVTILSDVLTPETDTNEVLSNSISLDLASFSHTNVLEETVRVAIDINRHKELIIKSASSLLILLLKHLRLNHTLQFENLARYLVLANCLPLVLKFLDQNICRYFQAKHELAPFNYPQCALFFVRNG

SEQ ID NO: 151644 - protein, 134 aa, Heterodera glycines
  Coding regions on vcDNA: vcDNA=SeqID_78067; Strand=+; Position=1 -244,458-618
  Homolog annotation: Hit_ID=NP_495467.1; Match level="QueryCoverage =52%, HitCoverage=7%, E-value=4e-17, Identity=57%"; Hit description =adenosylhomocysteinase 3 (2H392) [Caenorhabditis elegans] gb|AAA82421.1| Hypothetical protein F10E7.8 [Cae
MQARYLGRQWRKTNMDLISGIYLRVRHRLNDDWAFANEVMRTKSIDSQQEENELGLAIRRFNARRYPYIYRDGGGQTETYSESHVGVAREGEEQHQQHERVFSSVTDAVKLGFVDEWEPKEWEPTDNVWFSLAG

SEQ ID NO: 151645 - protein, 189 aa, Heterodera glycines
  Coding regions on vcDNA: vcDNA=SeqID_78068; Strand=+; Position=1 -104,596-848,971-1084,1485-1583
  Homolog annotation: Hit_ID=NP_495750.1; Match level="QueryCoverage =84%, HitCoverage=49%, E-value=3e-43, Identity=76%"; Hit description =chaperonin Containing TCP-1 (58.4 kD) (cct-4) [Caenorhabditis elegans] emb|CAA88861.1| Hypothetical prote
MDRALKEERNYILELCKQIKKAGCNVLLIQKSILRFDHHLCFSPTGGGAPEMEVSVRVRAAAQTTHGAEQYCWKAFADALEVVPYTLAENAGLSPIETVTEMRSQHAMGNKEHGVNVRMGAITDIREENVVQPLLVSSFAVKQAAECVRSILKIDDIVIPCCRLSTMATFYGLEFGIRTMLYDRGTSCV

SEQ ID NO: 151646 - protein, 61 aa, Heterodera glycines
  Coding regions on vcDNA: vcDNA=SeqID_78069; Strand=-; Position=1 -33,106-258
MAMGEAKEWDERRIPRPQRRWLMRTTELKEGSGGDKYVKRVVSESELNALLKNAWLGKKRR

SEQ ID NO: 151647 - protein, 64 aa, Heterodera glycines
  Coding regions on vcDNA: vcDNA=SeqID_78070; Strand=-; Position=1-216
  Homolog annotation: Hit_ID=NP_495750.1; Match level="QueryCoverage =62%, HitCoverage=7%, E-value=9e-09, Identity=72%"; Hit description =chaperonin Containing TCP-1 (58.4 kD) (cct-4) [Caenorhabditis elegans] emb|CAA88861.1| Hypothetical protei
MNCLLPKLWFSHYYDMFESFQGAITDIREENVVQPLLVSSFAVKQAAECVRSILKIDDIVSLTQ

SEQ ID NO: 151648 - protein, 96 aa, Heterodera glycines
  Coding regions on vcDNA: vcDNA=SeqID_78071; Strand=-; Position=1 -11,73-352
MNRRWICNDVWMDIFPSFDRPQLGLKLALLSPRFNALVDKHFNGKSELTIWRPIAIRRKDKGPEPKLSVWMDDKIVEFPLPDYPLTSKIRFNHLRI

SEQ ID NO: 151649 - protein, 81 aa, Heterodera glycines
  Coding regions on vcDNA: vcDNA=SeqID_78072; Strand=-; Position=1-246
MHRVDQCRLDVALFAHEQKVLHYVLFALPLQFSVQQIERRKGVEVNAMVSKKGTTESQAIDASATAVAEQMSDRSLGEGSK

SEQ ID NO: 151650 - protein, 81 aa, Heterodera glycines
  Coding regions on vcDNA: vcDNA=SeqID_78073; Strand=-; Position=1-246
MHRVDQCRFDVALFAQQQKVLHYVLFALPLQFSVQQIERRKGVEVNAMDSKKGTTESQVIDASATAVTEQMSDRSLGEGSK

SEQ ID NO: 151651 - protein, 95 aa, Heterodera glycines
  Coding regions on vcDNA: vcDNA=SeqID_78074; Strand=+; Position=1 -135,261-405,708-715
MKGVTSNEKEMRKFSEEWAESVQQFKRLLKHLATVKPHLTRETLSKSIAKLEIEELEIAEWTKTIGEDKKKADIMFDNFMKKELGILRMLLHSAA

SEQ ID NO: 151652 - protein, 91 aa, Heterodera glycines
  Coding regions on vcDNA: vcDNA=SeqID_78075; Strand=+; Position=1 -183,603-695
MNCMFKTAKWISCLKSMAVITDDDQMLRYIELSIRDADGKMAKLKGQSSREEQQKSIDALRKFKECYIKERTLFETASGNGGGVQISDRKC

SEQ ID NO: 151653 - protein, 95 aa, Heterodera glycines
  Coding regions on vcDNA: vcDNA=SeqID_78076; Strand=-; Position=1 -212,272-347
MEMVPFELVNEWTKEKLTLAKANEFDKSWIMKRCKIGETTAVKQQQKKDENWDNNCNNVYFWLFSANNCIGPLSPPPAEEVEEEAGQCITKGPNE

SEQ ID NO: 151654 - protein, 85 aa, Heterodera glycines
  Coding regions on vcDNA: vcDNA=SeqID_78077; Strand=+; Position=1 -111,421-567
  Homolog annotation: Hit_ID=CAE60688.1; Match level="QueryCoverage =55%, HitCoverage=7%, E-value=1e-15, Identity=74%"; Hit description =Hypothetical protein CBG04341 [Caenorhabditis briggsae]
MRQCMRKVLPVDASDESRRTLAETEEYKGGLLMNEWWEYKTYKDNFLKKFELLHLPEYLIITYDRFHKNQWFIEKNPTIVNFPIR

SEQ ID NO: 151655 - protein, 110 aa, Heterodera glycines
  Coding regions on vcDNA: vcDNA=SeqID_78078; Strand=-; Position=1-661
  Homolog annotation: Hit_ID=CAE60688.1; Match level="QueryCoverage =94%, HitCoverage=16%, E-value=2e-39, Identity=72%"; Hit description =Hypothetical protein CBG04341 [Caenorhabditis briggsae]
VVGKLIFAEQTKEIPFLSLAMDLPPAPLYLDERLQNIIPQVPLSTLLMKFNGQTEKEYKTYKDNFLKKFELLHLPEYLIITYDRFHKNQWFIEKNPTIVNFPISNVDLYE

SEQ ID NO: 151656 - protein, 310 aa, Heterodera glycines
  Coding regions on vcDNA: vcDNA=SeqID_78079; Strand=+; Position=1-931
  Homolog annotation: Hit_ID=AAH44265.1; Match level="QueryCoverage =99%, HitCoverage=71%, E-value=5e-33, Identity=25%"; Hit description =B52-prov protein [Xenopus laevis]
MKSDRAKSNNGMKSDRAKSNNGMKSDRAKPNNGMKSDRTKPNNGMKSDRAKSNNGMKSDRAKPNNGMKSDRAKSNNGMKSDRAKSNYGVKSDRAKSNNGMKSDRAKPNNGMKSDRAKSNNGMKSDRTKPNNGMKSDRAKSNNGMKSDRAKSNYGMKSDRTKPNNGMKSDQAKPNNGTKSDRTKPNNGMKSDRTKPNNGMKSDRTKPNNGMKSDRAKSNNGMKSDRAKPNNGIKSDRTKPNNGMKSDRTKPNNGMKSDRAKSNNGMKSDRAKSNYGVKSDRAKSNNGTKSDRTKPNNGMKSDRAKSNNGTK

SEQ ID NO: 151657 - protein, 183 aa, Heterodera glycines
  Coding regions on vcDNA: vcDNA=SeqID_78080; Strand=+; Position=1 -197,550-904
MTLGHYDAWTFRRLDIMTLGHYDAWTFRHLDIMTLVHYDAWTFKKANRCRSDKNGFLLGEVTKRQIMKSLLLKLFVGLCFIDFTSNIKSKFEDFLENQEAMKLIQNYQEKRIKTIKELHAELTKKGIKLAERSLRLYLCKIKSANSDTSKESPNIPEIKFEKQDREEYFWQTFTPNMDHSVKD

SEQ ID NO: 151658 - protein, 43 aa, Heterodera glycines
  Coding regions on vcDNA: vcDNA=SeqID_78081; Strand=+; Position=1 -66,305-370
MAKNVLKHTNLRFAQNNRQKLRRLIYLNGCIGRVSKFYIEKIA

SEQ ID NO: 151659 - protein, 62 aa, Heterodera glycines
  Coding regions on vcDNA: vcDNA=SeqID_78082; Strand=-; Position=1 -97,499-590
MVAQSEKRWHAEAIAFLFEGATKYGMGQHSQKGLCRHVANGVQLCEGDLMHLRNVDHFELWR

SEQ ID NO: 151660 - protein, 249 aa, Heterodera glycines
  Coding regions on vcDNA: vcDNA=SeqID_78083; Strand=-; Position=1 -577,680-852
MEKARKSTPPRSMTLEALLEECRSIQSLKNSAAALSGPGQVHSVQVRPQRVSDGSKKSNRGKMVNQKGNVSVPNSKEYNFPFNSNRTDEDQQQKCKRCGQFHVNDCPYAADVNCYRCGKRGHIRPVCPERTQSNAVTVASTFCVTQNCHDWIWTQPLINGHPVKLVADSCSHLTIIQEPLWISLGSPKLRKQVANTGAPNIMGLDWIVPFEKATQSPIATTLDLSNAPTKVNTIDERPRHFKTVTLFSC

SEQ ID NO: 151661 - protein, 177 aa, Heterodera glycines
  misc_feature (167)..(167): Xaa can be any naturally occurring amino acid
  misc_feature (171)..(171): Xaa can be any naturally occurring amino acid
  Coding regions on vcDNA: vcDNA=SeqID_78084; Strand=-; Position=1 -140,236-399,506-560,1377-1548
  Homolog annotation: Hit_ID=NP_508238.1; Match level="QueryCoverage =99%, HitCoverage=25%, E-value=4e-47, Identity=55%"; Hit description =5-hydroxytryptamine receptor (XB915) [Caenorhabditis elegans] gb|AAA82470.1| Hypothetical protein C52B11.
REKSRQMIKQLNEQRAARTLSIVVGVFILCWTPFFLFTPLIALCGNSFADYETVFSIFTWAGHLNSMLNPLIYSRFSRDFRKAFKQILTCERERPTKKAIKSPLSPLNIVLAQLTSMAQIPPTFRYLLEIPIKNRKHAKLIRNHWHLRKWHHKSILNKIIPLLFHIXFLFXLKQTDK

SEQ ID NO: 151662 - protein, 263 aa, Heterodera glycines
  Coding regions on vcDNA: vcDNA=SeqID_78085; Strand=-; Position=1 -32,152-211,762-844,928-958,1265-1333,1392-1453,1515-1608,1656-1981
  Homolog annotation: Hit_ID=CAE63568.1; Match level="QueryCoverage =97%, HitCoverage=64%, E-value=2e-65, Identity=51%"; Hit description =Hypothetical protein CBG08056 [Caenorhabditis briggsae]
VSLAVADLIVGLVVMPLNSLFEMSRHVWLLGLTTCDIWHALDILASTSSIWNLCVISLDRYMAGVDPIGYRDRVSKRRIIYCICCVWLVSACISFPAIFWWRASSPHLYKDKRRCLFTDDAYYVVFSAMISFYIPLVLILFAYGRVYCIATTHSRSRVYCIATTHSRSMKSGEKRVSVYALSGPTDQIKSKKRGKKMEESDRCEFKYFLKSLNSPHNLQILLKHRDRNSGKSAKSGSPAPNQCSRNHSAGSETLRSLRTETDD

SEQ ID NO: 151663 - protein, 159 aa, Heterodera glycines
  Coding regions on vcDNA: vcDNA=SeqID_78086; Strand=+; Position=1 -129,229-318,490-618,935-1066
  Homolog annotation: Hit_ID=E89551; Match level="QueryCoverage=93%, HitCoverage=19%, E-value=5e-13, Identity=28%"; Hit description =protein K04E7.2 [imported] - Caenorhabditis elegans
MVLAKTRNQQSAEPNNLLDHFLDDHNCERDKECDFGRKNVCGQAKFLEELRTVLSMILLFVPMPLFWAYQSHMLSIWSIQRVNVDPNLPMIGAFFSRDQIGLHLNIFVLVLIPILYKAYDDPILPSLRYLKRMASGIFLCALASAVSATVQFRLNVSVN

SEQ ID NO: 151664 - protein, 88 aa, Heterodera glycines
  Coding regions on vcDNA: vcDNA=SeqID_78087; Strand=-; Position=1 -44,673-895
MYKKWSKYVQKTPNIKLVDNLRHRVDQHIGLELMTIAAGFCSGDRTTGVGGIPSPGYRPNPDPDQSRTFWKNDRDGFRVGIPTESRSR

SEQ ID NO: 151665 - protein, 107 aa, Heterodera glycines
  Coding regions on vcDNA: vcDNA=SeqID_78088; Strand=-; Position=1 -209,1132-1244
PQNITKVIIDHRSINQSMANQSINQWSMVRRSPFSPAVKMRTDLITKKKRSDEHTKANSQSETKFSRQQKIFLGFESDDLLADGWTAQNGTFALYGSAKEATKIVPK

SEQ ID NO: 151666 - protein, 44 aa, Heterodera glycines
  Coding regions on vcDNA: vcDNA=SeqID_78089; Strand=+; Position=1-135
KMSKRGSVKHLAITSMMSTRMITQIAALKTDRHVWLMVPNVKPW

SEQ ID NO: 151667 - protein, 154 aa, Heterodera glycines
  Coding regions on vcDNA: vcDNA=SeqID_78090; Strand=-; Position=1 -351,399-513
EAESNGGEILYTDTDSIFVLHDRDVEPITTGKYLGEMSEEYGGYEIEEYCCGGAKQYALKMRNKQTGDIEYVMKIRGITFDVDNRKTLHYDTFREMVLNYGKGEVDPAFFVYKNDFGPTRDSKVVTREKHKMYRPVCQKGIIDEELNVMPFGFC

SEQ ID NO: 151668 - protein, 19 aa, Heterodera glycines
  Coding regions on vcDNA: vcDNA=SeqID_78091; Strand=+; Position=1-57
GPGSRSRILKSSGPGPGRA

SEQ ID NO: 151669 - protein, 148 aa, Heterodera glycines
  Coding regions on vcDNA: vcDNA=SeqID_78092; Strand=+; Position=1 -76,659-786,829-1071
  Homolog annotation: Hit_ID=AAL93203.1; Match level="QueryCoverage =73%, HitCoverage=16%, E-value=6e-11, Identity=32%"; Hit description =transposase [Bactrocera dorsalis]
MSHPIWQIGLFKRTTEDSVECLECKTIQKFHGAHTSERISEILKALLESWNVKECHCFVTISAANLVKALDLMHIERISCAAHDLNLCVKDCFSKEKDEMAQIFEKCRKIVGTLKHSAKLMDDLKDVQGELGLPKAKLLQVANYQILI

SEQ ID NO: 151670 - protein, 42 aa, Heterodera glycines
  Coding regions on vcDNA: vcDNA=SeqID_78093; Strand=+; Position=1 -31,366-463
MNNRRTTLYKNFFTALFFVTYIGASGFLKNCHPYAILKTAKI

SEQ ID NO: 151671 - protein, 246 aa, Heterodera glycines
  Coding regions on vcDNA: vcDNA=SeqID_78094; Strand=+; Position=1 -81,130-789
MIYSSAICFGIFIFNHFSIPFSNAIPFEDDNMFNAFVRNGHKMQINEYSKQKYEGHFGIVYFTRKNWQCDKIVDAFEEYERAECQKYRKYLDILYEYLYREYVGIQTVKPKFVFKERIEIEGSIIYAVICLARISLFYFKLSWSNDFKYKLSEFFIYNSEPKLLNEKRLNFEVKLVNENEMPINEMILQLAIDRAYEYQTIESLDAIIRQKFKKMLEEMFKKAEEMAKKHKWQTFFAIFYPYFLMP

SEQ ID NO: 151672 - protein, 41 aa, Heterodera glycines
  Coding regions on vcDNA: vcDNA=SeqID_78095; Strand=+; Position=1 -34,412-503
MALLSVVTRSFDARNSDTDSIQGQRIDRLPVPIIPSLTRCP

SEQ ID NO: 151673 - protein, 75 aa, Heterodera glycines
  Coding regions on vcDNA: vcDNA=SeqID_78096; Strand=-; Position=1 -96,412-543
MCPCRAVLVDGGCDSTVGLRSDCARPGPAALQLFELYAEDGLPWALIALTAVRTFISTIGIICNLALVYVTIKTK

SEQ ID NO: 151674 - protein, 148 aa, Heterodera glycines
  Coding regions on vcDNA: vcDNA=SeqID_78097; Strand=-; Position=1 -112,1085-1419
MGRKNISVAKGREKKDGLWMAGIVPGGLKEAGGPMPNKIFDQSEQLGRNNRQFYQIVVEIMEVKEEESEEKSSNCYELEQLDENNEQNYDHFPNKFDKMKREIMEKFNKIKEIINQMSNKYSDKRKRQKKKLCANRLKIYPNGKDNLE

SEQ ID NO: 151675 - protein, 130 aa, Heterodera glycines
  Coding regions on vcDNA: vcDNA=SeqID_78098; Strand=-; Position=1 -18,70-197,427-673
MNQNETLFELYAEDGLPWALIALTAVRTFISTIGIICNLALVYVTIKTNSLNGPCNILIAFDAAACAWFEIGSWIGMFQILVGQQFVPIRLCCVYLLLPFITGIYASMSATLLIAFDRLLSICFPIWCLI

SEQ ID NO: 151676 - protein, 51 aa, Heterodera glycines
  Coding regions on vcDNA: vcDNA=SeqID_78099; Strand=+; Position=1-155
  Homolog annotation: Hit_ID=CAA33804.1; Match level="QueryCoverage =100%, HitCoverage=6%, E-value=2e-18, Identity=90%"; Hit description =unnamed protein product [Drosophila melanogaster] pir||S05988 translation elongation factor eEF-2 - fruit
MLVIAHVDHGKSTLTDSQVSKVGIIAGAKSGETRFTDTRKDEQERCIAIKS

SEQ ID NO: 151677 - protein, 87 aa, Heterodera glycines
  Coding regions on vcDNA: vcDNA=SeqID_78100; Strand=-; Position=1 -114,491-637
MKRLMVLAVAGKVAEVKAVGHSSGWEEDEKDWCRVARKLAMTSTRWAEIEGEEEKRAFVKREVRRLEGWAMRTARKELVAEWPDVLR

SEQ ID NO: 151678 - protein, 32 aa, Heterodera glycines
  Coding regions on vcDNA: vcDNA=SeqID_78101; Strand=+; Position=1 -3,347-442
MFLSLGFEVVCFCIFFLRICYEESGSKIAFLR

SEQ ID NO: 151679 - protein, 174 aa, Heterodera glycines
  Coding regions on vcDNA: vcDNA=SeqID_78102; Strand=-; Position=1 -91,216-649
MPRKRTLTGRRERMLRRETSSRLGKADSVAVPSTSTNIRAQCSQPRGAVEPAVGTSPMDLGTCVVSTPTTTGLQALSIIGGLDLSKIKTKTIYIKQLPGSSNKRTRHSSNVGTQNNATQHTVQQREDASDVESVAGILSQFSHNFSTKSHRYSASEVSADAFCCGCEHSTLYKR

SEQ ID NO: 151680 - protein, 35 aa, Heterodera glycines
  Coding regions on vcDNA: vcDNA=SeqID_78103; Strand=+; Position=1 -65,211-253
MLGPVCRHAGILFIVIFQIIIRNGELSIENSKILK

SEQ ID NO: 151681 - protein, 346 aa, Heterodera glycines
  Coding regions on vcDNA: vcDNA=SeqID_78104; Strand=-; Position=1-1041
MSDSQSSDDELMYSADENFEMKVSVQSSKNNDKISEAKKHSNCQKDPLEDPPNFENLLDNSPNCQKDPLEDQQNFGKDSLEDQQNLLKNPLEDEQHFGKNPLEEKSKKFKIPEDLLGDSQKPKTRNYVPENIPKVVARSILVFIVDNQVEIELRQIMRKKEMKAMVFRPRKWDKNTIGTEIEIGTITQCIVIWRETMDAELLAVLTKVEEICYELLCIWVVPKGVPIHVMKKRFPAIVRVPEEENIDNLLTKLEQIGMPIEKRGEQRWHETASTNAPRVNWNQLGDGHRVQAAGSHSYNSFVAPHFSSYLPTTTTKMFFPTPEMPKKVKILEKSNQKNLIPLWYWE

SEQ ID NO: 151682 - protein, 22 aa, Heterodera glycines
  Coding regions on vcDNA: vcDNA=SeqID_78105; Strand=-; Position=1-68
EHSYTKTGVNIESSAKTIEKDF

SEQ ID NO: 151683 - protein, 424 aa, Heterodera glycines
  Coding regions on vcDNA: vcDNA=SeqID_78106; Strand=-; Position=1 -536,570-792,838-1218
  Homolog annotation: Hit_ID=DAA04498.1; Match level="QueryCoverage =99%, HitCoverage=22%, E-value=5e-49, Identity=31%"; Hit description =TPA: pol polyprotein [Schistosoma mansoni]
IFIPNNSYIATLFIRDAHLKTMHGGRELVNSKLRENFWIPKSRRKIYEILKRKNKEKCGICAKFTNNKSYPKNPPLPVFRVKGKSAFEHVGIDYFGPLSVKTLDGNKKCWGAIFTCLIVRAIHLELVSDVSAEKFLLAFRRFIKRRRVPKLIISDNGTNFVLASKALKQIALEENKQKIQNFSSNLGIDWQFNSPYASWRGGAYKQKIQNFSSNLGIDWQFNSPYASWRGGAYERMIGLVKTHLIRSLGKRLLSFEELMTYLIEVERIVNERPLSYITQDEGEPFSLKLDPTFDREDIGEPFSLKLDPTFDREDINEYFEKKTKREELFEIYKKAIFKSEIFWKEWSEKYLLSLREKHINKNKDGNKYPKIGQVVIVSQDNYPRSMWKLGKIFEILSDRTVKLKIGNRMAERPTKLLYPLEIED

SEQ ID NO: 151684 - protein, 33 aa, Heterodera glycines
  Coding regions on vcDNA: vcDNA=SeqID_78107; Strand=+; Position=1-173
FSVSVSNFYFRKMKMPARCDKNIFQNKQICLKI

SEQ ID NO: 151685 - protein, 249 aa, Heterodera glycines
  Coding regions on vcDNA: vcDNA=SeqID_78108; Strand=+; Position=1 -205,279-406,460-876
MREMEDVLILSFKQLPIWFLWASSSSRPLGLFCIRVSLQQLCPLYISQIHNPSKSNSRHRLANSSSNNYAQGNFGPMHSSSSTSPLFGVRQMSYFGPGGASVQPNWNQQRQAQYINNPQLGQQNNIMSPPKQQQQFVVANCKPSQPCQISSFPADVVQQQQQTIGFPPPPSQSLQNSPPVATKQELNQHQYHQQMLVQQQQQQRYATSYTQQQFLSQPNPTAFPMGSNYGVVDHRQFMSQPCSIPSGTS

SEQ ID NO: 151686 - protein, 72 aa, Heterodera glycines
  Coding regions on vcDNA: vcDNA=SeqID_78109; Strand=+; Position=1 -105,406-519
MCSIILFTFCCCSAEYLHKCCVDPEKQYKMVKRNTEDLVNELRKKDECAGKNRKCFCWAHTKIYSESAGGWC

SEQ ID NO: 151687 - protein, 81 aa, Heterodera glycines
  Coding regions on vcDNA: vcDNA=SeqID_78110; Strand=+; Position=1 -169,353-429
MPTTFSICMDAESAAVLRPFLNLNSLANCQCGWAKCVNGWRVAAVRSVQLQQCCVTAKADFCFQLNAVEPFNKSEVPNKIY

SEQ ID NO: 151688 - protein, 330 aa, Heterodera glycines
  Coding regions on vcDNA: vcDNA=SeqID_78111; Strand=-; Position=1-992
  Homolog annotation: Hit_ID=XP_319741.1; Match level="QueryCoverage =78%, HitCoverage=59%, E-value=1e-28, Identity=30%"; Hit description =ENSANGP00000006515 [Anopheles gambiae]
MDKTLAEILEKLTQAIKQQSAPTSTTTPPAQNITLPDIHPFSTENVEEFEEWLERFQFALDCAAANMADEAKVKLLMTKLNPAAFGEYKRYCLPEEITKFNFTDTKSRLIKLFSHPPSLAINRYECLRVCRENGEKFEIFVNRLKAALRKFRFSELNEEEFKCLVLLTSLKSPSDAKLRQHILARLTAEGTKTTKTSKLFDKVVEDLNTQLKTEAEAKILEQPKPKINAIQHGKSSPNKHQNRGNGRPNQKFTGKSKAKIPPSNCYRCGELHWAQDCPKKENICSKCNRRGHIDRQCDKIRAFHQNKGRNFNTNTVMLSAAYINSVHSSN

SEQ ID NO: 151689 - protein, 543 aa, Heterodera glycines
  misc_feature (465)..(465): Xaa can be any naturally occurring amino acid
  misc_feature (495)..(495): Xaa can be any naturally occurring amino acid
  Coding regions on vcDNA: vcDNA=SeqID_78112; Strand=-; Position=1 -1372,1403-1594
  Homolog annotation: Hit_ID=XP_318550.1; Match level="QueryCoverage =99%, HitCoverage=55%, E-value=1e-120, Identity=42%"; Hit description= ENSANGP00000020240 [Anopheles gambiae]
IVAADASQHGIGGVISHKFANGSIKAMSHFSRSLTPAEQNYGQIEKEALALVEAVKRFHKMIFGRKFTLLTDHQPLKKIFGNKDGVPKHSHNRLVRWSLILTAYDFEIQYVKTDKFGQADALSRLISVQKSKSDDDEVIIASFEVESALDRNLINNVNQLPITFKNLAQETANDQALQQIRQFVKNIWPAPKNSIEGLDVIQFFRRRDEISIVKDCLMFGDRTVIPKSLQKQIQAAHQGHPGVKRMKSLARMHVYWPMMDAEIETFVQKCTSCAAVAKNPIKTTLQSWPKSDGPWKRIHIDYAGPFHGKMYLIVVDSFSKYPEIFEMNSTNASKMRSIAHYGIPETIVSDNGTQFQSHQFEGFVKSNGIDHIFTVPYMPQSNGQAERMVDTFKRAFAKIKGEGVDGNVLDTFLLTYRTTPSDTLDGKCPAELFLGRKPRIGLDLLRPPLSDQFNRKHGAKFRSFXIGQLVFLDLLRPPLSDQFNRKHGAKFRSFXIGQLVFTRRHNSAEWRHGKIIDKKGVIYTVELPNNSRRFHANQIRARQ

SEQ ID NO: 151690 - protein, 222 aa, Heterodera glycines
  Coding regions on vcDNA: vcDNA=SeqID_78113; Strand=-; Position=1 -24,949-1053,1526-1722,2221-2316,2495-2691,3183-3228
  Homolog annotation: Hit_ID=CAE64347.1; Match level="QueryCoverage =97%, HitCoverage=41%, E-value=1e-80, Identity=66%"; Hit description =Hypothetical protein CBG09034 [Caenorhabditis briggsae]
NGANRIALDTRAHAESAKEALDGKTIHGRQLRVRYSVHGATIKLKELSPAVSNEMLMLSFSAFGDVERAIHIVDEKGRSTGEGIVEFERKVSAQEAIAQIRERVFLMTTNSRPLQADFLDQKDDEDGLCEKTIQRTPYLYKERELGPRFAQMNSFEYIYGRRWKDLYEFERKRRAEVEAELREQRRRLDADMEAEYEDYKAQMLREELLHRQEELDRLEAQR

SEQ ID NO: 151691 - protein, 447 aa, Heterodera glycines
  Coding regions on vcDNA: vcDNA=SeqID_78114; Strand=+; Position=1 -396,536-695,833-1126,1406-1530,1577-1645,2035-2170,2327-2490
MCSYENGLAPDKRMDIFQFVASPNANPDNNTSINSEAASVDQNLPHLMHRMEELQPKLMSLNMNLANRNRDEIVNDGKEKEEPKKGDKAEDEANKEEEIVVLNPYLYLTNEAMEKMEKEHKEKDSAEANSDTTNANSLDKEKQPTAPIQLGNKRKLGDGVNKDNGEEDLMKLSTHNSEEPVDNGNVAYVSSFSSRSSTTTMSSVEDEEDSGTNAGDDGWMVVKKESFKKLCDFYEKRRRVECGGGTVAADPFAEQLEREFREATMADNNRTDERVDEKLTAESEPKKAGEFVKEVGQEPAAAVYVAQIVDLTTEKDGKSENSEKVTIPCVHSVVMRGVCAGCGQDFRQEKEPRGGTLMGCVDGEEVCTAGLPYPGYQKPKGQKHSRHCEWKHKNLVIQSLVEQLVGMGFDNCNGWLFRVAEKEGAELDRIFVAIDEDKMYRARISLQ

SEQ ID NO: 151692 - protein, 35 aa, Heterodera glycines
  Coding regions on vcDNA: vcDNA=SeqID_78115; Strand=+; Position=1 -73,318-352
MSKMLVSSFLLLPLLLVLLPTMDNVSKNEEKEKIP

SEQ ID NO: 151693 - protein, 177 aa, Heterodera glycines
  Coding regions on vcDNA: vcDNA=SeqID_78116; Strand=-; Position=1 -434,858-958
EFLLFLAKSCLAPSSVASSSTSTGGSSSSSPKKSNVQQQHQIPEEEEADVENGCGDNANAVVANDFNDEMPSSLFCIDEEDETLVATTTTATTSGINNNLSSMMSDGEIADDGDGDDNDDDDNEVVVVVVDDGGGGGLPLFKCDVFSREKFIDEITVMEQNYYRPILILINNKGGHT

SEQ ID NO: 151694 - protein, 352 aa, Heterodera glycines
  misc_feature (3)..(3): Xaa can be any naturally occurring amino acid
  misc_feature (289)..(289): Xaa can be any naturally occurring amino acid
  misc_feature (348)..(348): Xaa can be any naturally occurring amino acid
  Coding regions on vcDNA: vcDNA=SeqID_78117; Strand=+; Position=1 -171,268-433,477-563,1315-1514,1563-1623,1707-1895,2049-2090
  Homolog annotation: Hit_ID=CAE65000.1; Match level="QueryCoverage =97%, HitCoverage=62%, E-value=3e-45, Identity=34%"; Hit description =Hypothetical protein CBG09838 [Caenorhabditis briggsae]
HFXLKDYVKGLELIPSFMNWCVEMGIRHSGLDILCSPHGLCLVLQNLLKREQLLPKHILQDKLLHILQDKLLQSMENVALAICVAHEVLRGSESQWAAYFTTLPSTFPTPLFYSEEQLTALKPSPVFEESLRMHRAIALKPSPVFEESLRMHRAIARQFVYFYLQIAINFVKIFGKTHFRAINVLPKMFAKSPFTTQNFTFDFYRWCVSIVSTRINMVPSQHKKGEDGQPRMIPALLPFIDMANHANSIPALLPFIDMANHANSAANPVKIIFPTPKIIFPTPNLQKIXKIKLNKPIVNGEELFIHYGPRTNAKFLLHNGFVPQQPNPDDLFELKIGKPKCDPVLKAXSNLH

SEQ ID NO: 151695 - protein, 85 aa, Heterodera glycines
  Coding regions on vcDNA: vcDNA=SeqID_78118; Strand=-; Position=1-255
MRSPFCYGTSQPFGLYRYPRNIPANSASNFQPEALKYKATLKPKSYNHKSRNSALKKSQSAMEWTTNRPAPYFPRNDYAAFSTSQ

SEQ ID NO: 151696 - protein, 207 aa, Heterodera glycines
  Coding regions on vcDNA: vcDNA=SeqID_78119; Strand=-; Position=1 -288,543-713,984-1147
MLRSQSAASVSEIDLTSNSVFNASSLGLSLVKKEDSSAHDQSNSFSAPKNAEQLSKCLLDVETAKRLLASKLPLPELRPLMVGCYMRYHAIREILKDSECNFFIDKIIHVNRDGIRFKHCRDNSYRSIHKIKEPENAIDQRGFNLWINDMKKWNEPLPYMDLQLLILKSIRKAVSSLEEGESQSLMDSTDKTTVPEKPCNISRASLT

SEQ ID NO: 151697 - protein, 87 aa, Heterodera glycines
  misc_feature (5)..(5): Xaa can be any naturally occurring amino acid
  misc_feature (19)..(19): Xaa can be any naturally occurring amino acid
  Coding regions on vcDNA: vcDNA=SeqID_78120; Strand=-; Position=1 -56,111-319
AYHSXNGCNFLGNSIGYLXIRQLTYSIITKMTKFQDDCQRPLEQHVRFGCPRNTDYLVHEDERLTSLFILLNIGIWRSTYLCVKSSH

SEQ ID NO: 151698 - protein, 188 aa, Heterodera glycines
  Coding regions on vcDNA: vcDNA=SeqID_78121; Strand=-; Position=1-567
MQICVLLILFLINLIDQTETEKKKLEQKSCDGIFGEKWEEKEEEKRNELKKREIIAKFYKIKEKIKQKGRKYSTKEWNKINLKIAKKLGTNRLYIYKWIKEFGLQKQIQKSYKSKTDEEKLEFVQKFIEMKKEYKQKRKYSPKEWKKNYVEICKKIRVNYGMIKKWKKQFGIRSKITEEQKIEKMKNL

SEQ ID NO: 151699 - protein, 137 aa, Heterodera glycines
  Coding regions on vcDNA: vcDNA=SeqID_78122; Strand=-; Position=1-414
MLCGELGPVLDAKTETGNVEISTPLQALLSLFILCSGATVSSSAAKNLVQLILGTEPGMELVVYEGVRKDNVRAGIFPNHEDVERVWILWCEKCAVAKKLLQSSGFDQSEWKNSGHHLTDAELTAGTPFFRGCDVLN

SEQ ID NO: 151700 - protein, 147 aa, Heterodera glycines
  Coding regions on vcDNA: vcDNA=SeqID_78123; Strand=-; Position=1-444
MVIYPGSKSKTQHKKLHWNHFGPYEIVKTLDSSASVVPVDKKSAEPITVPIERLVRVPIGVPDISTLPHGKNPYRNILATILLASLKLSKLDTKGIFGQFEPLLQTQFGENSLKSSKKIVVNQLGTTDNLGERKMKQRQQKENDGLS

SEQ ID NO: 151701 - protein, 172 aa, Heterodera glycines
  Coding regions on vcDNA: vcDNA=SeqID_78124; Strand=+; Position=1 -47,90-559
MSDEPKEAEKKMEKQIWMCGDNWLKVFELVPIGQLGLGIALVSRAFDFFVDEHFKTRKWTLDSILIRCKFAEDGQKEMQTFNSRDELVPIQKVPLPNKVVGFKCIRCRQLNMAHHLSDVDATNYYIQIHRPKCRGFSQPISPSFRRFWGKFVNYKHRRTNFGMGYAHLAYAQ

SEQ ID NO: 151702 - protein, 84 aa, Heterodera glycines
  Coding regions on vcDNA: vcDNA=SeqID_78125; Strand=+; Position=1 -26,214-442
MAFFTAFGRGGGAPVVSPFELINNLTGERLTFKMLNRKHAMLKRYPIAQDEQKWANWENDMMVMGAKNVIWIEDEFDKSRKKAN

SEQ ID NO: 151703 - protein, 42 aa, Heterodera glycines
  Coding regions on vcDNA: vcDNA=SeqID_78126; Strand=-; Position=1 -97,1126-1157
MAVKSLPMVTRSDRGVNLANQKLIFTKNGHQLEYYFLWNIFN

SEQ ID NO: 151704 - protein, 102 aa, Heterodera glycines
  Coding regions on vcDNA: vcDNA=SeqID_78127; Strand=-; Position=1-307
MAYSLTLLWTEARPFLGRLKQLKGIIPIHFVPNASYFALRLYELSCVRFVSNESSGTRGAICQKLHRLGFVGPQPEHIFTPAPVAVKYLRQHGLRPKLIVHK

SEQ ID NO: 151705 - protein, 69 aa, Heterodera glycines
  Coding regions on vcDNA: vcDNA=SeqID_78128; Strand=+; Position=1 -66,201-344
MSRTNRRDFSHKGNPSHLKTQNLDILKKAREPRLEQDFLEIWVVENPESWMVSMLDLDLNFLAKNPGKL

SEQ ID NO: 151706 - protein, 86 aa, Heterodera glycines
  Coding regions on vcDNA: vcDNA=SeqID_78129; Strand=-; Position=1 -198,357-416
MDHSLRSPQSHRTAFVFSSSLSSSDASVHFQNINNTVANAMSPILAGHPNCVVIAKIDLTMNNSPAGDYGALPSDLSEQMAGCLSE

SEQ ID NO: 151707 - protein, 173 aa, Heterodera glycines
  Coding regions on vcDNA: vcDNA=SeqID_78130; Strand=-; Position=1 -126,172-378,433-621
  Homolog annotation: Hit_ID=CAE66170.1; Match level="QueryCoverage =90%, HitCoverage=27%, E-value=2e-56, Identity=68%"; Hit description =Hypothetical protein CBG11408 [Caenorhabditis briggsae]
MDFINDRVTNLHNCTYLVLDEADRMLDMGFEPQIRSIVGQIRPDRQTLMFSATWPVEVRSLAADFLSSPVGLNVGSLDLSANHNIKQNVEVIEDFAKKDRLFVLLNDILKQTEYKTLIFAETKRKVDELTREMRYKGIPALCIHGDKSQKEREWVLSGEQMNYGCKISFNHKF

SEQ ID NO: 151708 - protein, 121 aa, Heterodera glycines
  Coding regions on vcDNA: vcDNA=SeqID_78131; Strand=-; Position=1-366
MITWLKHCAGGGQPQNRVGLAPGHFPSVGRAADTVPTAREGKVAVEADGGIIGTEVGKLRQFGGCHEQTKCNLNKSPTKHEWLEEKADQNDQKITLISYEFAELIQSYRTIIPMNVFNYVN

SEQ ID NO: 151709 - protein, 198 aa, Heterodera glycines
  misc_feature (1)..(1): Xaa can be any naturally occurring amino acid
  misc_feature (187)..(187): Xaa can be any naturally occurring amino acid
  Coding regions on vcDNA: vcDNA=SeqID_78132; Strand=+; Position=1 -258,309-635
  Homolog annotation: Hit_ID=CAE63605.1; Match level="QueryCoverage =92%, HitCoverage=23%, E-value=9e-40, Identity=47%"; Hit description =Hypothetical protein CBG08096 [Caenorhabditis briggsae]
XSAFSSNHSCLVGLLFVALGLFVTTSELPQLSDLHSAVGFDCDFSLPCRWHSVGGTADRWKMARGEPDSILWLAATGTMLQPTEPFALLEVREEPFALLEVREGRLADILCSELIGCQEVPSLLSFTYWSVSASDLEICLLGSDFRRLCTGMLQATAQPGKVALKVPPIRRSFHVRNLIKINFNLIXWQTFKNRSQSF

SEQ ID NO: 151710 - protein, 51 aa, Heterodera glycines
  Coding regions on vcDNA: vcDNA=SeqID_78133; Strand=-; Position=1-153
MTVEVNSDAKSGGGVTCGGGRTVPVPKSVVGTTKGAMRVGEAVGNEVNGGG

SEQ ID NO: 151711 - protein, 303 aa, Heterodera glycines
  misc_feature (301)..(301): Xaa can be any naturally occurring amino acid
  Coding regions on vcDNA: vcDNA=SeqID_78134; Strand=+; Position=1 -101,349-507,711-844,937-1110,1172-1264,1507-1605,2093-2228
  Homolog annotation: Hit_ID=CAE63605.1; Match level="QueryCoverage =88%, HitCoverage=34%, E-value=1e-60, Identity=45%"; Hit description =Hypothetical protein CBG08096 [Caenorhabditis briggsae]
PLTPPPFTSFPTASPTRIAPFVVPTTDFGTGTVPFELLIVGSKTRPFFDRRLGRITEQTDDLLCDFTHTFPCLWGAESGRWAIVHKGAIPSLDQELASEEESPQYPSIVVIQGTAMLSSDPLRCQSGSGKLLFLLFRYWTNGRVLVQVCAIGWAVDSPKIQCVEEVAQHNRMDPNSLAVFELSDAIREPFTLNVVLNVVPIWEKNSHNNYLMIDEIAYIGECNLTASVSAGFSTTVFSTQPPKNETKKSTATHRPTLPTPRPSTVGPTAQSTIDPVDLIMTSTKPEEQKKGGKEKSCRKRXRN

SEQ ID NO: 151712 - protein, 144 aa, Heterodera glycines
  Coding regions on vcDNA: vcDNA=SeqID_78135; Strand=-; Position=1 -279,835-988
MDKKREELRRMVGRRYRDVLEASNTVKRLSEIANELASLLANIGQNVVHGQQKDKPSETPSFAGEDGTKLVAPKLLRPNASRCFLLLQNLLSMDFLMENLRQPDSTLLGLIKQMKDTVQSAEQIFAQGALISAIQCVTTKGWSP

SEQ ID NO: 151713 - protein, 37 aa, Heterodera glycines
  Coding regions on vcDNA: vcDNA=SeqID_78136; Strand=-; Position=1-112
HVRSLRNWHAVNSKLIDNGFVAPSNIVLHEKLQIEHI

SEQ ID NO: 151714 - protein, 209 aa, Heterodera glycines
  Coding regions on vcDNA: vcDNA=SeqID_78137; Strand=+; Position=1 -168,642-718,1661-1814,2496-2725
  Homolog annotation: Hit_ID=AAC53441.1; Match level="QueryCoverage =77%, HitCoverage=50%, E-value=4e-10, Identity=28%"; Hit description =sex determining protein [Mus musculus musculus]
MPPHNPNACYAINNPPIPRATTSLSNSTNPSNINNQNNISNGNGMAGGVQQQQQQQQKNPKLYKTELCRSWMEHGRCNYGESFHGQYLEKTQSNNALQQQQLQQQENCAHFFQFNNASQQNHQHNHQQQLPIGFFASPQQCSPENQNAQQSPLSSASYEMFGGISPKNQQQMTTELFDHGEMSSPQPNNTHNQLHHHHQQQHFNQHHQQ

SEQ ID NO: 151715 - protein, 24 aa, Heterodera glycines
  Coding regions on vcDNA: vcDNA=SeqID_78138; Strand=-; Position=1 -48,301-327
MVLIEVLLLVVVVELIRVLLMGVI

SEQ ID NO: 151716 - protein, 79 aa, Heterodera glycines
  Coding regions on vcDNA: vcDNA=SeqID_78139; Strand=+; Position=1-240
SIGPPRKSAVVPIRQGTASSATTVWPQRSRMAFGQANARDLQQRQKWHKGRERCQQSQQKRQQRVGPAKYARQSVLKRW

SEQ ID NO: 151717 - protein, 54 aa, Heterodera glycines
  Coding regions on vcDNA: vcDNA=SeqID_78140; Strand=+; Position=1 -24,226-366
MTLAFDDDTLTKSKGESKKLASPQLIGQITNLSDAESDAQNRRSSDGDTVKGQW

SEQ ID NO: 151718 - protein, 136 aa, Heterodera glycines
  Coding regions on vcDNA: vcDNA=SeqID_78141; Strand=+; Position=1 -100,1034-1344
MPLKNQENAIRKNSCQWYNLHNMKIFACVTSFFAREACNAYCSIARRWHGMALALAHWVAGVLALACPTPTVITPLSGAQFDNYSCLFNALSLLSETETGCTRIRVLRTLWRYKPYIFQLIWVLRVIEPVVRTPYR

SEQ ID NO: 151719 - protein, 148 aa, Heterodera glycines
  Coding regions on vcDNA: vcDNA=SeqID_78142; Strand=+; Position=1 -165,223-308,1050-1178,1255-1321
  Homolog annotation: Hit_ID=NP_508393.1; Match level="QueryCoverage =97%, HitCoverage=37%, E-value=7e-20, Identity=38%"; Hit description =G Protein, Alpha subunit (44.5 kD) (gpa-5) [Caenorhabditis elegans] gb|AAB52648.1| G protein, alpha subun
MVHSNYIDFFSQIAKGIAKFGIKVAPKERETVATFEQAYYGQFMNLDQADDLIALIRTFLEFACVKEVINERLNELDVPDNTEYLLENAQRILTEHYSPTHDDIIHARAATKGIYEIIFAFREFKIRLIDEGGQKTERRKWIHCFGNE

SEQ ID NO: 151720 - protein, 28 aa, Heterodera glycines
  Coding regions on vcDNA: vcDNA=SeqID_78143; Strand=-; Position=1-91
TVYAQIIAQSLLIPQSPIIPQSTRCFEK

SEQ ID NO: 151721 - protein, 21 aa, Heterodera glycines
  Coding regions on vcDNA: vcDNA=SeqID_78144; Strand=+; Position=1 -48,112-129
MWVDRKRRDANGSIALADLRC

SEQ ID NO: 151722 - protein, 158 aa, Heterodera glycines
  Coding regions on vcDNA: vcDNA=SeqID_78145; Strand=+; Position=1 -121,198-350,413-495,594-645,994-1061
MDPFLIYFYFFIIIIRGCCCNPFHCVIVLLQPSDGGGQPNQSNVGLHRNVQDNVPQQIPPFFVLHHVSEQERHLRQKDSSNSNGTIFAQFGDKMKANPNLSGDELYSAALEFVKQMFSSVRRQDKRQIYTHVTNATDFVFNATCDIILAKNIKSAGMN

SEQ ID NO: 151723 - protein, 62 aa, Heterodera glycines
  Coding regions on vcDNA: vcDNA=SeqID_78146; Strand=+; Position=1 -81,501-608
MGQTSPGLDIEKDGYLGCRKKICFGNPLVRKLVRVGSMNAEQVYRSVIFVKKLLPTKKKSEV

SEQ ID NO: 151724 - protein, 60 aa, Heterodera glycines
  Coding regions on vcDNA: vcDNA=SeqID_78147; Strand=-; Position=1-182
MMENAQCRMDFRPKQSALECQVPNRQSKKTHQNREGWHHRHRVDFDLASLALNETSTTVP

SEQ ID NO: 151725 - protein, 51 aa, Heterodera glycines
  Coding regions on vcDNA: vcDNA=SeqID_78148; Strand=+; Position=1-158
LSKTNTEKHLAAIKVATIDGTIITTIRAKVVTFTEEARNYTAFHDGIVPTQ

SEQ ID NO: 151726 - protein, 22 aa, Heterodera glycines
  Coding regions on vcDNA: vcDNA=SeqID_78149; Strand=-; Position=1-67
MSLFRRLAIFIVLLAFLGVFCG

SEQ ID NO: 151727 - protein, 26 aa, Heterodera glycines
  Coding regions on vcDNA: vcDNA=SeqID_78150; Strand=-; Position=1 -71,549-558
MSGSRFVEIVKSGVWFVGVVQIDRFF

SEQ ID NO: 151728 - protein, 60 aa, Heterodera glycines
  Coding regions on vcDNA: vcDNA=SeqID_78151; Strand=+; Position=1 -53,165-288,395-400
MPKMIFLAAPEAAAEWRRRTTTSSKRTNPTRSSRNECLNHFRKMLLTMMRRAVIVKVKRG

SEQ ID NO: 151729 - protein, 368 aa, Heterodera glycines
  Coding regions on vcDNA: vcDNA=SeqID_78152; Strand=-; Position=1 -231,616-908,1287-1377,3098-3588
  Homolog annotation: Hit_ID=CAE59031.1; Match level="QueryCoverage =55%, HitCoverage=18%, E-value=1e-46, Identity=48%"; Hit description =Hypothetical protein CBG02311 [Caenorhabditis briggsae]
DVHEYQRLLEEHDKLGAEVRRVGERNERWKREMDDRLSEWLDPLGELVANISNNFTNFFAQLGCAGEVRLDTPPENKYNVAEYGLSILVKFRNGVGLRVLDPHTQSGGERSVATMLYLLALQNLCPVPFRCMDEINQGMDPDNERAVFNMMVRLLGNSGTARGGGENIAKTQYFLLTPKLLNGLEFNERVTVHIVHNGPEIEHGDQSKKEGITDLIRVEKKAQIMRRMVPKYADEGAAAETATVPMPSPSAVVVIEPTLKKEKQREKEKRSGETDNGKKQRKDEKEEDEQQNMGEEEHTAQQRHQESANIGEEAEEEAANVGKRHRRRRFRRCLPLDGAGGLCAAVALDISALRQRAHSEGHIQQQQQ

SEQ ID NO: 151730 - protein, 75 aa, Heterodera glycines
  Coding regions on vcDNA: vcDNA=SeqID_78153; Strand=+; Position=1-375
LISSQKSCQLKTAKKAEFSKFFISIFFYSSKFSVIFSRLIEPVKSFRMISRLFDSVNNFKSYIDSKLAQTELARS

SEQ ID NO: 151731 - protein, 207 aa, Heterodera glycines
  Coding regions on vcDNA: vcDNA=SeqID_78154; Strand=+; Position=1-624
  Homolog annotation: Hit_ID=CAA09789.1; Match level="QueryCoverage =89%, HitCoverage=83%, E-value=6e-19, Identity=26%"; Hit description =HASPB1 protein [Leishmania donovani]
MATRKWPRDLPQRENSHAKTATRKRPRENGHAKMATRKWPRENGHAKTATRKWPRENGHAKMATRKRPRENGHAKMATRKWPRENGNAKIAMRKRPRENGHAKMATRKWQRENGHAKTATRKRPRENGHAKTATRKRPRENGNAKMATRKWQRENGHAKTATRKRPRENGHAKMATRKWPRENGHAKTSWPEIKVPFFFLLLLWLIV

SEQ ID NO: 151732 - protein, 118 aa, Heterodera glycines
  Coding regions on vcDNA: vcDNA=SeqID_78155; Strand=-; Position=1 -109,1137-1187,1285-1389,1467-1558
MIPGQQNVGTPFQYTNPNCQNGGQQFQAIYFVLFYLIGAGIACQQQSNDHTCHAHELVKSFAWYPTKCRAPSFKQFPITTTTKLPESSAHEFVKSFAWHPSKCRDSFFHQFPTTTTTK

SEQ ID NO: 151733 - protein, 912 aa, Heterodera glycines
  Coding regions on vcDNA: vcDNA=SeqID_78156; Strand=-; Position=1-2739
  Homolog annotation: Hit_ID=XP_318550.1; Match level="QueryCoverage =92%, HitCoverage=84%, E-value=0.0, Identity=41%"; Hit description =ENSANGP00000020240 [Anopheles gambiae]
MHWISDCPKAPICSNCNRRGHHQSKCRLPAPSSKSNSHRNHATMSIFNIGDDISDWIMVDCQLNGNKASLMADSGSRLAVIQQALWEQLGSPKLKKGISKAKSYSGHFFEISGYFICSVTYQGVTLQLECHVAPEGAMNLFGLPWIRAFEAALQRPIVTTLTTDQFKFDTDSNSISISEDPDKLATILKQKFPKVFSPSLGLCNKMCAHLHLKSGVQPVFCRPRPVPHAAKSAVDAELDRLVACGAIKQVDYSKWAAPIVAVRKKNGDVRVCIDFATGLNDCLELNRHPLPRIDDIFAALEGSTVFSQIDFRDAYLQIALDEESKELVGINTHRGLFQYQRLPFGVKSAPSIFQKLMDELTAGLNGVFGYLDDFIVATPTLEEHHSLLKKFFSRLQDWGLRVHLNKCKFLCSQIKFLGHIVSAEGIRPDPARSAAIDFMPPPHDLQTLRSFLGALNYYGRFIKPMRELRTPLDELLKKDVPWQWGHEQQQAFVKAKELMQSDLLLTHYDPSKPIIVAADASKNGIGATISHSFPDGSEKVVEHASRSLSSAEQNYSQIEKEALALIFAVQKFHRMIYGRRFTLLTDHKPLVAIFGSKNGIPIYTASRLQRWALILSNYDFQIKYISTNSFGQVDFLSRLVAQQRETVQSEDRVIANIEELPLSISDHDHPTSRDEPDESAVEFVFMATIDQLPVTTKEVAEQTQLDETLREVSEFCRNGWPKKTPQNLASYFTHRYKLSEVNGCLLFGERVIIPAELRQRILSALHFTHPGIVRMKALAQRHVYWPRMDLDIDRCVQNCDECALAAKAPPKAPLRSWPSTNKVYERLHMDFAGPCSDGRLYLIVVDAFSKWPEIFSVQSTTADNVIVQLEWLFSRYGSSPIMAHLFTQMNFPIFAGPGELSKVRSALSPAEQ

SEQ ID NO: 151734 - protein, 528 aa, Heterodera glycines
  Coding regions on vcDNA: vcDNA=SeqID_78157; Strand=-; Position=1 -702,741-1622
  Homolog annotation: Hit_ID=XP_320889.1; Match level="QueryCoverage =92%, HitCoverage=59%, E-value=6e-54, Identity=29%"; Hit description =ENSANGP00000012033 [Anopheles gambiae] ref|XP_313651.1| ENSANGP00000013044 [Anopheles gambiae] ref|XP_314
MAVDFAQILKQLVDQQTQAFQNLLQNAQPNPNVSNHSTIYSTINSQLGEFSFNPEMDSTFQNWLDRYGPFIQIDGKDLPDQMQVRLLLGKLGSEEYNRYAESVLPSKPTDFTLAQTIDKLKAMFGETKSIFTRRFECFQLTKSISQSPLDFASQVNAMCERSQMDLTKDEIKALIFLTGLSDTDRELRERCLRLLEEAKKKTPPEAISFEKLTEECRAFLSLRNTSNALAHSTHGSSTTKAEVSQSSSKTTTTTSNNQRSSQFQRKPQQPPSPCRYCNQMHWISDCPKAPICSNCNRRGHHQSKCRLPSPSSKYKSHRNHATMSVFNIGDDISDWIMVDCQLNGNKASLMADSGSRLAVIQQALWEQLGSPKLKKGISKAKSYSGHFFEISGYFICSVTFQGVTLQLECHVAPEGAMNLFGLPWIRAFEAALQRPIVTTLTTDQFKFDTDSNSISISEDPDKLATILKQKFPKVFSPSLGLCNKMCAHLHLKSGVQPVFCRPRPVPHAAKSAVDAELDRLVACGAIKQ

SEQ ID NO: 151735 - protein, 99 aa, Heterodera glycines
  Coding regions on vcDNA: vcDNA=SeqID_78158; Strand=+; Position=1 -217,259-317,452-475
MASLRSHLKNHHQLKLKELEEKDKAAESLKNKETNPRQPTLKRIFATSSPVIKKIARAESANSSQLTIEKTFSQWTPDGEMTKKIDKAINDLGQKIFHK

SEQ ID NO: 151736 - protein, 148 aa, Heterodera glycines
  Coding regions on vcDNA: vcDNA=SeqID_78159; Strand=-; Position=1 -164,234-516
MASPRKKQKHSSTDETSTEIGEYEQQIMGSVVTSFGKRRKVHVPKKMNKRILRKIWICFDVWMDMFPFFDRPQLGLKLALISPRFNVLIDKYFNGKRELTIWKWIGIDKMGTVPKLSVFTKYPTNSVPFPLPDRPLHSKIRFHFLLIE

SEQ ID NO: 151737 - protein, 124 aa, Heterodera glycines
  Coding regions on vcDNA: vcDNA=SeqID_78160; Strand=+; Position=1 -25,738-803,939-1013,1445-1552,1870-1970
MFMEWEIRPYPELVALLGRTEHVPATSTVTLTSAELRDLVTSALDANMRAAVNQTVRNTVAEESHNQQQLINRISELENQVRQLQILGPQPVTTSNGTSGIRGKHFFLFSVCGIAKPTIILIIV

SEQ ID NO: 151738 - protein, 89 aa, Heterodera glycines
  Coding regions on vcDNA: vcDNA=SeqID_78161; Strand=-; Position=1 -161,740-848
MKEIEKAIEQRQCKQKSRRSDKPTRQMTTKQEQNRPDQTTAQGVHQQRQVNIKLNLWPKIFGKQSLLGFLEILFRNSNKFFDFWHIENT

SEQ ID NO: 151739 - protein, 81 aa, Heterodera glycines
  Coding regions on vcDNA: vcDNA=SeqID_78162; Strand=+; Position=1-246
MVKGWAKAQKSCEWNQSQSIIINRARTGPGSRRDFAGTPGPCFFGQTTGTGSPGKTGVPVPGSRPGPFSKSRSRPFQNSGL

SEQ ID NO: 151740 - protein, 82 aa, Heterodera glycines
  Coding regions on vcDNA: vcDNA=SeqID_78163; Strand=-; Position=1 -146,219-321
MRCPLGPAFSSAAISEHEQQPMGSFVTEFGKRRSLRVAMKKNHRILKKIWICSDVWMDILPHFGLPKYPLPNKIRFNYLRIE

SEQ ID NO: 151741 - protein, 639 aa, Heterodera glycines
  Coding regions on vcDNA: vcDNA=SeqID_78164; Strand=-; Position=1 -97,140-366,413-523,572-728,960-1081,1129-1332,1386-1512,1816 -2042,2089-2199,2248-2377,2419-2631,2690-2882
  Homolog annotation: Hit_ID=EAA08227.2; Match level="QueryCoverage =98%, HitCoverage=33%, E-value=3e-60, Identity=34%"; Hit description =ENSANGP00000001289 [Anopheles gambiae str. PEST]
MKSGAGSLFGQQNTLGQQQGSLFSKPAGGFFSTTTSGATFPTATTTSSLFGGQTQTGGLFGAAKPAGTSMFGATSQPSGGLFGQQQTASAFGATTTPGTGLFGQNKPSAFGQVSQPSIFGGQQQTTGSIFGGTAPSSVGGFGAATTTTTSLFGGQPQQSAFSFGQQPQQTAATTGLFGAKPAQQFGAFGATQPTSSFAAKFAPPIGEDQMQLKGTPHKVNTKQMCITSMKEYEHKSLEELRVEDYIAGRAKNTGAASAASTSLFGHQNVMGQPQQQQQGGLFGKPAGGLFSPGGYLLICQDPRLGLPGTLRVPLKKQALGEMVIENQFLTQLFLPIVQAFIVNFAARAATTSGATFPTATTTSSLFGGQTQTGGLFGAAKPAGTSMFGATSQPSGGLFGQQQTASAFGATTTPGTGLFGQNKPSAFGQVSQPSIFGGQQQTTGSIFGGTAPSSVGGFGAATTTTTSLFGGQPQQSAFSFGQQPQQTAATTGLFGAKPAQQFGAFGTPATQSTSLFGAPLSKIGTGSIFGSPQQQQQPPVGGLFGQQTGTNLLQKPAQPSLFGTTSPQTGSGMFGTGFSQPSAFGAASAGSPPILLGSNVNISAIQQAIISAQLSSLPYGDSPLLKSPAISPSKSADDIA

SEQ ID NO: 151742 - protein, 348 aa, Heterodera glycines
  Coding regions on vcDNA: vcDNA=SeqID_78165; Strand=-; Position=1 -115,168-307,482-672,890-1041,1095-1234,1359-1526,1573-1710
  Homolog annotation: Hit_ID=CAE58454.1; Match level="QueryCoverage =99%, HitCoverage=44%, E-value=7e-61, Identity=35%"; Hit description =Hypothetical protein CBG01592 [Caenorhabditis briggsae]
VLDTGEMHPTHNRTNKFVQVFQDIVDSYGIASYREINPAPFTLVTFPFLFGVMFGDIGHGLVLFLAGLSLILWERRIEQSRIKDEFKMDKSLQVITCNEYLFEFDFDIFPLSLTQLIALSSDANSPRQMVLGLDPDVAFLRQEGSYWMGFFHSSVNLWTVAIPSFFFLSSIFVYLCVLIFVKWIFFSVKPDVIFGYYYPGSHCAPSLLIGLINMFMQKQRPYGFVDSNNNSTEYPNCHLSLWYPQQALVESVLVGVALFCVPIMLCGKPLVRKIRHHHRTTDGMVAANRKDSTRKLQKSKNILVRVKMDSEVAELIATTTSNNDLDKGTRNGQPSGEGGRAYRAEDEL

SEQ ID NO: 151743 - protein, 125 aa, Heterodera glycines
  Coding regions on vcDNA: vcDNA=SeqID_78166; Strand=-; Position=1 -61,108-293,343-471
  Homolog annotation: Hit_ID=NP_741262.1; Match level="QueryCoverage =98%, HitCoverage=13%, E-value=2e-25, Identity=49%"; Hit description =V-ATPase a subunit; ATP-dependent proton pump involved in the acidification of intracellular compartments
DAAYSCVVELGQYSLVQFKDLNHHLTTFQRTYVREVRRCAEIERCLRYLETEVVEGGVSDHIPPLDTTRTDITLLREMYDLESHLYDIERDIRQFLANEAQLKRNFNDLKQFKSVYEKVEAFFRV

SEQ ID NO: 151744 - protein, 76 aa, Heterodera glycines
  Coding regions on vcDNA: vcDNA=SeqID_78167; Strand=-; Position=1-231
MSLFFKKVGPQLGVPVRHHHHLCLQRVVGIPGQAAEQREHWRPGGPADGGTVQQRHRRGGGDGDDDDGRGHLMSDD

SEQ ID NO: 151745 - protein, 77 aa, Heterodera glycines
  misc_feature (63)..(63): Xaa can be any naturally occurring amino acid
  Coding regions on vcDNA: vcDNA=SeqID_78168; Strand=+; Position=1 -107,395-425,612-800
YKNYSITFLAVKKMNYAKICFIFLQLFPILFHSSEGRVELWQVSQGNPDYYTRGAILNEDAVXNENYNGGGQHYATF

SEQ ID NO: 151746 - protein, 225 aa, Heterodera glycines
  Coding regions on vcDNA: vcDNA=SeqID_78169; Strand=-; Position=1-676
  Homolog annotation: Hit_ID=NP_700900.1; Match level="QueryCoverage =88%, HitCoverage=99%, E-value=2e-29, Identity=37%"; Hit description =hypothetical protein PF11_0035 [Plasmodium falciparum 3D7] gb|AAN35624.1| hypothetical protein [Plasmodiu
MEKHCLPSASCSKFLVCDLIGENGKRRGKEEEEQKKMREREKKEEKEEMEDREREEKKERGEKEKGGEKGGKEEREGVVKEEEEEGGEGKRRKKTERERERGGDAGGKKREEKIREGKRRKESEKGENDWEKKGEEEEREEMEKEEDKEKEGKERRERETGEKDGQKKVEEGEGENDGKEKEGKTEAKREAEKQKEERSQRECRRKRTMPQFADERAAELLVIAF

SEQ ID NO: 151747 - protein, 91 aa, Heterodera glycines
  Coding regions on vcDNA: vcDNA=SeqID_78170; Strand=+; Position=1 -95,756-936
MIIKGTKVIGKVIRVIRRGTKVIRKSTKIVKWPLPVIRRGTKVIIRGTTVIRRGTMVIRRGTKVIIRGTTVIRRGATVIRSGTTVIRRGKQ

SEQ ID NO: 151748 - protein, 31 aa, Heterodera glycines; identical to SEQ ID NO: 126976
  Coding regions on vcDNA: vcDNA=SeqID_78171; Strand=-; Position=1-92

SEQ ID NO: 151749 - protein, 148 aa, Heterodera glycines
  Coding regions on vcDNA: vcDNA=SeqID_78172; Strand=+; Position=1 -54,105-278,366-551,942-974
MERQKSDTELSGVREDLKQKRHTLKEIEEAKTNLEDALAKITRELNLSNEQLVRKENLVEELENQLEEMRIVGTGKHQYIISTDQTVVGGINGSGAVSSHKIDDATLRQLFLSYFTAEKSKQPEIAIVMSRILGYSAEELSQIISDII

SEQ ID NO: 151750 - protein, 90 aa, Heterodera glycines
  Coding regions on vcDNA: vcDNA=SeqID_78173; Strand=-; Position=1 -48,128-313,437-475
MASLKKANERPKKKLSWTNVTVFLRIFRAKKDFLWKGNEIQWTGEPLAERMGILRTRKQDKVKSLKKKAIGQFAKEYKNKLNIFDIIPWH

SEQ ID NO: 151751 - protein, 121 aa, Heterodera glycines
  Coding regions on vcDNA: vcDNA=SeqID_78174; Strand=+; Position=1 -70,119-411
MHKIITLFVVLFLYSSKFNGHPKGEITEEEAEVSAEETEAAPEVKNGHCKFEGMLLLGQNADKNVDLLSILESAENNEKAKDTERTDKVKIIRPSEIHRFIESLEGQTVAKNGIQFNVMSG

SEQ ID NO: 151752 - protein, 380 aa, Heterodera glycines
  misc_feature (1)..(1): Xaa can be any naturally occurring amino acid
  misc_feature (349)..(349): Xaa can be any naturally occurring amino acid
  misc_feature (374)..(374): Xaa can be any naturally occurring amino acid
  Coding regions on vcDNA: vcDNA=SeqID_78175; Strand=+; Position=1 -108,358-442,603-653,702-843,987-1263,1483-1524,1722-1836,1888 -2044,2304-2384
  Homolog annotation: Hit_ID=CAE64442.1; Match level="QueryCoverage =95%, HitCoverage=53%, E-value=3e-72, Identity=41%"; Hit description =Hypothetical protein CBG09148 [Caenorhabditis briggsae]
XFIFAQLRISHDFLEETRTVMRHKFLNEWGDERDMLIYPPANGHYSAYSSDQIIKHFAHIVKAYYSIQNDSFAAFSYDTSAHIVDEHQSLRLHTVFANIPPDTSAHIVDEHQSLRLHTVFANIPPLRLCIDRIADVKIQNKIYIFDTSVENECFVLDFTQTEVDDVFRDPFTVRRLLVQRNITFRAEDALIVSKAFINFNVRTIHYSTLQNDRKPECYLIRLTIRFDNSRHTGQVKVDLIATISYINLCNGRIQQGENGLGTVMIALLDLFVLSMCLGSLFLCVRSLVKGHLLKNTTREYFTTREYFDRAFGIRLSIQDKWEFFNMWYGIVVVVRRAVTKHTMMKPNIXNGIPRDKRPPKFFFANLFSNEPPVXNFLLTF

SEQ ID NO: 151753 - protein, 105 aa, Heterodera glycines
  Coding regions on vcDNA: vcDNA=SeqID_78176; Strand=+; Position=1 -86,379-562,1177-1224
MTLIRDKHMPTKARRKHAAEQSITKPTKKHCPPKCFVNGAKPKEKSARSEQSQLNDSQKGETDGTTGEQNEQQRGDQVEGQGQHVQQIDMANSIFRMLSNNTKNG

SEQ ID NO: 151754 - protein, 272 aa, Heterodera glycines
  Coding regions on vcDNA: vcDNA=SeqID_78177; Strand=-; Position=1 -100,591-748,816-1009,1056-1154,1207-1236,1306-1423
  Homolog annotation: Hit_ID=NP_490911.1; Match level="QueryCoverage =91%, HitCoverage=64%, E-value=4e-59, Identity=50%"; Hit description =secretory Carrier associated Membrane protein (36.9 kD) (scm-1) [Caenorhabditis elegans] gb|AAK84628.1| S
ATNSTPPAVSMGQDELFRRQEELSKREQVERGGEEQNRRQQTQPQANGLGFGAQNRDHNWPPLPSIVPLKPCFYQDIDVEIPQQFQETVRWETVRWAYHVYLLYVLALAFNLVASLLFVLFAGGPIGLPFLAVIQLALFTPCAFLLWFRPVYKAFRDDSSFNFLVFFLVLFLHTIFCFIQDDSSFNFLVFFLVLFLHTIFCFIQALGLSEYACGWSDTLSIIRGWSDTLSIIRTTHFFVGLVMLCSAACFLAFVGMCLSLIKVIFRQICPPN

SEQ ID NO: 151755 - protein, 33 aa, Heterodera glycines
  Coding regions on vcDNA: vcDNA=SeqID_78178; Strand=+; Position=1-103
KATSNVELDAIIKTIGRGKIPTKVENWILSPEL

SEQ ID NO: 151756 - protein, 129 aa, Heterodera glycines
  Coding regions on vcDNA: vcDNA=SeqID_78179; Strand=+; Position=1 -216,270-440
MVLCPLSLNRQLGCTCTVLSESHSVQILCNGTQPDKVWAVLGGFAPNIDKLAIRRCTTNKKSSILKNMLPLKVRSLEISNCAIAQIQPNAFDSLADSLEELSLESNALTSLPNLHKLKRVKSLNFNNNS

SEQ ID NO: 151757 - protein, 247 aa, Heterodera glycines
  misc_feature (2)..(2): Xaa can be any naturally occurring amino acid
  misc_feature (9)..(9): Xaa can be any naturally occurring amino acid
  misc_feature (19)..(19): Xaa can be any naturally occurring amino acid
  misc_feature (226)..(226): Xaa can be any naturally occurring amino acid
  misc_feature (243)..(243): Xaa can be any naturally occurring amino acid
  Coding regions on vcDNA: vcDNA=SeqID_78180; Strand=-; Position=1 -131,185-340,429-526,875-960,1202-1310,1648-1781
  Homolog annotation: Hit_ID=NP_508505.1; Match level="QueryCoverage =99%, HitCoverage=44%, E-value=3e-53, Identity=44%"; Hit description =male sterility protein (61.2 kD) (XD555) [Caenorhabditis elegans] gb|AAC67415.1| Hypothetical protein Y71
IXVKNNIVXVLSNIAQLKXDDRNVIGTQRLVELCQQMPQLKAFVHASSAYANCNLAFVHASSAYANCNLAKTEERIYEQKVEVSKLVGTMEWMSDEMVEAIEDKLLEDRPNTYTFAKAMAENQLSKSAKDLPVIIARPSIIGAIWQEPLPGWIDNLNGATGIFASVGKGLLTDMCGDMKSVADIIPVDIVANMLIVAAACRSQMGCTFIATNLLSNNRLFEIEWHXNALFVSSFRFYSSHKAXSIPS

SEQ ID NO: 151758 - protein, 297 aa, Heterodera glycines
  Coding regions on vcDNA: vcDNA=SeqID_78181; Strand=-; Position=1 -186,232-366,458-519,633-690,744-899,988-1085,1447-1563
  Homolog annotation: Hit_ID=CAE58814.1; Match level="QueryCoverage =94%, HitCoverage=47%, E-value=4e-64, Identity=46%"; Hit description =Hypothetical protein CBG02021 [Caenorhabditis briggsae]
MNPLITLIIHPFSLLITGATGFLGKVLLENLLFTQPKIDKIFLLIRPLNNQTIKERLDNLLESPLFNRIRCVDETRLNSPLFNRIRCVDETRLNKLVPISGDLKMEGIGINEQDRTALINQVTFVFHCAATVKFDEALKVAIQMNVNVIGTQRLVELCQQMPQLKAFVHAAFVHASSAYANCNLAKTEERIYEQKVEVSKLVGTMEWMSDEMVVAIEDKLLEDRPNDRPNTYTFAKAMAENQLSKSAKDLPVIIARPSIIGAIWQEPLPGWIDNLNGATGIFARVGKGSVTFVCCFC

SEQ ID NO: 151759 - protein, 111 aa, Heterodera glycines
  Coding regions on vcDNA: vcDNA=SeqID_78182; Strand=+; Position=1 -81,188-299,355-497
MSSKPETLVERMKHLLSSGDDADVLFLHVPAHRAILNSASDVFEAMFRFDTTKNATDYESAAGEAKGPVEVTDIDAHVFKVMLNFIYADDLSELNGDNAMAVLYTGQKISF

SEQ ID NO: 151760 - protein, 103 aa, Heterodera glycines
  Coding regions on vcDNA: vcDNA=SeqID_78183; Strand=-; Position=1 -117,175-369
MVREIRKRDERKTNFGQCQAEDNTTILCRTFGAILKALRYSIPNNEFAADDFQLVTFDNFIQQILFHFQKGIRLDQRFRILVNVIQAATREILKKKKKNKRSI

SEQ ID NO: 151761 - protein, 98 aa, Heterodera glycines
  Coding regions on vcDNA: vcDNA=SeqID_78184; Strand=+; Position=1 -156,199-337
  Homolog annotation: Hit_ID=AAH55704.1; Match level="QueryCoverage =91%, HitCoverage=22%, E-value=1e-12, Identity=38%"; Hit description =Btbd2 protein [Mus musculus]
DFSCRCLDYIDQNAESLIQSDAFLEMEQNLLYEIIERDQLKIISGELIIWNAALRWADAQCLQNGTECSAENRRVVLGLALSKIRFPLISLSDFSDHV

SEQ ID NO: 151762 - protein, 16 aa, Heterodera glycines
  Coding regions on vcDNA: vcDNA=SeqID_78185; Strand=+; Position=1-48
MTLSKKFLPRPYVSAS

SEQ ID NO: 151763 - protein, 68 aa, Heterodera glycines
  Coding regions on vcDNA: vcDNA=SeqID_78186; Strand=+; Position=1 -172,670-704
MYKFLNEIHFQALRWADAQCLQNGTECSAENRRVVLGLALSKIRFPLISLSDFSDHVVYHTYTVPKAK

SEQ ID NO: 151764 - protein, 284 aa, Heterodera glycines
  Coding regions on vcDNA: vcDNA=SeqID_78187; Strand=-; Position=1 -361,424-569,619-966
  Homolog annotation: Hit_ID=EAL31740.1; Match level="QueryCoverage =39%, HitCoverage=9%, E-value=1e-12, Identity=34%"; Hit description =GA13337-PA [Drosophila pseudoobscura]
MYKYNFFFAVPSGVLTSEESVGICQFHLPGLLSPVAFPSHARISAWNNTPRGNAGTLAMEITKFSQFARRDEGKCRLSKGKVHIKALPWKICAKINTTKNENGTTEKCLGFFLQCTAPREDPKWSCKCSATFRIISQKRGTEHLIGKRNDHIFNNKMNTLGFSNFITFSELMEKDKGFYDKDGDKVTLAIDVIVKEEKADKLDYSNPNKTNGKIVMEIGKLTEFSREICLSERSSEIKQIKGLSWKILALIINQNNKSSEKCLAFYLLCAGSKSGHKIWIYPII

SEQ ID NO: 151765 - protein, 143 aa, Heterodera glycines
  Coding regions on vcDNA: vcDNA=SeqID_78188; Strand=+; Position=1 -268,534-697
MDPNRGLYDQNEDKVTLAIDVIVEEQITERFIISEPNKSNGTIEMEIDKLSEFAREVSQSERSSETIQIMGLSWKIVTEINTKNDRNGKYENWSRKCMATFRIVSQMIDLGDFSRKFDEKRIFSAGNKNRGFTNFITFAVSDN

SEQ ID NO: 151766 - protein, 47 aa, Heterodera glycines
  Coding regions on vcDNA: vcDNA=SeqID_78189; Strand=+; Position=1-143
HNALLQLKRGYGSYEYDRITALHSNINMMPSAHSGPTFPLWHREYNK

SEQ ID NO: 151767 - protein, 22 aa, Heterodera glycines
  Coding regions on vcDNA: vcDNA=SeqID_78190; Strand=+; Position=1-72
MIVTDSAQILSPVVCASEVASS

SEQ ID NO: 151768 - protein, 152 aa, Heterodera glycines
  Coding regions on vcDNA: vcDNA=SeqID_78191; Strand=+; Position=1 -114,633-686,906-1065,1300-1427
  Homolog annotation: Hit_ID=CAE66717.1; Match level="QueryCoverage =100%, HitCoverage=61%, E-value=7e-46, Identity=59%"; Hit description= Hypothetical protein CBG12063 [Caenorhabditis briggsae]
MKVVALVSGGKDSCFNMMRCAEEGHEVVCVANLHPPNEIAELDSYMYQSVGSEGIKFYADALGLPLFQRKISGRPKCVESNTYVQDEEDEVEDLYHLLKTVKEWDPEIRGVSAGAINSTYQKLRVEHVCERLGLVPLCFLWELDQLQLLDAM

SEQ ID NO: 151769 - protein, 32 aa, Heterodera glycines; identical to SEQ ID NO: 127531
  Coding regions on vcDNA: vcDNA=SeqID_78192; Strand=+; Position=1-225

SEQ ID NO: 151770 - protein, 98 aa, Heterodera glycines
  Coding regions on vcDNA: vcDNA=SeqID_78193; Strand=-; Position=1 -29,189-310,600-745
MAQVFWGQPKWERANCSPSSIAIEFFSNNKKKRSYEEWTNICGFWYSNRETPFTDHGVQQLELVQFPQEAQRDESKPFAHMFNTQFLISAVYRARGNA

SEQ ID NO: 151771 - protein, 82 aa, Heterodera glycines
  Coding regions on vcDNA: vcDNA=SeqID_78194; Strand=+; Position=1 -97,176-327
MRNTKKCERQNAKRRPIPDPYYYQIEQNFWKIGVVGPLEGKGVRTSPPFGTVPDLYMGPGTGRSLKEAKPKHTYVNLLLNQT

SEQ ID NO: 151772 - protein, 28 aa, Heterodera glycines
  Coding regions on vcDNA: vcDNA=SeqID_78195; Strand=-; Position=1-87
VETLIPIVNNSCTVSISNGEEAMSKDCY

SEQ ID NO: 151773 - protein, 142 aa, Heterodera glycines
  Coding regions on vcDNA: vcDNA=SeqID_78196; Strand=-; Position=1 -217,266-430,480-525
SIDPSDDGFSFKDRHGFSLMLAKLAELLAEDTGESCNLSRKTIFELLGSSSEWNLGLIGPLLPKYSFFYDKAGFSELLRSLFPSLIRRDHQPCADSAISSFVEALFGTDSFSETISRAFDQFIPHLLDSRLSARNFFCTFCK

SEQ ID NO: 151774 - protein, 66 aa, Heterodera glycines
  Coding regions on vcDNA: vcDNA=SeqID_78197; Strand=-; Position=1 -45,544-699
MTNSTHFVVKISKIKGVEISHFAPKSEMRKAKCETPKNAKGEMRKVKRRPIPDPYPTHLTREHSEL

SEQ ID NO: 151775 - protein, 42 aa, Heterodera glycines
  Coding regions on vcDNA: vcDNA=SeqID_78198; Strand=-; Position=1 -42,142-228
MASVQKDRREHHSSLNCNCDLKIDIQEEESKIQKILIKKSRF

SEQ ID NO: 151776 - protein, 110 aa, Heterodera glycines
  Coding regions on vcDNA: vcDNA=SeqID_78199; Strand=+; Position=1 -76,160-389,1224-1250
MSISTSSTNADFTPSIGEGVNEMGKEVNDDSISLDEDWQFDRKNETVADRQQLLMVGNERSFNEAFTYIFRQNYLFLKEFHESYAKNKMKMEFKITKLVLEKPTFADRHL

SEQ ID NO: 151777 - protein, 77 aa, Heterodera glycines
  Coding regions on vcDNA: vcDNA=SeqID_78200; Strand=-; Position=1 -61,419-524,564-630
MFKLLILSFFILFAFFGFADGNNSFCTDNFESNCLEFAKMVAKRADGFDECLLAAGATNCAGRLACCEKYGQQSCIC

SEQ ID NO: 151778 - protein, 21 aa, Heterodera glycines
  Coding regions on vcDNA: vcDNA=SeqID_78201; Strand=-; Position=1 -35,425-455
MTLFFIYSLKKTSKVSINSVY

SEQ ID NO: 151779 - protein, 53 aa, Heterodera glycines
  Coding regions on vcDNA: vcDNA=SeqID_78202; Strand=-; Position=1-162
VLGQEVSYGSDELADVLSLQSYDGHYSYYDANNDWENDYDEDIDYDLYDSDYY

SEQ ID NO: 151780 - protein, 86 aa, Heterodera glycines
  Coding regions on vcDNA: vcDNA=SeqID_78203; Strand=-; Position=1-259
HFSASTADRVEKFAIGFSCLFGHFDYGLGTSDAKAMNWHNLLHSLLISCPQIKTIDVKIFFEFRPGEHEGLCTILLKWSPQFVETC

SEQ ID NO: 151781 - protein, 105 aa, Heterodera glycines
  misc_feature (14)..(14): Xaa can be any naturally occurring amino acid
  Coding regions on vcDNA: vcDNA=SeqID_78204; Strand=-; Position=1 -227,360-451
  Homolog annotation: Hit_ID=CAE58816.1; Match level="QueryCoverage =86%, HitCoverage=4%, E-value=1e-30, Identity=70%"; Hit description =Hypothetical protein CBG02025 [Caenorhabditis briggsae]
YFSKSSIAWQLLFXEYFYDFQNDCFSTSYTNEKLQQLFNNTMFVLEQEEYQKEGIEWQFIDFGHDLQPTIELIEKPTGILALLDEQCIFPKEADKSLVEKLILHH

SEQ ID NO: 151782 - protein, 338 aa, Heterodera glycines
  Coding regions on vcDNA: vcDNA=SeqID_78205; Strand=-; Position=1 -39,143-202,437-523,612-725,1447-1572,1636-1798,1901-2044,2098 -2193,2254-2441
  Homolog annotation: Hit_ID=AAK85118.1; Match level="QueryCoverage =89%, HitCoverage=20%, E-value=1e-102, Identity=50%"; Hit description= non-muscle myosin II heavy chain [Loligo pealei]
MVKRTSITDPALHAEWASKRLIWVPHETEGFVKVEDMADLTWLNEPSVLDNLKQRYYSDLIYTYSGLFCVVVNPYKKLPIYSETLIEAYKGKKRHERPPHSHSSADHINMVGELEQQLLQANPILEAFGNSKTVKNDNSSRFGKFIRINFDMSGYISGANIEFYLLEKSRTCRQATDERSFHIFYQFLRGTSPEEKTNFLLEDVSRYAFLNNNYISLPNVDDSAEFHNTVRSMKIMGFHDEEINSVLRMVSAVLLFGNIEFKQEKNTDQATLPDDTVSQKICHLLGLPVAEFSKAFLRPKLKVCESAWADLAHFMDMRMNWDVGNIVPGFLEVWCMEL

SEQ ID NO: 151783 - protein, 41 aa, Heterodera glycines
  Coding regions on vcDNA: vcDNA=SeqID_78206; Strand=+; Position=1 -53,136-208
MEDSVNPSANLNSVTFDLPLSPPAEEEKEEDKADQSNGNVV

SEQ ID NO: 151784 - protein, 86 aa, Heterodera glycines
  Coding regions on vcDNA: vcDNA=SeqID_78207; Strand=-; Position=1 -151,571-680
MNGLADESVPFGDHLKSGFGLVEHNAMQPNLFWNFHYLFPMFSPSTCVLFDHITTTEKKIFTINGDKVFLGFNSVSLSISEVEELT

SEQ ID NO: 151785 - protein, 27 aa, Heterodera glycines
  Coding regions on vcDNA: vcDNA=SeqID_78208; Strand=-; Position=1 -22,730-791
MGGQTALEFSLQNEHKMVLFGLLLKKL

SEQ ID NO: 151786 - protein, 21 aa, Heterodera glycines
  Coding regions on vcDNA: vcDNA=SeqID_78209; Strand=-; Position=1-65
KNSNFNLYQVKIIQNYLVFYN

SEQ ID NO: 151787 - protein, 67 aa, Heterodera glycines
  Coding regions on vcDNA: vcDNA=SeqID_78210; Strand=+; Position=1 -82,611-734
SPYNLVSERAVERYDLEGLVNRNNIYRPIPMPNNDLMSGKTFIYGKITNKIMFYPQRQGIPKDHSLA

SEQ ID NO: 151788 - protein, 83 aa, Heterodera glycines
  Coding regions on vcDNA: vcDNA=SeqID_78211; Strand=+; Position=1 -54,865-1062
MRRCSTQKTARRLTFILKTVTGQSDSGQSDSGQSDSGQSDSGQSDSEDNRTEVDNRTVDNPTVDNPTVRTIGQKWTIGQSNIK

SEQ ID NO: 151789 - protein, 92 aa, Heterodera glycines
  Coding regions on vcDNA: vcDNA=SeqID_78212; Strand=-; Position=1-278
MDLNNGFYDREEDKVKLTIDLTTVDEPKVDKFNLDQSNSKGTLFMEIEKVSEFAREIFESERKSETVHIKGMPWKIWAEIKKKDESTDKNEK

SEQ ID NO: 151790 - protein, 72 aa, Heterodera glycines
  Coding regions on vcDNA: vcDNA=SeqID_78213; Strand=-; Position=1 -70,199-347
MLGPALFKIRFPLLSNEEFTRKIVPFGVLSKDEVIAVYQFKFLPNYHGISDGFFPMQFPTNGRISDRKKAHF

SEQ ID NO: 151791 - protein, 82 aa, Heterodera glycines
  Coding regions on vcDNA: vcDNA=SeqID_78214; Strand=+; Position=1 -63,412-514,856-938
MALAETVANMATGVRNARKQFNEHVAEKCPQKDSLGPLYAQICGSHKNSAVLREWEGARRRRRLQQKAILDRMLRKRGGHKS

SEQ ID NO: 151792 - protein, 257 aa, Heterodera glycines
  Coding regions on vcDNA: vcDNA=SeqID_78215; Strand=-; Position=1 -38,443-1124,1540-1593
MSHAFRVPPRRPQNEGQGDKNDDDDEDQSEMEIFNRQITDICQMLLAHHHNEVEKVGRLCAQMGEAILQVLAIQQQIPNPDEVEQQHGEDNGRDNRNNCSFDEDESDGESDDPTVEHPLPAARRVLRRLKLPTILDISAATEADVQEYGTKLSDTIKQITKLRVQNGGALTSELELRSKQKQAQNLLQQIGNLMPQLVVEEEEVAEILNLAEQSADRFSIGFLNKEQKKQFEEAIRQAKKAFEILLNINWTVWGTIL

SEQ ID NO: 151793 - protein, 145 aa, Heterodera glycines
  Coding regions on vcDNA: vcDNA=SeqID_78216; Strand=+; Position=1 -103,198-431,576-676
MDEIGGRKTNEFLRKISQFRDVMNKMNGTTKDIIHKDQIGSANSGRTDEFYEKPNGYAKIRESRLIGLKGPNLAMFHFQAVQMRVQNLSDCKNELIFFMPMDLIVVLDGEEKGFRIVRICFVIPPDNLGVTYFEVKIIKLQRENG

SEQ ID NO: 151794 - protein, 25 aa, Heterodera glycines
  Coding regions on vcDNA: vcDNA=SeqID_78217; Strand=+; Position=1-75
TCTCGVVVKLSTFHNFSPGFNSPLG

SEQ ID NO: 151795 - protein, 202 aa, Heterodera glycines
  Coding regions on vcDNA: vcDNA=SeqID_78218; Strand=+; Position=1 -71,119-153,247-334,381-453,504-587,665-783
  Homolog annotation: Hit_ID=NP_510572.1; Match level="QueryCoverage =99%, HitCoverage=74%, E-value=2e-68, Identity=71%"; Hit description =RAB family member (23.4 kD) (rab-14) [Caenorhabditis elegans] emb|CAB01884.1| Hypothetical protein K09A9.
NSSAPYNYSYIFKYIIIGDMGVGKSCLLHSCLLHQFTEKKFMAMADCPHTIGVEFGTRIIEVNGQKVKLQIWDTAGQERFRAVTRSYYRGDTAGQERFRAVTRSYYRGAAGALMVYDITRRSTYIHLSSWLVYDITRRSTYIHLSSWLSDAKTLTNPNTVIFVIFLIGNKSDMDAQRDVTYEEAKAFAEENGLTFLECSAKT

SEQ ID NO: 151796 - protein, 25 aa, Heterodera glycines
  Coding regions on vcDNA: vcDNA=SeqID_78219; Strand=+; Position=1-75
MGEGRARPLLFCLLSQAVLAHNTLY

SEQ ID NO: 151797 - protein, 327 aa, Heterodera glycines
  Coding regions on vcDNA: vcDNA=SeqID_78220; Strand=-; Position=1 -276,324-523,568-960,1007-1121
  Homolog annotation: Hit_ID=NP_001004509.1; Match level="QueryCoverage= 99%, HitCoverage=23%, E-value=4e-36, Identity=29%"; Hit description =si:busm1-180o5.3 [Danio rerio] emb|CAD60788.1| novel protein similar to DNA polymerases [Danio rerio]
AKALECGYTVDRFYRAWHYEEEANDLFKGYVRLFLKLKEEASGFPKGVETGEQKDMWREEYKEKYGIEIELAKVKKNPGLRYISKLMLNSLWGKFSMRNCLNKNAVIDRASEFYKIACDHKIELCDIVEYSDEAIRLIYRDKEDFVMEHKSSNIVISLWTTSMARLKLLEFMREAESNGGEILYTDTDSIFVLHDRDVEPITTGKYLGEMSEEYGGYEIEEYCCGGAKQYALKMRSKQTGETEYVMKIRGITFDVDNRKTLHYDTFREMVLNYGKGEVDPAFFVYKNDFGPTRDSKVVTREKHKMYRPVCQKGIIDEELNVMPFGFC

SEQ ID NO: 151798 - protein, 157 aa, Heterodera glycines
  misc_feature (128)..(128): Xaa can be any naturally occurring amino acid
  Coding regions on vcDNA: vcDNA=SeqID_78221; Strand=-; Position=1 -110,197-290,839-963,1437-1574
  Homolog annotation: Hit_ID=NP_490992.2; Match level="QueryCoverage =99%, HitCoverage=38%, E-value=8e-46, Identity=57%"; Hit description =putative protein family member, with at least 6 transmembrane domains, of bilaterial origin (46.0 kD) (1D
LLNGLSERYNNFHWFIYQFLCIIGVIANICFVVVLLRPTPTMRKNPFNLFLIVIAICDMSLMASYFIYKQVEMCHPWYFTFFWIVYTYGYAVLSVFVHSASLWLTVNMAVLRYLVLKSGSSSSRVPRXGSYKAACGAVAAAVLLAAVGSAPSMLRYE

SEQ ID NO: 151799 - protein, 134 aa, Heterodera glycines
  Coding regions on vcDNA: vcDNA=SeqID_78222; Strand=+; Position=1-405
  Homolog annotation: Hit_ID=EAA15356.1; Match level="QueryCoverage =86%, HitCoverage=85%, E-value=5e-10, Identity=42%"; Hit description =Predicted membrane protein [Plasmodium yoelii yoelii]
MSKPNKCCFTVVVGVVVVLGVVVVVVLVEVVVVVVVGVVVLVGVVVVSSELSVISSVAEMSVVSFVAKMSVVSFVAKMSVVSFIAEMSVFSSVAEMSVFSSVGVGASGVGIGVVVVVVVVVVVVDLKESRLKKN

SEQ ID NO: 151800 - protein, 126 aa, Heterodera glycines
  Coding regions on vcDNA: vcDNA=SeqID_78223; Strand=-; Position=1 -35,1094-1438
  Homolog annotation: Hit_ID=EAK90389.1; Match level="QueryCoverage =100%, HitCoverage=34%, E-value=1e-23, Identity=48%"; Hit description= cryptopsoridial mucin, large thr stretch, signal peptide sequence, transcripts identified by EST [Cryptos
TGLSWPGTELTSTTTTTTTTTTTTPIPTPEAPTPTDENTDISATDENTDISAINETTDILATNETTDILATNETTDISATDEMTDSSEETTTTPTSTTTPTTTTTTTSTSTTTTTTPSTTTTPTTT

SEQ ID NO: 151801 - protein, 43 aa, Heterodera glycines
  Coding regions on vcDNA: vcDNA=SeqID_78224; Strand=+; Position=1 -108,154-175
MCPAITFRSCRNMPSFHQTSRDLCRPFTITEAPHIPVVLVRSD

SEQ ID NO: 151802 - protein, 154 aa, Heterodera glycines
  Coding regions on vcDNA: vcDNA=SeqID_78225; Strand=+; Position=1 -182,309-409,587-768
  Homolog annotation: Hit_ID=NP_500020.1; Match level="QueryCoverage =98%, HitCoverage=38%, E-value=5e-40, Identity=49%"; Hit description =zn-finger, C-x8-C-x5-C-x3-H type and Zn-finger, RING (48.1 kD) (4B749) [Caenorhabditis elegans] gb|AAF607
MEEAFAKARSEEKQCGICMEQIVEKGLRFGILQNCTHCFCLDCIRKWRRQTDEEIKTKTVRSCPECRVHSDYVIPSKVWIDLKSDKDKLVSVFKGNKCFYKHQLPDGSIVEGKSPTQLRKNRRNDAIMFSLYDFLPSDSDWEDDFFNDNSDLYD

SEQ ID NO: 151803 - protein, 172 aa, Heterodera glycines
  Coding regions on vcDNA: vcDNA=SeqID_78226; Strand=+; Position=1 -268,1193-1272,1319-1489
IFCGIGTQNFWGSLEINPADPAKLNSEIHGHDHENREFHGFWIMVTVTIHDAQVFFNHGTPLLMLERGQKNPAVADGASRIQFAAVVDRVKMNKIPFLFIALFVVQIIAAYEPSCKCPENEEPGQKSCNGCEPSCDNPKPEICTARFCDCSCDCVKGLFRDKTKKCVPKCPY

SEQ ID NO: 151804 - protein, 229 aa, Heterodera glycines
  Coding regions on vcDNA: vcDNA=SeqID_78227; Strand=-; Position=1 -82,135-341,424-615,664-737
  Homolog annotation: Hit_ID=AAN32886.1; Match level="QueryCoverage =88%, HitCoverage=98%, E-value=2e-92, Identity=87%"; Hit description =gland-specific protein G2D01 [Heterodera glycines]
MSSSPSVSVLAIVAIVCLMCQCCFSAPHPCCPGSQKVVSLMSNYVGPCCPGSQKVVSLMSNYVGTFANSISKSSLCSDAQNVADALKGQLIGCSNGGDRTLLAEIEASLATHSADECECALSLGFVRAMFAIAASASSHASNNSEWQALSTQFGQKVTEIDSKCAEFGISIGKVPINGPKGVHVQNVPNSESVISMPGLAGSHKGVHVQNVPNSESVISMPGLAGSHTQ

SEQ ID NO: 151805 - protein, 88 aa, Heterodera glycines
  Coding regions on vcDNA: vcDNA=SeqID_78228; Strand=+; Position=1 -63,1051-1254
MTRNVQSLVLALAKCPSTVARLIDHILSFISIFCFFSSTPAFVIAIGGAFVECRKAFHVAFGGNTVALGQAFHILRVASGAATEKQFE

SEQ ID NO: 151806 - protein, 47 aa, Heterodera glycines
  Coding regions on vcDNA: vcDNA=SeqID_78229; Strand=-; Position=1 -8,1027-1162
MPICCTGCNAQNVKCLSKCHGVATECHMKCLSAFDECSADCDYKWWG

SEQ ID NO: 151807 - protein, 215 aa, Heterodera glycines
  Coding regions on vcDNA: vcDNA=SeqID_78230; Strand=+; Position=1 -254,599-853,917-1055
MYTILRFPFWPYDGAQHILLDNSYLHYFKTTSEEYTEGLALKIAIYTHFYMLKWKTEQNKEILEQRRISGSENSLYTEINNHLKTISIGSALKSLNIATVCLLLREKYTLLSTLNGAEFKRQNPPCPSCETQEKAQQTVKDHFEEMAEWMLSDLLKSFHSRKRLIKYLKCEIAAKNNQYEIEKAWKKLVNLFGFARALLLCRTFRQEFGILCKRN

SEQ ID NO: 151808 - protein, 79 aa, Heterodera glycines
  Coding regions on vcDNA: vcDNA=SeqID_78231; Strand=-; Position=1 -48,1119-1310
MKGGSRRVPFPTPGTYHHLQQQILSASSCYTVQHQQQQQSSSASLFTLADATLLQNSAIVNEALKTLGTFQQQEIAAKR

SEQ ID NO: 151809 - protein, 65 aa, Heterodera glycines
  Coding regions on vcDNA: vcDNA=SeqID_78232; Strand=+; Position=1 -68,151-281
TEYRQVFKKEFRSLFGRLRKNNVVQTIGMAQMCNVNPSNINNNKVNRSSQMTIIRNVNTIIQIRH

SEQ ID NO: 151810 - protein, 50 aa, Heterodera glycines
  Coding regions on vcDNA: vcDNA=SeqID_78233; Strand=-; Position=1 -67,175-260
MPNVSRQNRDSKNQSAEVGPTTSSYIQCLMDKWSIKKAFRKLKGEGFTGY

SEQ ID NO: 151811 - protein, 307 aa, Heterodera glycines
  Coding regions on vcDNA: vcDNA=SeqID_78234; Strand=+; Position=1 -33,146-499,560-645,759-881,944-1080,1142-1265,1626-1692
MSSINTSSDNALYLAYRSVGPSVDLIVPAVALYLVALIGIVMNGTALVVTAKSRQMPLAFFILIIIIEFNFNFNLNFPFFSSLRGSANFLMALICLCELVHQIGHTFLLVVVISGTNFVSLHTADLIIAPSVFALNCGLMAMFCAAVDRLFAVLMPFKHFSICAKYKLPYLFGHLLICIIYGTFIQYHVLASAFENAGMPTNGLLADAFQDDIYQFFIGGVYSISFGCICCYVTIFLIVRLKKSVTQQTNTRLLRSLVIILSINIGGYLGTLIMSQLIGTIGQVYFCSTYLYNQSQTENIIRLHHIK

SEQ ID NO: 151812 - protein, 33 aa, Heterodera glycines
  Coding regions on vcDNA: vcDNA=SeqID_78235; Strand=-; Position=1-104
VLDYDAEASSKKAKNRLDLTKKYGKAALRQSSR

SEQ ID NO: 151813 - protein, 71 aa, Heterodera glycines
  Coding regions on vcDNA: vcDNA=SeqID_78236; Strand=-; Position=1 -112,1303-1406
MSFVCFNKFTECICQCRVGVPVNVVPILAHCKSRRLQFALDYDVEASSKKAKNRSDLTKKYGKAALRQNSR

SEQ ID NO: 151814 - protein, 64 aa, Heterodera glycines
  Coding regions on vcDNA: vcDNA=SeqID_78237; Strand=-; Position=1 -102,1279-1368
MGAVAVVYSRSGPLPEWTEEEWEARKRIERSTAIDPVGPDTGTLQNLDNLDPDPAFVDPAIPDP

SEQ ID NO: 151815 - protein, 282 aa, Heterodera glycines
  Coding regions on vcDNA: vcDNA=SeqID_78238; Strand=-; Position=1 -244,745-872,1099-1233,1720-1804,1848-1891,2375-2587
  Homolog annotation: Hit_ID=CAE62038.1; Match level="QueryCoverage =75%, HitCoverage=18%, E-value=1e-95, Identity=64%"; Hit description =Hypothetical protein CBG06054 [Caenorhabditis briggsae]
MALCNKKCQIQCHLPSFCLIVVLLVVLIDEKLLILAQILGGQQPPPPPPPPPQQPAPQGQAVGPGGPGMLFTGTGTNMYYGVNLVPFGPENGDLEVSPGFLTSGQTIDLHLFFPFYGGLYNYTTISVNGYLGFATVLDQGPTINVGPDSTDWPRVQDPAMIAPYLCKQQACPSTAGSYVRCDANSDYFLDEMMRWLQEGVAGASAFRADAALVVTWYNTGSAVSGRSDLDGGQLATYQAIWLTDQPGRLSYVIINYDKLGFDAADFRANSRSGRCRVRNVRE

SEQ ID NO: 151816 - protein, 86 aa, Heterodera glycines
  Coding regions on vcDNA: vcDNA=SeqID_78239; Strand=+; Position=1 -70,122-222,287-376
MGIVARRLLKNRAIQKQLDRRQKNMKTLRRQQAAAGRSPIVVHSAGIGLPRTEPVHQRQEICTVPAHEVIYDVPFDGKREEDEDSF

SEQ ID NO: 151817 - protein, 68 aa, Heterodera glycines
  Coding regions on vcDNA: vcDNA=SeqID_78240; Strand=+; Position=1 -54,108-260
MPDERVLHLECFESGDYDMMELYGPDRAKEMLIELRDYAEAHGMPCQYVKMLLYKLDKGLIKWKGTKP

SEQ ID NO: 151818 - protein, 453 aa, Heterodera glycines
  Coding regions on vcDNA: vcDNA=SeqID_78241; Strand=+; Position=1 -710,758-1409
MAINISDKKSLFNQILGQTDLTVTSSGITISGPRLSTPRFIPFDEAGRCRCCKGTESEIDTVITKEGITLWCTRIEKAQFIPFDVVYDLPGHCFFRLKNKSRVFNIPYGDIPSSDTHTTKRPRTNDYHQHELKRKAKVALDLVEAGLMADAMQDGARWKKAKTAINVLGNLLLAESLDTTSATPLKNDVADIKKEEEATVAEEHKEDDDDQQKEDLGDIDKTLDDFFNSIKASTANIDKDICFKLPFGLIISGPSSSGKTQFLLKFIAESDQLITPKPVSMLYCFGEMNAAVPVLQKAGVDVYAGVPSEELIKRLPKPLLLVLDDLMLSVDERYLSDLFTKKAHHHQFAVVFVTQNLFERKIKVARLSAQYLVLMRAPNSLLSIRNIGVQLFPRQLDFFLDAYRKATARPYGYLLIDMHAASDPSLRLRTNIFKDEQEEDEGTVVFIPKNGAA

SEQ ID NO: 151819 - protein, 187 aa, Heterodera glycines
  Coding regions on vcDNA: vcDNA=SeqID_78242; Strand=+; Position=1-561
  Homolog annotation: Hit_ID=BAD54671.1; Match level="QueryCoverage =56%, HitCoverage=17%, E-value=3e-10, Identity=34%"; Hit description =putative C2H2 zinc-finger protein [Oryza sativa (japonica cultivar -group)]
MRRELADRPAKVELTKGISVLLRRGAEDEEGEVVDTPSRPPPPPPPPPGGRPRLPPSPPGRAPSPPGSPPPRPQRPPRPTRASRRDDRLEQWEKRRHDIQRRRPVVRDLLAEAAAAPLPESYTDDEYMLESGLALPTPSQYYGDLPVVPYQHQIEQMDTAAAQHRIAIRRKLKKDEAYDDSDRKKYR

SEQ ID NO: 151820 - protein, 765 aa, Heterodera glycines
  Coding regions on vcDNA: vcDNA=SeqID_78243; Strand=+; Position=1-2298
MITRSPPLTRQRALNLGIELDNGGKQILERVNPNSNQNPSLSLELGNGHREMVDDGGGLGQSRLLNEQQLRNRLLTVTMLDNNNPVVHVPNENVQNQRIAMNAPLVNSGIFGSNNGNVGDYSEELGGTRILQNRPNSNSGAINLNNAEMIPTYPPALASTPVENFGNLARNSENENFAFIEHNEVRAQYTQPRSTENIRPIFVRQTAIHSHLSAMRLPPIQQPVVAIDFPEQFVQRNTQTNMPQPPFYGNQRQNENLHQNLQRVAGNEVQQRGVHINPGNFPERVNAPNADAFHMRREMHDLVLTQAIKSLDNFSYSMTLNSLPELKGNTGSDAVRAFFRHFDVATEEWPEAKRLSALRSKCSGRAERAFNVAVSNNPFRYENVKRSMVQQLEETDARQMSAFDELMSGISRRNNERIDDLADRVSSLVRKAYPGLLEHLYDDYSIRHFIRALQNPELALTLKLARRPSMIFDEFVALAARAEATQKASKISLQKQRNIPNFQDHNQSVHYNPRPMQQTFRNENFPRISQSQNRQNCYNCGRFGHFARQCNYPRQVRTENANIGTPATGANKTSVEVPKDTSQPQYNKPLPFSRNYLRQNFLVEQQENPPPTSQNFLIGGISMSNDELEKLFERDKSVEAGNSRAKLLNVSVGKIMVIKVFVCDLSATAMLDGGAQVSLVSFAFFSKIMTEKNIDKILLCPTRESTQVVDINGKTVEYVGVVSLPIVRKNTKVWIRFHVTNASFGYEFLFGTNALARLVLSFMTA

SEQ ID NO: 151821 - protein, 229 aa, Heterodera glycines
  Coding regions on vcDNA: vcDNA=SeqID_78244; Strand=-; Position=1 -135,196-300,980-1429
MELSKYLRQEFEFAQIFGISLHLQEIKKHFVGQNGQLMANDIEASLDSFISKNGFGLIENEQKLKIEEAISELEQIIRKWVAKVAKLNRTPDAWMPLIEFKFEISPNTFVAFDIGLTTFAPQEEIFKTEERINYEQSDALSAKMANEIGQLANRRREFITKGGGYEELKEMNNEEEKLRVKLRSLAGDWRCLIKSDSDAKLFDYGKNPPGGIAWGYLLVGFLYSLSLKK

SEQ ID NO: 151822 - protein, 218 aa, Heterodera glycines
  Coding regions on vcDNA: vcDNA=SeqID_78245; Strand=-; Position=1-655
  Homolog annotation: Hit_ID=CAE70527.1; Match level="QueryCoverage =90%, HitCoverage=89%, E-value=8e-14, Identity=24%"; Hit description =Hypothetical protein CBG17156 [Caenorhabditis briggsae]
MRIDTFVGEVENVSEIFDLAEKCKEKFANFEENVKNQNENFNEKNEENYSDEKERKNGNKLGKDEEEADKTKVFDVDEALKYVNSEENNEGKDKKKKKGKKKPKPNKMPSEIGTKSEEENQNEDKMPMNGMEEKKLKKVKVSADRIPSESNLSEKDGQFVEKESYAKLMPKTHKNDGTNFEITQKENEKDNGSEGETMREKEKEKKEKITQKKKETKK

SEQ ID NO: 151823 - protein, 75 aa, Heterodera glycines
  Coding regions on vcDNA: vcDNA=SeqID_78246; Strand=-; Position=1 -100,623-750
MPEEARIIGESGIKKDMGQKGAASIAQSVRAFHGGCPVGHAGGAVTVRAVDDVGTASSAHAHSAIDDPLIDSRMD

SEQ ID NO: 151824 - protein, 720 aa, Heterodera glycines
  Coding regions on vcDNA: vcDNA=SeqID_78247; Strand=+; Position=1 -33,83-294,761-837,951-1095,1647-1830,2346-2608,3388-3610,4037 -4214,4920-5267,5711-6009,6510-6710
  Homolog annotation: Hit_ID=CAE63694.1; Match level="QueryCoverage =75%, HitCoverage=85%, E-value=1e-164, Identity=48%"; Hit description= Hypothetical protein CBG08209 [Caenorhabditis briggsae]
MPPEIVRRQPEGYGQCADWWSFGVIAFELLTGCSPFTVDGNQNSTEDIARRILTKKVPYPKWMDRTARDFIGQLLNRDPKLRLGARGAAEVKKHHFFDGTDWEAVERQFTAQAPLFSPADKPPPECHTFFSGYSFVSPSVIFASDNVIGQECLESSVRLLSAQSSPFFANYRLDITAQGLLGKGSFSICRKCERIADGRQFAVKIVSQRFAHQARREELHWQILLPILCQVRVLEALQPHSHIVPLVDAMSDAFHHYIVLELLDGGELLQRLRRMEKFTELQAAEIMAQLVAAVKHMHDRDIVHRDLKPENILFERDGPDDAKPRLRLVDFGFARILPRPAAIGSTMGSQSLITPLCGTLHYAAPEVLDIEDELPQYNEQCDLWSLGVVLFTMLSGKVPFHAKSQAESAAEIIARIRAADFSFSDPVWSMVSQSAKDLITGLLTVDPTRRLSLAQLGAHPWLQSVSTTTDDGTVPDGGAGGGGGTELPTPTILPSSADATFNATLSAFLHANRDGFQLMDVQTAPLLVKRRGMKRQRGPDTTATTASGSGGTAAGANDGGGIGAERMEQCAANNTNNNSMTTATTLCTVSECPELTMNMNSSGGDQHHQQQKFKRRPTTLNLFGTIGEVEQQQQQHEHQQPQGTPNSAAFTEYRDTKPPYLKYSRDDFTRAECGGSGATVEQQQHIGGGTPGMANDQSSGCSSLSGASTIRLSNDSNESQ

SEQ ID NO: 151825 - protein, 185 aa, Heterodera glycines
  Coding regions on vcDNA: vcDNA=SeqID_78248; Strand=+; Position=1 -9,263-568,979-1221
MIKFKNNGELKVAQIYPLSINQLIDQEITVEQIATKIRGKSNDLWEGQVAKWAKKWVGTKDKISEKKKAKGNNGKSAYFSKFYDSLRMDRLVLLANNIREASINKKFTDSTDVIEILVTTTNQEKDKTGISETFCHKLAQENEVSGNYKHILIPLCMNRRNEVFREDEEVINQTDEKAILLRNYD

SEQ ID NO: 151826 - protein, 219 aa, Heterodera glycines
  Coding regions on vcDNA: vcDNA=SeqID_78249; Strand=+; Position=1 -258,537-938
VIERLNEIVKDPHNFAELTENDLLVNALVTFSFPKLRHIFKKYEEKYGEKIEEQVDNAYIKEFKHLSKNRIMNLLKLDLHVEQHFWQTLNAILTDIQGRPYFFAQLLKEKLDKLRGNEKWASADALKDVTRILLTRAPIDLADIDQEFQGLSGSLTIRISISAYIEQIIGFEKEKKQKKGNVFRSFSIRSKSHEDIGTAVSSESNTAAAEGKPSQKIEL

SEQ ID NO: 151827 - protein, 285 aa, Heterodera glycines
  Coding regions on vcDNA: vcDNA=SeqID_78250; Strand=-; Position=1 -121,168-272,394-518,560-843,1109-1330
MPVFFLYFSRTYIGLTQRQLLDGVNAFGDNPLNFSPIGNHSALGTTISTINSEHSYAATPIQFGIGTINSYVANHSWEDEIVRAPHFPIPLWNMHSQATSALARTNNGLEATHLHFMKGLCHHPALSDFICGVNKSIDRQVDAARSARHFIHKRHKRYILQDAVIMRILADASYNSNGEISDLMSALGLQVEGYAGKLRDFKNYDDSIVHVPLLDNSWVFTLLDNSWLGQNVAWTIRGLDNSWLGQFVAWTIRGLDNSWLGQFVAWTIRGLDNSWLGQFVAWTIC

SEQ ID NO: 151828 - protein, 93 aa, Heterodera glycines
  Coding regions on vcDNA: vcDNA=SeqID_78251; Strand=+; Position=1 -273,348-356
  Homolog annotation: Hit_ID=EAA74000.1; Match level="QueryCoverage =88%, HitCoverage=21%, E-value=2e-13, Identity=52%"; Hit description =conserved hypothetical protein [Gibberella zeae PH-1] ref|XP _385211.1| conserved hypothetical protein [Gib
MIQNNITNDNNNNNNNNAPNNGNNGIFNHIHHQQPTTDEAKQLRATNIGLAECLKGGVIMDVMNAEQAKIAQEAGAVAVMALERIPALIRQEY

SEQ ID NO: 151829 - protein, 156 aa, Heterodera glycines
  Coding regions on vcDNA: vcDNA=SeqID_78252; Strand=+; Position=1 -79,168-270,390-499,896-1061
  Homolog annotation: Hit_ID=NP_622476.1; Match level="QueryCoverage =80%, HitCoverage=43%, E-value=1e-34, Identity=60%"; Hit description =Pyridoxine biosynthesis enzyme [Thermoanaerobacter tengcongensis MB4] gb|AAM24080.1| Pyridoxine biosynthe
GPGLPKIPGPAQLLIHFVSNMKVNNAEIRNAEIRNLTKMNEEELMSWARLNSAPIELVFQTAREGSLPVPNFAAGGVATPADAALLMQLGAEAVFVGSGIFMSDNPAKRAAAIVQAVTHFDKPNVLAKVSRGLGIAMKGMDVLVPEKRSHWNNKKE

SEQ ID NO: 151830 - protein, 88 aa, Heterodera glycines
  Coding regions on vcDNA: vcDNA=SeqID_78253; Strand=+; Position=1 -35,799-856,976-1106,1566-1610
FPRVPNITSVGEKAFLFQDANCGDNPEYKDDLFINHLSFFILLLFSAFVILKIVLSPRCPAVPAEVASKCWSWQDNRKHIGLSNDIKN

SEQ ID NO: 151831 - protein, 129 aa, Heterodera glycines
  Coding regions on vcDNA: vcDNA=SeqID_78254; Strand=+; Position=1 -116,423-451,577-692,796-924
MQFVVETLRGICPGQTANGRFDERRRQRLAVQLPKIDIKCTKTIGYVNGRWLEQRGCAPFNPLNSQICTKVETNAALSELSGQNIDIHVSSEQCFCNQNRCNGTFTPKTLTALSVLWPLMLAFFLVKNY

SEQ ID NO: 151832 - protein, 102 aa, Heterodera glycines
  Coding regions on vcDNA: vcDNA=SeqID_78255; Strand=-; Position=1 -54,247-420,645-724
MSSGEDRQMEQEDLQQSTVGTGTKRKLAAQASFDDDLDLDGFSELDKLEPAVAAAAGSGANAEQTNNGGTMLQNGTELLLTQSTTSATMHNNSPRPGGSFAT

SEQ ID NO: 151833 - protein, 1145 aa, Heterodera glycines
  misc_feature (658)..(658): Xaa can be any naturally occurring amino acid
  misc_feature (699)..(699): Xaa can be any naturally occurring amino acid
  misc_feature (1126)..(1126): Xaa can be any naturally occurring amino acid
  Coding regions on vcDNA: vcDNA=SeqID_78256; Strand=+; Position=1-3490
  Homolog annotation: Hit_ID=CAD40308.1; Match level="QueryCoverage =97%, HitCoverage=56%, E-value=1e-133, Identity=31%"; Hit description= OSJNBb0013O03.3 [Oryza sativa (japonica cultivar-group)]
KKNKQSALYQAANDSRNAIFYSLSAFEIICKKCGALHFKEESATKNANVYSCCKDGKISLLSDHLEEYPMELKQLYFIDHPYHKNFITNIRRINSAFSFASLSCLRFSFKTPGPPCFKIQGQVYHKFNESAMPNNNELPTNGQLYFIDTNDAAELRKINISCDQNLMEYIENFMREQNKFAKSFLLMKEVYEEQNEISKKEGKEIPELRLLFSLKQNFDKRRYNLPQTNEVCAIMFCDSNDEIPPARIVVYPKINKKLKNLYPLDKCVEPMTYPLLYPLDKEGYHIGLKDKRQKITLCDYFKYFLYFREKFFPHFYAKKLFQQWLVDSAAKIEWDRLEYIKTHQTELCSSNYSNVEDFLKLKAEKSGAEIQRKIILPSTFSGGPRNMHEHFMDAMAIVNETGKPDLFVTFTCTQNDPDILKCLKPGQTPSDRPDIIARVFQLKKDYLLHLILSEQIFGNVVGYCWVIEYQKRGLPHLHLLVTLDRNSKWRTTTEIDKFIAASIPNKSEDADLYEIVSSCMMHGPCSEKTLCWDHAKNKCMKKFPKPFLEETKINEDGYPYYKRSNDSRFVFKKGVKLSNQFVVPYNYVKVLLIKTVNGKKYDSFAKACLARGLCEMTTWFKCMESKYFFKISERLRVLFANFDSLWTKIPGKIMGFFXGLYGCRHKIKKSKFDDFPLSNWLTANKSNPNKPRTFLIRFXNNATNKNAKTNLSRNDNFNPIEETKIADKLKMMLNEEQMNIIKELTDVFESNKQKCIFIDGPGGTGKSIYFKTIYHYARGKNKNVCNMAFSGIAATILKKGRTLRNRFKLPLNINKNSTLLKLIVKKRNEIKETDIFIWDEAPMSRFILDIIDRKLKEIMQNNLSFGGKTFILSGDFRQCLPIKEFAIRSEIIDLLIKNSPLWKEFTTLKLTQNMRANTNEKQFAKDLIEIGNGTMGKNGYFNVPEHCICQENLVCEIYGENLKNHNYDELSNAILSPYNTVVDKYNVEILDLLPGEQHSYLSIDETDLSKNNPVPEILNSLKCSSIPDHEIKLKKGAMIMLLRNLNVKEGLCNGTRLQVIDLGKHVINCIIKSGDRIGEQTFIPRITLIEEKKFPFLLRRHQFPILAFAFTIDKSQSQHFSKIGSXFMMIPFSHGQTYVALSRRN

SEQ ID NO: 151834 - protein, 268 aa, Heterodera glycines
  Coding regions on vcDNA: vcDNA=SeqID_78257; Strand=+; Position=1 -232,480-519,672-798,1269-1325,1409-1505,1550-1575,1628-1659,1835 -1911,2196-2314
  Homolog annotation: Hit_ID=CAE59452.1; Match level="QueryCoverage =82%, HitCoverage=43%, E-value=7e-56, Identity=45%"; Hit description =Hypothetical protein CBG02828 [Caenorhabditis briggsae]
MQLVRLVGCNRTLLADAIRCLRRIPPADFTEQLWNMQLNFLEFPLVIVSRDANFFSAEDAFEALRKRHYAQDVNLMIGILCIWAKFSVAYGNIYNIPKFFDVPHQPMLSLDNFNECVKTAFSRLPDIVRDAASLDNSPARVYVYYFDQASSANPWPKWTGVMHGYEIEYVFGVPIYNESAGYTKREQILSQKMIKLWTSFASTGIPSLDHREGFSDRLHWPQYHSQNNPLMEKLTSALSASFAKTRLFPQSIVAIFFTLISVQKILIY

SEQ ID NO: 151835 - protein, 32 aa, Heterodera glycines
  Coding regions on vcDNA: vcDNA=SeqID_78258; Strand=-; Position=1-99
RQKLSEVYKKIFEKEMIAMLHREFTGDFWELM

SEQ ID NO: 151836 - protein, 185 aa, Heterodera glycines
  Coding regions on vcDNA: vcDNA=SeqID_78259; Strand=+; Position=1 -63,121-183,312-368,546-602,662-759,1359-1575
  Homolog annotation: Hit_ID=AAS38911.1; Match level="QueryCoverage =98%, HitCoverage=94%, E-value=2e-17, Identity=32%"; Hit description =similar to Leishmania major. Ppg3 [Dictyostelium discoideum]
VQPAAESSSGSSSSGSYDTQETQPSGSDSSSGACSGASCGEAAQPGASSSSSCSGASCGQAAQPAASSSSSCSGGACGQQTSSSSSSTSSCSTCGLTSYNNNWSSKSSYTTSSGSAAAPAPVPAAAPAAGGYSGGSSAGGHSSSSSCYVCGRHGLTSYPQTSYTTRTYGGGSGCGSGGCRSLGCP

SEQ ID NO: 151837 - protein, 404 aa, Heterodera glycines
  Coding regions on vcDNA: vcDNA=SeqID_78260; Strand=+; Position=1-1215
  Homolog annotation: Hit_ID=NP_504186.1; Match level="QueryCoverage =78%, HitCoverage=38%, E-value=2e-24, Identity=23%"; Hit description =vglm uuk m polyprotein like family member (5E780) [Caenorhabditis elegans] gb|AAB63927.1| Hypothetical pr
MLAGGLSLSLLCFIFTMCSMVGYAMAGLRILFWIFSVLFARLFKPRKETWVLSEEEENLLYPHRRIRRPRPATRNWASGRVSQMTILVMASLPFVHGGIETVAIMAKSESCLNNGTTKMCQVKGSVTLALLPAGQPNVLSMKTDDGLILGTLQVILKGLSLECQVYTKAWKRSYEIASVASKRCPSAGSCVGDFCTKVRPSTAIRELRETETFPGNSFCIDSTAFWGNQCLLAASSCLFYKWFAKPRSSAIYEVIGCNSWEFGIHIQFRLDSTTGRSTTVETVLLPGRVLKWHNISISTIGVSQAPTPLLNADFLIEGRNVALVRERITDSLHCTDLKAAQAFNCTLGIDACTGCLPDHTDGTVSCHCRVANLEGLMEDLQRRLPLSFRHYELRNIGRRIFAIT

SEQ ID NO: 151838 - protein, 308 aa, Heterodera glycines
  Coding regions on vcDNA: vcDNA=SeqID_78261; Strand=+; Position=1 -181,465-1208
  Homolog annotation: Hit_ID=EAL51823.1; Match level="QueryCoverage =97%, HitCoverage=64%, E-value=1e-40, Identity=32%"; Hit description =alpha-NAC protein, putative [Entamoeba histolytica HM-1:IMSS]
MANGWPMKEKPISGKRTERLESKSVQRREWRHSLNGRGRGVDLMMISMREGGQNEQCRKAVQWPRQTNESRDRLVGQKKAERGKRKLLKKEKGKRREEGKGRRREEEKGKRREEGKGKRREEGKGKRREEGKGKRREEGKGKRREEGKGKRREEGKGKRREEGKGKRREEGKGKRREEGKGRRREEGKGKRREEGKGKRREEGKGKRREEGKGRRREEGKGKRREEGKGKRREEGKGKRREEGKGKRREEGKGKRREEGKGKRREEGKGKRREEGKGKRREEGKGKRREEGKGKRREEGKGKRREEGK

SEQ ID NO: 151839 - protein, 407 aa, Heterodera glycines
  Coding regions on vcDNA: vcDNA=SeqID_78262; Strand=-; Position=1-1222
  Homolog annotation: Hit_ID=NP_700531.1; Match level="QueryCoverage =61%, HitCoverage=15%, E-value=1e-13, Identity=28%"; Hit description =regulator of nonsense transcripts, putative [Plasmodium falciparum 3D7] gb|AAN35255.1| regulator of nonse
MIRNAQCSATSRPVRRRQDSERGKSCTNPFEQGKATDHLLHSLLAEQIGTLFDDTDMIIVDESGQASYVQLLSMLTNFPNLNKLLVAGDRWQLSVNLKDVPEAVQNGYGLDTAILNLDAAAGVDRTTLTVNFRSHPFITECISAGVYAAHNEILTTGRTIKQMDQLTSKTPISLPVPQCPIIFVHQIDRMQEDPTSFSATNPMQTRTVMKCLTFLRPCFNGLIRVVCFYAGQAKEIGTEVSALNMPNVMVTTVDGCQGHEAEFVFVVTTKSGLSSNDNSGAFWNDERRVNVALSRSKFGMMVVGDLKLLWSAGGIWRRFLRRALDKAIAVTPEYIHAMMDPHPQFVDGVIATPNGSVKAFDFYDDWQGSDGPFLPRSIRPPRMLFAGTSRQQQSARQPGSAHPNMPA

SEQ ID NO: 151840 - protein, 471 aa, Heterodera glycines
  Coding regions on vcDNA: vcDNA=SeqID_78263; Strand=-; Position=1 -1330,1430-1515
MILETSVDPMATLGAKMLELEGASFVTNNPEKSGEGSEKSAGTNDLMETEEGEKNEGMPFVAEILNVVNEMSGTEMPEKAQKAGFGFILDDEMHQALDNIDESNDTAGFGTSHLRCAIVQVQSSMAVAMLKRFTKNCPWFFGISNGTPTGSDRRLRLGDEVDIVNFAWKSGYEVLRHFDQDGTSPPWLNAGNINIQATAIKANIANPTNIVPKIGIVLNVKRRGMRKTNVIQSLTVVAPGMKVAQSLPGWALGEKDWFRTGQAVLVETVELMRPNLWKVNQIYALPLNCPFGQVNDRKAYHPFVAVGIDQSPILHKFPFRRGDLDATIAQGEQAIAAAVTACLDKLEEDILRFTITAEPQVEYGAEADTAIITIRHRLDNKQEMVDMSKMWTEDQPIHVRVAAKGAKPCATGFIMNVERQESETGLSIVAKLFLAYQEAKNYDFNLFTEMAKNTTTGLGTIMSILMARQGE

SEQ ID NO: 151841 - protein, 317 aa, Heterodera glycines
  Coding regions on vcDNA: vcDNA=SeqID_78264; Strand=+; Position=1 -27,767-843,893-976,1029-1270,1724-1916,1980-2225
  Homolog annotation: Hit_ID=CAE64089.1; Match level="QueryCoverage =99%, HitCoverage=57%, E-value=5e-42, Identity=32%"; Hit description =Hypothetical protein CBG08694 [Caenorhabditis briggsae]
KQSLIFTKSFGRQNSLKQIMRNVSLLFTNSNQFFEMPRPISNKIIFFEMPRPISNKIINIGGIVEMKVKELEPGIKAIVDGIKAIVDNSRDGTVIVSFGTFADINSMKREMTMAFLEAFAHFPNYEFIWKVELSDKDAKVFAKYKNVHPVKWMDQKSLLSDPKMRAFVSHCGLNSVSEAVQFGVPILAIPLLGDQLYNAIMARVKGIAVQLDVGQLNGDGAEQLLLQVLNDPSYSLQVLNDPSYSQNVKLLKQKFASTPFGAKEKLIRWVEFAAEFPDLNELNLPWEEELGTLAYYSVDIIFLIVAMLAIFAWILFK

SEQ ID NO: 151842 - protein, 129 aa, Heterodera glycines
  Coding regions on vcDNA: vcDNA=SeqID_78265; Strand=+; Position=1 -144,276-426,798-892
NITDPLDAIERFYFGITDPSGNRSEYKQEFISRCKGYSSHRSPHGVLIKMKRNLLLNCRLPLGNETESYADVLGLFHKIEKHLHNMSISSEEYEFLKNSLLAKSTWVQDKLKSSSSNNLMFKTLLFFIE

SEQ ID NO: 151843 - protein, 319 aa, Heterodera glycines
  misc_feature (54)..(54): Xaa can be any naturally occurring amino acid
  Coding regions on vcDNA: vcDNA=SeqID_78266; Strand=-; Position=1 -138,390-678,723-908,971-1113,1159-1239
  Homolog annotation: Hit_ID=CAE68699.1; Match level="QueryCoverage =99%, HitCoverage=62%, E-value=1e-46, Identity=37%"; Hit description =Hypothetical protein CBG14618 [Caenorhabditis briggsae]
SGHFNALQPAEVIAKIGIGASCLALCALLWSTHSILWEIEQIQAEIDAKVKSDXNSQLKKKTKECQPKVESHSRDGETETSLNAPFTECARMNCPVGPTGLPGQPGDDGIPGTVGRLGVPGVDGTDIQENPLPDMPCIVCPAGYPGLRGTQGERGLPGAYPGLRGTQGERGLPGAAGPRGKGGPPGKSGKDGGFGKRGPLGKRGQLGVPGKAGAAGENVVGGIGVKGAPGQPGAGIGVKGAPGQPGAKGPPGFAGLAGRPSKMAGQPGRQGLRGPTGMPGEPGPYGVPGPQAPGPYGVPGPQAPPGEIGQAANFCPMRC

SEQ ID NO: 151844 - protein, 25 aa, Heterodera glycines
  Coding regions on vcDNA: vcDNA=SeqID_78267; Strand=-; Position=1 -27,293-343
MSIYFSLSHKTNFAIIIQRLYYNNV

SEQ ID NO: 151845 - protein, 42 aa, Heterodera glycines
  Coding regions on vcDNA: vcDNA=SeqID_78268; Strand=-; Position=1 -24,68-172
MPKKQLVLPEWRNDTKILLIKANMDQLFLAPSTEPDAEEKEL

SEQ ID NO: 151846 - protein, 306 aa, Heterodera glycines
  Coding regions on vcDNA: vcDNA=SeqID_78269; Strand=-; Position=1 -186,230-388,432-583,633-807,902-1150
MSDIWKYFDKSSNDKALCNVCGKKIVRNDGSTMGMWKHLEARHKQQFTELKSWNLLEKQEQKKQRRIDNYVVPKKNELEEAEESIVRIMIRQNNSFLFVEDPDLRNLTKKAFPNLEFGGRDHFRRKVIPRMADQIRHAIRTGIGDGHFAITSDGWSKPTHSPQLQSLTIHWIDDNFCRNDAVLGAFPMDEFFHSGEVIAEGIANCLTENGFHWIKLRDVCMMTLCCCHFLNLVIQDAIKNQCLSEIIWKAKEPILSQFRRDGIRPTECWHLSKSRRKFCWQCNFEETKKCPELCLHPKNLDGPRWK

SEQ ID NO: 151847 - protein, 271 aa, Heterodera glycines
  Coding regions on vcDNA: vcDNA=SeqID_78270; Strand=-; Position=1 -64,366-505,730-1084,1130-1383
  Homolog annotation: Hit_ID=NP_608540.1; Match level="QueryCoverage =99%, HitCoverage=63%, E-value=2e-34, Identity=34%"; Hit description =CG2839-PA [Drosophila melanogaster] gb|AAF51469.2| CG2839-PA [Drosophila melanogaster]
MPKKKESEKEIKRRQAIRWSSRLDESGYLGKTGSGYFRVQKSRVRVQVFKPGTGGRESGRGTESGRGTEEKVEEEQKVEEEQKVEEEEKEEEEQKVEVEQKVEEEQKVEEEQKAEEKVEDKVEEEQKVEDKVEEEQKVEEKVEEEQKEEGKRKRKRTRNRKRTRKRKKKKKRKERGRGTERGRETEKSGRGTESGRESGRGTESGRESGRGTESEEKVEEEVEDEQKVEEKVEEEQKVEEKLEEEQKVEEKVEEEQKVEEKLEEEQKVEEK

SEQ ID NO: 151848 - protein, 145 aa, Heterodera glycines
  Coding regions on vcDNA: vcDNA=SeqID_78271; Strand=+; Position=1 -53,117-182,244-426,724-921
  Homolog annotation: Hit_ID=CAE65927.1; Match level="QueryCoverage =73%, HitCoverage=25%, E-value=4e-15, Identity=37%"; Hit description =Hypothetical protein CBG11100 [Caenorhabditis briggsae]
HSLNLLCTFGSKCILQNKFETARNFLELGVKRVTLLPETEPTILLSFYCCYAEALFHTGDIERALDYAKRAQKLSQGSDIDAAVRAYVRDFSRQIERDTLRASVRSNNERTASSSSSSSSSSTSLSAEGAEGTEKGISNWLWPFK

SEQ ID NO: 151849 - protein, 83 aa, Heterodera glycines
  Coding regions on vcDNA: vcDNA=SeqID_78272; Strand=-; Position=1 -80,209-330,841-890
MSLITSISLAVLVFVVATVRESEAGCWPPALNGFSSGYLNLKSSEKIQLKKSVYFLAVATAASVARAEIFFLFLTIEYDLKID

SEQ ID NO: 151850 - protein, 206 aa, Heterodera glycines
  Coding regions on vcDNA: vcDNA=SeqID_78273; Strand=-; Position=1-621
MKLLPLFFLIVILIIKIDQFGAEKKKLKQKSFDEIFGEKWEEKEEERRNELKKREIIAKFYKIKEKIKQKGRKYPRKEWNKIERKIAKKMGTYRKNIYEWIKELGLQKQIKKSYKSKTDEEKLEIVQKFIEMANELKEKRKYSTKEWKQNYAEICKKIGVSQRIIEKWKKQFAIRSIKLFVIFSSILFHSFLEYFLPFYLFFSFIL

SEQ ID NO: 151851 - protein, 47 aa, Heterodera glycines
  Coding regions on vcDNA: vcDNA=SeqID_78274; Strand=-; Position=1 -53,856-946
MVPILRNDPSLTTKLRIGRRLSAPPDPLPSPVLQNSLEKCAAKNLFF

SEQ ID NO: 151852 - protein, 136 aa, Heterodera glycines
  Coding regions on vcDNA: vcDNA=SeqID_78275; Strand=-; Position=1 -127,345-484,1048-1191
MFGAGELSTHKLVGLPLTWISNMFFQQEFKEWLRIRSGLRSKALISCFITFSVSAGQAFRICRFGRNSIMPYNGSHNSLFVYALLPTPEVAWHVCWACNQIDENLGNYWPSKYGQMKFKPTVQMSARQTFLDETNS

SEQ ID NO: 151853 - protein, 86 aa, Heterodera glycines
  Coding regions on vcDNA: vcDNA=SeqID_78276; Strand=+; Position=1 -58,124-326
MANRWHRQQRHRTDERGQYDSRHFDGVRPTKCALRHRRPNGPTAATANGRSVRVGCPSAVAAPTPNAPFWRVGQRMNGEKTNKLEQ

SEQ ID NO: 151854 - protein, 421 aa, Heterodera glycines
  Coding regions on vcDNA: vcDNA=SeqID_78277; Strand=-; Position=1-1266
  Homolog annotation: Hit_ID=EAK90389.1; Match level="QueryCoverage =53%, HitCoverage=19%, E-value=6e-17, Identity=32%"; Hit description =cryptopsoridial mucin, large thr stretch, signal peptide sequence, transcripts identified by EST [Cryptosp
MMLFTCKIKLCMLKEDECNTLTVTDQRMPLAVALCLLTNHSQIKPPSCNGKRAKSAANGNFNVDNAGAEVGTGTAAIGGRNGGGTTGKEEEQQTMRGKGKKQNGGRGSRTEVSGEVAEGTAQTDDSGPTTERPTERTTGATTASSTAPTATTTSTERTTATAQTTETTTEPTQSTNTTTGTTSSTTATSTTASSTTMTTKTVTEEQLLSSVERAASGESSEGIQPKASSLSSAAEAAAQPSSSSASSPITAQTTETSPITDGTTIHYKKSREEMTEDFPRPQLLLQNDHAKTAEGDKKRMERMERAEEGSWTISASEEGEEKGKGKKKVPGGEEEEFGGVTKPVQVFKKGKLEGTAPTEEGKAKPQMAAAGRTQRDTPAAGGRAGGSRRRMAEVDFDIQSPELMILDDYGLEIASISPSGV

SEQ ID NO: 151855 - protein, 646 aa, Heterodera glycines
  Coding regions on vcDNA: vcDNA=SeqID_78278; Strand=-; Position=1-1941
MFIPRSPPLTRQRARNIQQQQQNEHQNTQRPHNTANTENVLENSVVDGEILRTNGNMDSAQIRNALLELAQPNRQNEGQENGAENNGNEEQRGGLRMRFRNVGTNDGRENWLVGDENRNDGHRNLNQNLLPRTSTPISGPIFPELLIQNVHQSVHQNLPNRQNMGDKNQQHGIPKTAMPQPQVVQQPIAFFPPVQQAVPGPFLNYPAINPFYQLAPLPMQLPNQQMIGFMSTNAQNPPQMQNAYNPQFQQPYLPQGNHQFGMINQAHIPQVVQPISQPQQQQINAAQNLARQNFENRPIENVIERGREPGMDQVAYALIMSQIPALKGNEGAEKFREFFKRFDSNTGEWTNAKRISSLESKVFGRAERAFRSACSTVPFRYELIKREMLRQLEETDAREWNAFDQLMSGIRRKNGEDLDDLADRVITLVRRAYPGLTDHLVDDYAIKHLIRTFESSELALSLEMGRRPGMTFDQFVGMAARAEATQKATRRIASNNAYGKTNFGATLTRQGPEPKTNFQHSTGNRPKCFYCEKEGHIARNCFRRQAEEGNQNHNSQQNHNVTGSNKTPLSLYPSQSPAYKPEPNNANPQRPQNTQSRNFLRQNYLQRKVPRCPWDFRMKFGGWIEHPQVLKKSDFIFCGMNSSAEL

SEQ ID NO: 151856 - protein, 276 aa, Heterodera glycines
  misc_feature (16)..(17): Xaa can be any naturally occurring amino acid
  misc_feature (269)..(269): Xaa can be any naturally occurring amino acid
  Coding regions on vcDNA: vcDNA=SeqID_78279; Strand=-; Position=1 -172,260-390,439-498,573-648,702-862,953-1056,2305-2357
  Homolog annotation: Hit_ID=NP_495694.1; Match level="QueryCoverage =91%, HitCoverage=28%, E-value=3e-62, Identity=49%"; Hit description =glycerophosphoryl diester phosphodiesterase (2I358) [Caenorhabditis elegans] emb|CAA87796.1| Hypothetical
SRDIKRNGQQQNRGHXXPGEADERDELRSFPTLVEALQRVDEHAGFNVEIKYMRMKDGSHECENYFERNQYMDQLLVDVFRHAGKRRIVFSSFDPDICTLLSVKQNKYPVLFLSVKQNKYPVLFLCVGQTDRYVPFLDERYVPFLDERSKVTRVGTNFAACSNLLGINLHGINLHSEELLSDPSSLKRAVAMKLITFVWGEDLDKLEHVAYFRRQNVDAIIYDRIGELETRQNVFVVEREVKSALFKSPRTSPSLSRASPSPAFCLSHXTFLPHFV

SEQ ID NO: 151857 - protein, 120 aa, Heterodera glycines
  Coding regions on vcDNA: vcDNA=SeqID_78280; Strand=-; Position=1 -120,174-416
NLLSDADPFFREQSENGEPFRNDGEDYFVFRTTSVAIEFLAFRIELFMLQQRNWASTESKIGLTPSRFALAYCPSAAIGSGAIIVCCPLRHALLNAGHNWLPFPAIGRCENAEADGPNKS

SEQ ID NO: 151858 - protein, 146 aa, Heterodera glycines
  Coding regions on vcDNA: vcDNA=SeqID_78281; Strand=-; Position=1-441
MNPISELFRIANGQGNDGNDFKKLQAEHAIDQLNDRLHNITEKLKSLLPEMQFDQIIPFSDAKFFEICSEGIVENGIIKHIRESLEEIVRNQENSQQSKNKALNAIIIIQAIKSDLDIFANLAIENLNILREEEQSDDKIKMNLSN

SEQ ID NO: 151859 - protein, 227 aa, Heterodera glycines
  Coding regions on vcDNA: vcDNA=SeqID_78282; Strand=-; Position=1-684
MEIINYFLFFTIFLFYPSQSSASKKLRLCVICEHSREVKIVLELFYELNGGIFKIYSDVQIGENFEIKINEKDEREIDNYILQFHVSVNPINNEFLPDENDENPADDQPYEDQFVQMDDIRSLHRTVKVELFRPNFSRLYVVNLGSADPPGRLNWNRRVFVEAENDAGNYHAFVYAFVQKNRRGFELEDERILLGFAPLEKLENANGQQMPKAKNKCQINNINNLIF

SEQ ID NO: 151860 - protein, 21 aa, Heterodera glycines
  Coding regions on vcDNA: vcDNA=SeqID_78283; Strand=+; Position=1 -58,252-259
MFYYAYLINNGCRKKIDAHFK

SEQ ID NO: 151861 - protein, 59 aa, Heterodera glycines
  Coding regions on vcDNA: vcDNA=SeqID_78284; Strand=+; Position=1-177
MEVDKHEKSEAVPTEAKNESELIKSTKLEDEEEFEEFPVYNKGEGIDTVEAQAAINVWE

SEQ ID NO: 151862 - protein, 448 aa, Heterodera glycines
  misc_feature (14)..(14): Xaa can be any naturally occurring amino acid
  misc_feature (217)..(217): Xaa can be any naturally occurring amino acid
  Coding regions on vcDNA: vcDNA=SeqID_78285; Strand=-; Position=1 -180,240-306,521-673,915-1089,1185-1243,1537-1674,1912-2131,2330 -2447,2647-2771,3053-3154
  Homolog annotation: Hit_ID=NP_497007.1; Match level="QueryCoverage =96%, HitCoverage=96%, E-value=1e-148, Identity=57%"; Hit description= general substrate transporter (48.5 kD) (2O777) [Caenorhabditis elegans] emb|CAB05777.1| Hypothetical pr
RAKSREFLTLSIPXFFRSESKLWTANFFLGTCVLYASRVALPICAVAMAQEYGWNKTDSGGTMLSCFFWGYAFTQLIAGSCADLLGGERILPVSTLVWSLLTLCTPQLFDIAYWTNSPLLVLLFVRVSTGVGQGFHLPSMASMISRHLTASEKGRVFGILLAGSTLGSVVAGGVGSVMLEWFGWRSLFHFVGILSILILSILWCLMFNFLSKDALSXGEENGQSADDSIAGDHRDKWRVSAAGNESAAVPWGKLFRHPSFWAASSAQYCGANAYFTMFSWLPSYFSDNFPHAKPYIYNVVPSMAIVVTSLLSPLVASRMMAKGRSVTFARRCMECCSLLGMALCFLSVSLSDSFSASLALFTLAMAVRGFHHGGVAVNPTDFAPNHTGSVFGVFNAFAAITGFIGVYVAGWILQMTNNHWGVVFICTAVQCVVGAVAYGFKGTGKRII

SEQ ID NO: 151863 - protein, 56 aa, Heterodera glycines
  Coding regions on vcDNA: vcDNA=SeqID_78286; Strand=+; Position=1-229
DFLLLSVEEFSPKLGVHIRTSRNAIFKGNILVVFEFGGELQAFLGYLNEIFSSIFH

SEQ ID NO: 151864 - protein, 305 aa, Heterodera glycines
  Coding regions on vcDNA: vcDNA=SeqID_78287; Strand=+; Position=1-918
MEEILSEWDCTEMQAFNELWAGVKRQPDESLDQFAERLHGVVECAYPGLPPNFVDEFAVKHLIRAMENPEISVGLEIARRPGMSFYSFVALAVRAEAVQKATKSAGFGKEHRPNFQQKSTVPPQKIFPPKTNRIVCYNCNKTGHISRHCRLPFARKQSNCARKPPQQNFATKSADFRKNSEAEKKLIDLQLSNQPPAQPTNVEAGPKRKASNRQRNSSSSCSVKATKMEEKSAEIPKWFLNAIFAALVVFAGVFSKEKSKCGQIWKSKGSMSRTDEVKGGKHSENWGQFFRRRPGRNWRMSQPPI

SEQ ID NO: 151865 - protein, 106 aa, Heterodera glycines
  Coding regions on vcDNA: vcDNA=SeqID_78288; Strand=-; Position=1-321
MCYEKVFHSKKGVPKVSSFQQSMLLPSPSVFHASSRPLSSRWSALLPTIGHRSIKNWSSFPILRPVNRSRVHEFTSSNWPPFAASCSKECNQMMKLTAMVALIRNS

SEQ ID NO: 151866 - protein, 168 aa, Heterodera glycines
  Coding regions on vcDNA: vcDNA=SeqID_78289; Strand=+; Position=1-508
SLAFGFHYTLRHNFFFYHETFCLGVPFSDPSSPSVSSFTSNVAANDGSSSSSNNNNHLLHHHQQQLNHHGSAAAAATAHTTSLNNDADTSKWVINGYTTVYGTYIGPMRSSMVGTTTMAQSAANNNIGHFFAVNESVVQCVNCTFAGDIAGAVFDFFFGHIGLNWIQQ

SEQ ID NO: 151867 - protein, 64 aa, Heterodera glycines
  Coding regions on vcDNA: vcDNA=SeqID_78290; Strand=-; Position=1 -70,1035-1159
MANEFKQKGKYSSKEWQQNYAEIEQVFKNKLYCRDHHCRKLTAPMERRVVDPTLDNTELAALNS

SEQ ID NO: 151868 - protein, 83 aa, Heterodera glycines
  Coding regions on vcDNA: vcDNA=SeqID_78291; Strand=+; Position=1-249
  Homolog annotation: Hit_ID=BAC87222.1; Match level="QueryCoverage =100%, HitCoverage=77%, E-value=5e-13, Identity=40%"; Hit description= unnamed protein product [Homo sapiens]
MSREMKWKWKREKKSKKKMEWKSKRKRKRRKRKEKEKGKGKEKEKGKGKGKREKEKGKETGKEKGKRKGKREEKRENEKGKGK

SEQ ID NO: 151869 - protein, 37 aa, Heterodera glycines
  Coding regions on vcDNA: vcDNA=SeqID_78292; Strand=+; Position=1 -9,577-681
MHPLEDCEDLDNEIDEALSEFEANNPERNLLHTICFY

SEQ ID NO: 151870 - protein, 343 aa, Heterodera glycines
  Coding regions on vcDNA: vcDNA=SeqID_78293; Strand=-; Position=1 -153,642-1306,1401-1612
MKQTAPITKTGLAKRSLRSGYAFSHCSGFGELIAKGTMFKNIEHLRIPSLSIRPILPPPPAVPNSSRLHQSQHHSHQYRHHKHHQPTSTRRSTIESLVIEQPPSADDEKDDGMTPMITQIVVVKEEDEEGDEVIRATEQQQRVGSSNYQQGTTPTELIRGSDQYGKQTELVDSTDQHWSSERVQASDHYGKSTADDRPLSERDNESRRMVTAYSARPIDMARPNSELKHNLVVNAELEDEEDQRSEMPTPNTSHSFVVNAELDDDVPSLPSNWLRKADTMPKLFDANELAMTSVEQTAAAEHGKTFVSKTRRKSSSSSATSRNSQEMGTVKMDSQRNRQTVFT

SEQ ID NO: 151871 - protein, 126 aa, Heterodera glycines
  Coding regions on vcDNA: vcDNA=SeqID_78294; Strand=-; Position=1 -131,471-720
MRSLVQIQTDEWSQLLRRLEQEEFEQHKEQIQEENALLKRLLAECGRHEEQLSKRHSEQSHQLEMEAAKVRFWHKFLFLATHVQAGGNVNHGIMGPVLYDQLKDGKEILDFPSKRTKKIKNFPLHK

SEQ ID NO: 151872 - protein, 21 aa, Heterodera glycines
  Coding regions on vcDNA: vcDNA=SeqID_78295; Strand=-; Position=1-63
KVGTGTKFFDRDREKTRDQSG

SEQ ID NO: 151873 - protein, 215 aa, Heterodera glycines
  Coding regions on vcDNA: vcDNA=SeqID_78296; Strand=-; Position=1 -58,213-667,1093-1227
MGRDKAQASENARISAKTTEPVLITIRKRQDSNPSMTCNLPILFPTFSKFSALYYAAVLLYPILDSHPDSILETLGKFYARISTLNFMLFSSPRLQQCVVERLVDQSHKMSLKKRNHLNSTSLGEKQASNDGDNKDNNCQQNQQQHNSLALRISDPAHTVTTVELTGDQKRMRSLVQIQTDEWSQLLRRLEQEEFEQHKEQIQEENALLKRLLAE

SEQ ID NO: 151874 - protein, 36 aa, Heterodera glycines
  Coding regions on vcDNA: vcDNA=SeqID_78297; Strand=-; Position=1-143
IKINQRLKIHRRLKYSVNVAQNRKSPTQNSLLLANP

SEQ ID NO: 151875 - protein, 50 aa, Heterodera glycines
  Coding regions on vcDNA: vcDNA=SeqID_78298; Strand=-; Position=1-151
MEEKDEEMSQKFGQPQIKWAHSTREWMKIAEKIGTSLTSIYRWKAQLGLT

SEQ ID NO: 151876 - protein, 51 aa, Heterodera glycines
  Coding regions on vcDNA: vcDNA=SeqID_78299; Strand=-; Position=1 -12,242-385
MRKDSLADHKFVRGYLFFGAISQAAKLKITFTNHRKLLVSKNIKIFNLNPY

SEQ ID NO: 151877 - protein, 91 aa, Heterodera glycines
  Coding regions on vcDNA: vcDNA=SeqID_78300; Strand=-; Position=1 -216,942-1001
MILQLAIDTAKESPNESVDEIIKQNFDRNLYEMFKKAAKMTQEKNGSSSSLDAFDDKHLIIIGSKFDDSNIWIYKKNCPKFGQGIGRNPSD

SEQ ID NO: 151878 - protein, 104 aa, Heterodera glycines
  Coding regions on vcDNA: vcDNA=SeqID_78301; Strand=-; Position=1-315
MLIAFMKGQQKNLQISKYAIQKYEAYLGILYFLKKNWQCKNILENFDEFEWKKCQKYRKYLVILYEYLLREYAGIPAVKAKYVNKMWSIEIEGFYVLYSLTKIS

SEQ ID NO: 151879 - protein, 52 aa, Heterodera glycines
  Coding regions on vcDNA: vcDNA=SeqID_78302; Strand=+; Position=1-364
TCSGPKAWKICFLVIVKQLFELLALILSFLFSLNPKKFNKTYFDLLCFAQNL

SEQ ID NO: 151880 - protein, 309 aa, Heterodera glycines
  Coding regions on vcDNA: vcDNA=SeqID_78303; Strand=+; Position=1 -87,137-754,799-996,1664-1690
MFYSVSTILLFITAIIHLYLIHISCAIPSFDDNILIAFMKGHHWKCDKIAEKFEEYERTECQKYRKFLDILYEYLFREYIGIHTVKPKFVFKDQIEINGPIIYVVHCLAKISQFYFKLSWNKNYEYKLKSLFKWLDNIFEPKLLNEHRLNYDETKLPINEIILQLAIEKANEWQINKSLDGIIVQKFSNKFEENLEEMFKKAEERAKNNKWKANLINDDKHLILVDPKYEDKWTWTDDALFSEFVKGLATNFEKFFKMAKEYSNYLNRMKEKGGRNLKKNAKNIENICIFYMNIYSDYMLKGLITGLFL

SEQ ID NO: 151881 - protein, 66 aa, Heterodera glycines
  Coding regions on vcDNA: vcDNA=SeqID_78304; Strand=+; Position=1-201
RQMALIRLSDSAFKHRYVPAERQTYSEQQPYERTSANGDETISTEKKWDTKAMNWPKMLLDEEGKR

SEQ ID NO: 151882 - protein, 77 aa, Heterodera glycines
  Coding regions on vcDNA: vcDNA=SeqID_78305; Strand=+; Position=1 -329,443-509
INSEQAMRLPLEFGTGSPAPSTLKLNKKIHLQHGRTKSFGHHIFQFRRHSQIEGYAGKLKDLKILMIQLSMSRNEFY

SEQ ID NO: 151883 - protein, 65 aa, Heterodera glycines
  Coding regions on vcDNA: vcDNA=SeqID_78306; Strand=-; Position=1 -151,493-539
MDIPTYTLNKYSYKMSKYFRYFWHSIRHILQISPQFCHIANSFSLNAQFQGFVRIFPIEFMIFIF

SEQ ID NO: 151884 - protein, 73 aa, Heterodera glycines
  Coding regions on vcDNA: vcDNA=SeqID_78307; Strand=+; Position=1 -127,187-281
MDPKTLQLAIDTAKKVQHGEPMKYSRKAFDNFVFRIPKFRHLEFMKGQATNFKKFHKLFNENELMIFAKQKNI

SEQ ID NO: 151885 - protein, 98 aa, Heterodera glycines
  Coding regions on vcDNA: vcDNA=SeqID_78308; Strand=-; Position=1 -66,588-818
MRLPLEFGTGSPAPSTLTWPTTTLDNSWVFTLLDNSWLGQFVAWTKRGLDNSWLGQFVAWTIRGLDNLWVSGKDKAKLNIKIGQSLGGKPLNNLQMKK

SEQ ID NO: 151886 - protein, 259 aa, Heterodera glycines
  Coding regions on vcDNA: vcDNA=SeqID_78309; Strand=-; Position=1 -228,525-771,974-1155,1204-1326
  Homolog annotation: Hit_ID=CAE69479.1; Match level="QueryCoverage =91%, HitCoverage=52%, E-value=6e-28, Identity=28%"; Hit description =Hypothetical protein CBG15681 [Caenorhabditis briggsae]
MSTTLKPSDYKIFPKSQKCVPSNGTESTASGATEDSFSAEDRKTDWRSIYLAALVCFFGQVQFSIFLNSQFAFMKTLDPTVSEGFFGIIVGCFSLMQMIFSPLMGIWADRIGQLRVPLLVCNAMMLIGNMLYFVIEWFPVEWMKHVMLLSRLVAGIGPAFQWFFTYIGYPGWRLNRWISINMFTATALFAICTNVLIHFLLQFFFRESSVGILDSPKSKANSSEVESAIQKLPPYDRWALAICCAMRFTQYLIFTNLET

SEQ ID NO: 151887 - protein, 32 aa, Heterodera glycines
  Coding regions on vcDNA: vcDNA=SeqID_78310; Strand=+; Position=1 -16,531-613
MGHGIASDVIDAIWPVDPPTLRMALSRDETDK

SEQ ID NO: 151888 - protein, 75 aa, Heterodera glycines
  Coding regions on vcDNA: vcDNA=SeqID_78311; Strand=+; Position=1 -77,188-338
MAIRQIFQFGHQLCMNVTAFKNEFFGNDQSHKFCVHTRRGDFVKRGWDSKKEPTEKGIDLGFEYLKVIQMMNYPF

SEQ ID NO: 151889 - protein, 17 aa, Heterodera glycines
  Coding regions on vcDNA: vcDNA=SeqID_78312; Strand=-; Position=1 -31,220-242
MYKKLFTGAAKNFLKRL

SEQ ID NO: 151890 - protein, 34 aa, Heterodera glycines
  Coding regions on vcDNA: vcDNA=SeqID_78313; Strand=+; Position=1-103
MPPLFRRHPRRSGWCAFTDKNSEGIPNSLGMSGK

SEQ ID NO: 151891 - protein, 75 aa, Heterodera glycines
  Coding regions on vcDNA: vcDNA=SeqID_78314; Strand=-; Position=1-229
  Homolog annotation: Hit_ID=NP_490685.1; Match level="QueryCoverage =98%, HitCoverage=77%, E-value=1e-10, Identity=38%"; Hit description =transposase (1A616) [Caenorhabditis elegans] gb|AAB54166.1| Hypothetical protein F53G12.11 [Caenorhabditi
ADPSLYWEVNSQKWPMIGAVVRKFLSPPATSSESERLFSTAGLISDDLRKSLQAENLAKLLFLHHNLLLTGFSIE

SEQ ID NO: 151892 - protein, 94 aa, Heterodera glycines
  Coding regions on vcDNA: vcDNA=SeqID_78315; Strand=-; Position=1 -73,763-974
MGFTSFVRATYYKNKGDLCPLFSDGEQPSKKRKQYRDADRRILTLVERYAQEMGVQNPLVPIHYDHQYFANPGPNFNYVIEFLQGISHNYEMNP

SEQ ID NO: 151893 - protein, 230 aa, Heterodera glycines
  Coding regions on vcDNA: vcDNA=SeqID_78316; Strand=-; Position=1 -138,631-799,1248-1401,1600-1831
MPTATTKTTVVPRAMLVDDMPTVAVAFSRLWLISSLNELNGLLICTRFVQQFIFRLADLEDVQMQPEHRQAEIDQQKCETNKRLGVALRDDLAALLDKYKKYAAGEFRPVFFVVLDTYTEKGSDLPGQQPIATERRHPPKSAPARVRNCANRRRSYNRSGCDGLAVANVSQRHRRLYACERRQPTRARERQRQQQRQTADPFGQTETETGTAQSQSHSADHGNGDKPDGG

SEQ ID NO: 151894 - protein, 76 aa, Heterodera glycines
  Coding regions on vcDNA: vcDNA=SeqID_78317; Strand=-; Position=1-230
MASSVSSSSSLAHHHRSHFGILPLIVSPLFLCLSIFGTDAIPIDGVDDAAFQPFQQRQPFALFAVAQEADENGGIG

SEQ ID NO: 151895 - protein, 85 aa, Heterodera glycines
  Coding regions on vcDNA: vcDNA=SeqID_78318; Strand=+; Position=1 -171,259-345
MSFLLRFILQLGLALFHRCTFGIGTWSGPFLFVDCLKVRSICRRRGIVRQMAKEMIRIAAKSNDPLIGWIAKEDATTDAFFQSVF

SEQ ID NO: 151896 - protein, 80 aa, Heterodera glycines
  Coding regions on vcDNA: vcDNA=SeqID_78319; Strand=+; Position=1 -114,171-300
FSLPFPIYHRWNASDCHPKIVINESTNAIQRNTTGTEEFLGGDGLLIPRSCRAGPIQMSYASAGRIGIIYAEYRILAGNG

SEQ ID NO: 151897 - protein, 129 aa, Heterodera glycines
  Coding regions on vcDNA: vcDNA=SeqID_78320; Strand=+; Position=1 -76,638-817,1168-1301
MRDCGICGINPAGSRPAKNFEFQSRKKRVYCASVRGALLCCANDILEENIARNWIEAEEKNVDIIISARIATTVETELFALTYETDGAKLLPSCDCTDPHLLFDGKRSLSHYCKLPCKADSTCKIFSLY

SEQ ID NO: 151898 - protein, 67 aa, Heterodera glycines
  Coding regions on vcDNA: vcDNA=SeqID_78321; Strand=-; Position=1 -114,818-898,1260-1268
MPSVSLSMIDFSHVFFIQKTETKMDENYMFGLLHIIKLPNSQPTESRTYFALRFCTTNFAKSSISKE

SEQ ID NO: 151899 - protein, 52 aa, Heterodera glycines
  Coding regions on vcDNA: vcDNA=SeqID_78322; Strand=+; Position=1-158
RSRTKRRRPKRRRTNFSTVTFFFLNRIKRFLVLFESVRKDTISLQIFKNFYL

SEQ ID NO: 151900 - protein, 44 aa, Heterodera glycines
  Coding regions on vcDNA: vcDNA=SeqID_78323; Strand=+; Position=1 -73,135-196
MDKDIVPKEGNRFKKHFDPLTTKEAKSSVTFRSTEITGDYFVLP

SEQ ID NO: 151901 - protein, 83 aa, Heterodera glycines
  Coding regions on vcDNA: vcDNA=SeqID_78324; Strand=+; Position=1 -37,1299-1513
MGFWAMGSHPVASHEYLDFSLFRLVPPHLVDPGTIVVKTVRQPNVLEEHNYHKRPIMYIINQLIIKSINHLTQGIKPNALFLT

SEQ ID NO: 151902 - protein, 128 aa, Heterodera glycines
  Coding regions on vcDNA: vcDNA=SeqID_78325; Strand=+; Position=1-387
MALSQLKGKEKKLLDEKTKLEKLSEIARPSHRLMPILLHRQPEIDVKKEAEETVLDGGESEKDVKRETVENEESEKEAAEKQPKEETEKGRETQAEAETSATQHTVREKENDDKGKRVDERRQSIDQK

SEQ ID NO: 151903 - protein, 70 aa, Heterodera glycines
  Coding regions on vcDNA: vcDNA=SeqID_78326; Strand=+; Position=1 -162,544-594
MAEAIVPKFGMLTKEEMARMKMLQQQMERKPELAAAVKRARLEQEHKTLKTDEEGSTTLNLTVPGQENTK

SEQ ID NO: 151904 - protein, 153 aa, Heterodera glycines
  Coding regions on vcDNA: vcDNA=SeqID_78327; Strand=-; Position=1 -90,457-828
MYLRSAEDLIIWMGKLNDGSTKPQFYHAGKVQIGDELLDSYVSRITHQFVDGAVTKNESAVVVVEVLLANLTIGNMPSDAIRSVVHYTKSGRTNAEFIVNRVQQLNAWQTLAGKLRGCVRRTTADSAWGYFVRMGNGETKNTAKATENCPNWV

SEQ ID NO: 151905 - protein, 68 aa, Heterodera glycines; identical to SEQ ID NO: 135126
  Coding regions on vcDNA: vcDNA=SeqID_78328; Strand=+; Position=1-207

SEQ ID NO: 151906 - protein, 41 aa, Heterodera glycines
  Coding regions on vcDNA: vcDNA=SeqID_78329; Strand=+; Position=1-296
SVFENLKKHRSLEKINSKILSRKIQVFSCFAWTWTWIFFHI

SEQ ID NO: 151907 - protein, 22 aa, Heterodera glycines
  Coding regions on vcDNA: vcDNA=SeqID_78330; Strand=+; Position=1-75
LVIYCCVFLISCHLRLIYSFSK

SEQ ID NO: 151908 - protein, 124 aa, Heterodera glycines
  Coding regions on vcDNA: vcDNA=SeqID_78331; Strand=+; Position=1 -178,522-719
  Homolog annotation: Hit_ID=CAE62158.1; Match level="QueryCoverage =84%, HitCoverage=1%, E-value=3e-26, Identity=60%"; Hit description =Hypothetical protein CBG06205 [Caenorhabditis briggsae]
KRQVYVVEEPRDTFVVPLNSQHANEKENATFECEVNDKDIDVKWFHDGAEIGMDGRHFKMLLVLQERAGCRRRLLIINVLIEDHGEYKCTAKDDETMAQLIVHPKFVKKAERKPVTCWLDDELY

SEQ ID NO: 151909 - protein, 38 aa, Heterodera glycines; identical to SEQ ID NO: 130624
  Coding regions on vcDNA: vcDNA=SeqID_78332; Strand=-; Position=1-216

SEQ ID NO: 151910 - protein, 38 aa, Heterodera glycines; identical to SEQ ID NO: 129423
  Coding regions on vcDNA: vcDNA=SeqID_78333; Strand=-; Position=1-364

SEQ ID NO: 151911 - protein, 215 aa, Heterodera glycines
  Coding regions on vcDNA: vcDNA=SeqID_78334; Strand=+; Position=1-648
MNIYLGNSGTSEAYWATHFPVGDFVAEVTENAIVLESEQSVFYFEKEKGDEREGIVGVPDEAYKMSNDVFILIHTPSPQKARGKRETKQKSEPQRKERPAKQEVFLKIRPGQNSKFENLDPASRPKSNWTGTTWAPKRNTTELIILSTPVPQSTSTVGSTIKVTMTISTNITSTVPTTIRPKIEVKKPIFKKIQIKNEQKLSQYTRQLGKRWKNW

SEQ ID NO: 151912 - protein, 153 aa, Heterodera glycines
  Coding regions on vcDNA: vcDNA=SeqID_78335; Strand=+; Position=1-462
MNVTEIPALMTPIPPTTQKIVEKVELPKEKGENKSDSIKAEKKNEKLLIPSTAITVVKKIKDEKVRDVSEKTVKNKKSEEEYSQEVEAEVIESLANDGNEMEEFENSFQDESDEEVSVELFDENEIFDMDRRKRTTVTTPDARWIKKVEKSKV

SEQ ID NO: 151913 - protein, 115 aa, Heterodera glycines
  Coding regions on vcDNA: vcDNA=SeqID_78336; Strand=+; Position=1-345
  Homolog annotation: Hit_ID=XP_470219.1; Match level="QueryCoverage =98%, HitCoverage=7%, E-value=3e-27, Identity=51%"; Hit description =Putative retroelement [Oryza sativa] gb|AAK98731.1| Putative retroelement [Oryza sativa]
MMLDQNIIRESESEFASPIVMVPKADKKSWRFAVDYRALNKMTKKRVFHLPNIQELLDLMGAKKYYTCMDMMQGFMQIPMAKEDIEKTAFISHLGIYEFITMPFGLTAAPDTFQR

SEQ ID NO: 151914 - protein, 69 aa, Heterodera glycines
  Coding regions on vcDNA: vcDNA=SeqID_78337; Strand=+; Position=1 -72,831-965
MFKPSQIVGLVWTGALHSLALRVKVVPSEVNERKARKEPSITRELDTKLFKVMALCVCPPRRRKRGGSK

SEQ ID NO: 151915 - protein, 88 aa, Heterodera glycines
  Coding regions on vcDNA: vcDNA=SeqID_78338; Strand=-; Position=1-331
PNGHLKKSIFFVFGAVPPNRCAQIYGETESFRNSFPIACTLILRWIFAPHNCLSTPNGHLKKSIYFCFRGSPPEPMRPDLWGDRILRE

SEQ ID NO: 151916 - protein, 155 aa, Heterodera glycines
  Coding regions on vcDNA: vcDNA=SeqID_78339; Strand=-; Position=1 -301,493-739
SIIIYLCLNFFLLWHLFTHLPITFCHLLFMCQIGIIMVPFFVPFCRNFLALFCPLISQFISCQFLHCFAQIFNPLFCQFCTFLCQISLFIYFLPIFGIILPQFLTLSFANFYTFLCQISLFISCQIFAHFCAKFPYLFLANFLHLFSPFSHLKNI

SEQ ID NO: 151917 - protein, 1119 aa, Heterodera glycines
  Coding regions on vcDNA: vcDNA=SeqID_78340; Strand=-; Position=1 -87,123-987,1030-1187,1231-3480
  Homolog annotation: Hit_ID=NP_507780.1; Match level="QueryCoverage =95%, HitCoverage=68%, E-value=1e-105, Identity=26%"; Hit description= predicted CDS, DNA polymerase type B, organellar and viral family member (5T899) [Caenorhabditis elegans
MPGFRQLNRNTMQKYTSIKCKGYGTSNIPIRPITKSDVTDYQFPILLYHNNNHFDGIKTLSKFFNKRYYCLSCESVYERKSQHSMNCSSLCHGCREVGVDYPCEPQQGYFKKCEHCNNNFYNKVCYERHLHKDLCTKFQRCEDCGVIYNVKYHGKTGHQCGEKFCRLCKQFHVKEDDEDNPCSSCFIQPLKPHKLKPYRIIAYDFEATQDKKVGNKFEHEVNFVSATIICTDCINGNWKDSLKGSSCKICGPHRTITFAPFDFSNTIVDQKVTTRHPLRDFVQWLLFDHNKKFPTVAFAHFGGRYDMTMVIKEVISQGIHNPDIIKQGNRLYELKINQNEHGPQTILRDSYNLMPIKLSGLIKSFGLKIQDKQHFPHMFNKASNYDNVLSHLPPREEYCPDQMKIPDQQKFDNWYNSNYNQPFNLKEKLPEYCCNDVQILTHALVELRREFKQLTKRDGKHGGIDILWQAMTIASACVKNFALNHLKPNSLAIVPEKGYTPQQNQSALAIKYLDWYSHINNVNIQTAHSRYGEYVFKREGQVYQVDGYIKGTNGKRDKIIEVNGCLWHGCGECFEDLDEETRMPNGKTLREIREREVRKHEIIRRYVDLEVVWEHEINEQLKKDATMRGYFDNWKDRSPIKIRDAFHGGRTGPMKLLHTAKPGQKISYKDFTSLYPWTNFSTSYPLGHPKIINFRLNEQTVNWRAPSDNPYKGLLKVLLLPPNRNINVTVMPVKFDERLLFPLCEKCAKHITNEHPNGLKDDNYSCPHFNPNDRAFVSTCTHLELNAALEVGYTVRKLFHVLQYDQWSDNIFKSYVSEMMALKIHATGFPSWCSNEEEKKEYIEENRQRFGILLDNEKMKAEPGKRYIAKLCLNSLWGRFSMRNLLSKAIINNDESLIRQYTDDKKIELVDLEMMDDDNDVFMLTYRPKEEFVDENKYSNVVISLFTTSAARLYLYDALKKVADTPDCEILYYDTDSVIYVHPEDNDPLPTGKGHLGELTDENPDHNILEFISAGCKNYGMKLQRKDTGEIEHDLKIRGFTLDAQTIQKIHYDTVKDQILRYGSEDPPDPIIVTYPHFIRPNLIQGKVYTQSLTKHYQPVFTKGIINDSFQVLEFGYRK

SEQ ID NO: 151918 - protein, 329 aa, Heterodera glycines
  Coding regions on vcDNA: vcDNA=SeqID_78341; Strand=-; Position=1 -611,674-1050
EIQKCADPLTEFRSCVHQSVEEAIQNAQNTIGGANKVGVIISSELLDQGDIIMPITPITSNVVDAIFNQFCKVEQSKSKHVNLYGAPFVVTVTVLNTEGLPRRRTTKGSAPPIHSSQSHIFKINNNDNYCLFYALELMRYYSLYIRGVISRKQFRWLKDNQTTVLRQKVLLLLRDAGIPTTEPEYDAEIYIHQVQGLWSTKYPGEYKIFIFNDYQTRPITKSDVNEYQFSIILYHHDKHFDGIKTLSKFFNKNYYCLSCESVYERKSQHSMNCSSLCHGCREVGVDYPCEPQQGYFKKCDQCNNNFYNKVCYELHLQQDLCTNFSDART

SEQ ID NO: 151919 - protein, 21 aa, Heterodera glycines
  Coding regions on vcDNA: vcDNA=SeqID_78342; Strand=+; Position=1 -28,528-565
MKEYFELEKCNNFLTIIILTI

SEQ ID NO: 151920 - protein, 66 aa, Heterodera glycines
  Coding regions on vcDNA: vcDNA=SeqID_78343; Strand=+; Position=1 -40,106-266
MGNKLEIEQNVSKKRKFYTIADKLEKMKHYYQMKKQNPKLTDSQIAQVLNVSRASMYRIKAELEKF

SEQ ID NO: 151921 - protein, 45 aa, Heterodera glycines
  Coding regions on vcDNA: vcDNA=SeqID_78344; Strand=-; Position=1-138
FEDICKLLIINTQSYRTTPTMLNLIDNEQSYGSKSLPTTFRPTTF

SEQ ID NO: 151922 - protein, 252 aa, Heterodera glycines
  Coding regions on vcDNA: vcDNA=SeqID_78345; Strand=+; Position=1 -33,98-343,385-555,602-910
  Homolog annotation: Hit_ID=CAE57522.1; Match level="QueryCoverage =70%, HitCoverage=9%, E-value=9e-45, Identity=55%"; Hit description =Hypothetical protein CBG00497 [Caenorhabditis briggsae]
MDAQAQDRCHRIGQTRNVTIYRLISEKTIEENILTKSMQKRRLGEMAIDQGEFTPDFFKNTGNLRDLFSNETAVAKIIAPVVDEPKNIKDVEAAMNRVEDTQDAIAAQLAKEEDTAEVAEFDETLNGASTSYDLRDIDSPSEQYLELISGLKPVERYAVNFMADEYKPMLDKEVEEAEVGSILQSFGMRSYFTGKNKSEANGVHGKATECGRRTVVRHNRRKWQRRRGKEATERGGTARHRLQRLHGPRRCR

SEQ ID NO: 151923 - protein, 207 aa, Heterodera glycines
  Coding regions on vcDNA: vcDNA=SeqID_78346; Strand=+; Position=1 -373,852-979,1021-1143
MTTKGCTTNSLWRSERKCYHLHPKIQKELQKLDYLTVIDDGSHDDFFLLEVAKCNGGFVISNDKFRDHRVRTEVPDGLRQIIDNRSVPFSFHYVPIDKIGKTTLADPAKLGYLELEFTLKPPNISAMFSLSPSDPSYGMVFSQRILRSEKRALEMLERLDVMSEYLLQLMCENLGVKRSLKHLKMPEMERMPIEFERFWRFYDLHQK

SEQ ID NO: 151924 - protein, 76 aa, Heterodera glycines
  Coding regions on vcDNA: vcDNA=SeqID_78347; Strand=-; Position=1-228
MRRAILKSRHFRLPSNEQLEMHLEASLSTFGSRLYICPDEQQKTVARLSMEKTGPNGVETDPLRAFGYCELLMGPK

SEQ ID NO: 151925 - protein, 268 aa, Heterodera glycines
  Coding regions on vcDNA: vcDNA=SeqID_78348; Strand=-; Position=1 -135,215-667,829-1047
MNSLKRFQLPEQGTRQQEELDSVEPKNISDVVNFNSAGVFYVLGKACPFRSKGLICRRKLSDDNMCEACGQKAIAPIHTVFVRLLLQDVEQADIAQRVTMFSSVAEEFLGMKAAELLAKEKEPESLAKHLDDLIAVKIIAKVNIKVVFFAIYYIFDKPQHRRTVRLTLDLIGLSICSRSALEKMTVMCQKKKMMMMMLRHKLQNGLDVIAILFFLREFTMRQDCTLTIFRNEHREICSWLYPSGGSSTLLITIQLTLLEKLGPYAFVT

SEQ ID NO: 151926 - protein, 214 aa, Heterodera glycines
  Coding regions on vcDNA: vcDNA=SeqID_78349; Strand=-; Position=1 -324,571-705,763-948
MLSSGSDPNVHLVLLRDLFFACSTQISSSFQPVSHSFAIVETHFGTQKNNEETVQNIAENEENISEEVAEGGEHSLKNEEKVPNKSGQNKEKAANTTQRTPPSLGVLQLFLIERLKCFCLSLESLNDQLELGLRSVSSCFTPFNFFTSVRLEKLIPNVFTIILTLHRPLNASQLTVTALLDIAEQLVLFYPQPKFLLEFFRLSMSDALMTVNEL

SEQ ID NO: 151927 - protein, 160 aa, Heterodera glycines
  Coding regions on vcDNA: vcDNA=SeqID_78350; Strand=-; Position=1 -201,908-1102,1200-1286
MSGRNTFRTKCIANKANCALQPALSFVQTFGADILSCMVNPWHLIHLQLLGPRDFEKVAIGLYVRCKVKELCSVERIERVSWDASPPYEIYGRQMQVLLHFYGPSQTPPSPISAVQFPSTEIDRQVVEQQRKCRTFVPPSGNHIKRKSEELQNALYKIHY

SEQ ID NO: 151928 - protein, 126 aa, Heterodera glycines
  Coding regions on vcDNA: vcDNA=SeqID_78351; Strand=-; Position=1 -66,847-1009,1058-1134
  Homolog annotation: Hit_ID=AAP30754.1; Match level="QueryCoverage =67%, HitCoverage=45%, E-value=3e-35, Identity=84%"; Hit description =putative gland protein G11A06 [Heterodera glycines]
TDLNCIINIKYFSFLAHILAFFRAMFVIAASASSHASNNSEWQALSAQFGQQISEIDSKCAEFGIGIAKVPYDGPKGDHSQRNVPGTDSVISMPGLTGSHGDHSQRNVPGTDSVISMPGLTGSHKQ

SEQ ID NO: 151929 - protein, 58 aa, Heterodera glycines
  Coding regions on vcDNA: vcDNA=SeqID_78352; Strand=-; Position=1 -12,87-251
MAKWDEPLSMFGEFEKRREKVYEERREKMEVWSEQKRKRKADEENEEEEWENKGNGDN

SEQ ID NO: 151930 - protein, 73 aa, Heterodera glycines
  Coding regions on vcDNA: vcDNA=SeqID_78353; Strand=-; Position=1 -56,112-277
MNGGIGPQGKWSNLSVMLIFCLQSIAPPILRLVFSKVLRHQFMAHLRLKWPANNGTPPPVGAGIALKQPKRIG

SEQ ID NO: 151931 - protein, 208 aa, Heterodera glycines
  Coding regions on vcDNA: vcDNA=SeqID_78354; Strand=-; Position=1 -206,588-789,838-1056
MEIQYAHLAGYCVVCWLLHEPVDRDHTVCLCGFPLQFRMLRRQFTCWLIGMAVWAVALAQSLATNSASCTKKVILSKHIRFVAVWYTVGTYGMSCDWSAYAKSGTRTYYVTLNLLTIVAYLLIYISTAVIIFTKKAVRLRFFKAILKPKSSSNDGQMANGQQQKNNGQFVSTVGKGANEPKRLSVAVDVVGLHPKNARVALQQRSLRC

SEQ ID NO: 151932 - protein, 177 aa, Heterodera glycines
  misc_feature (42)..(42): Xaa can be any naturally occurring amino acid
  Coding regions on vcDNA: vcDNA=SeqID_78355; Strand=-; Position=1 -129,206-260,1002-1228,1796-1891
  Homolog annotation: Hit_ID=CAB40412.1; Match level="QueryCoverage =99%, HitCoverage=34%, E-value=6e-47, Identity=57%"; Hit description =hexokinase [Haemonchus contortus]
GEVVRLVLEDLTRRGLLFSGDHSQIAEPGCFPTKLVSDIEGXLNDDEENPFNDDEENPFHKIEELLQDIGIWNSTPADCANVAYVCSLVSARAAHFCACGIAALLKRMGRPTVTVGVDGSVYRFHPTFKFLLDHKIDELVEGKYEFVLVLSEDGSGRGAAVAAAVASRMNRIMCEHH

SEQ ID NO: 151933 - protein, 104 aa, Heterodera glycines; identical to SEQ ID NO: 139542
  Coding regions on vcDNA: vcDNA=SeqID_78356; Strand=+; Position=1 -258,315-371

SEQ ID NO: 151934 - protein, 207 aa, Heterodera glycines
  Coding regions on vcDNA: vcDNA=SeqID_78357; Strand=-; Position=1 -301,432-637,1070-1186
EREEAWKEYESERLPRQLLPLPMPSPLTMDGTAAVPGTSQQPPFGTATDMAHFSNALQLRQLQLLQLQKQQQAAQVAKNLSFLVQQQQTVRSGEIGYFTQVMGQLTVAYNNDPIYKLCFQVPGMQAKTAYRIFQIKQFLSYFINLIPAEDLGEMNSANAFANYFNGILQITLATTIEIAKPHQRCQAGILFIQQTFPEVMQHLNHSQ

SEQ ID NO: 151935 - protein, 154 aa, Heterodera glycines
  Coding regions on vcDNA: vcDNA=SeqID_78358; Strand=-; Position=1 -57,125-254,339-397,456-491,539-584
  Homolog annotation: Hit_ID=CAE74536.1; Match level="QueryCoverage =89%, HitCoverage=8%, E-value=2e-28, Identity=52%"; Hit description =Hypothetical protein CBG22293 [Caenorhabditis briggsae]
KLILLMEIIKKCEAIGDKLLVFSQFLNSIALIRRMLLVFSQFLNSIALIRRMLAFYADNGKWFVDGHDALMRQGERWSWILGHDYILGHDYDVIEGSVSSKDRDRIQREFNDIQREFNDPLNLRKRLLLISTRAGSLGIKRLLLISTRAGSLGI

SEQ ID NO: 151936 - protein, 254 aa, Heterodera glycines
  Coding regions on vcDNA: vcDNA=SeqID_78359; Strand=-; Position=1 -236,279-582,837-1061
MSRREQLERNMNLKKPRMALTDDSIVADEIADAREAEMRAAATADSDASAFSDEENTEPVKFERGTTQKGALYLWQRGQVQICQKKCIWFSCCQKTCQATVRLDDEQHLTGRLGSKEHNHCVVFTQQSADAGRAQIKQAIEVNPQLRPSQMRAQVRAGTADETFDQLGTNDALDRMVQSSLLDVLRRNRRWSLDGTFRSAPTQWTQVFIVGAYVDKRMVVCAQALLPGKNSRFYREALSAIRNAVASAPAKIYA

SEQ ID NO: 151937 - protein, 617 aa, Heterodera glycines
  Coding regions on vcDNA: vcDNA=SeqID_78360; Strand=+; Position=1 -1216,1260-1417,2166-2644
  Homolog annotation: Hit_ID=NP_507780.1; Match level="QueryCoverage =95%, HitCoverage=41%, E-value=1e-40, Identity=26%"; Hit description =predicted CDS, DNA polymerase type B, organellar and viral family member (5T899) [Caenorhabditis elegans]
MKRSASASSKKQLIDKKYLINVIDDIFCFFYALELMRYYSLHKRGIITEKRWRWINNNQTTVLRQKVLQLLRDAGIPTTEPNYDPKIYIHQVQGLWSVKYPGEYKIFIFNDYQTRPIIKSDVVDYQFPILLYHKNNHFDGIKTISKFFNKHYYCLSCEAPYDSKSTHTMKCTSLCLGCREVGVDYPCETQQGYYKKCEYCVNIFYNYNCYERHLQKDLCTKFQRCEDCGVIYNINVHGREGRNAHQCGEKFCKLCKQFHVKDDDEMNPCSSCFIQPLKQHKIKPYRIIAYDFEATQDKKVENKFEHEVNFAAATIICTDCINNSSWNYSLKGKNCAICGPHRTITFSPFDYTKTTIDKKIVTQKPLREFVHWLFVEHNKKFPTVAFAHFGGRYDITLYIKEIIKQGMRNPQIIKQGNRIYELKLKENDCGPLTILRDSYNHMPIKLSGLIKSFGLKIQDKQYFPHMFNKSANYFNVLPHLPPREDYCPDQMKKADLQKFDNWYNYNRSQPFDLKEKLPEYCCNDVQILTHALVELRREFKQLTQRDGKHGGIDILWQAMTIASACVKIFALNHLKPNSLAIVPEKGYTPQQNQSALAVKYLDWYSHINNVNIQTAHS

SEQ ID NO: 151938 - protein, 205 aa, Heterodera glycines
  Coding regions on vcDNA: vcDNA=SeqID_78361; Strand=+; Position=1 -183,234-668
  Homolog annotation: Hit_ID=NP_001004509.1; Match level="QueryCoverage= 97%, HitCoverage=13%, E-value=2e-16, Identity=30%"; Hit description =si:busm1-180o5.3 [Danio rerio] emb|CAD60788.1| novel protein similar to DNA polymerases [Danio rerio]
MDEENEVYLISYKEKEEFVEENKYSNVVISLFTTSAARLHLYGILKKVADTPKCEVLYFDTDSIIYVHPEDNDPLPTGKGHLGELTDEKPDHDILEFISAGCKNYGMKVRRKETGEIEYDLKIRGFTLDEKTTQRIHYDSVKNQIIKYVSGSPASPISVNYPHSIRPNLIQGKVFTQSLTKLYQPSFTKGIVNNSYHVHDYGYRK

SEQ ID NO: 151939 - protein, 94 aa, Heterodera glycines
  Coding regions on vcDNA: vcDNA=SeqID_78362; Strand=-; Position=1 -132,218-425
TEFEKHSTVLSGNESNIPEKIAKAEPQHHDIEKPVSSLKFGGGATLFPAEYADDVDLYLRQLERRTPLDFDFLSVHKTIDGRMRQILVDWLVHV

SEQ ID NO: 151940 - protein, 86 aa, Heterodera glycines
  Coding regions on vcDNA: vcDNA=SeqID_78363; Strand=+; Position=1-261
MHLWIYIYGFRHWARYGNAIFVTLVYTKFGGPDTWGWGRDSTLGDHTVGDPTLWDRTVGDPTLRDPTIGDLYIWGTVHLRVYHLMT

SEQ ID NO: 151941 - protein, 385 aa, Heterodera glycines
  Coding regions on vcDNA: vcDNA=SeqID_78364; Strand=+; Position=1 -432,518-1079,1381-1544
  Homolog annotation: Hit_ID=NP_701342.1; Match level="QueryCoverage =87%, HitCoverage=24%, E-value=8e-15, Identity=23%"; Hit description =MAEBL, putative [Plasmodium falciparum 3D7] gb|AAL10509.1| erythrocyte binding protein 1 [Plasmodium falc
MEINFVIIFILFLIVLIDGIDEDLFNDLWKNLKPSTSKNIKKPIFGEINAIKEEIVVKNENDEQGNANQIETEDIKPKLLQKIKKEKTLEEQTNNLKIKIKMPKIELDKLSEESFGNEFNEEADQNVSSADHNDSVDEAYYNIMESETRNEMEILNKFNLIKTELRKESVYKNLTNVQFECEIAKKLGTNRNKISKLKKKLGQKREKRTEESEETKMELIRKFDQMRKEKICGLKYDEKKRSVIEREIAKELGTNRNKIYKLKKKLGQKREKRTEESEETKMELIRKFDQMRKEKICGLKYDEKKRSVIEREIANELGINRHKIYQWKRKFGKSKIYSDAEKLEYVKRSEEMTERKPMICEKKIAETLGIPYTNLKRWMKKFCSK

SEQ ID NO: 151942 - protein, 80 aa, Heterodera glycines
  misc_feature (2)..(2): Xaa can be any naturally occurring amino acid
  Coding regions on vcDNA: vcDNA=SeqID_78365; Strand=-; Position=1-254
FXDSHNNAVALIGVVHLITAALNFLGLYLNSHSVIVREFSLIPVPRLARAIIFTIIGFCIFDTMYQSNGPFTPFIYPFYK

SEQ ID NO: 151943 - protein, 36 aa, Heterodera glycines
  Coding regions on vcDNA: vcDNA=SeqID_78366; Strand=+; Position=1 -60,169-219
MHLPDLWTIFIENTRRMEKLHIAIKSFIIKAWIYIY

SEQ ID NO: 151944 - protein, 44 aa, Heterodera glycines
  Coding regions on vcDNA: vcDNA=SeqID_78367; Strand=-; Position=1 -32,156-258
MGEYRIVLKNLLENLFAFCKANRACEELSNDTNNVGFGLQRKKL

SEQ ID NO: 151945 - protein, 30 aa, Heterodera glycines
  Coding regions on vcDNA: vcDNA=SeqID_78368; Strand=-; Position=1-91
AEPVDFIKHNLTIQSYYLAGDAPKALTPLV

SEQ ID NO: 151946 - protein, 90 aa, Heterodera glycines
  Coding regions on vcDNA: vcDNA=SeqID_78369; Strand=-; Position=1 -172,374-474
MSADSTTSRGTSVVPGGGHRCVHCTTWTAGACTHCDVKRCCKSDAAKTIDNRRQRRVVSMIRVLPMNSSLMNGPVRSQSTVCSLLSRGTF

SEQ ID NO: 151947 - protein, 67 aa, Heterodera glycines
  Coding regions on vcDNA: vcDNA=SeqID_78370; Strand=+; Position=1 -141,1129-1191
MADVLAKQIFIQNIQTFMEIATLICILNFVIGIGTLPLLPHAVQKAKPKNEPRMSMTITSIAQDNFI

SEQ ID NO: 151948 - protein, 35 aa, Heterodera glycines
  Coding regions on vcDNA: vcDNA=SeqID_78371; Strand=+; Position=1 -54,105-158
MKSMSAYCIILFSALVLAKRRKPKSRRWVCGICCT

SEQ ID NO: 151949 - protein, 91 aa, Heterodera glycines
  Coding regions on vcDNA: vcDNA=SeqID_78372; Strand=+; Position=1-345
ETNDQTKTIDSIVRKKERISLCSFAVPSPIFPSSPFIHFSSQFLPQNALLRWPLFLFRFAHPSFPPPRLGRSLCPRRFPLLLSVHLCPFPF

SEQ ID NO: 151950 - protein, 108 aa, Heterodera glycines
  Coding regions on vcDNA: vcDNA=SeqID_78373; Strand=+; Position=1 -62,659-774,835-982
MGVGIGPAEIGERCQLCQRRKRADLPLSQSLLALKTQADRLLFGSVFLRRPKGLAENAVVPETPSEVADLEGTTRQIAETIERIDDLEEKLKELLEHKDNVMGDEVDR

SEQ ID NO: 151951 - protein, 35 aa, Heterodera glycines
  Coding regions on vcDNA: vcDNA=SeqID_78374; Strand=-; Position=1-106
MGVGEGTDGGESCGDATEASERRKILHWKMKQADD

SEQ ID NO: 151952 - protein, 286 aa, Heterodera glycines
  Coding regions on vcDNA: vcDNA=SeqID_78375; Strand=+; Position=1 -89,146-322,362-498,1323-1587,2081-2275
  Homolog annotation: Hit_ID=CAE63786.1; Match level="QueryCoverage =97%, HitCoverage=51%, E-value=2e-15, Identity=40%"; Hit description =Hypothetical protein CBG08327 [Caenorhabditis briggsae]
CILPNQPNFKGEGRVSINDIDANYLRRQTALKETTAQTIPALMDAWNDLLRARQGCLIVYVPKECLSQIRDQIVVSLHIDIIVCSPKQGIKFVFTRNQENDDGLPSGAHLFTYRSNPQSSTKEWLPCSEEPLQFFLTGVFVERFFGATESNYQLNKLLKDSCDYEARFGAIALRPNANHSQFFFDPNCPETCSPFYLDALFRKGHLVIRMLEKRLPKEQFVKGHFAHTIQIDAAVSRHDIQCHSKGRKLKKKRIMLGTGEEVDVDLNSMDFDSPVLWIRFNLKNSI

SEQ ID NO: 151953 - protein, 88 aa, Heterodera glycines
  misc_feature (57)..(57): Xaa can be any naturally occurring amino acid
  Coding regions on vcDNA: vcDNA=SeqID_78376; Strand=-; Position=1 -105,156-315
  Homolog annotation: Hit_ID=NP_001003835.1; Match level="QueryCoverage= 77%, HitCoverage=5%, E-value=6e-14, Identity=55%"; Hit description =TATA box binding protein (TBP)-associated factor 150kDa [Danio rerio] gb|AAT68099.1| TATA box binding p
LSSLKLIFYDTIPNSDDDSLKTLCYQLLVPTSAANIGFAIGDFQIHVQPEMPEVTLXVPELIPLLKHTMKSLNRIFVFFEELLSCRFP

SEQ ID NO: 151954 - protein, 128 aa, Heterodera glycines
  Coding regions on vcDNA: vcDNA=SeqID_78377; Strand=+; Position=1 -240,486-632
  Homolog annotation: Hit_ID=CAC83611.1; Match level="QueryCoverage =69%, HitCoverage=32%, E-value=7e-22, Identity=53%"; Hit description =EXPB1 protein [Globodera rostochiensis]
MPSFLPMLFLLLSVQLLSFLPCSFSASLSVAPAYTTKDTCLSESSASDSISAQLNKPITGGQFTFYGIGGQGACGLDIATPTKSAAGSGTLFNSDAAWVESCLPDARYLLNDLVCINRCVKIEYKGNT

SEQ ID NO: 151955 - protein, 186 aa, Heterodera glycines
  Coding regions on vcDNA: vcDNA=SeqID_78378; Strand=+; Position=1 -280,331-579,1381-1412
MAALNAAVGGKEVASATPIIEFLEVASATEQIELIETETIPQNLESFEVASAIQKGVIMETALAVEKVIETDKTRGISAGLEEEFERGMELGEDFTATQFSNVSWSEPRAIASPVPMSSNEEHCAEGGVLKYLVCQTDVKSVVGRKKSGQGPFFMGIPDILVSAERRLQMGDTVVVKNINHLNLVV

SEQ ID NO: 151956 - protein, 77 aa, Heterodera glycines
  Coding regions on vcDNA: vcDNA=SeqID_78379; Strand=-; Position=1-411
FVALVVRTRQDQRSSGCHKGGGDKIGHWFISTWFCNRLKTIQRWGFQISHRHICANASPPNHLCPAINRNQSRLNYA

SEQ ID NO: 151957 - protein, 164 aa, Heterodera glycines
  Coding regions on vcDNA: vcDNA=SeqID_78380; Strand=+; Position=1 -138,628-769,1122-1336
MLNKIKIAPYKNICSEQIRNGENEEVENFMNTISDLVVGENITIDSVFANRKALPNELAQIIEAERDAFEISNVFAVYTHQNGEKWKNAILYDGYDESKDSWVLSQDTYALESVANFSISVSAELTLTALLGGPVPESFKKILMANDKFAQGNTFSDTFLKFCM

SEQ ID NO: 151958 - protein, 29 aa, Heterodera glycines
  Coding regions on vcDNA: vcDNA=SeqID_78381; Strand=-; Position=1 -84,124-129
MGIKTNIQGGWIKKFIICVFLENGHCGMV

SEQ ID NO: 151959 - protein, 116 aa, Heterodera glycines
  Coding regions on vcDNA: vcDNA=SeqID_78382; Strand=-; Position=1 -226,267-391
MGKNEKGWVIEKISYDLYCEALSDQLIIPPRDLVQNNADVVLESFYHIQQSFDEIDLLNEEISLIITTYAAPKGSAQSINHLFGLKESGRLLVKNSDNYCLFLQYNVEQIVPNNRD

SEQ ID NO: 151960 - protein, 60 aa, Heterodera glycines
  Coding regions on vcDNA: vcDNA=SeqID_78383; Strand=+; Position=1-390
FIRALLRISLKISGRQFYILAIFYFICDRKFLHTSHFLFYCDQAYLSSYFWDFFQNVVIE

SEQ ID NO: 151961 - protein, 734 aa, Heterodera glycines
  Coding regions on vcDNA: vcDNA=SeqID_78384; Strand=-; Position=1 -840,894-2003,2051-2253,3391-3417
  Homolog annotation: Hit_ID=NP_496808.1; Match level="QueryCoverage =99%, HitCoverage=31%, E-value=3e-91, Identity=31%"; Hit description =integrase, catalytic domain containing protein family member (2N547) [Caenorhabditis elegans] emb|CAB0249
PCPYGQNQTIVVPRHSILDKQSRLQLHVFCDASEHTFAAAVYIRSETADNSQANLIFAKNRLRPRTANQLTIPRLELLAILVGIRAMRFAEKELRRPIEERHLWSDSQIALSWVKSEEPKAQFEQRRLVEIRQGPTTTFHFVRTDQNPADIATRGCTPAELCTRQMWWKGPEWLTNPETEWPDERSQRQPTPLLPIPRLKNRRPRPSWPNKVRCPLLDPARFSTMLTLLAFSSSNSSGVVDQNGSKSAPRQSHGVALRRAIRSEQPGLSSSDKDGLDGLLCLKTRLLHANGPPTLASPVLLDRHSSLTRLIVQEIHADLRHAGVDWTLTEFLGRYWMPQARRTIRGILRGCPSCRRITAPPFARPTMPPLPSMRVKPANPFEFVGLDFAGPTSSRLSDGSLAKTYLVIVTCFVTRAVYLEATTDLSAPSFINVLRRFISRRGRPKRILSDNAPTFVQTSKALDILTGPPPETDAVTFAARRGIQWDFIPAYSPWMGACYERLIGLVKSCIKRTIGRRILDYDDLSAFLAEIEASVNSRPITWVSDQPDSSKPLTPKDLIQPGLPNDLESSTLISTTTIASPVPRVSQHFGKLTGAADHFWLKWSHEYLLAIRERAGWTHKGPRLRTPTAPHIGQLVIVEEDLRPGNVRSVQLRINGQTVTNVRSVQLRINGQTVTRPISRLCPLETENQIPEPAPDATVSIPTDQSGKDPKTAESPQEMPPVPPPSHQLHSFLV

SEQ ID NO: 151962 - protein, 172 aa, Heterodera glycines
  Coding regions on vcDNA: vcDNA=SeqID_78385; Strand=+; Position=1-515
ETEWPDELTFATPADSPSADPPFEKSETKTLMAKQSPLPPPLIDPARFSTMLTLLGTTILVLQFIGRRRPKWLKIGTSSIPRGGPPTGDSFRAARTFLIRQDQRSSLDGYDKHPTVFNEDGLLCLKTRLLHANGPPTLASPVLLDRHSSLTRLIVQEIHADLRHAGVDWTLT

SEQ ID NO: 151963 - protein, 1878 aa, Heterodera glycines
  Coding regions on vcDNA: vcDNA=SeqID_78386; Strand=-; Position=1-5634
  Homolog annotation: Hit_ID=NP_508324.1; Match level="QueryCoverage =90%, HitCoverage=68%, E-value=1e-145, Identity=26%"; Hit description= predicted CDS, peptidase family A16 and RNA-directed DNA polymerase and Integrase, catalytic domain and
MSELIRQRLTAEVRTLSDLVKRLRQRVGRLTEFTRMAPEEIPLAEETKLAKGVRTDRQLLQRSIDRVNGMLRECFDHIQLLGDPFLKQAEEDLLAALPTFDDEQADPNVEEWPVITLLSKAQLILDGLQVYIEARFDTTDAISSRSSSRVSDHGADDENRIHRQRQSTDPPTQAQPANAHQPSNSARADQNLFNQRTPAFPLNLTFPRASNRPTHRSEPHHGHFRQSTNDDDALRVSRIEIPRFSGSAEEWITFWAAFDFAVHSRQYPAFQKHLLLLQYLEKGSPPRRMIEGYPPSDANYSTVVSILRDRYGDVGNRRDQLNAQLLHLKPARNNLKELRQLQQEIERICTQLCSLEPEGELSPIANSSLVTNLIKSKLPPPVLLDLIRMERESYTSWTARNWREGFATIVTDKEQVDLCVRTFQDMDIQPRERPPERAPSRPGGRSFRPPAPERRYLENTRAFPALAQPVSANGISCSLCEQEGHRPSACQRYTTVIQRRRRLEEQGRCLRCLRQDHVTRDCSRQDRCSKCQANDHHFLLCPSIDPPGRTNHRQENQERNGNASRNVSRATGANAEPVRPRATPTTTALLVCDEGESIPEAVCAAAFDPLPVDSGSFPVPKSTRVAHLMTQTLKASCQGGPPDGIPAFVFHDPGSQSGYISRAMTEKLRPPRLSEHLLRIHTFGDSRPKTVRSAKFAIQLQRLDGGWETLELNVIDEITTKIKALQWDTTDGPLPPNAVLKVVEKAPDILIGIREFWQFFIGRSTLHSGLHLIQTIFGPMVGGEAEFPETPRHTPTIAMLTSHPSNVESFPSSRAVNDFWSLEAIGITDDPNQNDDQVAMQQFGNTVRQLPSGRYSVRLTWREPRPPLPSNWAIAYRRLLSTTKRLQCSPELLDRYSAELTRQMDADIIELTGRDNDEHFLPHHAVINPKKLRIVIDASARAKGTPSLNDCLHRGPVLLPDLCGILLRFRSATIPVLADVQGAFHAIEVEPEDRRFCKMLWLKNPARPVSGDNLLIYRYKRLVFGATCSPFILAAVLLQHFDKHEHPFAQALAANMYVDNLLIECETEEEAIDKSSIAKQILKDADMNLREFLSHSPNVMKQIPEDDRLDKTPAKVLGLTWDTLSDRITFSLPKDTDATATRRSVLSIIASTFDPLGLVGPCLLPAKRLFQRLWGEGTAWDAPLPDTEAQTWSQTLSLWQDQTIFVPRHSILGNQSRLQLHVFCDASEHTFAAAVYIRSEAADSSEANLIFAKNRLRPRTANQRFTIPRLELLAILVGIRAMRFAEKELRRPIDERHLWSDSQIALSWVKSDEPKAQFEQRRLVEIRQGPPTTFHFIRTDQNPADVATRGCTPAELRTRYMWWKGPEWLTSPETEWPDELTFATPADSPSADPPFEKSETKTLMAKQSPLPPPLIDPARFSTILTLLGTTILVLQFIGRRRPKWLKIGTSSIPRSGPPTGDSFRAARTFLIRQDQRSSLDGYDKHPTVFNEDGLLCLKTRLLHANGPPTLASPVLLDRHSSLTRLIVQEIHADLRHAGVDWTLTEFLGRYWMPQARRTIRGILRGCPSCRRITAPPFARPTMPPLPSMRVKPANPFEFVGLDFAGPTSSRLSDGSLTKTYLVIVTCFVTRAVYLEATTDLSAPSFINVLRRFISRRGRPKRILSDNAPTFVQTSKALDILTGPPSETDAVTFAARRGIQWDFIPAYSPWMGACYERLIGLVKSCIKRTIGRRILDYDDLSAFLAEIEASVNSRPITWVSDQPDSSKPLTPKDLIQPGLPNDLEIVDSDLDYDDCLSGPARLAALWKAYREAADHFWLKWSHEYLLAIRERAGWTHKGPRLRTPTAPRIGQVVIVEEDLRPRNLWPMGIVVALNGSPPN

SEQ ID NO: 151964 - protein, 172 aa, Heterodera glycines
  Coding regions on vcDNA: vcDNA=SeqID_78387; Strand=+; Position=1-515
ETEWPDELTFATPADSPSADPPFEKSETKTLMAKQSPLPPPLIDPARFSTILTLLGTTILVLQFIGRRRPKWLKIGTSSIPRSGPPTGDSFRAARTFLIRQDQRSSLDGYDKHPTVFNEDGLLCLKTRLLHANGPPTLASPVLLDRHSSLTRLIVQEIHADLRHAGVDWTLT

SEQ ID NO: 151965 - protein, 127 aa, Heterodera glycines
  Coding regions on vcDNA: vcDNA=SeqID_78388; Strand=-; Position=1 -127,297-553
MFSGATEFIANQAFTSALWNIAESGVQRAEYLVHNYLLSPTAAFSKSFPPQRTAWTHKNSRLHLKRFIMSHSTKTAPFLWSDTTTGTASTICAHWNDWRKFRTREVLLIFTSPSSIYLFIFGFVFSA

SEQ ID NO: 151966 - protein, 139 aa, Heterodera glycines
  Coding regions on vcDNA: vcDNA=SeqID_78389; Strand=+; Position=1 -166,238-459,804-830
  Homolog annotation: Hit_ID=CAE59800.1; Match level="QueryCoverage =79%, HitCoverage=13%, E-value=2e-47, Identity=73%"; Hit description =Hypothetical protein CBG03262 [Caenorhabditis briggsae]
ICIFYDSPAYKLLKTKILITFFLAHIMYSKYGDFHTIDWPRDLARDRMRHKYIKGYRYREDFPFGSASAVWDAGSGWICVLLVGLAAGAIAGVIDIGARWMSDLKDGICADRFWLDREHCCWSANDSAYKDNECSSWTH

SEQ ID NO: 151967 - protein, 372 aa, Heterodera glycines
  Coding regions on vcDNA: vcDNA=SeqID_78390; Strand=+; Position=1 -136,232-674,1081-1378,1461-1702
MSKIGKLIRKSRNLEAIPEWYLDTKHFKVDVCPNFENGKVVDTYRDTDGIELVKMYEGFLEDSKLFLSIHAKGVSKESLFGEETVEIKNENLKIVKKAALWLIDNFVDEFLAYLDNFFEFGGNQKEKDRILNEIWQKWVETNAKMQTFKEQGQLFCHIYVFSMFFLSTIWQRLGEKERKKMAKVMAEKRWDQITIFALRWYGKSSLEFGRSSAAFATCDYSQWDELLHHRNAQLVHSLTLFRLIKRFKGFAHFLCQMIKKDTVETKDRLLLLFRSVAEFDWLEKQFPMILRIEELNFRCRLHFYEQMFKFKSSSDLHRYSEFRMAFSVLFKQLSVRLTAKSAKLAHPMLTEVMFVVHEDIFREMALALAFCR

SEQ ID NO: 151968 - protein, 376 aa, Heterodera glycines
  Coding regions on vcDNA: vcDNA=SeqID_78391; Strand=+; Position=1 -532,750-1348
  Homolog annotation: Hit_ID=EAL51907.1; Match level="QueryCoverage =97%, HitCoverage=37%, E-value=2e-15, Identity=24%"; Hit description =Viral A-type inclusion protein repeat, putative [Entamoeba histolytica HM-1:IMSS]
MKRNLLREKEMKGMDGKEVEEEEKVEEKSKREDEEEGKKEKEEGERKNGWLREKEERRKENMREKEEKDGGKGKDEREENGEEGTEEKVEAMRRKAEDGENGKKHSDIPVAKCQFFGMNGKIQKANERVKKEKNDQRKGGRPINAKSAKKSETHQTKEGKASNEEEKEAKSIDLLIEDITTDEFLLEKHRKNMNANNDHNLDNELLANLSVYAHEIKQQMETYKQLSNYGTEFRNWAKNVANEWQNKMREKVPKERNERIELMNELCRILHRMANFGEKFYDQNWDNCTEQMQIMCSEVKGQLHKRHLSRQITENDQLEKEWAELTKEGQIKAIDTLWGEKNGNRKAKGNRRKEFVAFLEQWRKMRDQMELGEGFS

SEQ ID NO: 151969 - protein, 313 aa, Heterodera glycines
  Coding regions on vcDNA: vcDNA=SeqID_78392; Strand=+; Position=1 -328,699-1051,1593-1850
  Homolog annotation: Hit_ID=S16356; Match level="QueryCoverage=61%, HitCoverage=14%, E-value=3e-13, Identity=30%"; Hit description=ovo protein - fruit fly (Drosophila melanogaster)
MPFSPVQTAALQAQHAALHANSTNRPNYGALAVTSTTTARQFQQQPQHHHHQQAVLMPAMAAAAAAAQQQQHHQQFQQQQSSNACHQQMQQQQQTQYQQQSQQQHNANLGLSLGDLNGCFRSNQPQQHQQQSHLLHHNDFVPSSHDMMIGAGTIGTKLYSSAAASPPPSFGPIGGTAGAVAPPTTTSTATTALSALGTSVSSNNLHAMLGALELDNGGTPPQQQQGHFSSAISTDFKLGGGSSSLLLLRSTSNGYGAGAGSAVIQQQNAANTNTTSAFSPWRMPSSAVDAMSQNDFLDILSSTSPSPYCQLPV

SEQ ID NO: 151970 - protein, 90 aa, Heterodera glycines
  Coding regions on vcDNA: vcDNA=SeqID_78393; Strand=-; Position=1-440
LRNVLHNFRPNRYSVLDTQMLSSADGWQDIEGMPNGSEALISEKLTVPKTIVTKEQQKRPIGGQRANDYGSVREMSGGRSDGRTETAQIG

SEQ ID NO: 151971 - protein, 368 aa, Heterodera glycines
  misc_feature (72)..(72): Xaa can be any naturally occurring amino acid
  Coding regions on vcDNA: vcDNA=SeqID_78394; Strand=-; Position=1 -136,189-327,388-601,645-711,761-944,989-1062,1564-1637
  Homolog annotation: Hit_ID=NP_509901.1; Match level="QueryCoverage =92%, HitCoverage=70%, E-value=4e-60, Identity=33%"; Hit description =P-GlycoProtein related (pgp-3) [Caenorhabditis elegans] emb|CAA91467.1| Hypothetical protein ZK455.7 [Cae
MGATVALVRFSCLYDPIGVGTSIILAILQSFVSNYLKRRGMLDLLAAEEASKMGTESLAAEEASKMGTESLXYVRTVQALNGQGKAYRTFSEAMRKPHRMAITRGLWTSLSLWTSLSFALTSSFVSFNFGFTYCLGMLLIRAGHTTPFVLFQVVEALNMASFMIMAAAAYFPEYLRARFSAGLMFAMIRLKPRINSLSDKGIRFSAGLMFAMIRLKPRINSLSDKGIKTPIEGRLELKSVQFAYPNGQKQLKTPIEGRLELKSVQFAYPNGQKQLALDGLSLSASVGKRIAVVGPSGCGKSTVVQLLERHYDPIGGSICVGSICVDGVDIRQLSIKHLRHCMALIGALFTLFSLTFNSLTLTVSVVSS

SEQ ID NO: 151972 - protein, 61 aa, Heterodera glycines
  Coding regions on vcDNA: vcDNA=SeqID_78395; Strand=+; Position=1-284
GKKLVKIVENVGPAVPIGAAGKFFWKFECYLLRNLPIKLFNFRLGGNSRKIPLFAGKFLKI

SEQ ID NO: 151973 - protein, 137 aa, Heterodera glycines
  Coding regions on vcDNA: vcDNA=SeqID_78396; Strand=+; Position=1 -60,839-898,1056-1349
MCPSLWFGPCPSPWPFRSPSARQIARSHLKDQLLLELSIQTSSFPTASRSDEEEDEEDDDEEEEDEEAVDAGESVAGRTHWHRNDKRGLAAQVAQECHKQHQRRPTFGLMMNGGAMPFATAPMNPLQVHTAEGGTEG

SEQ ID NO: 151974 - protein, 353 aa, Heterodera glycines
  Coding regions on vcDNA: vcDNA=SeqID_78397; Strand=+; Position=1 -573,811-1165,1207-1339
MLLMPFQLPSTALTDAERRVKGWQRKRTLRLMRRCNTLPSTVMQRQTTTTAPHGTTQKATKRTTMARGESDATQEQQTKSDTTKCQQQRHESPKRQKSPIGDIQNASGVSVERVLLENDGGREQFCKDVVATADTKGLNEWDGEERSPSPTLVHLCSSFGDELGECFPFIDQNEQQQQLPEDHNNNSNKNAKGATEKTCHRNGDGQGNFGMRRTHSERHPADTKTQQRIRRLSADGSACASCAGWVVIVGNEDENGAKNNGTDNDRLNGAEYNNYRNDNDNGTTAAGSPTFGTNIEQRKKKSTARQVTKDAKYGSKCAAFSTGATLALRNGGGCSATPPLLLQQRQLQQKRHK

SEQ ID NO: 151975 - protein, 53 aa, Heterodera glycines
  Coding regions on vcDNA: vcDNA=SeqID_78398; Strand=-; Position=1 -35,1116-1179,1238-1297
MNEVNGEGQHRGLIIIYHQCEEYHHMDTISLIISQEWMTFLFTFLPITFNIVM

SEQ ID NO: 151976 - protein, 125 aa, Heterodera glycines
  Coding regions on vcDNA: vcDNA=SeqID_78399; Strand=+; Position=1-377
MGDASIQRLTDILQQLLTAQQQNAPPAQNASQLPTLPDVECFDASQHSGCEIEDWLKRFKFALDCAAPNLQDELKVKLLMTKLFGPTFSEYCKSVLPREVTDFNFVETAEKLKALFSRPQSVWID

SEQ ID NO: 151977 - protein, 22 aa, Heterodera glycines
  Coding regions on vcDNA: vcDNA=SeqID_78400; Strand=+; Position=1-67
TNQLIPSNTFGQFHQFWVASIV

SEQ ID NO: 151978 - protein, 206 aa, Heterodera glycines
  Coding regions on vcDNA: vcDNA=SeqID_78401; Strand=-; Position=1 -21,75-661
  Homolog annotation: Hit_ID=NP_921250.1; Match level="QueryCoverage =98%, HitCoverage=14%, E-value=4e-47, Identity=45%"; Hit description =Helicase-like protein [Oryza sativa (japonica cultivar-group)] gb|AAP53537.1| Helicase-like protein [Oryz
DGDSNDLNCNRNCNRRVTRLQYLCYSLAIREREFNPILYGGKLFQQYCVDEYVKIEGDRMSWIKNNQKRILADAYKNIDNMLKKSTRKRFATGKEVFLPPSVTNSPRYVEKHFQDAMAVVRRFGKPDIFLTMTCNPQWEEISENLFHEQTSIDRPDLVVRVFNLKVKAIMNQITKVKIFGEVIAWMYPVENQGRGLPHIHLLLTLA

SEQ ID NO: 151979 - protein, 214 aa, Heterodera glycines
  Coding regions on vcDNA: vcDNA=SeqID_78402; Strand=-; Position=1-645
MPKDYVHELYKTTINQTNSNLELHPLIFHAWQLDNESEATRFPHINEFINSEQFKDKLEQHITARTEALGALKGGIEGFTMRWLKGLIDEAITWWIRVACVYSTFLMLRDIVLPCTLAYLLNPIRVTLLSLVGVRPHPTFRPTVSKPLGIEEGMPLREMPRTPKPPARRAEHRSMSPIKLDMIARTARYQQPRTQSHLDLTEDSPFGRPRRKEF

SEQ ID NO: 151980 - protein, 327 aa, Heterodera glycines
  Coding regions on vcDNA: vcDNA=SeqID_78403; Strand=-; Position=1 -355,612-1240
MTSNKQRQLVHKDVKLRHQFKQKHSSMQLTARFRKQIHMSSTIEEVQQRMNHNRPQPRRSQQRGLRPTQAPKICQSGMAQYKQGRGIRLHPASSAMALTGPRRRLSEQPLQREQGHESINFPGPIAGLFKGEQISTATNCFAQPATLFVKRHNLQMFSPVHQVQNCQYATEFCQLPDNSTLIWKSTCNGNECQTCDYEKAEVINGKFTAAYGESMAIWISEDHQKALTFAKNAPELIACDGTRIVMSEQNFGIAKEQYDDIVSTTTRWKRHPTRTARITALGIPSGNKRGVKSAKHEGSQPDSPGQTLTTATKRPSSLDRRNDNGGQ

SEQ ID NO: 151981 - protein, 280 aa, Heterodera glycines
  Coding regions on vcDNA: vcDNA=SeqID_78404; Strand=-; Position=1-843
MAIHQECPFAKSEMTNHEAQLWSTNDELEVNFPGPIAGLFKGEQISTATNCFAQPATLFVKRHNLQMFSPVHQVQNCQYATEFCQLPDNSTLIWKSTCNGNECQTCDYEKAEVINGKFIAAYGESMATWISEDHQKALTFAKNAPELIACDGTRIVMSEQNFGIAKEQYDDIVTTTTRWKRGIRPEQLASQLSASQVANRRIHHALAKKPDRRSNHVVDSSRLRLFNLPHAARHCSPMHSGVFAQSHPSDSSQPRWSTPASDIPIHRFQTTRDRRGNAAA

SEQ ID NO: 151982 - protein, 923 aa, Heterodera glycines
  Coding regions on vcDNA: vcDNA=SeqID_78405; Strand=-; Position=1-2772
  Homolog annotation: Hit_ID=CAA82797.1; Match level="QueryCoverage =70%, HitCoverage=90%, E-value=6e-50, Identity=25%"; Hit description =gag protein [Ascaris lumbricoides]
MSGPIQKGIINALKALDNAKSATSLLLHPDPDLSNWENAVNLEAQFDRVVKEIRSMEMQMDSLRDLSNAWIELLARLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNILGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQAPRTPNQRSRRPNQPMALRDMTFIASSLDEGHRHQGYVSQQHTQQAKKHCQQMRNQVQSVKKGPPYPCIFCNSNHWHDECQNVDTLNQRISIVREKKLCFKCMKPNHRASNCARPSKCYHCKRRHPTALCRDQYKAENGINTPSTSCSEEKPNANDCKRSTVIEQQQMCNAIQSKETRALLMTTKATIFNPSRPSLSMMGTIFIDPGSHRSFISSSAAEQLDLNVLSTEECYLSSFGEREPKRYISDRVAIGILCPDQDRFIFNLNALKFLLNDLPVLQLNALDNDELRQKKLSLPNESRQPDILLGMDVWHQLNVQPIEQLPSGFTICQSKIGNIISGTGRIKLKQPSNISFVLMVNNDESPQSSKAAQRQKNIQQKEKDELRRHQRNKLLSSIATLRSRRKRESAPISSKSIVIDLSSDSDASGIEIIQNPVRDRQAKSPNEHSTAPIPMAVQWLTPTRKSSSVAKRPAFSFSKQPKGKAANPAQTSQTNELNRKMKALSPTASGSGANHHCVATLARSSDSTTVIDKGSQQNCPNMSSATISKTPCQQHSSEKTLN

SEQ ID NO: 151983 - protein, 21 aa, Heterodera glycines
  Coding regions on vcDNA: vcDNA=SeqID_78406; Strand=+; Position=1 -3,698-760
MAPQSNDRFLTNSDSPKCVST

SEQ ID NO: 151984 - protein, 549 aa, Heterodera glycines
  Coding regions on vcDNA: vcDNA=SeqID_78407; Strand=-; Position=1-1650
MFLSGKDDESSITAIDRKLWQGKVTVKISDLEKVQNDMGKLEDGVNRAFRHLNRSLNQKVTWVNDVVANTNANFETLKVQFETLTERVDILERDNDGATSGGTFSLNNQNRASLAPFVMPMGNAQPNQLMPNQVPIQQLSSEDEDDGPTLFGLNMLMSGPAVGSGLEMFREESVFAFDDWAERFKDYLSVSGKAYTEREKVTRLKLALKDTPLALFKELLPAQTDTLDTALSELRRKLDSPQRREITKRTLSLCKQREDETVAQFLRRLTPLVDATNSSLTGNSRKEKICEEFLDRLKPNISFLIRLVGLSRAKDLDLVRAQAEELEALLLMSKGDETVRLSDVVNALNNQSSQSRWFTEANLNNDFAGQWASGNNVRGFSSFSGSDEQTQQQGGGEGQNRSRNWGESHQEQFSQRNWSSNPRCDYCDRVGHVAYNCYQRRANFSQGRWSNQQPQQSQGQWQNRQSSVNMMDVPSSSNASAEFFKNLAQALLDLKIQERRNYKDEEPRSGAMNALTHIKPETEVKKCQVGEELSKKIPSLWAGNKSKPS

SEQ ID NO: 151985 - protein, 152 aa, Heterodera glycines
  Coding regions on vcDNA: vcDNA=SeqID_78408; Strand=+; Position=1-459
  Homolog annotation: Hit_ID=YP_082380.1; Match level="QueryCoverage =95%, HitCoverage=28%, E-value=4e-12, Identity=30%"; Hit description =collagen-binding surface protein [Bacillus cereus ZK] gb|AAU19467.1| collagen-binding surface protein [Ba
MTKPKQNEKDGKSVKKGQREKAGQKTTKTMTKPKQNEKDGKSVKKGQREKAGQKTTKTMTKPKQNEKDGKSVKKGQREKAGGHGEKAGGDGDKAGGDGAKAGGHGEKAGEQSEKAGEQSEKTGGQGEKKADQKEEWAHQTRSPIGYSPKSSN

SEQ ID NO: 151986 - protein, 148 aa, Heterodera glycines
  Coding regions on vcDNA: vcDNA=SeqID_78409; Strand=-; Position=1 -285,350-508
  Homolog annotation: Hit_ID=NP_741172.1; Match level="QueryCoverage =78%, HitCoverage=12%, E-value=2e-13, Identity=35%"; Hit description =pharyngeal and intestinal protein kinase involved in feeding (112.9 kD) (kin-18) [Caenorhabditis elegans]
MVDKCHPLWRFKEPVNGEECHNRQPSAEECQNNGVETAHNHLSPTRNRTIISLNGNDDSLTSSNTNNETGQDQNGEAQRQGAPAFSIVLDQQQVKDEINTLRRSKFSTLRTTKIIAQEVQDYQAENNLYEQMCGYKRLRQQHHKELKQ

SEQ ID NO: 151987 - protein, 17 aa, Heterodera glycines
  Coding regions on vcDNA: vcDNA=SeqID_78410; Strand=+; Position=1-52
MEKACKIWRDYIDFSAL

SEQ ID NO: 151988 - protein, 73 aa, Heterodera glycines
  Coding regions on vcDNA: vcDNA=SeqID_78411; Strand=-; Position=1 -57,566-589,995-1132
MAERERRAPPHLNVASNFLVRFVETFEAWNYRQSGHLIVEFGSLASVEFFVEMMAADRIPYLHKPVGFQDLIT

SEQ ID NO: 151989 - protein, 66 aa, Heterodera glycines
  Coding regions on vcDNA: vcDNA=SeqID_78412; Strand=-; Position=1 -77,999-1104,1195-1212
MLEFSCFLVLLHYSDFVLSNDTNQIGCPLRRQNLDYIAYLLTAVYHESHRVEPWEASMVDQTNSLP

SEQ ID NO: 151990 - protein, 31 aa, Heterodera glycines
  Coding regions on vcDNA: vcDNA=SeqID_78413; Strand=-; Position=1 -92,335-338
MSQLYRTIPTEFDVKENTVATVPKGRKRKRR

SEQ ID NO: 151991 - protein, 203 aa, Heterodera glycines
  Coding regions on vcDNA: vcDNA=SeqID_78414; Strand=-; Position=1 -255,642-733,879-952,1051-1096,1197-1341
  Homolog annotation: Hit_ID=AAN32888.1; Match level="QueryCoverage =93%, HitCoverage=64%, E-value=3e-77, Identity=73%"; Hit description =annexin 4C10 [Heterodera glycines]
MAYRIYISLRCYRRAVLIEILATRINRQITALKQAYEQLDRRHQHNQLEEDIKAKTKGPFQNLLVSLLSCSREESAPASIVLAHDLRETFEFYRQAAHHEIEEGIKQEFSGHNETGFLALIKYVRNASVFFADLLFNSMKGLGTRDSDLIRLVISRFNNNICHPIKHAFHTLHKKSLEEAIKGDTSGAYRDALLALVKGNTEQ

SEQ ID NO: 151992 - protein, 117 aa, Heterodera glycines
  Coding regions on vcDNA: vcDNA=SeqID_78415; Strand=-; Position=1 -43,108-418
  Homolog annotation: Hit_ID=AAK21961.1; Match level="QueryCoverage =91%, HitCoverage=50%, E-value=9e-60, Identity=100%"; Hit description= secreted venom allergen-like protein vap2 [Heterodera glycines]
MHLINLIALFFMLFGPSVQQYTKTPTNEDKEAAVNCHNKFRSQLALGNADNKLGGNKMPKAGNMRKFEWDENLAKLADEWANKCTLSHSWNGWAGENLAMNGGTFSNSSIQIDNCGY

SEQ ID NO: 151993 - protein, 461 aa, Heterodera glycines
  Coding regions on vcDNA: vcDNA=SeqID_78416; Strand=-; Position=1 -117,334-708,806-857,1026-1134,1454-1593,2075-2177,2238-2277,2595 -2759,3240-3521
  Homolog annotation: Hit_ID=CAE62158.1; Match level="QueryCoverage =92%, HitCoverage=63%, E-value=2e-35, Identity=29%"; Hit description =Hypothetical protein CBG06205 [Caenorhabditis briggsae]
MGRIGVGAAGIQRRGKNSWLRTTAQGPTFERMGEFMEYLVTCKKSATWSTNFKVQNLSDRGEYVFRVAAKNAAGWSKPSPQSDRIKLRQRYGPPGMPIQVHAQSIGRDGTPKIIFLIFYKNSGPNCVTLTWQPPAEDGGCKLEGYLVQKREWGHEQWEMATPDMCPLTEFLVPGLREFQAYEFRVIALNSHGRSPPSLHTLPINIEETAGACPTIVINKEVSVQKPSVVPLKSQRANEKEKDATQIRTPKTAQPSSAHGIGPSLDSSAGQPLSSTARRRQPRRSTRKDAIELTPLDIQCCSKNLTLPRPKNTERTASGGGRRRVGSTAADRPAQAAAAAYAGDEEAPNEEVADSEGEQQLLDMTTVEVRCADEPLLANAPFNVPGRPYPPDSLYTTYNSIMLHWAPPLRDGGTPITEYELEKREHGTKLWEKADTNADPKANTKKQWEKDAFANVPDTRFK

SEQ ID NO: 151994 - protein, 55 aa, Heterodera glycines
  Coding regions on vcDNA: vcDNA=SeqID_78417; Strand=+; Position=1 -45,282-404
MIRDRYRIIFIPTIKWICWIDSNMRGFFFSKIVFILLSRIFTFIQYFVFLYISSQ

SEQ ID NO: 151995 - protein, 196 aa, Heterodera glycines
  Coding regions on vcDNA: vcDNA=SeqID_78418; Strand=+; Position=1 -199,340-461,518-549,753-990
MNSAALALTDSDLNPGRGFLKFITIIFGLMLCYEILQQCYHAGGLSLLERQLIANMVRTRTPQAIKSAIDAFNALDEKFYVANEEGNSCPICKEIVPGTMAKPLSCNHIFHNECILACNALNQEMATQSAFGVSSNGQENGATNGNGVAQSTAAVGNPPEVVIDMPSDGQNGGNTVGTGTDGTETNRHNNGTANVG

SEQ ID NO: 151996 - protein, 66 aa, Heterodera glycines
  Coding regions on vcDNA: vcDNA=SeqID_78419; Strand=-; Position=1 -139,363-424
MNIFLVLFLGTSRQCKNGVKMGRFATVQKWALRETCKFNRKRPGLIICKASTFALFCVESVTQIQV

SEQ ID NO: 151997 - protein, 66 aa, Heterodera glycines
  Coding regions on vcDNA: vcDNA=SeqID_78420; Strand=-; Position=1 -97,145-248
MEIWCKVEEGGLVLLGKSIFTLCVYLTGAGAEGVYIAIITGRGSGDCAMSITRTNNSAGFEVYYIF

SEQ ID NO: 151998 - protein, 121 aa, Heterodera glycines
  Coding regions on vcDNA: vcDNA=SeqID_78421; Strand=+; Position=1 -158,378-585
MNSSEETTENVGMGGNKDERQTTSKDETDESSSENQRNEQRQRQMDCEKEDSRFECNICLDMAKDAVSLPATMPFHYVFINRSIFALGRFDVRPFVLLAMPFPMDGHASLSPAVPRVQIGD

SEQ ID NO: 151999 - protein, 54 aa, Heterodera glycines
  Coding regions on vcDNA: vcDNA=SeqID_78422; Strand=-; Position=1-167
SNGPYTAGMCRARQNPIPIKSPIPIMAKNPINCDSDYDSDSAHPWYTAQQCSSV

SEQ ID NO: 152000 - protein, 278 aa, Heterodera glycines
  Coding regions on vcDNA: vcDNA=SeqID_78423; Strand=-; Position=1 -189,671-1318
  Homolog annotation: Hit_ID=CAE56414.1; Match level="QueryCoverage =78%, HitCoverage=50%, E-value=1e-21, Identity=31%"; Hit description =Hypothetical protein CBG24106 [Caenorhabditis briggsae]
MVMRRLQQQQQQQQPQEVREIVVEQLLDPLYKDTRSAAAFTSVEPLLREAQRVHPTRGIRRAEERLYRYFTHRGTQCWTGVIQQLVSALNASPHRALSGLRPRDVNFANAEQIRRQQLQRLANNVRKNSRQVRGRNPRPPRFHAGDRVRIEKHKHVFKKGYLPRFTDEVFTVTEVRDSRTPTTYKLRDDTGELLTGWFYAQDLCLVLPPPAPPQRPTQQGAEASAAAAAAAAVVGPVYDIERVLKRRRQGRNGVEHCLVKWKGYSAAHNSWIPATSII

SEQ ID NO: 152001 - protein, 381 aa, Heterodera glycines
  Coding regions on vcDNA: vcDNA=SeqID_78424; Strand=-; Position=1-1146
MSSSSSFYIVLPSNTQVEGNRTNSFRVRLPRKLQFGSQWSVGLAVLLYPHSWPSLGTTEEQFVRVEWQTGEQVRIPVPASTVRNPSELLTSLHRALGEGSEKLATELRQIQLTYHQLISEAESSAKTQLEAAIRDRKKQQQQQQQKQQQENATEKKQLEKRESAKPKPNEKGKDDDDDKEEEEWKRAAYNSLYRQSLDKLVVDRMSEAERVQLQRHLPVGLELWVQSYRKARLSCRFNFDVEQQRFRLELDQSRIRQVELSDQLAYILGFHKRHLSAPLNVARYQPDMKGGVSSFYVYAPGLIEPVIIGNVCAPVLRMVCIRGAQPDDMIEEAYTTVQYHQLITKEIAEIFIEIRTPTGALMPFQYGTCTLTLHFRKSHYF

SEQ ID NO: 152002 - protein, 338 aa, Heterodera glycines
  Coding regions on vcDNA: vcDNA=SeqID_78425; Strand=-; Position=1-1014
MKHTTRMLLVPEELYRSLLARSSAPVADASSARGGLPQHTTPIEHTAKRMARAAHSGGITQSTDGVSPASKQQHLLNDDERLIHYQQEFKRFKKLLEDEQERPAPVRLTQLPTDEASKGLLRDALSEAARTIQQQQPQPKQPALHQQQQQSSQSDSSTMRQPPRRRQRPAKRTHRTTSASTDGAEASRFPSSSSAVSLLTRTDNGGGGGGAETTEREDSPNDDRPQNVAAVDPARKGQREEADVQLHPSTSTAPAAAAVLRDTEQRKRQAIDYALRNAGTLGIGDGQQVYRLMQGAYRPIKNSDLDALLTFHFAEPKPEKAPPGYKTFIGNARQDPRM

SEQ ID NO: 152003 - protein, 110 aa, Heterodera glycines
  Coding regions on vcDNA: vcDNA=SeqID_78426; Strand=+; Position=1-333
MDTSSHESDRKAGDGADNADAPAACQQQQQPSLTADEPLLVRQPKEAPAHQLMKKEEEEEKPRQESAPLPQPTHNDDVSKSVSQSVAVHHNAQNKKLSKQNKKSVARLLR

SEQ ID NO: 152004 - protein, 110 aa, Heterodera glycines
  Coding regions on vcDNA: vcDNA=SeqID_78427; Strand=+; Position=1 -74,1271-1529
  Homolog annotation: Hit_ID=CAE57459.1; Match level="QueryCoverage =74%, HitCoverage=41%, E-value=2e-16, Identity=55%"; Hit description =Hypothetical protein CBG00424 [Caenorhabditis briggsae]
MVKEFEKVRDHPDPSAMLFTCMDSSKAINTLYDLYHGRPFDAESPMDHWLRRNGHQSVQKLTQLLMAGPGTELEFASENGLMAFCAHIDRTDQLSAVDKLSQINTLQVGN

SEQ ID NO: 152005 - protein, 175 aa, Heterodera glycines
  Coding regions on vcDNA: vcDNA=SeqID_78428; Strand=-; Position=1 -255,384-656
MPSLSGSNWWWAPGQKAAEEAEAFSAAAAGQPTNEQMQQADNEQTVHFVATTVEAMLSQIPGISRDILASINLSQLIYCQNFAAMKLADKGQIGRYVLEKKLLNLRIFADFFLTLSNICKTKQNQNNALANREITWIKLANSNGFLEICFEQFYKQIAQAIIEQGDTENEVIGVI

SEQ ID NO: 152006 - protein, 134 aa, Heterodera glycines
  Coding regions on vcDNA: vcDNA=SeqID_78429; Strand=+; Position=1 -108,162-458
MNKIFANDSKAVFEDDMHIGEAFDEVFKQIYEQENEMPFDRCREIWKEVEHSEKTLVHETNHLLKNQGVDFTISGLLSFTIGLQNSIETEMKMLKDAEASLDALKKRELELVRHYKDKQSKILSSLDHGMQILI

SEQ ID NO: 152007 - protein, 206 aa, Heterodera glycines
  misc_feature (19)..(19): Xaa can be any naturally occurring amino acid
  misc_feature (25)..(25): Xaa can be any naturally occurring amino acid
  Coding regions on vcDNA: vcDNA=SeqID_78430; Strand=-; Position=1 -163,215-299,417-493,541-586,758-850,903-956
  Homolog annotation: Hit_ID=S60252; Match level="QueryCoverage=77%, HitCoverage=28%, E-value=2e-47, Identity=62%"; Hit description =paired box transcription factor vab-3 - Caenorhabditis elegans
NQNNGFLFQKNNLLFINIXSRITKXLPILNYKGKTFLEGHTGTNQLGGVFVNGRPLPDPLPDQIRQRIVDLAEDGMRPCDISRNLLVSNGCVSKILARFYQYGTIKPRAIGGSKPRVATREVCEKIKSKPRVATREVCEKIKVYKDAQPSIFAWEIRDRLKQDKVCTDETLPSVSSINRVLRSIQTRKVSSINRVLRSIQTRKEST

SEQ ID NO: 152008 - protein, 85 aa, Heterodera glycines
  Coding regions on vcDNA: vcDNA=SeqID_78431; Strand=+; Position=1 -60,362-485,529-602
MYILKLTTIILLFCLIYYFNDTQQPPVETTTEMPQTAAGEAQLGELKIVPELADSTPTKNNATNSSDSNDESNGMDGNVFCLYLL

SEQ ID NO: 152009 - protein, 220 aa, Heterodera glycines
  Coding regions on vcDNA: vcDNA=SeqID_78432; Strand=+; Position=1 -344,629-735,1196-1407
MLDHIKSIILSEMLYQRRVDQFKCRHDLKYRLQSNLDLVKQIFMKILYNDSTQDGKEKFTMSKMLVDGGLNSLKLLLSFAARLSAAVGGVLSNFLYKIATHTVVSLKYCEIPKKRIFGYRIELKVDTNGNTILVRLGWKEYTVGQQLISKTNFKFLQQLAKTELSPQDVVNVCQKIDNSVGIGAAMEGTESAATKLFSAVAAHFEASNNEIHQKNPSGKG

SEQ ID NO: 152010 - protein, 176 aa, Heterodera glycines
  Coding regions on vcDNA: vcDNA=SeqID_78433; Strand=-; Position=1 -107,166-287,350-522,591-719
  Homolog annotation: Hit_ID=CAE73751.1; Match level="QueryCoverage =91%, HitCoverage=48%, E-value=8e-36, Identity=45%"; Hit description =Hypothetical protein CBG21284 [Caenorhabditis briggsae]
MDKMPMQVLDAIVPFIDFYDHLNGIDSRKSIFLFLSNGGANSIAQRTLEYYNRGKPREEITFREMEEIIQISAYNEGDGGLKSSRLINKHLIDYFVPFLPLERRHVTMCFKDYLRSLNVNYTPEQLERLTDSISFFPREAPIYASAGCKQVVQRTDFILEELIRESRMINNFSDEL

SEQ ID NO: 152011 - protein, 45 aa, Heterodera glycines
  Coding regions on vcDNA: vcDNA=SeqID_78434; Strand=-; Position=1-211
NIKYSWYQKWLWVFIKQKFDFAFMSSSRPSSNPTRRSHVVRWCRE

SEQ ID NO: 152012 - protein, 97 aa, Heterodera glycines
  Coding regions on vcDNA: vcDNA=SeqID_78435; Strand=-; Position=1-292
MTEEGANTTFTAALISDGRAENQLEQKKPSQLHSLPFSMDFNGPALVSKFFQTEDGANGLKAALFRGHLLLGKTVRAPEGFAFYAVKESEHSQSEEG

SEQ ID NO: 152013 - protein, 24 aa, Heterodera glycines
  Coding regions on vcDNA: vcDNA=SeqID_78436; Strand=-; Position=1-73
MVRFITAPNLLASQQSLPILPDRT

SEQ ID NO: 152014 - protein, 110 aa, Heterodera glycines
  Coding regions on vcDNA: vcDNA=SeqID_78437; Strand=+; Position=1 -219,947-1060
MSWIVFSCPNCNGLNCMRPVNYSKPLICVHPSIKNLTDYLQKEPTATPNCTSTTLSFLLIIITVMLTIILLDHVNRQEQVALPAISVAVVTDVPKIEQHDGDDDQELDLR

SEQ ID NO: 152015 - protein, 185 aa, Heterodera glycines
  Coding regions on vcDNA: vcDNA=SeqID_78438; Strand=-; Position=1 -55,102-293,496-626,685-864
MMPNKGKRSIAKLCLNNLWGRFSLRNFGLSQTLITNDPVVLTEYLENRSLEVTAIDELDEQHILISYEKKKEWIEEHACSNIDTDSIILTHPDDNCPLKTGPHLGQFTDEYPNHEILEFCSGGAKQYGLKLRRKDAPADADLEYVLKVRGFTLNYDVIKNQGLRYETFKEQVLRYAETGERQQST

SEQ ID NO: 152016 - protein, 188 aa, Heterodera glycines
  Coding regions on vcDNA: vcDNA=SeqID_78439; Strand=-; Position=1 -313,373-521,574-678
  Homolog annotation: Hit_ID=XP_316911.1; Match level="QueryCoverage =77%, HitCoverage=13%, E-value=1e-15, Identity=31%"; Hit description =ENSANGP00000006552 [Anopheles gambiae]
MDSNKSFYNKAEDKLALAIDVITVDEPKMEKFISDPNKSNGTLSMEIEKVSEFAREIFESQRKSETVHIKGFPWKIWAKIKTKNESTDNEKWLAIFLLCDAPKEAENWSCKCSATLRIVSQKSGVKDLRREFTNEDTFNNKTNNWGFSNFISIAELMDPSKGFYDQSEDKVTLAIDFTVKEAKTEDET

SEQ ID NO: 152017 - protein, 305 aa, Heterodera glycines
  Coding regions on vcDNA: vcDNA=SeqID_78440; Strand=-; Position=1 -69,167-260,356-490,530-639,1659-1797,1977-2347
  Homolog annotation: Hit_ID=NP_060267.2; Match level="QueryCoverage =68%, HitCoverage=51%, E-value=3e-20, Identity=28%"; Hit description =BTB (POZ) domain containing 2 [Homo sapiens] gb|AAK25826.1| BTBD2 protein [Homo sapiens] sp|Q9BX70|BTB2_H
MPSSMDRMKHLLSTGEHSDVHFLVLPAHQLILKSASDVFEAMFRFDAKKERPENVSGNCPDVVEIPDIEAEAFKVMLSFIYADDLSDLNGDNAMAVLYAAKKYNIPDLVDRSLQIPIPELRNVFFAYAQALLFDLEALRWADEKCRQNGIECSSGNRRSVLGPALFKIRFPNIHEEDFAKCVVQSGVLTEKEVLGVYQFNSHPFLCLRGVPGLYSLKFPSHGRIFNWNKAKGNRRGTLALEIEKMSEFAGESVGRSRFSDAVYINGFPWKIKAKITKGIDEKKYLGFYLWCDAKEGPILITILKI

SEQ ID NO: 152018 - protein, 89 aa, Heterodera glycines
  Coding regions on vcDNA: vcDNA=SeqID_78441; Strand=-; Position=1 -98,253-301,378-500
MTMTVRDFFNRFLNIRRLGPKCKTQKISTFFHSNWHCGGTATVEEIAKTSFSVRHPSWPFDLFAQPTPIVRPLKWRRFTALLALGLSAI

SEQ ID NO: 152019 - protein, 182 aa, Heterodera glycines
  Coding regions on vcDNA: vcDNA=SeqID_78442; Strand=-; Position=1 -182,327-693
  Homolog annotation: Hit_ID=NP_702697.1; Match level="QueryCoverage =78%, HitCoverage=23%, E-value=8e-13, Identity=30%"; Hit description =hypothetical protein [Plasmodium falciparum 3D7] emb|CAD49135.1| hypothetical protein [Plasmodium falcipa
MATNLSTNRSENSPQRARIDFDDSGANDSFGSGGRSVGGRKKRTSAQNIVEKKRQSRAEEPKQITAEIDQNDGPNVEEKKNKKNDEKEEKRRETKDEEVSEKSSDREEEEQEEGGGEVELFSEDDRIDEVGEDQDVAEGGTKATLKGTGNDNGTVMRDQSDDDEEEEEGEIVEEGAEDANEW

SEQ ID NO: 152020 - protein, 225 aa, Heterodera glycines
  misc_feature (167)..(167): Xaa can be any naturally occurring amino acid
  misc_feature (183)..(183): Xaa can be any naturally occurring amino acid
  Coding regions on vcDNA: vcDNA=SeqID_78443; Strand=+; Position=1 -77,342-385,431-507,561-614,662-872,2011-2126
  Homolog annotation: Hit_ID=NP_509115.1; Match level="QueryCoverage =96%, HitCoverage=54%, E-value=3e-31, Identity=36%"; Hit description =rhodopsin-like GPCR superfamily (XH248) [Caenorhabditis elegans] pir||T34117 hypothetical protein C25B8.5
TTRKAKRSGDTRHPLPLDMTFGDLLLTVFCHPNEFLIRKHEFLRFCHPNEFLIRKHEFLRHVGLCSIIHFCNWIGLAVSGLSFCNWIGLAVSGLSLTLLNVDKLIYFRWPLSYERAMSKVDKLIYFRWPLSYERAMSKRRAICLCGGVWIVSLGFLDFLEVIIIFTXFEGLFLMYGPRKLFLXRPFACLFCIIQIQTSCIRIEFRFRSTQSPRATTDDGVSSSAP

SEQ ID NO: 152021 - protein, 34 aa, Heterodera glycines
  Coding regions on vcDNA: vcDNA=SeqID_78444; Strand=-; Position=1-132
KRARSSRLRPRSGLNSPTNLETGAKRPSEVSKLP

SEQ ID NO: 152022 - protein, 40 aa, Heterodera glycines; identical to SEQ ID NO: 149798
  Coding regions on vcDNA: vcDNA=SeqID_78445; Strand=+; Position=1-242

SEQ ID NO: 152023 - protein, 151 aa, Heterodera glycines
  Coding regions on vcDNA: vcDNA=SeqID_78446; Strand=-; Position=1 -182,256-529
MQVQSAKNIRGIAPVEMLLKAFELELGVVPDKAFQHELRFVAEYQKGQSKLQELARVPRNDESKEKQTRHELHWALVLIFLAENAEFLDKKSQTFLYDNSQLLLYSSRQMMLNGETSEFVITMEKFVIWSPLREINGEREKRRDRERQKER

SEQ ID NO: 152024 - protein, 56 aa, Heterodera glycines
  Coding regions on vcDNA: vcDNA=SeqID_78447; Strand=-; Position=1 -111,342-401
MIHLHNANLHQLKMDCGLPSVGEGEGQTKFGILTAFLKKLFCLYFNCFKVFSKGQF

SEQ ID NO: 152025 - protein, 70 aa, Heterodera glycines
  Coding regions on vcDNA: vcDNA=SeqID_78448; Strand=+; Position=1-215
NYSFTSDERAMQNNFVANLHQNGISFLADYAALWLLGLDMLQMYNKHEQQIKLFISRSCSCTMEAWVIIN

SEQ ID NO: 152026 - protein, 228 aa, Heterodera glycines
  Coding regions on vcDNA: vcDNA=SeqID_78449; Strand=+; Position=1 -78,137-487,756-1010
  Homolog annotation: Hit_ID=NP_493130.1; Match level="QueryCoverage =82%, HitCoverage=20%, E-value=8e-12, Identity=31%"; Hit description =glycosyl transferase, family 14 (1M951) [Caenorhabditis elegans] emb|CAB03539.1| Hypothetical protein T09
VQGQMLLLGDPQVNENDDKIKFTQEEAPEIRFDWWALPKGSAPLDCARLFAKDKKYIGKMVRRRICREEDPTENDLDMSCTAIQSRNRFWHGAKDDQQGEQNEKEHANYPMAQIRTVYKARNGEIGINIGCEYSNGLKPIRPLDYVVVELEFAATFSPLNWYCFVVDAASPALFKRRVRALAKCFPNVIMGDERPMKSDGEGMMEAVLDCFERLDTPKRKWEYVTLLQ

SEQ ID NO: 152027 - protein, 133 aa, Heterodera glycines
  Coding regions on vcDNA: vcDNA=SeqID_78450; Strand=-; Position=1 -81,135-208,256-300,343-386,434-483,528-575,625-858
MDATKWHTFVNQVAATGPITKAAICGQDGNIWAKSDNFNLDPMEANVAVSAFRNPGVLANRGLACEGVTYPITQPPSTTNNTCLSGEIDGQHGVTIARTNRAFLVGVTEGTDTDVGRVETVSLAQQLATQYGW

SEQ ID NO: 152028 - protein, 148 aa, Heterodera glycines
  Coding regions on vcDNA: vcDNA=SeqID_78451; Strand=-; Position=1 -22,388-468,537-592,747-1034
  Homolog annotation: Hit_ID=CAE70759.1; Match level="QueryCoverage =92%, HitCoverage=45%, E-value=6e-13, Identity=34%"; Hit description =Hypothetical protein CBG17508 [Caenorhabditis briggsae]
MYCAVSYFYIIKVGPSFDNETSVEEANIQYMVVTDAGKLSLTVYARDPMLFFQSKALAGNSFGIRRNQFTRATTANGPRRKKCLHEGKQSSKSITKLKLKSRVLKNYEQNKKAQMATAANATESPAQTFAEMVKNPSMALQKLMQNYQ

SEQ ID NO: 152029 - protein, 337 aa, Heterodera glycines
  Coding regions on vcDNA: vcDNA=SeqID_78452; Strand=-; Position=1-1014
  Homolog annotation: Hit_ID=NP_502080.1; Match level="QueryCoverage =38%, HitCoverage=17%, E-value=2e-18, Identity=41%"; Hit description =endoplasmin (87.1 kD) (4L887) [Caenorhabditis elegans] emb|CAA92973.1| Hypothetical protein T05E11.3 [Cae
MPTSSSPTNLLPLLYGSYERLKKHACDIDKRLLYSLRRLDNFTRLNFLVEVEWKGKTKMQEGKEEDAYILYSRAMAIYLMISESIDNEFKRSRGGYLFYDVSQRICADFDKVAASLQQRFMEGQGDEPEFCDPVGLRWAEIVENPISKNLDCNKVSNSSDDQDKIRSLSPANATELVATEKFLTKIKADKENHILHIKDKTDRGIGMMKHAVTNNLATVRQSGTSEFISKLFDSSISSKQNQDLVTQSLHLNEEARNFLELDKLKKSEKKIGSSETDNKNGLMRIWRLEKFSVKNGRILLSVESAKWLKTWIFIKIPDKILLDKHIKIFRGHKCPHF

SEQ ID NO: 152030 - protein, 123 aa, Heterodera glycines
  Coding regions on vcDNA: vcDNA=SeqID_78453; Strand=+; Position=1 -191,447-620,1586-1592
MRTTILYHCRYLSFHCLGLNDLMGAHVEWKREMEMEMMQRSQNAKLAAVRNLHDFLLNGPKEPRSTKDQKRVGRIQKALLANFVSPFSRIVSAKCRKSDQKWAERHTEAKGGEGAAENDERRI

SEQ ID NO: 152031 - protein, 117 aa, Heterodera glycines
  Coding regions on vcDNA: vcDNA=SeqID_78454; Strand=-; Position=1 -84,125-293,348-446
FKYSTNIDYSLGSLGHEEISCNYIDLSYIRVNSPELVSEFDGKISIFVDAVDRTVSDGYFLTGSASISAACAAPSQREGRIYGIDRWETLFPVQIKLEFYQRRKRQWLIPEDTAPWE

SEQ ID NO: 152032 - protein, 649 aa, Heterodera glycines
  Coding regions on vcDNA: vcDNA=SeqID_78455; Strand=+; Position=1-1948
  Homolog annotation: Hit_ID=XP_415982.1; Match level="QueryCoverage =68%, HitCoverage=25%, E-value=3e-13, Identity=25%"; Hit description =PREDICTED: similar to MOV10-like 1; Mov10 (mouse)-like 1 [Gallus gallus]
MPVPSIEELTELCKIWEIDLAVGCKVNPAAKAKPCAHGYVLSIEKRSLCVGYEIDAKVIFSYQEAKDQDAQEEFDQMRCGELDGCVELIPQTSVRALQERMFTLRSNDCSKVAKDEAKVGRIMSILLGRPVKPESPKANNPLMTFGALSKLKEGQIDTALCMLDEVPRLVFQQAGPGTGKTFSAASIVATVLATDPTARVLALAPPNVAVVKLVLEMQDALAAGNHVEPMLALFSGTGKLRYAKEVERISPHLLATAVEAQDFQELLQKDQERVKVERYLDACERNPRLAQEMAVAKIVQEHKNRRLCFATLSFCEQLPALFGETTHLIIDEAGQAPYVQILNLVSQLPCLTKVLITGDRRQLRVHLPSLPIAIREDFGMDMVIQNLDVARGTDVTTLSVCFRSHSALVRCTEAGFYKPHGELLTPGRDDSERALMTDQTAFKLPKKGVPLILVHQSTPAQRDEVSTSSANPGQTDTAMRALWRLARAFPGTLIRCICFYAAQALEIERLVAQQEIPDILVTTADATQGHESSLAVVVTTCSVFDGGADSQPFWADAARVDVAISRASHGMIIIGDLLLLNRTETWRRYLDQATTETTVVGPEYFDFEQFKNPDNYYDKDGQLISANGGAVRSEHFYSKYGKNVWYNNS

SEQ ID NO: 152033 - protein, 264 aa, Heterodera glycines
  Coding regions on vcDNA: vcDNA=SeqID_78456; Strand=-; Position=1 -67,115-270,313-540,583-777,831-971,1018-1023
  Homolog annotation: Hit_ID=NP_491496.1; Match level="QueryCoverage =87%, HitCoverage=53%, E-value=3e-12, Identity=26%"; Hit description =downstream Of Mes (in same operon), protein similar to human HLA class III (45.9 kD) (dom-3) [Caenorhabdi
MSEPIDYLSTDFHYNGKAIFSAKQLGVFSYDSKKGHLEMGCANLKYVYEGFMNRKLNIDLTQGIHKQIEKWRSESLDKVFDWLLNSYDEGSSLEEVKCLEFQNNFLVLMQALNGCEFVSRRGPMSRIAISPYIWQSLNDKSQKLACVKYNDVIFIREFTRPDGEDDKSNWNTFVQKASFAGRKFEQLITMDEPEGGEPDTTAPVDPNPELDGIFKANLIVEGRSLNIFYGCEFDALRASDGKFIELKTQLKFVGFGKYFSFKAL

SEQ ID NO: 152034 - protein, 55 aa, Heterodera glycines
  Coding regions on vcDNA: vcDNA=SeqID_78457; Strand=+; Position=1 -48,1524-1643
MAIVHSPPSLRKRFCEIMKSDLYSQIDRKFEESSTSNEGSDNELVADDNASLNSM

SEQ ID NO: 152035 - protein, 43 aa, Heterodera glycines
  Coding regions on vcDNA: vcDNA=SeqID_78458; Strand=-; Position=1 -128,205-208
MSNFSLLSTETLDSRRCRRTAADEDAETELAKDSLSEGKATSS

SEQ ID NO: 152036 - protein, 141 aa, Heterodera glycines
  Coding regions on vcDNA: vcDNA=SeqID_78459; Strand=+; Position=1 -59,112-203,288-388,1255-1316,1448-1526
  Homolog annotation: Hit_ID=NP_499356.1; Match level="QueryCoverage =92%, HitCoverage=23%, E-value=3e-31, Identity=50%"; Hit description =flavin-containing monooxygenase (58.5 kD) (fmo-13) [Caenorhabditis elegans] emb|CAB97238.1| Hypothetical
MTKKRCAIVGAAVSGLPSARWALAYDFEPVIFWALAYDFEPVIFERLDKIGGLWRYKPEQFNLASVMKSTVIDTSKEMNAYSDFPPPEHFANYMHNTQMLAYLELYTEHHGLYQYIRFHNTVLAIRRADDYSRKMGVDLAC

SEQ ID NO: 152037 - protein, 428 aa, Heterodera glycines
  Coding regions on vcDNA: vcDNA=SeqID_78460; Strand=+; Position=1 -85,156-298,345-492,563-857,908-1069,1113-1283,1363-1425
  Homolog annotation: Hit_ID=NP_499356.1; Match level="QueryCoverage =93%, HitCoverage=65%, E-value=2e-73, Identity=38%"; Hit description =flavin-containing monooxygenase (58.5 kD) (fmo-13) [Caenorhabditis elegans] emb|CAB97238.1| Hypothetical
KIVKFEDQIKFEGDIIHSHDFKNSKEYEDKVNVVVGAGNDKVNVVVGAGNSAMDLNVELGRVGKKCYLSTRRGAWIGKRVGEGGIPEDCLFNTRDCLFNTRFKVWLNRILPQAFTNWLFIRQCQKRFDHAKYGIMPSHGFFSQHLTVSDDLPCRIITQHLTVSDDLPCRIITGSVQVKPDIREFTSHGIVWADGTVTDDIDKIVMATGYLFNFDLVENGQLIPVKDNTVWLYKNMLAPQLADWNTLAIVGLAQALGAIHPVAEMQARLFFAALCGGAIHPVAEMQARLFFAALCGDAKLPTREGMEHDIDRAQAELAKAFVKSTRHTIEVNYILFMDELAEVNYILFMDELAELIGCQPNPVDFAFSKPRLAHALLFGPNVSYMYRLRGPKAWDGAEEAILDIPRRMAILDIPRRMDMCLSGRKVKEA

SEQ ID NO: 152038 - protein, 20 aa, Heterodera glycines
  Coding regions on vcDNA: vcDNA=SeqID_78461; Strand=-; Position=1 -43,87-106
MQNSKKNKKQINTNFLKNAT

SEQ ID NO: 152039 - protein, 106 aa, Heterodera glycines
  Coding regions on vcDNA: vcDNA=SeqID_78462; Strand=+; Position=1 -194,240-363
  Homolog annotation: Hit_ID=A35810; Match level="QueryCoverage=93%, HitCoverage=16%, E-value=1e-12, Identity=38%"; Hit description =alpha,alpha-trehalase (EC 3.2.1.28) precursor - rabbit gb|AAA63460.1| alpha,alpha-trehalose glucohydrolase sp|
MLFQNDSKHFVDRPLKKEAKKIVEEFTSTFGGNELDVSKMNEQQVDQLAKFVRENFGRANGVLIAYTPEDWVESPPKLERIKDAEFKKWAKQLNELWKELSRKMPD

SEQ ID NO: 152040 - protein, 292 aa, Heterodera glycines
  misc_feature (224)..(224): Xaa can be any naturally occurring amino acid
  misc_feature (246)..(246): Xaa can be any naturally occurring amino acid
  Coding regions on vcDNA: vcDNA=SeqID_78463; Strand=+; Position=1 -221,267-326,527-660,710-833,888-960,1027-1098
  Homolog annotation: Hit_ID=CAE75311.1; Match level="QueryCoverage =99%, HitCoverage=44%, E-value=7e-42, Identity=37%"; Hit description =Hypothetical protein CBG23281 [Caenorhabditis briggsae]
KAVNFWGVQNDSKHFVDRPLKKEAKKIVEEFTSTFGGNELDVSKMNEQQVDQLAKFVRENFGRANGVLIAYTPEDWVEYTPEDWVENPPKLERIKDAETATLISKTTHSLICVPHPFVVPGGRFREFYYWDAYWIVKGLIASGMTKMVKNMCMNFAEMVNRFGASGMTKMVKNMCMNFAEMVNRFGFVPNGGRIYYDKRSQPSFFTFMVYDYFLATNDTKFLHXVLPVFMVYDYFLATNDTKFLHXVLPVLEKELGHWSKNRSVEVEVELGHWSKNRSVEVEVGGKKQTFYQ

SEQ ID NO: 152041 - protein, 186 aa, Heterodera glycines
  Coding regions on vcDNA: vcDNA=SeqID_78464; Strand=+; Position=1 -129,444-567,854-1061,1177-1222,1277-1330
  Homolog annotation: Hit_ID=NP_505959.1; Match level="QueryCoverage =97%, HitCoverage=49%, E-value=6e-27, Identity=27%"; Hit description =trehalase (tre-3) [Caenorhabditis elegans] emb|CAD54509.1| trehalase [Caenorhabditis elegans] emb|CAB0125
MVKNMCLNFAEMVNRFGFVPNGGRIYYDKRSQPSFFTLSDKQTIPRPESFCQDVQLVTNISNTQRKADIWKNVASTAESGWDFSCDNAKASTYAAEHNEFRSDFQRLFYKEEHGVWYDFNIKSGKLHEEYYGSVTVPLFTQCYDTDDVGTAERINVNSTQQWDFPNIWPSLAHMLIESLRRSGNKK

SEQ ID NO: 152042 - protein, 67 aa, Heterodera glycines
  Coding regions on vcDNA: vcDNA=SeqID_78465; Strand=-; Position=1-204
  Homolog annotation: Hit_ID=NP_034790.1; Match level="QueryCoverage =89%, HitCoverage=83%, E-value=5e-15, Identity=57%"; Hit description =keratin complex 1, acidic, gene 10 [Mus musculus] emb|CAA24214.1| unnamed protein product [Mus musculus]
MGSCQMCGGGGFPGGYGSMGAYGTGLLGGSYGGSLYGSGGYGGGLYGGGLYGGGGYGGGLYGGGFFG

SEQ ID NO: 152043 - protein, 101 aa, Heterodera glycines
  Coding regions on vcDNA: vcDNA=SeqID_78466; Strand=-; Position=1 -145,364-423,566-666
MADRSALTSLFWHFFLAAFLLASQNLNGIKGQAILPQNQCPFGATPDGACNYLNFCVDPRETCIQGVCCQPLPINPTYTNNPTYPIYPNNPTYPIYPTNPI

SEQ ID NO: 152044 - protein, 109 aa, Heterodera glycines
  Coding regions on vcDNA: vcDNA=SeqID_78467; Strand=-; Position=1 -201,259-387
  Homolog annotation: Hit_ID=NP_501109.1; Match level="QueryCoverage =62%, HitCoverage=23%, E-value=2e-12, Identity=54%"; Hit description =putative protein, with a coiled coil-4 domain, of bilaterial origin (4H869) [Caenorhabditis elegans]
MRYLLRIRNYNFLTKIGKSSVVQSQESPPSLLTDSKPFKKVLNSAVQYYEECIGLVEVHKARDEVNRCENNLFLAQQARREKQGEIKSLQNRLKDIHSELDRTQRGEDR

SEQ ID NO: 152045 - protein, 178 aa, Heterodera glycines
  Coding regions on vcDNA: vcDNA=SeqID_78468; Strand=-; Position=1-537
MVVTNKESPGSKPTHMQKAKQHRESKTLRRHKINKLLSSAATLRPRRKRESVPNSTTPIVIEIIQDPVADQQISLSNKHSTAPLSKELRRPTATKQSSSNSTRPVSFRKRTQGKAAPYAGISRTLEHSSQTKALSPTTKEKRANQQHAMALEGSTDPTTNTYDWQSAKFSKHLLANNQ

SEQ ID NO: 152046 - protein, 44 aa, Heterodera glycines
  Coding regions on vcDNA: vcDNA=SeqID_78469; Strand=+; Position=1 -90,1110-1154
MPYRSPVGCQCIRHTKACTTDTDASQRRPTHLTIDEIFLVNCII

SEQ ID NO: 152047 - protein, 98 aa, Heterodera glycines
  Coding regions on vcDNA: vcDNA=SeqID_78470; Strand=-; Position=1 -21,106-148,657-889
MGGGKREQIIKTKSENQCSHLPQNAKIIFKSFKFHFDQMGKMNEKGKKVKDKRHSEETALFDQMTISELNEYEVGQLIANSAPPVRSIEGICQKRDNI

SEQ ID NO: 152048 - protein, 386 aa, Heterodera glycines
  Coding regions on vcDNA: vcDNA=SeqID_78471; Strand=+; Position=1-1161
  Homolog annotation: Hit_ID=NP_941288.1; Match level="QueryCoverage =100%, HitCoverage=96%, E-value=0.0, Identity=100%"; Hit description =Tn10 transposase for IS10 right [Serratia marcescens] ref|NP _052934.1| transposase [Plasmid R100] gb|AAD5
MCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAAT

SEQ ID NO: 152049 - protein, 89 aa, Heterodera glycines
  Coding regions on vcDNA: vcDNA=SeqID_78472; Strand=+; Position=1 -94,154-253,297-371
MRPSTSNLDSKSIIDSYLNSTEDCQFLLRALEKQAFENVVFALRAQGPLTQYTELLLDHLKTALSIDDDEFNIKIRIASNNPHICRIAQ

SEQ ID NO: 152050 - protein, 104 aa, Heterodera glycines
  Coding regions on vcDNA: vcDNA=SeqID_78473; Strand=+; Position=1 -47,82-349
MEFVIRRNVMGKSVEKKDKKGLVHKLKRRFALFAKMDLQETECWELHERLAKLKVDERLAKTKVAKKKKKPKPNNFKQFDADFGKAMMTKGPVFVEDFIKAILL

SEQ ID NO: 152051 - protein, 209 aa, Heterodera glycines
  Coding regions on vcDNA: vcDNA=SeqID_78474; Strand=-; Position=1 -489,1118-1258
MKQRICHLTATHKTTKRPGKPKVRTAIQRTETPDEGHGKVQGESGRTQPKDKPKEGKRIGGQAETVGQNSEKSRKFMKRKNERKIQQEKGTENYEQCKEQVRRRAMELCSPRPTHLWAQTLADFGQMPSDLALQQRSSNSDRTVEGEAEEASGIKGCFRCGSKTKVERLGNSAEEGQLEENELKGVQRKVTELISALRNAHNAKAQNEQ

SEQ ID NO: 152052 - protein, 46 aa, Heterodera glycines
  Coding regions on vcDNA: vcDNA=SeqID_78475; Strand=-; Position=1-138
LFRVLPPLLRFLSLLLVLLNALLPLLLGLSDQMRMSIPFSDLGESL

SEQ ID NO: 152053 - protein, 118 aa, Heterodera glycines
  Coding regions on vcDNA: vcDNA=SeqID_78476; Strand=-; Position=1 -66,113-403
MTEEEESLAQEEESLKKEIEEEEENLPDFSDDFVDKDNLEELPEKREDEAIGKEGAQSEWDGREGQTQANSAEPSHYRNPGELAQLRAKLLSPTKRRQSAIPGEIQMVTKKSQKGRRH

SEQ ID NO: 152054 - protein, 39 aa, Heterodera glycines
  Coding regions on vcDNA: vcDNA=SeqID_78477; Strand=+; Position=1 -35,77-161
MEKEIWHKMRLKMRHSNEDKANYDIKKANPSSHRETENF

SEQ ID NO: 152055 - protein, 200 aa, Heterodera glycines
  misc_feature (152)..(152): Xaa can be any naturally occurring amino acid
  Coding regions on vcDNA: vcDNA=SeqID_78478; Strand=+; Position=1-611
  Homolog annotation: Hit_ID=AAB30592.1; Match level="QueryCoverage =100%, HitCoverage=94%, E-value=6e-39, Identity=47%"; Hit description= stage-specific S antigen homolog [Leishmania donovani infantum] pir||A56010 amastigote-specific protein A
PQNSGPQMSGSPNVGIPKCGSPKVGSPNAGSPKSGPQTSDPQMSGPQMSGSLSVGPQMSGPQMSGSLSVGSPKVGSPNVGPQMSDPQMSGPQMSGSLSVGPQMSGPQMSGPQMSGSLSVGPQMSGPQMSGPQMSGSLSVGSPNVGSPNVGPXVSGPQKSGPQMSGSPNVGPQMSDPQMSGHQMSGSLSVGSPNVGSPKVG

SEQ ID NO: 152056 - protein, 514 aa, Heterodera glycines
  Coding regions on vcDNA: vcDNA=SeqID_78479; Strand=-; Position=1 -174,277-428,475-502,1150-1535,1588-1712,1763-1890,1968-2269,3137-3384
MTFVYESKLRKDNIVYDKEVGLQHEIEQTFQSPPVKRSYNSSPRSSPTDSNQCCCSCMEIIGGLLYNCSRCNSSFHSICHFPALPINKGSYSSDWICHRCEMEVQYNRRHVPRIKWNLDANLLDSKRVTDRIALWKRYTELPKSETPFRSVISCFYTKVREDNTKQHLKLKSMTTKKQQKTINKPFKIESLIKRAYAVAEQNFSGDCSNSREETPIDVGSPDDARLSIAVEALMKMHNQTEDHDMMDDFLHPFTVSESKFDFAIGFSDVFVPKMEEDNNQLPLLSFNPTLLDRTQPIFASLKILSGADKSMGESDFLIPIHSSFVTLGPLKSFYALQNAHQATGVDFLRQGLSFLFSIHLNGFKAKLCFEIVSANLFDCDSFPSSKCMQKNASRFDDFVSECTCQRMDAEDGDESVVLRLLESNYEIVPSRKRTKQTNMADLDQNNARNESEGRSESTNEIRAPITEAEIRAKEMVMPDDVLGLNCITESMITKQNQKWHSLSDFLCRPEDNVY

SEQ ID NO: 152057 - protein, 415 aa, Heterodera glycines
  misc_feature (273)..(273): Xaa can be any naturally occurring amino acid
  misc_feature (405)..(405): Xaa can be any naturally occurring amino acid
  Coding regions on vcDNA: vcDNA=SeqID_78480; Strand=+; Position=1 -151,200-252,309-437,489-623,1083-1213,1374-1732,1796-1988
  Homolog annotation: Hit_ID=NP_501648.1; Match level="QueryCoverage =91%, HitCoverage=42%, E-value=1e-60, Identity=36%"; Hit description =putative protein, with at least 13 transmembrane domains, of bilaterial origin (4K122) [Caenorhabditis el
LLSPQHTAETADVAALQRITSEMMDRQTISQLINFTKTKLITKSKFHLAILYFCLYHCYVFALLSMMILYFCLYHCYVFALLSMMMWALLYHSMWALLYHSVFGLLFLLLTCFLWALVNSRKWTFKLSPILLAYVEFLLLVQYVFLLLVQYVFSMNLHKNELGLPESVEIIGFKLEQSRTDAFMALLLKIILSLPLFILLRLHLREDYYNSLNGRERFRQVNYGTFAVNDSQSGLLHFGEFANNRCQRGRRHFLFHRISTFFIVFILLLIVSXSYFYLNLLFFSLIASFRLFRKVVFAFFTVLIIYASVVLVSIYLYQFKGVPEFWQKWTHINETVWEDIGLIDYKANEFGLLFTNLTKLISLLVVTMLQLKFFHSPWSRLVSDSAEASHLECVETVDTVRAGLXKRNRIKFMAP

SEQ ID NO: 152058 - protein, 128 aa, Heterodera glycines
  Coding regions on vcDNA: vcDNA=SeqID_78481; Strand=+; Position=1 -119,205-380,1124-1215
  Homolog annotation: Hit_ID=CAE74039.1; Match level="QueryCoverage =30%, HitCoverage=5%, E-value=1e-10, Identity=69%"; Hit description =Hypothetical protein CBG21690 [Caenorhabditis briggsae]
MIGYDVLAFVFIVFQLRILHSWFFQRCMIEFRCEVIQANRGAILINQLIEKEMREQTEQQNKKLHEIKDRTAAIRKRYEEQQRRSTGISFFSPQTYGQAKRSGDYYMFDYEPDKDELVVPIESFVSRR

SEQ ID NO: 152059 - protein, 35 aa, Heterodera glycines
  Coding regions on vcDNA: vcDNA=SeqID_78482; Strand=-; Position=1-148
SLSNLSLLLSNWVISHYSQMGGFVGVPLIVYVLSV

SEQ ID NO: 152060 - protein, 106 aa, Heterodera glycines
  Coding regions on vcDNA: vcDNA=SeqID_78483; Strand=-; Position=1 -167,318-471
MDQNQSDQMVNEFGNHRLSQIKAAIDDNQQRLDQNDGDHHYRDAIALKIPSSVRWRNQSVPECPKQRRLCRLRQKMNSQKQQLTCTTRPGRTSADRGRGCNGIWEK

SEQ ID NO: 152061 - protein, 367 aa, Heterodera glycines
  Coding regions on vcDNA: vcDNA=SeqID_78484; Strand=+; Position=1 -377,428-522,604-831,877-1059,1111-1333
  Homolog annotation: Hit_ID=NP_501646.1; Match level="QueryCoverage =75%, HitCoverage=27%, E-value=7e-51, Identity=39%"; Hit description =putative protein, with at least 6 transmembrane domains, of eukaryotic origin (4K108) [Caenorhabditis ele
QQTQEDEETDVPSMRKLPRQEIGTERQEKLAGDETEKKSLEEKSEEESRAKSWGIVLFFETFPFVSQFPFPKGQTILSLFLFALKLFRSLIGWVSAFLNRRSREHRYVEYVLNKEKEKLKQMMCNELFNGQITTSALRDRWEAHNMHLVSSEADIKRLEDEALNRWEQRNIFARFITAIGNCIAAHTDIICYCFVIIVHGYTAGLLTLPLPALVFLWGTLASPRPSKLFWIVMIIYTEFEIVAKFAFQFGFWPWNGDTVGNNKVYKTEYVFGVQRIQGFAGKDVALLIALFFHRYMLRKFGLWRDASSDRLINEMPKKRMDNGSSSSSSAEKSPQKSTQSTVVPSSSGENFESVAKAQQEQVIWIFW

SEQ ID NO: 152062 - protein, 181 aa, Heterodera glycines
  Coding regions on vcDNA: vcDNA=SeqID_78485; Strand=+; Position=1 -84,337-411,633-792,843-1069
  Homolog annotation: Hit_ID=CAE72764.1; Match level="QueryCoverage =80%, HitCoverage=68%, E-value=2e-41, Identity=48%"; Hit description =Hypothetical protein CBG20014 [Caenorhabditis briggsae]
MATGGKMGFGEIVPKLSQVTEWDTMANQIRVEIEAPLVDDPEPPSEFAGICTDVEVGPHGHWLVLLHKGYRQCFNSGDNLQLEVKNEWKGTEWHCQLEIPLAYLPGNVTKFNAYALHGSDEQRHFEALHAVTDGTLTEPDFHNLMFFGKLDTKRIIPDGYNRTVFNDLKYGDLWEEATSDK

SEQ ID NO: 152063 - protein, 43 aa, Heterodera glycines
  Coding regions on vcDNA: vcDNA=SeqID_78486; Strand=+; Position=1-129
MQTPNELTAGSGVTNFIKCSVCDAKWPYKSGHFPWGFAIRCTK

SEQ ID NO: 152064 - protein, 34 aa, Heterodera glycines; identical to SEQ ID NO: 145298
  Coding regions on vcDNA: vcDNA=SeqID_78487; Strand=-; Position=1-189

SEQ ID NO: 152065 - protein, 99 aa, Heterodera glycines
  Coding regions on vcDNA: vcDNA=SeqID_78488; Strand=+; Position=1-300
MFFSFKNHFLHHQLEQNAKFGIGCSGITIQNPPVKSKQQKIEEIYGTQNNNIMPIVTLLSVLYVCSVVVQTACAMPMQMLVMYTPINSYEGGFKLFLEI

SEQ ID NO: 152066 - protein, 57 aa, Heterodera glycines
  Coding regions on vcDNA: vcDNA=SeqID_78489; Strand=-; Position=1-171
MVHSFLRYSILFVISCFVYGHDDENDNHIIGDVYLGDEFWYQLSPITDLPTIDGVEF

SEQ ID NO: 152067 - protein, 284 aa, Heterodera glycines
  Coding regions on vcDNA: vcDNA=SeqID_78490; Strand=+; Position=1 -480,542-612,904-1006,1085-1284
  Homolog annotation: Hit_ID=CAA11148.1; Match level="QueryCoverage =97%, HitCoverage=59%, E-value=1e-155, Identity=99%"; Hit description= Hgm1 protein [Heterodera glycines]
MNLHTIFSVLLCALVLSCAVGKPPAKKGQQSKKADVIAKAAAGEPAEVKNDGKAKKSATVVPVAAGPVGASNDAKGTTAGGNKATGDTGTTKPSAGGSATTDDDDDDESPSPSAAAGGATTTDGKAKPSGDGTATTLSGGGGKASSAAKAGSGGTTVPAKGEETTAVKVDENSKGTDETEKPEGSTDATITGDTFTKVNKIADEITECEFYFVHLENVKANEKEKLWTRTKQEAEIDTEEMAEDSVDYRIVTPAISKDQPDMGTLYEQDTDDLPSDPDRRARRN

SEQ ID NO: 152068 - protein, 89 aa, Heterodera glycines
  Coding regions on vcDNA: vcDNA=SeqID_78491; Strand=+; Position=1 -246,358-381
MERKQKRLEEVTEGFNIVLFGLPLQKDEGELSSSDSEEPTSSEEEEEAANSADGAAAPKKSGARLVASRERRRTRRVDEQKQISFFGQN

SEQ ID NO: 152069 - protein, 41 aa, Heterodera glycines
  Coding regions on vcDNA: vcDNA=SeqID_78492; Strand=+; Position=1 -78,753-800
MSLNGTYLFNLSLYCSNSMHEVRAVQKRPSQILNLYLVKKT

SEQ ID NO: 152070 - protein, 58 aa, Heterodera glycines
  Coding regions on vcDNA: vcDNA=SeqID_78493; Strand=-; Position=1 -108,271-339
MRSKLLWPMLTLRRRRATTVAPKVANSLWPSSEPPTAFALSKTAPISSTRRRQGLKLL

SEQ ID NO: 152071 - protein, 162 aa, Heterodera glycines
  Coding regions on vcDNA: vcDNA=SeqID_78494; Strand=-; Position=1 -112,152-214,751-1050,1315-1328
MDKFEILKWIDQLDKPMADLIRKLHKSVNELSASINEDSLDQNAKIQNLISLIKEIAIETQRQRRRKKRSVGSTVGVLIVGGFFCILAIWAIGKYCKDCSPENQQGEDIENGRRVAAREIQPESPEGHMPPRRDRSCERKGKARQGRHRSRSNSQTRLSKLL

SEQ ID NO: 152072 - protein, 48 aa, Heterodera glycines; identical to SEQ ID NO: 135361
  Coding regions on vcDNA: vcDNA=SeqID_78495; Strand=+; Position=1-146

SEQ ID NO: 152073 - protein, 71 aa, Heterodera glycines; identical to SEQ ID NO: 124984
  Coding regions on vcDNA: vcDNA=SeqID_78496; Strand=+; Position=1-217

SEQ ID NO: 152074 - protein, 123 aa, Heterodera glycines
  Coding regions on vcDNA: vcDNA=SeqID_78497; Strand=+; Position=1 -75,140-241,294-408,863-942
  Homolog annotation: Hit_ID=CAE72864.1; Match level="QueryCoverage =73%, HitCoverage=23%, E-value=3e-24, Identity=54%"; Hit description =Hypothetical protein CBG20163 [Caenorhabditis briggsae]
MHEGLANVCLIGSSMTVVKSKIDMQIARKRKGLTSQHDKSLVAFMNAICAAFVRHVNIELIKCVVVASPGFLRDQFIEFFWQYIEREGLKQQFAPHRGCQCANFLEYARDRRATHPIGGFYWH

SEQ ID NO: 152075 - protein, 102 aa, Heterodera glycines
  Coding regions on vcDNA: vcDNA=SeqID_78498; Strand=+; Position=1 -101,205-285,339-464
  Homolog annotation: Hit_ID=NP_504842.1; Match level="QueryCoverage =89%, HitCoverage=45%, E-value=9e-20, Identity=48%"; Hit description =ATP synthase factor B Mitochondrial (22.8 kD) (5H721) [Caenorhabditis elegans] gb|AAK95868.2| Hypothetica
MARPFIGFAFDAFKRRLGAHDFPFLRGFIHGFNYYDAQRVKEIGAERAAAEWVVRCEGKVKFDHSPHIFSDYNALQRFTSELDPKRESDRVHLVAVDATDSC

SEQ ID NO: 152076 - protein, 55 aa, Heterodera glycines
  Coding regions on vcDNA: vcDNA=SeqID_78499; Strand=+; Position=1 -141,217-243
MPAVDCLNGYRSYINDRNAELIMGDPLNPNMETDFDFAGNLALFDKACNYYAVIA

SEQ ID NO: 152077 - protein, 354 aa, Heterodera glycines
  misc_feature (347)..(347): Xaa can be any naturally occurring amino acid
  Coding regions on vcDNA: vcDNA=SeqID_78500; Strand=-; Position=1 -40,782-856,922-1019,1070-1125,1182-1284,1841-1907,1968-2112,2247 -2438,3453-3592
  Homolog annotation: Hit_ID=CAE75506.1; Match level="QueryCoverage =75%, HitCoverage=46%, E-value=1e-59, Identity=45%"; Hit description =Hypothetical protein CBG23516 [Caenorhabditis briggsae]
DRHKVRGGGANDCEGAADQNIWAVLVAGSNGWWNYRHQADVCHAWHVLADVCHAWHVLVDHGVSPDRIITMIYDDIAHNKRNPYPGKLFNNPTMKDVYEGNPYPGKLFNNPTMKDVYEGVRVRIDYRGDEVTPANFKAILLGNEEAVEGKRVLKSTSNDKVFVFFSDHGAFGLVAFPLFQQLTVKELTQTLQKMHALFQQLTVKELTQTLQKMHAKRMYGQMTFYLEACESGSMFDQKIAQQINVFAVTASNAFESSWGCYCDTPIVGLEYTCLGDLFSVNWMEDSDRQVKQRREERKRGGRERERQRVMHNFCFGSCFIQIYNLTSSAYNLILTPDGKASGRSLIXIKNNKGP

SEQ ID NO: 152078 - protein, 357 aa, Heterodera glycines
  misc_feature (349)..(349): Xaa can be any naturally occurring amino acid
  Coding regions on vcDNA: vcDNA=SeqID_78501; Strand=+; Position=1 -54,125-257,294-414,559-682,797-869,1012-1101,1143-1266,1311-1477
  Homolog annotation: Hit_ID=NP_009111.1; Match level="QueryCoverage =98%, HitCoverage=48%, E-value=3e-62, Identity=38%"; Hit description =trehalase (brush-border membrane glycoprotein) [Homo sapiens] pir||JC6504 alpha,alpha-trehalase (EC 3.2.1
LKTFVREHFGKADDFLESPQPIDWKENPPKLQPQPIDWKENPPKLQNIADPELKTFANQLHDLWKELGKKMPESVKAKENKSTLIYVPNPFVVPAKENKSTLIYVPNPFVVPGGRFREFYYWDAYLIVRGLLASGMTESVKHMCDNYAEMVKKFGFVPNGGRIYYNKRSQPPFLTFMVNDYFAETGDTEYLKSILPVLEKELQFWRTKRSVKVNAKGKERTFYQYRAESNVPRPESFCQDVDLVRVPRPESFCQDVDLVRDIPEAEKKRIWNELASAAESGWDFSSRWIEKDESTNNETLQWKLRWIEKDESTNNETLQWKLTRLMITKIVPVDLNALICGNLEMLSNXYTIGECPQ

SEQ ID NO: 152079 - protein, 64 aa, Heterodera glycines
  Coding regions on vcDNA: vcDNA=SeqID_78502; Strand=+; Position=1 -48,436-582
MSVRKCPSANVRPQMSCNCKRVQKCRAKMKSRKTVLNVLARNNGHSRKEGMLNTVIQKAEKNKS

SEQ ID NO: 152080 - protein, 531 aa, Heterodera glycines
  Coding regions on vcDNA: vcDNA=SeqID_78503; Strand=-; Position=1-1596
  Homolog annotation: Hit_ID=XP_318550.1; Match level="QueryCoverage =83%, HitCoverage=45%, E-value=2e-99, Identity=44%"; Hit description =ENSANGP00000020240 [Anopheles gambiae]
MSANRLLRWSLMLLAYDFEIEYVNTTEFGQADALSRLIAKSTSPEEDRVIASMEFEKEAENFFSNTLETVSFSSKDIISAGNEDETIKKVKKFVRDGWPNDKAIASETEEIKLFFRRKDDLSITKECLMYGERVVIPPKFRAKVLRMLHKGHPGIKRMKQLARNQVYWPKLDAEIEDFVRNCEPCQLAAKSPIKTELHSWPKASKPWQRIHMDYAGPFYGKEYLLIVDAFSKYPEVFEMPTKSTAATVQKLRYLFSRHGLPETIVSDNGTQFSSKEFADFTQSNGINHCFSAPYNPMSNGQAERFVDSFKRTFRKLKGEGALSAEIIETFLTAYRTTPNDTLQECKSPAEAFLGRKVRTTLDLLRPPQFQPMERDELMERRFNKRFGAKPREFGPGDKVFARHRISQNWRPGKVVKKTGVIYDIKFADGTTNRYHANQIRPRQIEDKTTEQLNIFNDVFGLPPQVRAEPEDVQPQDEAVRSEADEDEIGRAVEEQNDGRIEQEEQPNEERPITPRVYPRRNRRPPDRYSPH

SEQ ID NO: 152081 - protein, 172 aa, Heterodera glycines
  Coding regions on vcDNA: vcDNA=SeqID_78504; Strand=+; Position=1-518
  Homolog annotation: Hit_ID=XP_318550.1; Match level="QueryCoverage =100%, HitCoverage=18%, E-value=6e-40, Identity=48%"; Hit description= ENSANGP00000020240 [Anopheles gambiae]
KKGIRQMSANRLLRWSLMLLAYDFEIEYVNTTEFGQADALSRLIAKSTSPEEDRVIASMEFEKEAENFFSNTLETVSFSSKDIISAGNEDETIKKVKKFVRDGWPNDKAIASETEEIKLFFRRKDDLSITKECLMYGERVVIPPKFRAKVLRMLHKGHPGIKRMKQLARNQV

SEQ ID NO: 152082 - protein, 614 aa, Heterodera glycines
  Coding regions on vcDNA: vcDNA=SeqID_78505; Strand=-; Position=1-1844
  Homolog annotation: Hit_ID=NP_491240.1; Match level="QueryCoverage =92%, HitCoverage=41%, E-value=1e-112, Identity=38%"; Hit description= zn-finger, CCHC type and RNA-directed DNA polymerase  and Integrase, catalytic domain containing protein
HPKREKPNYERPKSQQSTKTEQQKCWRCGQTNHHHAACPQKGYKCRKCSQNGHIELRCEAVQEWRKKNAKSWLKKNVGNVHIVTVNIGTTAKPTTKSTLLRVKVSFQGKVIEFVLDSGAEVNVINEMTYKLIGSPKIKACKEQAVLYDGSTRSFIGKGTGTFEFNGVNVEQEFYVAGKDSLNLLSIQTMDAFGLLDELKEKISSKMVNMCKGGKKDNAPIRPKGTEVNEYLTKLKKAFPDVFKEELGFCTKAKANLVLKPDAQPIFRKARPVPHNSREVVEKELERLESLGIITKVEHTDWAAPILIVKKADGTARMCIDYSTGLNNALLDHQHPLPLPNDIFATLNGGKVFSQVDLKDAYLQIELTAEAKKLCTVATHRGYYKFNRLPFGVKTAPGIFQSVMDKLLAGLEFATAYLDDIIIVSKSKEEHFQNLEKVFERIQSWGFRVKMDKCSFFQEQIKYLGQIIDKDGRRPDQGKIAAITNMPAPKDVPSLRTFLGMVNHYQQFVKNMRFIRQPMDELLKKDKDWDWGKECQGAFIKIKEILSSDLLLTHYDPKLEIIVAADASEHGIGAVISHRFPNGAIKAIEHASSSLTPAERNYSQIEKEGLALIYA

SEQ ID NO: 152083 - protein, 97 aa, Heterodera glycines
  Coding regions on vcDNA: vcDNA=SeqID_78506; Strand=+; Position=1-292
  Homolog annotation: Hit_ID=XP_308192.1; Match level="QueryCoverage =100%, HitCoverage=24%, E-value=3e-33, Identity=68%"; Hit description= ENSANGP00000021557 [Anopheles gambiae]
WDWGKECQGAFIKIKEILSSDLLLTHYDPKLEIIVAADASEHGIGAVISHRFPNGAIKAIEHASSSLTPAERNYSQIEKEGLALIYAVRKFHEMIYG

SEQ ID NO: 152084 - protein, 150 aa, Heterodera glycines
  Coding regions on vcDNA: vcDNA=SeqID_78507; Strand=+; Position=1 -192,413-573,630-729
MNKIDVQPKRDPTGSQKNRRAPQRRRHTDVLNGIIEGRVLKTEMMPSSVATDCKFNDYYCNRLCSRLTVNCLVTFLLITVIGFNYDKLHLTFTYNSFSEHVAALRGKLNGKALHNARSECMPSATNFAILLPALNGTTKFMPVEKPGAAQ

SEQ ID NO: 152085 - protein, 116 aa, Heterodera glycines
  Coding regions on vcDNA: vcDNA=SeqID_78508; Strand=+; Position=1 -221,1453-1582
MDDENDGDDVEVEVEQDDTAERLCHDAMEQPTTSHGPQRHIVASNVGNAQQRHQLARQQQLSNTEEAEQREFDDLVRSYQEHMILMHRAMTPIEAFWCAQYGEVGKFITLAQIGMP

SEQ ID NO: 152086 - protein, 95 aa, Heterodera glycines
  misc_feature (71)..(71): Xaa can be any naturally occurring amino acid
  Coding regions on vcDNA: vcDNA=SeqID_78509; Strand=-; Position=1-428
  Homolog annotation: Hit_ID=XP_453836.1; Match level="QueryCoverage =98%, HitCoverage=98%, E-value=3e-27, Identity=65%"; Hit description =unnamed protein product [Kluyveromyces lactis] emb|CAH00932.1| unnamed protein product [Kluyveromyces lac
LIRQVSCYTLLSGFRLPWPPSCCLYQPTPFMGSNERALWHLNSTFGSSHIASSAYQKWPTWSSNIQRLGSXVKQPWLHTHLEFENRLRTFRPQVL

SEQ ID NO: 152087 - protein, 135 aa, Heterodera glycines
  Coding regions on vcDNA: vcDNA=SeqID_78510; Strand=+; Position=1 -226,275-420,668-703
MNYSIFVSVIFAGLIIVGLDGTDENGKMEKNNGKKIIKFLEDFQENDAKDENDLQIDFNSEHSREVTQMNNRNFITFLRGSSSKASDTPKPPSSASVLLPKVRKFLEGGTPTMPYYQMPFLQQKVDQVFFSSNSG

SEQ ID NO: 152088 - protein, 310 aa, Heterodera glycines
  misc_feature (283)..(283): Xaa can be any naturally occurring amino acid
  Coding regions on vcDNA: vcDNA=SeqID_78511; Strand=+; Position=1-942
  Homolog annotation: Hit_ID=NP_032862.1; Match level="QueryCoverage =99%, HitCoverage=93%, E-value=3e-61, Identity=50%"; Hit description =per-hexamer repeat gene 5 [Mus musculus] emb|CAA26710.2| unnamed protein product [Mus musculus] sp|P08399
GTGTRQTGTGTFTFEKTGTGTFTFEKTGTFTFEKTGTGTFTFEKTGTGTFTFEKTGTGTFTFEKTGTFTFEKTGTGTFTFEKTGTGTFTFEKTGTGTFTFEKTGTFTFEKTGTGTFTFEKTGTGTFTFEKTGTGTFTFEKTGTGTFTFEKTGTFTFEKTGTGTFTFEKTGTGTFTFEKTGTGTFTFEKTGTGTFTFEKTGTGTFTFEKTGTGTFTFEKTGTGTFTFEKTGTFTFEKTGTGTFTFEKTGTGTFTFEKTGTGTFTFEKTGTGTFTFEKTGTFTFXKTGTGTFTFEKTGTGQKTGTGTFTFEK

SEQ ID NO: 152089 - protein, 270 aa, Heterodera glycines
  Coding regions on vcDNA: vcDNA=SeqID_78512; Strand=+; Position=1 -758,1941-2000
  Homolog annotation: Hit_ID=NP_032862.1; Match level="QueryCoverage =99%, HitCoverage=93%, E-value=3e-49, Identity=49%"; Hit description =per-hexamer repeat gene 5 [Mus musculus] emb|CAA26710.2| unnamed protein product [Mus musculus] sp|P08399
TGTGTCTLKTGTGTFTFEKTGTFTFEKTGTGTFTFEKTGTGTFTFEKTGTGTFTFEKTGTGTFTFEKTGTFTFEKTGTGTFTFEKTGTGTFTFEKTGTGTFTFEKTGTGTFTFEKTGTGTFTFEKTGTGTFTFEKTGTGTFTFEKTGTFTFEKTGTGTFTFEKTGTGTFTFEKTGTGTFTFEKTGTGTFTFEKTGTFTFEKTGTGTFTFEKTGTGTFTFEKTGTGTFTFEKTGTGTNKTSNTGTGTSTALHQPIKIGGDENTLSKKGKAQ

SEQ ID NO: 152090 - protein, 214 aa, Heterodera glycines
  Coding regions on vcDNA: vcDNA=SeqID_78513; Strand=-; Position=1 -120,567-950,1498-1638
MQKEMLSQMEAAIRESLMDKSALEQMRRREQFLMEQALNKSAHSFSRLKLSNEEAEKLPGTSAQKLENAEKSVKFDEKANFIISPSPITSGTRPTATSLAQLKIVPNSVEKRRKSAADLLNENANYIKMEEKPSINEENPKPPKLVEKRISLGQIHVPQQRKEMKNETEAAKQINDSRPQTAKAARELMEQNSEVDEVRRRIAAKIKAEVINGK

SEQ ID NO: 152091 - protein, 79 aa, Heterodera glycines
  Coding regions on vcDNA: vcDNA=SeqID_78514; Strand=-; Position=1-337
DKTSSAETSSNEFFDHNFFSFSIKLNILGIIRKHSKNAISLQIFKNFYLCTKKSEQKSSNYWVFEFLLAITFLKLNQNF

SEQ ID NO: 152092 - protein, 107 aa, Heterodera glycines
  Coding regions on vcDNA: vcDNA=SeqID_78515; Strand=-; Position=1 -175,712-860
MKLFTLYCILFFVSDTFAGCFTGSKTSEDSDSEREDDAVPKAAQETVKRKPTLNTELLRLGREGIMIDAWGRLPGGDRLAKSLKWLPTDSTDLLADFPAPGKEELSE

SEQ ID NO: 152093 - protein, 74 aa, Heterodera glycines
  Coding regions on vcDNA: vcDNA=SeqID_78516; Strand=+; Position=1-225
MHLFPILSPIFSLLFAGIVPVPIGGSGGSIFAICKKSDVDRKNPMPKVKAFDTPATTPSPPTDRTSTDRKTQGS

SEQ ID NO: 152094 - protein, 47 aa, Heterodera glycines; identical to SEQ ID NO: 127360
  Coding regions on vcDNA: vcDNA=SeqID_78517; Strand=-; Position=1 -43,174-739,1042-1268

SEQ ID NO: 152095 - protein, 44 aa, Heterodera glycines; identical to SEQ ID NO: 139610
  Coding regions on vcDNA: vcDNA=SeqID_78518; Strand=-; Position=1 -104,289-319

SEQ ID NO: 152096 - protein, 50 aa, Heterodera glycines
  Coding regions on vcDNA: vcDNA=SeqID_78519; Strand=-; Position=1-196
NFFIWTSLFVTRNHYFGDFVTKIVKNHYFGVLSLFRHFLENSLTKMHKTK

SEQ ID NO: 152097 - protein, 91 aa, Heterodera glycines
  Coding regions on vcDNA: vcDNA=SeqID_78520; Strand=+; Position=1-275
MLLAFVYPALIDLFTFVPHYRAEGHRQKACFRLLLNLFLASVGLFGMVAGLYASVSNLISHGSNECNAMTTTGTPTIMWNLYNGTTLSSSI

SEQ ID NO: 152098 - protein, 184 aa, Heterodera glycines
  Coding regions on vcDNA: vcDNA=SeqID_78521; Strand=+; Position=1 -81,1707-1871,2006-2131,2586-2768
  Homolog annotation: Hit_ID=CAE64848.1; Match level="QueryCoverage =47%, HitCoverage=14%, E-value=2e-10, Identity=36%"; Hit description =Hypothetical protein CBG09644 [Caenorhabditis briggsae]
MAKLRTLCFYVLILFLFGFTVFDVQKILCLSESHEIVAEVKEIQTLLPGAEEAEEKCMEYGGEEQFGTELECHGQCRLGLIRKICKCTARTLESLADSETLQNFPLCDYAKCNLKLNGKKQLKRFISFMLLRLHKMMHKESAVEGEETERQNEPREMPSPSRAGGDTEISMSPMDGGGGQRKKR

SEQ ID NO: 152099 - protein, 64 aa, Heterodera glycines
  Coding regions on vcDNA: vcDNA=SeqID_78522; Strand=+; Position=1-223
YYSYVYVQTIKYNIFTNETEGRSLNTARQSCPIIKVPHNSWRPSRRRRIAFIRSMTYQIADARV

SEQ ID NO: 152100 - protein, 360 aa, Heterodera glycines
  Coding regions on vcDNA: vcDNA=SeqID_78523; Strand=+; Position=1-1083
MLDLLNSLCETKSAIATNCGDCSSEWTRAIEAWNSFCPHLDEAQNERVLGSVERWLKGEEEVVPDENSLMEMNLEHLVEKMEPYGDAQLDGGDVALLHKIGLELAKAKEEKRLAGRVMTAPGIWDQLSNICILIGGFVGRAQTATEKQQITALTMCWENALCGQLEEIYVSAVMNALERWRAGATNGTDAGVIIGGSRKALQTMNRVASEEGQHNERQKTAISKTEMALIAELGAYFAEVIEAQRKAGAQWKEMRKTEPIVGMDKMLKKQCKRSVGRTKQTKERIYCLSWTEFRRKIPPENRKMFISWSKICKTMNLKETKKENNEQIRDKMEENILMKREEEKKEKKSTKKRKDEKPNN

SEQ ID NO: 152101 - protein, 93 aa, Heterodera glycines
  Coding regions on vcDNA: vcDNA=SeqID_78524; Strand=+; Position=1 -81,478-678
MLAAADQRQDADKTDNTPQGGAPLMSQVRTFAYFKLSLAYGDDREMLFVLAWRWQKYSLCFGQAPVPAGSAWDGRKAARRWERGEETAKFKSE

SEQ ID NO: 152102 - protein, 46 aa, Heterodera glycines
  Coding regions on vcDNA: vcDNA=SeqID_78525; Strand=+; Position=1-139
MPGGSFPPLPPTTSATAKPTKQVVRCSFIRSLAAPIQSPVDDISFL

SEQ ID NO: 152103 - protein, 162 aa, Heterodera glycines
  Coding regions on vcDNA: vcDNA=SeqID_78526; Strand=+; Position=1 -307,853-1034
MMEDDVRHQQQQQMPRFAGKLIGDGGECRDGSAEGAAHSIHLKREEEDAAGAEQQRQREEAEDAADLGADALKARRAARQRKREPVVVGWRTLEKAMRTTAEDSDMSPLEQFLLGSTLLSRLCSFFEMAFAEAQRQQRGKFKLPIKDYGVGTDGVMSATFPR

SEQ ID NO: 152104 - protein, 125 aa, Heterodera glycines
  Coding regions on vcDNA: vcDNA=SeqID_78527; Strand=-; Position=1 -235,391-533
  Homolog annotation: Hit_ID=A48145; Match level="QueryCoverage=96%, HitCoverage=82%, E-value=1e-41, Identity=61%"; Hit description =ubiquitin-conjugating enzyme ubc-2 - Caenorhabditis elegans
MDDGRDLYHWKASIKGPPESPYEGGTFHLDIVFRRDYPFTPPTVKFDTIVYHPNVGERGDICLDILKQMWAPSLTISKVLLSISSLLCDPNPNSALRQDIATMYRDNREEYNRIAREWTKNHAMR

SEQ ID NO: 152105 - protein, 213 aa, Heterodera glycines
  Coding regions on vcDNA: vcDNA=SeqID_78528; Strand=+; Position=1 -66,167-230,409-483,537-608,781-855,911-1117
  Homolog annotation: Hit_ID=CAE75111.1; Match level="QueryCoverage =89%, HitCoverage=20%, E-value=5e-37, Identity=47%"; Hit description =Hypothetical protein CBG23036 [Caenorhabditis briggsae]
KNSPAKRTARELFPFLVDLAGSERLKGMERLKGMPNGGERQREGIRINQSLSTLGRVIKALYDRQNGNGTSSQQIPYIPYRDSVLTSLLKNAFGGNSKTIMIATISPADLHYEETLSTLRFADRMKAIRTVPVVNESATERLIRAIRTVPVVNESATERLIRTIRSENDRLLRALERGELEEVAEKVDKKRDNTKFKKRSESMARSNQNYLLE

SEQ ID NO: 152106 - protein, 136 aa, Heterodera glycines
  Coding regions on vcDNA: vcDNA=SeqID_78529; Strand=+; Position=1 -132,391-501,820-947,1675-1714
MVGLSTNVQEMSAMSLGELEQSLNAYREETPHLWNLNEDPALSDETTKSVRYFLALFLILQFIFQCPGSGQNAQIQLKGMSQQKGEEKGSEGGEGEDQLRNGTKRNCETKFEKSVRNGRQKVERFMSRYYRMQVGH

SEQ ID NO: 152107 - protein, 330 aa, Heterodera glycines
  Coding regions on vcDNA: vcDNA=SeqID_78530; Strand=-; Position=1 -246,296-508,657-827,1010-1369
SAAPARERNADEVLGEFDANRITAQRAKLELRIDLSRAYKSLLTMTTTGETAMLDNDNRNNKNRQRGDGGAEGTAPRGTMRKLIGIANRWEHLKETNNKRTDEEEGRTDKESVSNNELKKLLTMNRRMSAIRTVVLIDEEEDNDGEQRGNGEEYHNEAERRKNQIRNRIEHEWVSPYDNYVLTARQKTVTDFGDAVGICGSRMVSMVFGSTNARGTDVNGNIVNGGTIRATTIVEKLSKKRTTNEWRTNDGNTVEETVEEEGETQKTKRKRYSHLDEREEEAEEEKPTVKTEEEGMAEDDEIIVMDAEERTFFADPANLTRKARKRQRKK

SEQ ID NO: 152108 - protein, 132 aa, Heterodera glycines
  Coding regions on vcDNA: vcDNA=SeqID_78531; Strand=+; Position=1 -192,347-553
MPGQFRKGNVCVMRGNEVVYVAPDHKTLDAIATQFKKKLNAGFKEINNPKEDGPTLAAWAHYMFVKAHFFDGNGRSARCIMNICFLKMNLEPLVLDSTTRNDYNEALTCDDHFKFASFIDKIWKSKSWFRLK

SEQ ID NO: 152109 - protein, 278 aa, Heterodera glycines
  Coding regions on vcDNA: vcDNA=SeqID_78532; Strand=-; Position=1 -7,538-668,1053-1310,1768-2038,2298-2467
MPGRDVALIGDHKFATESAIKENPDYFRERNEALYIKAIEQSEKILEELFLRALNRSLLSRNVYGELITHERFSSWDVEYRMDLYFTNVQPFLDFPVVEQEIERERQMHIENRVTFIGGITMPKGVVPKLNGDTKQIFKSGNSANENGGVVLLSFGSVVEMNDGEAHAVALKNIVVEVFKQYPQMNMIIKWGKRAPIGTSEQYKKLADNVYAKSWLEQSAILDIRSKTLKNDFADAFNEMLTNYTEYKQKMDELSTKMNAVEPEKEFIEKFRQLRKSI

SEQ ID NO: 152110 - protein, 106 aa, Heterodera glycines
  Coding regions on vcDNA: vcDNA=SeqID_78533; Strand=-; Position=1 -96,266-488
MVAKEGITETHYVLHRHLAELLAADKENVEQVLLLVHELDCAEPTEVPPKFDGRLLVWHRMTFDWADAKNCTDAVLQHRQREREHRHIWEGAIFLPNPNKPSVSKL

SEQ ID NO: 152111 - protein, 209 aa, Heterodera glycines
  Coding regions on vcDNA: vcDNA=SeqID_78534; Strand=+; Position=1 -234,545-940
MYKIFKMVEAKVLGKVDKLAKQSENAKNENAKNGNAKLAGVRMIMMAPALAFSVPETVTAEQICDAILNGPLYGLSDASALNSQTSLKIFYETDSFATQIEDEALLHFVKGRRDLNKILTHVNWILPKGASSLRYTVGKHIAEFETMLSLLYLMRKRWHCANAKKRVAKIGIECTKLRQYVDIMYEYLFRVRYAKPAVMPMFQMRGPRL

SEQ ID NO: 152112 - protein, 29 aa, Heterodera glycines
  Coding regions on vcDNA: vcDNA=SeqID_78535; Strand=+; Position=1-88
MTFHENVVQMAINANDPAEQYRPSAARLE

SEQ ID NO: 152113 - protein, 293 aa, Heterodera glycines
  Coding regions on vcDNA: vcDNA=SeqID_78536; Strand=+; Position=1 -468,843-1064,1412-1538,2000-2064
  Homolog annotation: Hit_ID=EAA04577.2; Match level="QueryCoverage =32%, HitCoverage=46%, E-value=7e-10, Identity=37%"; Hit description =ENSANGP00000019118 [Anopheles gambiae str. PEST]
MSSAKRSIGDAGGSNDKAGTSRSPAIGNKQQPHHQQHNHRIRNNTSNSRSPTKKRREEEEGTRAKVATKNGTAGSGSKSPRRHSQHHGGLGAALEEMRERKWATIAGPSSSSGAKAQKLSTASAKSVGEKAVHRQQHHHNDKPAKKRETKGGAQRRLTFASNHKANDDDAEDDDDTAAGPSGAADAGTSYASAQMRVLPLSKVRTIMEASPNANEMKISGEAMFAMSKAAEAFISMLAKGAYQQMLTGSHTRINYNELAMFVHDTDELNFIQDILPQKHKFSEVDKLMTTNRR

SEQ ID NO: 152114 - protein, 62 aa, Heterodera glycines
  Coding regions on vcDNA: vcDNA=SeqID_78537; Strand=-; Position=1 -154,442-476
MCSELDTDADSGDQSDGRNRVQLDARKAHEAGQLHGHAGHNAGDLCCLGINETHLERFGEFE

SEQ ID NO: 152115 - protein, 56 aa, Heterodera glycines
  Coding regions on vcDNA: vcDNA=SeqID_78538; Strand=-; Position=1 -98,346-418
MSSSSTIFVLLLIIAICLSLTIAMPAVDNQIESVPLRQKRYGYGGGGFGGGMGFDG

SEQ ID NO: 152116 - protein, 219 aa, Heterodera glycines
  Coding regions on vcDNA: vcDNA=SeqID_78539; Strand=+; Position=1 -97,567-855,1437-1710
MPPHFCIFIILFNLIQITHNVPPAGLRGGLRGVFNDVYWTFQNLEFFNFPHHEARHVVLDQLYLEYFMEKNEQNGNEKRLKIATFTLFYMIRWKIEQKKQFLLSIQSVDEDGEYTGRTLYEKKKAAIRGIICDYIKEETSITTLCLMVIRKNYLLEVLDEKSPNFNKSHIESPAKSDECFDESVAERIIDENNEGIVEWMLSDMLHFFDKRQRLNKYLE

SEQ ID NO: 152117 - protein, 154 aa, Heterodera glycines
  Coding regions on vcDNA: vcDNA=SeqID_78540; Strand=+; Position=1 -77,125-275,559-795
MDKMLLLFLFLIIVIGLIAADKCNNFPRLNFLSLQQQRKTRESRCCSMPTSRVMFGSETGPYDKGDVLCSIYHQKQNGLMSRCSGVLFNPSLVLTCAHFWEKAEKDGDGSMAYAGIEDGQSVEEGVSKKVQFYNNKNYYPLIIMAKTPKNLIFS

SEQ ID NO: 152118 - protein, 157 aa, Heterodera glycines
  Coding regions on vcDNA: vcDNA=SeqID_78541; Strand=+; Position=1 -79,696-1090
  Homolog annotation: Hit_ID=XP_522969.1; Match level="QueryCoverage =73%, HitCoverage=83%, E-value=4e-12, Identity=34%"; Hit description =PREDICTED: similar to putative protein family member (XC187) [Pan troglodytes]
MRNQSLVLSWRSDQKTYSFPEFSSKSFCWFIRALRARYSNFVGLTEIRRGTTVIRRGTTVIRRGTTVIRRGTKVIKRGTTVIKRGTKVIRRGTTVIRRGTKVIRRSTKAIRKGTTVIKRGTKVIRRGTTVIRRGAKVIKRGTTVIKRGTKVIRKVQQ

SEQ ID NO: 152119 - protein, 213 aa, Heterodera glycines
  Coding regions on vcDNA: vcDNA=SeqID_78542; Strand=+; Position=1 -181,317-777
  Homolog annotation: Hit_ID=AAO34661.1; Match level="QueryCoverage =59%, HitCoverage=13%, E-value=3e-09, Identity=29%"; Hit description =putative Lon2 protease [Oryza sativa (indica cultivar-group)]
MNSIFVICIDIYDGVAPSPLILSEKSCFSSKLINTGLFAVTILIQGMAQQVLPDNCKQGSAKCRQIFKNAIDKAYNAARQIYQQRNIGGTFFAAKHLEIVFEPADWPISGGSCSAAAAIALLSKAEKELARVDTVVSGGVLPNGPISHVSGLELKITGARNYNMRRILLPTANFGDVAELPPNVTNGIEIVFRANIFQIMEDMHLSMTHLLAV

SEQ ID NO: 152120 - protein, 105 aa, Heterodera glycines
  Coding regions on vcDNA: vcDNA=SeqID_78543; Strand=+; Position=1 -30,82-369
MRNRNMEPALREEPYIYEEGKRKIPRMKFWFDLIKNRNKFGVVLCTNHGLTGIAAYSSETISTAMAPAVFVSARTTAGDWVLEEKSKGRETDDEETVRDEAIFFF

SEQ ID NO: 152121 - protein, 88 aa, Heterodera glycines
  Coding regions on vcDNA: vcDNA=SeqID_78544; Strand=+; Position=1-264
MSNLIRMVLGPQVAILRQRVNTARTHVDREEDEEVNNAALMEAKVLLLKVLQRVEAELAKWENVISGLQGQEKQTEQERLETFINERE

SEQ ID NO: 152122 - protein, 227 aa, Heterodera glycines
  Coding regions on vcDNA: vcDNA=SeqID_78545; Strand=+; Position=1 -40,638-812,857-1099,1143-1228
  Homolog annotation: Hit_ID=CAE72273.1; Match level="QueryCoverage =86%, HitCoverage=24%, E-value=5e-30, Identity=36%"; Hit description =Hypothetical protein CBG19393 [Caenorhabditis briggsae]
HFTRPMTFYASRDTRSPYSRFTNSHLVMCHCLGLLGNCWLLSALAVISQRPDILEKLFITKEYNHRGVYEVRLCIHGIWRRIIVDDFFPCHRLCIHGIWRRIIVDDFFPCHRSTKRQIFAVGRRGQLWVSLIENALAKYNGNYAILKSGLISEGINKFSGLGGYYMPFFRIFKSDSDFDIVWAKLLSARQLFFLMSCKSDSDFDIVWAKLLSARQLFFLMSCSCGAG

SEQ ID NO: 152123 - protein, 149 aa, Heterodera glycines
  Coding regions on vcDNA: vcDNA=SeqID_78546; Strand=-; Position=1 -104,339-382,438-460,834-937,1358-1511
  Homolog annotation: Hit_ID=NP_496057.1; Match level="QueryCoverage =99%, HitCoverage=30%, E-value=2e-48, Identity=66%"; Hit description =EXCretory canal abnormal EXC-7, ELAV type RNA binding protein (48.7 kD) (exc-7) [Caenorhabditis elegans]
ETEGRTSGKSAKVSERNTNLIINYLPQNMTQEEVRALFGSMGEVESCKLIRDKSSGLIRDKSSGQSLGYAFVNYERPEDARKALTSMNGLRLQNKVLKVSLARPSKDDIKGANLYVSGLPKSLTQFELESVFRPFGTIITSRILSDNVT

SEQ ID NO: 152124 - protein, 62 aa, Heterodera glycines
  Coding regions on vcDNA: vcDNA=SeqID_78547; Strand=+; Position=1-191
RSVLPFSYVRFASDQSNAQRGDEGKAAAVAHFGRVGHRDGAVHGICGSHLNHCFSQANSTKS

SEQ ID NO: 152125 - protein, 136 aa, Heterodera glycines
  Coding regions on vcDNA: vcDNA=SeqID_78548; Strand=+; Position=1 -108,494-610,1002-1128,1635-1693
MNDSCTIHGKKFDCSFAWLLERYKLSDKFAITEKIVVDELNSICNFERHVFDFSQMVDGSVRRLETYAWKVFLLAHVLLEYDTVVWVDTTIIFDNFNLTAILTSMNEGRIGPVQMPLGMYEFLPMFSNFEAKNGIN

SEQ ID NO: 152126 - protein, 90 aa, Heterodera glycines
  Coding regions on vcDNA: vcDNA=SeqID_78549; Strand=+; Position=1-273
MAIEHSFVGGPLFAPFHCFARPFSTTRAFGTITGIGTIATIGRFSTKCRANANKICAKFHGTKQKQRRRPMPAEKLMKAIRDREREKDHF

SEQ ID NO: 152127 - protein, 31 aa, Heterodera glycines
  Coding regions on vcDNA: vcDNA=SeqID_78550; Strand=+; Position=1 -81,275-289
MTNDQRAYKNDGIFKGMAQVRGWIGENRVNT

SEQ ID NO: 152128 - protein, 117 aa, Heterodera glycines
  Coding regions on vcDNA: vcDNA=SeqID_78551; Strand=-; Position=1 -317,479-515
MPFSQIFPIFSQVSIVEDNGHYEQRYLWTLVKKKEDNINNNQIDALGQKLDTLIEKIDQDKNVQQKSVDTLVEQTKTLNDKLDTLVNAISTLVEQLEKKSVKVSLWPGNDYFIQFIQ

SEQ ID NO: 152129 - protein, 101 aa, Heterodera glycines
  Coding regions on vcDNA: vcDNA=SeqID_78552; Strand=-; Position=1 -117,565-753
MLASASLLVSCWPLLFGLCFRRPSKFPKDKWPNWPLSQSERKSRKRWRIGRFVTPTLRKSAKFERDGRQRDNSLGWPAAAKALTRTVVASNYDADHCHNGT

SEQ ID NO: 152130 - protein, 61 aa, Heterodera glycines
  Coding regions on vcDNA: vcDNA=SeqID_78553; Strand=+; Position=1 -73,132-198,241-287
YIITNSFIRNNKLIYKIQSLGMKRFVGISSAVFLCHFFLSYDCCIISGKKTCRIMPMTCGY

SEQ ID NO: 152131 - protein, 66 aa, Heterodera glycines
  Coding regions on vcDNA: vcDNA=SeqID_78554; Strand=+; Position=1 -73,132-192,1391-1678
  Homolog annotation: Hit_ID=NP_509897.1; Match level="QueryCoverage =60%, HitCoverage=4%, E-value=2e-11, Identity=73%"; Hit description =guanylyl cyclase (gcy-9) [Caenorhabditis elegans] emb|CAA91488.1| Hypothetical protein ZK455.2 [Caenorhabd
CFKSQIIPHPFLFSFTRISSTSTPIQVVAFLNDLFSGFDAIIAKHDAYKVETVGASKHYSSHKALA

SEQ ID NO: 152132 - protein, 670 aa, Heterodera glycines
  misc_feature (250)..(250): Xaa can be any naturally occurring amino acid
  Coding regions on vcDNA: vcDNA=SeqID_78555; Strand=-; Position=1 -51,1377-1564,1650-1766,1864-2038,2237-2453,3085-3171,3227-3298,3522 -3598,3638-3799,4167-4286,4342-4406,4501-4615,5020-5205,5319 -5381,5441-5470,5521-5607
  Homolog annotation: Hit_ID=CAE70655.1; Match level="QueryCoverage =98%, HitCoverage=60%, E-value=0.0, Identity=58%"; Hit description =Hypothetical protein CBG17362 [Caenorhabditis briggsae]
FYASQRTFMRPMAFFLCIPFGYFLYVREKERMLYDMTWRIPREQIKLLGEGGKHQRRSDPSLGKSMESASALNGRELGRLSTKQAVARLSTKQAVANGVKCACKRYLQTRNISFNKHDLTRLKELKMMENENLNKFYGISFNQQNELIALWVLCQRGSLEDVLFSGEIKIGRNFQVTFAKDVGQGLYFLHNSPIRMHGFLCLQNCLVDSNWNIKLTNFVTEEIIGDKLKHNELKYVDRDEMDQQEVNKKXMEIWKLKLIQQAPEIVREYLSSKHLPPGTPAADIYSMAMAMVLYQIMFKLEPFYERNLPPNKIVSKIAMSNDNDQIIRPSFPNQQQNQAYNLQLLSALEACWLEIPEMRPNIKNQAYNLQLLSALEACWLEIPEMRPNIKRIKMIVFANLRSTGSGSLVDQMMKMMEEYTSNLEQLVKERTQMLEDTQQQADRLLKSMLPAAIADDLKAGRSVPPQLYSAGRSVPPQLYSNATVLFSDIRGFTRISSTSTPIQVVAFLNDLFSGFDAIIAKHDAYKVETIGDAYMIVSGLPRENGNAHVHHISEIGLKMRTFVANFKLAHRPDEVMMVRIGFHSGPVAAGVVGLQAPRYCLFGETVNFASRMESHGLPNKIQESHGLPNKIQISEHSFNLLISEHSFNLLSCFYHQFVMIERGKVEIKVS

SEQ ID NO: 152133 - protein, 23 aa, Heterodera glycines
  Coding regions on vcDNA: vcDNA=SeqID_78556; Strand=+; Position=1-70
MIKYGQIKRFESKNQKQKRTDQR

SEQ ID NO: 152134 - protein, 73 aa, Heterodera glycines
  Coding regions on vcDNA: vcDNA=SeqID_78557; Strand=-; Position=1 -36,101-286
MPEFSVVWVSFRSMHKLACRQFFGDKGRQTEVSNGRAERTESTDCGREALFAGKGPQRHSMNRNLLIESEAVQ

SEQ ID NO: 152135 - protein, 294 aa, Heterodera glycines
  Coding regions on vcDNA: vcDNA=SeqID_78558; Strand=+; Position=1 -175,452-645,1092-1298,1587-1894
MNFSAFNFAALCLLFCLCFHPSKNILNATTNSSPSSPKNIGIFTKLGKQNSNVVALKISGRFNSKLAKNKAVKVLARIDFPKDGKSRFNYENQLQIMLGNQKRLLNERIVLKQTIYKSNQKQKLIIPYEICALKSAKLEVENSRNLNKIDNESLKSNYTQILSGSQLIRIIANAMSREIDQFNNAMLLDKGDESVRRVGSSAFAGADEKEQLRFVGLVLWHLVFRDCPIIDPTADEFVFIAKVEPSIDATDPNVAMAFCAELDSELARKSQPKEQKEEKKVAEKMQEKIEKEFD

SEQ ID NO: 152136 - protein, 44 aa, Heterodera glycines
  Coding regions on vcDNA: vcDNA=SeqID_78559; Strand=-; Position=1 -27,535-642
MKSTAIPINQRNSLSNWSLSDLAPVERHHENCQQKFCKTVAKSH

SEQ ID NO: 152137 - protein, 44 aa, Heterodera glycines
  Coding regions on vcDNA: vcDNA=SeqID_78560; Strand=+; Position=1 -31,194-297
MSQCFTEFKGDLIKLKVFFFAFFFSFAYLKILANEETAVQADKQ

SEQ ID NO: 152138 - protein, 249 aa, Heterodera glycines
  Coding regions on vcDNA: vcDNA=SeqID_78561; Strand=+; Position=1 -190,253-417,470-523,827-857,906-1212
MNCFSSAVSRIQHARAHIYHSISDIGVHVDDNGFNRLFPQLLHYERATEPPQADITLTFIRPGATPSHSQIPSVVSQPPSRDSPPHSDSTPNPPSHSQQNNPTALNSLLSGFMSFAHQLLGGVPDQNHPRHPTISPPDDIVYLRVTRATMIFGMTPKLRVLAFFLRRILSLLPPTECKMFLRLLSIRHLMTFCWMECLTTNVAMRMLTWDLLKGLVLALLLRIPTHKRIINLQMSNGKRREEQKPTSCN

SEQ ID NO: 152139 - protein, 70 aa, Heterodera glycines
  Coding regions on vcDNA: vcDNA=SeqID_78562; Strand=-; Position=1 -95,345-462
MLLYSFALLIFTQFFGVFAQFFGVHSQKKTESLTICYPSLLATQKLENEHFMDEASINSKLFNIDVDYNV

SEQ ID NO: 152140 - protein, 67 aa, Heterodera glycines
  Coding regions on vcDNA: vcDNA=SeqID_78563; Strand=-; Position=1 -9,326-431,736-824
MIVANRASNELSNDTTMLDLVGKEKSYSPKTCVRMKTVRLSQDFFGALYFSHKNVICLGNIKYKAKL

SEQ ID NO: 152141 - protein, 146 aa, Heterodera glycines
  Coding regions on vcDNA: vcDNA=SeqID_78564; Strand=+; Position=1 -219,818-1039
MPASTNSMDAVTAAYYGLVQFCDDPNHRSLTLTLTAIALFVIYAIGILSQLVVLPANWRLSEQRSAFLLLLHINVFDLIWLFEYVWLSLEYLIGTRLIVKFSLDAFLFRFVNFCIDTFYIELAFNRCIAFLFPRLYNTICCEKSVR

SEQ ID NO: 152142 - protein, 56 aa, Heterodera glycines
  Coding regions on vcDNA: vcDNA=SeqID_78565; Strand=+; Position=1-168
MAKDPCQCLPTPPTFGRDAFVVTPSAQKFKWVTKWQWFRHNRLRWNSQIVISSMTT

SEQ ID NO: 152143 - protein, 54 aa, Heterodera glycines
  Coding regions on vcDNA: vcDNA=SeqID_78566; Strand=+; Position=1 -58,113-246
EENPLEIEAQNCLLDLRQELAFVDSLDPSLGQCLTNSRRLLISESMKLEEWHNP

SEQ ID NO: 152144 - protein, 57 aa, Heterodera glycines
  Coding regions on vcDNA: vcDNA=SeqID_78567; Strand=+; Position=1-659
VHFIIFLPLLSYFYHDLVRVLDKILARDFVVIFLVTDFHGIRYFPGTKTHWISISLV

SEQ ID NO: 152145 - protein, 194 aa, Heterodera glycines
  misc_feature (6)..(6): Xaa can be any naturally occurring amino acid
  Coding regions on vcDNA: vcDNA=SeqID_78568; Strand=-; Position=1 -90,142-178,230-257,305-364,685-722,1100-1152,1205-1285
  Homolog annotation: Hit_ID=CAE64437.1; Match level="QueryCoverage =75%, HitCoverage=23%, E-value=1e-40, Identity=61%"; Hit description =Hypothetical protein CBG09141 [Caenorhabditis briggsae]
QSIEFXLKITFFSLLPEADGVNVTIELHVQGISKISEITADFEGISKISEITADFELDVMYSLDVMYSEIWLDPRLSFKHLNVCTTNITLKEIWLDPRLSFKHLNVCTTNITLKSDFRARVWTPDTCIINSKGSSIHKSPSENTFVILYEHGLVWSNFKGQNYKIWTFVILYEHGLVWSNFKGQNYKIWCVNTL

SEQ ID NO: 152146 - protein, 83 aa, Heterodera glycines
  Coding regions on vcDNA: vcDNA=SeqID_78569; Strand=-; Position=1-252
MAFMARLRRHQAVHVRRPCRRRVQQQQFNRNIMESDIIPSIPNTLLAPMMALCRLRHQVQAVQQKQKQQHGQAVHAKQMRQLR

SEQ ID NO: 152147 - protein, 91 aa, Heterodera glycines
  Coding regions on vcDNA: vcDNA=SeqID_78570; Strand=+; Position=1 -200,259-334
MQMVPFELVNEWTKEKLTLAKENENELEDNCWIMKRCKIGEAAAVQLQKDENCNNVFFYLNANNCIGPLSPPPPAKEEGRRGIKHHKGAVF

SEQ ID NO: 152148 - protein, 102 aa, Heterodera glycines
  Coding regions on vcDNA: vcDNA=SeqID_78571; Strand=+; Position=1 -136,380-552
  Homolog annotation: Hit_ID=XP_309659.1; Match level="QueryCoverage =69%, HitCoverage=5%, E-value=8e-13, Identity=45%"; Hit description =ENSANGP00000003886 [Anopheles gambiae]
ELNVPTANAAIWSSASRKVGPPFVGKRPMSAICPNIATEQTQFVLDFCYQGVCGSREQQCRFIWGPTAKNSIAECYAYNEYGSFSGNCGYDQAKDQYHRCKK

SEQ ID NO: 152149 - protein, 119 aa, Heterodera glycines
  Coding regions on vcDNA: vcDNA=SeqID_78572; Strand=+; Position=1 -234,387-512
MATKPAKKGNNGTRGGIVPSLAEQRSLVAHPGYDTGGSTSSDEQQPTRTTVADQRAQQQQEQQTVIVAQQPYRNPLTMAVQQKQPKMPTKPPTIKVKEEKGGAEAKINVKAMAAKFEKK

SEQ ID NO: 152150 - protein, 26 aa, Heterodera glycines
  Coding regions on vcDNA: vcDNA=SeqID_78573; Strand=-; Position=1 -59,250-271
MAKEMTNDENKEEEEELWEKKFNLNR

SEQ ID NO: 152151 - protein, 124 aa, Heterodera glycines
  Coding regions on vcDNA: vcDNA=SeqID_78574; Strand=+; Position=1 -161,384-466,540-670
  Homolog annotation: Hit_ID=EAL31104.1; Match level="QueryCoverage =80%, HitCoverage=13%, E-value=1e-10, Identity=39%"; Hit description =GA10887-PA [Drosophila pseudoobscura]
MLCRRPHKICIIIAIIFLVFVPYCAAFCPPGCECRDDQFLVACNSSALTSIPILLNPMLKTLVITNSNGLKLDSFSIALYQQLESLELSNNQITRIPSNFLSRLTKLRSKIQLTANSFLLIADN

SEQ ID NO: 152152 - protein, 105 aa, Heterodera glycines
  Coding regions on vcDNA: vcDNA=SeqID_78575; Strand=-; Position=1 -43,1022-1111,1250-1434
MRPIRSRNSNDFLNVIEKRKPKIDTWDLAYRWHSKQTNEAPGEGKFFYVETIKLAQQLPNFVPNLMTPIAAVPKRRPSPYMKSNLSLNPNRAAFQVKKTAWPLAK

SEQ ID NO: 152153 - protein, 166 aa, Heterodera glycines
  Coding regions on vcDNA: vcDNA=SeqID_78576; Strand=+; Position=1 -213,340-373,805-884,974-1119,1639-1666
  Homolog annotation: Hit_ID=CAC33829.1; Match level="QueryCoverage =99%, HitCoverage=40%, E-value=2e-15, Identity=37%"; Hit description =annexin 2 [Globodera pallida]
MIEILATRTNQQIADLRNVYDTELAISDPQYRLLEAYIKEKTSGPFQHLLVSLLNESRDETHASDEEMAKKEAQQLFELRRKGLAAKSPWVSKNAAEFNRVFAKGSFSQLRKLFDYYKQIVVQHQKQKRHYKEEYDKSGKYDIEAAITNEFSGIDKDGYLFLVFCT

SEQ ID NO: 152154 - protein, 71 aa, Heterodera glycines
  Coding regions on vcDNA: vcDNA=SeqID_78577; Strand=+; Position=1-345
ELETGNFKFAGPVAGLEFKIFYRTGSGRINPANPAFKICRILRRIADFRKFQKILYYKKVFQSIKKYSIYF

SEQ ID NO: 152155 - protein, 425 aa, Heterodera glycines
  Coding regions on vcDNA: vcDNA=SeqID_78578; Strand=-; Position=1 -97,163-241,546-710,779-883,1082-1307,1716-1932,2309-2696
  Homolog annotation: Hit_ID=NP_509527.1; Match level="QueryCoverage =82%, HitCoverage=35%, E-value=1e-24, Identity=26%"; Hit description =sodium:neurotransmitter symporter family member (snf-12) [Caenorhabditis elegans] gb|AAC48222.2| Sodium:n
VDKFLEDIADMLRIQKLPSVDFFSSREHFMWRKFMHIIGPTGSYIKWMWSMFTPIVLTMLLIASILDYERVTFNGIILPIEYELIAWIVMIGPLLIVPGTAIYNIWDARRKNKPLKSVFNGSFRKRELDDEESKQPKHTQQQEGGLYDYIDPLSRGASTKSGVNRISRRSGVMQWQNDQQQQQQKHSASAIIDDDQKYQQVRERLRRWTEEEGSSSIGIQRSLTDRPEIEDDSAEENLEDETHDNRMPGRIREWHQQQLHGIAVSSSSSPTPPPLDYHCYQQQQKLTDTSISDNQRKCESPFLFGPPPMQAILSAGSIHSGHPTDAVDDCRNESAATSDIIKTKITRQHGDDGIIGQNDKNKNLGIQKFHQSSSAIELDEFGKSCLGSVSVFNVPFRQQQQQQQHHDQQFSLSSPIRTQPNWRSS

SEQ ID NO: 152156 - protein, 121 aa, Heterodera glycines
  Coding regions on vcDNA: vcDNA=SeqID_78579; Strand=-; Position=1 -24,1153-1326,1779-1851,2055-2149
MALSPLSQESAGRSFYLFYISKLIFFFKSCPIGITRVNLLHFLCCLGLLLPVVCFAWHFRAGRHGTVGQKRTCLINLFQLEFSIGAESHNVFFGVFKGLGSIGWAVSFTATLPYFLVDKIN

SEQ ID NO: 152157 - protein, 169 aa, Heterodera glycines
  Coding regions on vcDNA: vcDNA=SeqID_78580; Strand=+; Position=1 -212,464-539,960-1071,1211-1320
  Homolog annotation: Hit_ID=AAG23825.1; Match level="QueryCoverage =94%, HitCoverage=21%, E-value=6e-27, Identity=75%"; Hit description =guanylyl cyclase [Heterodera glycines]
MPGNAVLAFTTPSTPVANQTLIKVAMLVAQNDTDYGLPRKNAALRDSGGAIPMALEQLWADEILPKSINFSAPNAWPFGFQFQLANDGLGTEHGVDKAVGEQSTVSINFKARIFNTQTSDLSTIVNGLRKRARIILLCFDDVTQLRTFALSLFDGGLKTKVRGMPNYAN

SEQ ID NO: 152158 - protein, 248 aa, Heterodera glycines
  Coding regions on vcDNA: vcDNA=SeqID_78581; Strand=-; Position=1 -11,71-346,397-820,1267-1302
  Homolog annotation: Hit_ID=AAL78214.1; Match level="QueryCoverage =57%, HitCoverage=74%, E-value=3e-12, Identity=33%"; Hit description =putative esophageal gland cell protein Hgg-20 [Heterodera glycines]
MNRRWICGDVWMDILPSFDRPELGLKMALLSDRFDVLVDKHFDGKSEFTIWKAIEIRKDEEPKAKLSVWTDDKCVAFPLPDRPLPIKIRFKDLQIHYIDHSVLTFLRSNKPIWDRSGTNLELYIEYCDQRIWDVLDRQIWPIFAKSIRHFGFHDGDDLDKLRRRISPTILTDVDQLNSIDSGALFPDGIADDGPNATAGQALTKWLHTPSKDGQPKQLYRNNYFGPPKLEWVNNFKEAIVAASGRRSG

SEQ ID NO: 152159 - protein, 120 aa, Heterodera glycines
  Coding regions on vcDNA: vcDNA=SeqID_78582; Strand=-; Position=1 -61,477-777
MPRCCEGPTHRGQMLSCHGDGQFVLASVPLQFDAEMQTDGQTVQNVPRPNLRRGHQRTAPPHQKLADLRAYALRAEVPVSGGQICGQQISNHKTAGGGVLAEHIWGQVQIVENAKLGMPE

SEQ ID NO: 152160 - protein, 16 aa, Heterodera glycines
  Coding regions on vcDNA: vcDNA=SeqID_78583; Strand=-; Position=1 -44,117-123
MLQMLFGRNWQLFRTC

SEQ ID NO: 152161 - protein, 64 aa, Heterodera glycines
  Coding regions on vcDNA: vcDNA=SeqID_78584; Strand=+; Position=1 -30,1269-1433
MNGVNQQNGVVPPEKQSLYKPTNEQRTEWEAMDEKQTLHELGFTMKNARADGKTADLCGKVVPL

SEQ ID NO: 152162 - protein, 108 aa, Heterodera glycines
  misc_feature (2)..(2): Xaa can be any naturally occurring amino acid
  Coding regions on vcDNA: vcDNA=SeqID_78585; Strand=-; Position=1 -176,411-562
IXSLERVSFLADSLFRLFTKFYECIKWHFRQSPNKSEIEKFGAAILKFGRFVCGTLREGDNAGSFCLPSSTTIGTELLLPSTLRKIKQKTKGRKEQKTITGRIKVSTE

SEQ ID NO: 152163 - protein, 96 aa, Heterodera glycines
  Coding regions on vcDNA: vcDNA=SeqID_78586; Strand=+; Position=1 -172,1663-1781
MSMWPISWAAILEIKNVIKKGGTKTNLRKRVSFMTIRRKHVLCSPNSSSVAVHMPIEKFKAFKIISFRLPDNPTVDNPTVRTIRQKWTIRQWTIRQ

SEQ ID NO: 152164 - protein, 36 aa, Heterodera glycines
  Coding regions on vcDNA: vcDNA=SeqID_78587; Strand=-; Position=1 -107,268-271
MKRDWTIRQWTIRQLDNPTVRTIRQKWTIRQWTIRQ

SEQ ID NO: 152165 - protein, 55 aa, Heterodera glycines
  Coding regions on vcDNA: vcDNA=SeqID_78588; Strand=+; Position=1-165
MFFYALDDDQRPNDSNQQQQMISRWFEIDEQTGQISAISAPPIGIDQQRKTVKFG

SEQ ID NO: 152166 - protein, 111 aa, Heterodera glycines
  Coding regions on vcDNA: vcDNA=SeqID_78589; Strand=+; Position=1 -52,572-790,867-931
MSQALEMVKLIMCGYCLDSYFTKVGDGHIEFVWLLLKDSSGKNESAGAVILKSSLSESVEYQKIIFKKETELQKTQNALTDNLIKGYKIHKTFTNRVGNGKIDYVWVMVKD

SEQ ID NO: 152167 - protein, 269 aa, Heterodera glycines
  Coding regions on vcDNA: vcDNA=SeqID_78590; Strand=-; Position=1 -71,776-1139,1353-1727
MIGKVPDERRIAASTFLNLDKTEGLSSLFIAKTSEKWQKLCQMKVFEEEIGTLKKELGNGINKLAMQKKEDKTTTSKTNENKDILSKKIMAKIKESPKKVTTKIKEKRKEDKMEQNIELMDKMNVIEGQMGEFCAKFAEFEQICDPTKLFLKGLAKQIEAVKNDLVPELEVLINEKKLENAGVKSTKLLFELADFQLKIETKLRKYEEIGREISQNLVHLKHGRAKKKALTDAIQQNANSAKKHMENIGKMLKKIKNSNSKKMGDSASN

SEQ ID NO: 152168 - protein, 60 aa, Heterodera glycines
  Coding regions on vcDNA: vcDNA=SeqID_78591; Strand=-; Position=1 -45,452-589
MERTAGGLSLAFDCQLVDLMPAMFREEEQKIDDSEDILPLSSSSSLNIQNSLDDLMKLKK

SEQ ID NO: 152169 - protein, 223 aa, Heterodera glycines
  Coding regions on vcDNA: vcDNA=SeqID_78592; Strand=+; Position=1 -140,200-309,356-551,817-1042
  Homolog annotation: Hit_ID=CAE58522.1; Match level="QueryCoverage =99%, HitCoverage=68%, E-value=6e-84, Identity=69%"; Hit description =Hypothetical protein CBG01674 [Caenorhabditis briggsae]
MGRLSFDKEGSIAKALSLIKLYEEEGIEKERILIKLSSTWEGIEAAKVLESQHGIHCNMTLLFNFYQAVACAQAKVTLISPFVGRILDWFVKNSDKKEFDRITDPGVQSVKRIFNYYKKFGHKTQVMAASFRNTEEIKGLVGCDLMTISPALLGELAKDSEAVGPMMTVENAKKCELEQIEVDEKIFRWQMNEDAMADEKLADGIRRFAVDAIKLEELIRSNL

SEQ ID NO: 152170 - protein, 126 aa, Heterodera glycines
  Coding regions on vcDNA: vcDNA=SeqID_78593; Strand=-; Position=1 -66,515-705,841-964
MERDKRKYMSSRFSITEQGEFSWHLPKGRFDHHGTAEDMLRCVQLNLRRLVDRIPDALMHRGWVLDGEKGNFLRRLAAVRTIDSLRDLLMLYEAAIRRPVFLPIWWQSLSATRFVNTLFLNKKIGT

SEQ ID NO: 152171 - protein, 31 aa, Heterodera glycines
  Coding regions on vcDNA: vcDNA=SeqID_78594; Strand=+; Position=1 -88,137-144
MKNGPNATFTPFKSGHSFVVIINSVPKGKGQ

SEQ ID NO: 152172 - protein, 146 aa, Heterodera glycines
  Coding regions on vcDNA: vcDNA=SeqID_78595; Strand=-; Position=1 -154,255-333,819-888,1233-1265,1782-1886
  Homolog annotation: Hit_ID=NP_610224.1; Match level="QueryCoverage =95%, HitCoverage=65%, E-value=1e-15, Identity=34%"; Hit description =CG17266-PA [Drosophila melanogaster] gb|AAM70809.1| CG17266-PA [Drosophila melanogaster]
MSPQYTKWMEFNASLAHPSDPVVFLVIFSFFLSLLFFIIMFKDIESDSASCGRIIIDLMVAAVPQTTENFKQLCAGALTLPVNGAQIEYGYRGTNFDRIVKDKYIKGGKIEEVLGCKSLYGDYFADENFSVAHDAPGIVSMVMKWK

SEQ ID NO: 152173 - protein, 89 aa, Heterodera glycines
  Coding regions on vcDNA: vcDNA=SeqID_78596; Strand=-; Position=1 -243,468-494
MTSSMTTQNAKVKLRTPILFEYFYYYFVIHTLNPSLDNNFFRKSHSRLRGLGEDLPSEIFALKFFLRKNKEGSVNLFFLTRRNSPKKEI

SEQ ID NO: 152174 - protein, 31 aa, Heterodera glycines; identical to SEQ ID NO: 152171
  Coding regions on vcDNA: vcDNA=SeqID_78597; Strand=+; Position=1 -88,137-144

SEQ ID NO: 152175 - protein, 34 aa, Heterodera glycines
  Coding regions on vcDNA: vcDNA=SeqID_78598; Strand=-; Position=1-106
FLGCKSLYGDYFADENFSVAHDAPGIVSMVMKWK

SEQ ID NO: 152176 - protein, 78 aa, Heterodera glycines
  Coding regions on vcDNA: vcDNA=SeqID_78599; Strand=-; Position=1 -154,255-337
MSPQYTKWMEFNASLAHPSDPVVFLVIFSFFLSLLFFIIMFKDIESDSVSCGRIIIDLMVAAVPQTTENFKQLCAGAL

SEQ ID NO: 152177 - protein, 87 aa, Heterodera glycines
  Coding regions on vcDNA: vcDNA=SeqID_78600; Strand=+; Position=1 -72,154-294,468-518
MTIKGTGCVNSMNFVFFLFIFMTQVFIFWAILLNVPSRLRRIGGLRPRRRPPVFDDVDTRPLRPLHLLVREDSTGTRNRLSTIQEVK

SEQ ID NO: 152178 - protein, 162 aa, Heterodera glycines
  Coding regions on vcDNA: vcDNA=SeqID_78601; Strand=+; Position=1-489
MSTLPPRHQSHSEASDFFSPIAAATMAMDVEQKKPNPKPRQQQTDASNFFGPISAATMGMGAEQLKPTIKQQQNQQQNGVASEFASAISAATMGMGNEQRQHQPPPQKEKEQTDQEILDEFLESVSAATTLLDVPQKKPKKKGKKEVEDEEAAAIASITRKQ

SEQ ID NO: 152179 - protein, 137 aa, Heterodera glycines
  Coding regions on vcDNA: vcDNA=SeqID_78602; Strand=+; Position=1-414
MAMDVEQKKPNPKPRQQQTDASNFFGPISAATMGMGAEQLKPTIKQQQNQQQKGVASEFASANSAATMGMGNEQRQHQPPTQKEKEQTEQEILDEFLESVSAATTLLDVPEKKPKKKGKKEVEDEEAAAIASITRKQ

SEQ ID NO: 152180 - protein, 976 aa, Heterodera glycines
  Coding regions on vcDNA: vcDNA=SeqID_78603; Strand=+; Position=1 -1855,1906-2981
  Homolog annotation: Hit_ID=AAA93301.1; Match level="QueryCoverage =33%, HitCoverage=87%, E-value=2e-47, Identity=33%"; Hit description =HASI
MASKFVLVPDEIYRGLTNSDSENINLDFVQRALERTKRKGENVTAKNVHYNQELSRYLHLRDEDQNKPSKVEITKGLNALIKRGNESDEEEQVFNLESDRSQQPASQISRPRRHHHHHNNDDEEMPLQPAFPALQAENRGQKRKANDFYSSWEEGAKRQLRHEDETVPSSSKIGNRQRRRQPPLSLRREQRQIPAEIQQEEPFQPAPEPSIPIHPQINRKRKAHNALNDVREIKKRLIGLEELRPPSLQQEASLRFQQKRTNKPRVNQPQHSSSSALVTRRNPQRNLLAEAAFAPLPDNDDGDDFELSQPPATAAQAQPLPPRPSLPSKTKKRKSNKAEEDTERKRIKISSRKRDLLAEAAAAPLPVNDDGDDDFELSQQPGTSAQAHPPGPPLPSKTKKRKSNKDEEDTEGKRTRIGSRKRLSSPTVTKNEPKRQKSSGNEGLSEEQRRQFADDQRLFTIPNSQLTNEQKRRRLQFVFNRNPVKYGVRGDTILNNAGNPITDSSVTQALEYIIERRAGRVPQFRQPPGTKIIQNRINRDLILRTWTAPPVPPRGAKRKLPQTDQDAELNQKSQKIRGLGQARGRAQEGLMLPFPTRGVKRKTTVPPEAAMEIPSKTQHRLYNDPNSPAAFAGVNRLWLEAKKELGYKISKKDVKHYLEGHRTYTLMRPRRINFPRSRTTAAGFMTDCQVDLADFQALSRHNSGNRYLMVLIDVLSKQIFVTPLRTKKADDMIEGFKQLFSQMPMKPYRIFSDKGTEFKNQQLKKLFDEEEVEKYESNHSEKKAALAERAIRQIKNRVYRYFAQLKTLNWFDVIYKIVNGINKSPSRVHGMRPIDVNFKNSQKVWEKMFGEEQHRSLFGKHRKRPKFVPDQNVRMSIAKGQFEKGYIPNYGDEILEIDAVKRHMKPMRYKLRDAKGEKFKGFFYPEELTPVRKETDTTYRIERVFRKRKRTDGTMEVLVKFIGYPEREWIHETQLV

SEQ ID NO: 152181 - protein, 195 aa, Heterodera glycines
  Coding regions on vcDNA: vcDNA=SeqID_78604; Strand=+; Position=1-588
MSNSTPSSPPSKRSRRFFIDELLREPYNELSNPRKSPKDYVKKLDSEIERVPKFQWLKNKSTFIIEDVPADPEGLLIGIFQHCMDEAMSESVLGGIKPTHLGCIVSSQLLTSDIWIPIRQITPDTINTILNRFNDVAQSKKQDGVTLWGQPFNVTVITVNRKGLPEKRQLKGGAPRKLAPVNHQIHEQCLIKVFK

SEQ ID NO: 152182 - protein, 517 aa, Heterodera glycines
  Coding regions on vcDNA: vcDNA=SeqID_78605; Strand=+; Position=1 -245,289-580,620-899,939-1226,1267-1358,1402-1758
  Homolog annotation: Hit_ID=NP_001004509.1; Match level="QueryCoverage= 85%, HitCoverage=29%, E-value=8e-57, Identity=32%"; Hit description =si:busm1-180o5.3 [Danio rerio] emb|CAD60788.1| novel protein similar to DNA polymerases [Danio rerio]
MDFITERVPNVEIFWQCEIEAMLVRDKQMKTKFSEYTGDGGPIDIRSCFMGGRTGALKLYHEAAKHEQISYYDFTSLYPYINYVTDYPIGHPTLHVPCEDVDWRRPEDNPYPLAILKVFVIPPRRIDVPVLPVKVDDRLCFPLCMKCCKKFPNGAVKAAYSCTHNDRERGWISTCTSLELNAALEEGYRVTELLRVLEYSKSDNELFRPYMSEFVVQKLHASGFDQNIRGNLEAEEQFIAECCEQFGMKIDRNKMIPNKGKRALAKLAVNNLWGRFSLRNYGLSQTLITDDPSELGNYLDNKKIDVTGLDMLTPDRILISYQQKKDWVKEHPCSNVVVSLFTTSAARLHLLKAMQKVVRTPGCVLLYTDTDSLIYAHPIGKNPLSTGPHLGQFTDEFPDHDILEFVSGGSKQYGLKLRRKGTEKIEHMLKLRGITLNYDVTENQGLRFDTFKEKVLQFARTGNVEPIKAVYPNFLRPTVNAGSVISAPLQKIYKPYVSKGIVCSRDFRVIDFGYVAQ

SEQ ID NO: 152183 - protein, 177 aa, Heterodera glycines
  Coding regions on vcDNA: vcDNA=SeqID_78606; Strand=-; Position=1 -524,611-620
MLLTEKIAQILNCRVSELRDRLNHPSDFKHVVKALKGCHVQTTYKDRNGFTKSFLFGGITPQGASTTMAYGRLGRPFNVNVTAHFYVRHRIKLRHPFLHCVIERFPEGQEDRFYPLELCKINAGQIEPGWLGRIFTETGSDNNNNINTDENASTETSLISSGRQECSQSDGYSLCQN

SEQ ID NO: 152184 - protein, 120 aa, Heterodera glycines
  Coding regions on vcDNA: vcDNA=SeqID_78607; Strand=+; Position=1 -55,99-253,298-450
MPTPPHDNKIYKKSEYLKVDDADEVDTDPSPEEVEKWTPEQVIEWDQRSYEKMPAEEEIWQEFLDKGEANVLREFFGGEGALKVEKSLREYAKKKEQRDEILMRKRKEYEEKMENNKGEN

SEQ ID NO: 152185 - protein, 338 aa, Heterodera glycines
  Coding regions on vcDNA: vcDNA=SeqID_78608; Strand=+; Position=1 -159,239-380,479-541,590-643,695-751,802-1343
MSDSTNDAIRELQRALREQQRTIFVLRSQMVDHRAVILQTVARTEALEGYAANSRGGRFRSRYSPMVALEMTTIGRRLEERQQRRHAQAHASTNSSSPGRGQGSNEPSVGAIAVNSGLTETFPPTPLSSRGQNSAPLRQNTAGAGPSTGIADGGAESGGQWFGPTIENHMNRSRLRLVREEMAHRTMQQQVEHQHQQLLERAERVRQANVEQQMEEADVLQEQLQQQDEENDENRDPEMEQRRLVQVARQAEYERLVRLQLREARRFHNGVASSVVVPPPLFWEEECVICTNARANFYNRQCGHVCLCAECAVTAVIQKLTVCMMCRAPVNGIYPYVR

SEQ ID NO: 152186 - protein, 141 aa, Heterodera glycines
  Coding regions on vcDNA: vcDNA=SeqID_78609; Strand=-; Position=1 -67,266-469,894-1048
MSILDFLYSMPRRLFCAYFAIFGLLEALNGLRNIKVDNYLIELEKVSEEYQKQWKRFENKNLNEKEQKEIVKRMGEENAKLWELMKEIGLDWASMCEAGKEFFSQILKKSKCALNDGSMRGGEAESEEEAGQADQPISSPK

SEQ ID NO: 152187 - protein, 91 aa, Heterodera glycines
  Coding regions on vcDNA: vcDNA=SeqID_78610; Strand=-; Position=1 -188,607-694
MLALQQARVVPTPRQWSLWTAKFNFKYNSKRAPDFSDRGLFDSKGHFDRNIINFRRGLFDSKKKFSKILFCEDTVHCGPGRTSDELRNGGD

SEQ ID NO: 152188 - protein, 88 aa, Heterodera glycines
  Coding regions on vcDNA: vcDNA=SeqID_78611; Strand=-; Position=1-267
MHHFQFWSNLFPILVLITSIVVLSANEVVEDGTTEEQDMAKALALSKTYYWRNMVLKWDCKKEKMISPEQIGYKQSHEKCWRFANIGK

SEQ ID NO: 152189 - protein, 79 aa, Heterodera glycines
  Coding regions on vcDNA: vcDNA=SeqID_78612; Strand=+; Position=1-240
  Homolog annotation: Hit_ID=AAP30775.1; Match level="QueryCoverage =94%, HitCoverage=42%, E-value=2e-21, Identity=70%"; Hit description =putative gland protein G32E03 [Heterodera glycines]
MKAAAVPKAAAAENAQKGPLSAEVVAEENNLDTEAVDDDLGVEASDIDELAEDELLEDDAMDSKADAFLDMGEEAEMDS

SEQ ID NO: 152190 - protein, 154 aa, Heterodera glycines
  Coding regions on vcDNA: vcDNA=SeqID_78613; Strand=+; Position=1 -17,644-874,1844-2060
MKNARKTNHKVCNWLIAFDSLCQLFVVAPFGVNAIGVIFQYSSIDYRFCLATLMAATVASYASIMAMYLISVERLLIIMYPINCVYCNSGLYADVLNTVPSYVILLMCTLNYAAIFCLILWRHQTNKGSTQTTQQSAAKCCQLSDFNFIFYFHI

SEQ ID NO: 152191 - protein, 45 aa, Heterodera glycines
  Coding regions on vcDNA: vcDNA=SeqID_78614; Strand=+; Position=1 -135,197-199
MTPILTLHQIHAFHTKTRERNPQKGENAKKQDETDFPSPPRKTTK

SEQ ID NO: 152192 - protein, 175 aa, Heterodera glycines
  Coding regions on vcDNA: vcDNA=SeqID_78615; Strand=-; Position=1 -189,913-1100,1477-1629
EEPPTGNSSTATTDPVAMMLARRCAPSPMRTPPTSTSSGAAATAITIGTPQCPGTTITTAEEENDDQQQQQATTTSSASSTPSAAQQQQQQQTSLNKKHPEMDNAKRRLLLDPFIHQSLYTPKRSIFGTQAGAYSQVADSNELLLAEQSATVAVEGLVRTSFVEWCAKTWTGVRF

SEQ ID NO: 152193 - protein, 73 aa, Heterodera glycines
  Coding regions on vcDNA: vcDNA=SeqID_78616; Strand=-; Position=1 -165,585-641
MAEETSKTSENIAEDNGIKALDSLFAAVAHASKCLAFAAGTPNFCLATPAFLAVMVWCCFLMPVMVKWGEGII

SEQ ID NO: 152194 - protein, 140 aa, Heterodera glycines
  Coding regions on vcDNA: vcDNA=SeqID_78617; Strand=+; Position=1 -16,506-606,873-1036,1602-1743
MLVDKVEQISKLIDDASHYTNEMLYSIFAGWIGANAAVKRDGLILICVFLVLANADINDERKRAMTYAINHHFINCIGMALAGVGAHYPTLTSRLMEKLKDFTLDDLFKVLALQDKEFEEWLRELKLLYTPLVFVTVATK

SEQ ID NO: 152195 - protein, 339 aa, Heterodera glycines
  Coding regions on vcDNA: vcDNA=SeqID_78618; Strand=+; Position=1 -209,878-1052,1134-1303,1513-1699,1751-1805,1875-2033
  Homolog annotation: Hit_ID=NP_492462.1; Match level="QueryCoverage =92%, HitCoverage=64%, E-value=1e-164, Identity=56%"; Hit description= limpet (1J758) [Caenorhabditis elegans] emb|CAB02980.1| Hypothetical protein F25H5.1a [Caenorhabditis el
FQLIFAGEYTKAMNKDWHGDHFCCWQCDSQLTGQRYILRDDHPYCIKCYEEIFANVCDECQKHIGIDSKDLSYKDKHWHEDCFLCSMCKVSLVDKPFGSKNERIFCSNCYDQAFATRCDGCGEIFKAGMKKMMKKMEYKGKQWHDKCFCCAHCKTPIGTRSFIPKNEEVYCAPCYEEKFATRCCKCKKVISTGGVTYKNEPWHRECFCCTNCNTSLAGQRFTSKEEKPYCADCYGELFAKRCSACVKPITGIGGAKFISFEDRHWHNDCIGGAKFISFEDRHWHNDCFVCSQCTASLVGKGFITDGADILCAECAKARYGGEQLNIHLRRHFYFAPPPS

SEQ ID NO: 152196 - protein, 205 aa, Heterodera glycines
  Coding regions on vcDNA: vcDNA=SeqID_78619; Strand=+; Position=1 -279,504-842
MFLHFSVNAAEANELLEDDDDRAATSSSAPSLPKATATTTSLVKPYTTSDPFGSRRPPISSTIKSLLAKFEPSAAKPTDPSFASAKPNGLGTKASIKPDPSFVGDASAVPFSSSAVSPTISGATTTGTDSSATAVGVEQQPVHADDGDGRLGDEEVDEVAEEVRLELEQDALVVFTDICCWDLHMRFFLDKEGKFTSRKCCNRSE

SEQ ID NO: 152197 - protein, 158 aa, Heterodera glycines
  Coding regions on vcDNA: vcDNA=SeqID_78620; Strand=+; Position=1 -72,573-977
MAIGRGGDAGSHSGIGAEQQQQQQRVQRGDEQVEQVVQQQKTPVVVVDSRVSPVQRKPSRTVFNESNEIVDNEQQQPYPWQQRRQNANSSSSCSDVRDSVSLSAGDNEADDDFGEDDVDHTVEVCGAMLWMGPSGYYWHFMLCANHWVRNGTSTVGQL

SEQ ID NO: 152198 - protein, 388 aa, Heterodera glycines
  Coding regions on vcDNA: vcDNA=SeqID_78621; Strand=+; Position=1 -356,635-827,931-1140,1899-2050,2342-2597
  Homolog annotation: Hit_ID=XP_515539.1; Match level="QueryCoverage =97%, HitCoverage=60%, E-value=1e-21, Identity=25%"; Hit description =PREDICTED: M-phase phosphoprotein 10 [Pan troglodytes]
ITAEIDQNDGPLVEEKKNKKNDEKEEKRRETKDEEVSEKSSDREEEEQEEGGGEDELFSEDERIDEVGEDQDVAEGGTKATLKGTGNDNGTLMRDQSDDDEEEEEGEIVEEGAEDANECYEEDIEDPKVVQQKRGKLPKSAVDDKFFNLAEMNAFLDSEDKKEEDKMRQRSVRNLGQIENAEELEQLISAHEQSNLQPREWALSGEAKAEERPKDALLEQYVDADYRMAAPPTIDAEKMAQLEGIITKRIKDGEVGPQAAVGPEVNLLAPEEVKRRVKSAPKGTDERTETDRKRQRRQKKKKQRILASIGAMNGEGTDGGETAERVKTKKKVRRVKMDFAEQINKLVQNEGEQQLKKKKKRKIVEENGEEKKSKKMKKKKSKVGGEKE

SEQ ID NO: 152199 - protein, 366 aa, Heterodera glycines
  Coding regions on vcDNA: vcDNA=SeqID_78622; Strand=+; Position=1 -414,478-481,517-894,961-1265
  Homolog annotation: Hit_ID=AAO61963.1; Match level="QueryCoverage =37%, HitCoverage=53%, E-value=1e-12, Identity=33%"; Hit description =DNA polymerase [Aster yellows phytoplasma]
MDAVTQQQQQLPELLKHVPVLVCAEVICERCIAYGVDIEREPLRRAPQCQCGVPWRGANRRRWCSRIGEEQFDDDTCGPATAQQQQQQMPPDGLNPRRLRFFCDGEPGTGRGAMAQFVDFLLHTGPKGTRTVMLAHNGGPAGRAAEEGGPARAARLHAGAARDSPAPADLQRLAELLPRSARHPATHLWAARGAGQAVFPYHHIREQNLDVELPAGTLPPPAAYDPDRMRAAQRDDFMAWYERELHRPGRQPFVLRRELLRYCWNDVRILRAACLRFRELVGECADGMEPFLAATTIASLSMAVFRQHHLRPHTMVHTPEGGFLRGRRASAESRRFFALLAAMRPDLGPLRTARWSVGEMVMDNSS

SEQ ID NO: 152200 - protein, 167 aa, Heterodera glycines
  Coding regions on vcDNA: vcDNA=SeqID_78623; Strand=-; Position=1-504
MATDIKTILLRLSSIETLLSNNNNNTLATQMAEQFNAIAERLNEIERKINSNNNDNSSAEEKERKRSLVLIGLPEAVAEKPSERAKEDAETVAEVLDALDVEVCPQMVYRMGRRIDEKRNGQSCLASDDVPTFCIGTMGAQPDGTEAACWLAATSRQALSDERRIGG

SEQ ID NO: 152201 - protein, 238 aa, Heterodera glycines
  Coding regions on vcDNA: vcDNA=SeqID_78624; Strand=+; Position=1 -11,71-256,398-830,882-968
MNRRWICGDVWMDILPSFDRPQLGLKMALISDRFDFLVDKHFDGKTELTIWRRIKIVKDEGPKAKLYIDHSVLAFLRSNKQIWDRSGTKLEVFVPLYMTDVKLIWDVFTREIWPLFARNIRHLSFHNADALDNWRRRTSPTFLTDLDELVSIDSVGLFPDGIADDGPNATAGQALAKWLHTPSKNGQPKRLHRNNLLGPLNLEWLNNFKETFRRATTSVSYNIQFYLRVEPMPTAGQK

SEQ ID NO: 152202 - protein, 196 aa, Heterodera glycines
  Coding regions on vcDNA: vcDNA=SeqID_78625; Strand=+; Position=1 -329,455-716
MDELNIFAENYDKKLMIDKQQSLKELLAILMKIYADYSNASKREISKNAIRLTHSGNVTLRFGQILYETIENLENLPEDRVKYDENEQLLTIPLLFVNHLLERLNEFIERNLKENSKISDDFDFVLTLQTVAEESTELEAEKRQKPISAGVNVNLFQLLFSLAIRLCLLIDEKEKLAEKYLPKFVFALKMCTTNTG

SEQ ID NO: 152203 - protein, 61 aa, Heterodera glycines
  Coding regions on vcDNA: vcDNA=SeqID_78626; Strand=+; Position=1 -16,68-133,189-236,688-743
MDKAENKEIVKKLSELMELIKLKRVEKVKGLKEKFVELLEKDEVLYPSKKTSVPKNFHFAY

SEQ ID NO: 152204 - protein, 300 aa, Heterodera glycines
  Coding regions on vcDNA: vcDNA=SeqID_78627; Strand=+; Position=1 -18,74-179,287-469,619-705,756-938,990-1115,1158-1357
MISLTELSLTDQSNQERLKNAHVKPNEIDEKGTKNHKGKKKAVKIYSKEEKLQLLKKFQKRKKEFKMDDQINAFNRMEVAIAQELGVSIRMINEWKREFGLTIRRIEEAVARELGIGRTTLKKWKKQLGLTAKKSYSKEEKFEVILQFHKRNIEFKKDEILNSYNKIVQAIARELGVSRKNIYKWKKELGLSNEQWLELIRGRMNEFEKDENPNEFNNAEDGIEEEMDNCHVKKESKIYSIKEKLELLEQFQKEKNASKKNDELNTLRKIDAAIAKKLGISRTAIYRWKKKFGLSGLSSD

SEQ ID NO: 152205 - protein, 114 aa, Heterodera glycines
  Coding regions on vcDNA: vcDNA=SeqID_78628; Strand=+; Position=1 -87,817-1076
EKIEEVIARELGICRRTIRRWKKEFGLTTFQHQNGQKNKADSLNAEFNDQNGQSSFIKRQKHVNFEENSPPNSSPISQSISSDSPLNNELHEKLVSLRTNCFFLDSRFRIDFDF

SEQ ID NO: 152206 - protein, 395 aa, Heterodera glycines
  misc_feature (17)..(17): Xaa can be any naturally occurring amino acid
  misc_feature (93)..(93): Xaa can be any naturally occurring amino acid
  misc_feature (393)..(393): Xaa can be any naturally occurring amino acid
  Coding regions on vcDNA: vcDNA=SeqID_78629; Strand=+; Position=1 -185,720-821,920-1031,1213-1288,1331-1473,1518-1564,1814-1860,1977 -2127,2328-2443,2786-2888,3200-3217
  Homolog annotation: Hit_ID=AAH86264.1; Match level="QueryCoverage =89%, HitCoverage=27%, E-value=1e-74, Identity=42%"; Hit description =Unknown (protein for MGC:79647) [Xenopus tropicalis]
SERSIIIYQKTKTRQLXRKFTAKFVTDFAINFFDSPLNNELQEKLSSLKTNCFFLDSRLFRKFTMKYVRESGLLHPLLFSEPPEKLGMRFIKXFFSFNYISELVGGERRIEVFDVHTQEGKNMRLKEFVKYFRQSPSMRKNLLNSLSLEISDTKLSEQVIAPGFVRRIDWIDNVWVIAPGFVRRIDWIDNVWPKELLARQKNLLKESLGTKQRFSYPKVQKYCLMSVANCFTDFHYCLMSVANCFTDFHIDFGGSSVWYHVLKGEKIIFWLIEPTEENLKLYEEWFLGGNGDSKFLGKLTKCSRVRLRQGETLIIPSGWIHSVYTPVDALVFGGNFLHSYAIPTQIRISTLEDNIKRGKKYRFPHFKQIFWCFIAQIVRKCTHRLYQKKLFQXTL

SEQ ID NO: 152207 - protein, 67 aa, Heterodera glycines
  Coding regions on vcDNA: vcDNA=SeqID_78630; Strand=+; Position=1 -78,179-304
MANNGPRLNLDGEEICYNEFLGNAIDGSYTFNPIQSVYDNKDKAKFTPTKNYNIGTHKNINRLSFIN

SEQ ID NO: 152208 - protein, 1264 aa, Heterodera glycines
  Coding regions on vcDNA: vcDNA=SeqID_78631; Strand=-; Position=1-3792
  Homolog annotation: Hit_ID=NP_504186.1; Match level="QueryCoverage =30%, HitCoverage=46%, E-value=5e-32, Identity=24%"; Hit description =vglm uuk m polyprotein like family member (5E780) [Caenorhabditis elegans] gb|AAB63927.1| Hypothetical pr
MLAGGLSLSLLCFIFTMCSMVGYAMAGLRILFWIFSVLFARLFKPRKETWVLSEEEENLLYPHRRIRRPRPATRNWASGRVSQMTMLVMASLPFVHGGIETVAIMAKSESCLNNGTTKMCQVKGSVTLALLPVGQPNVLSMKTDDGLILGTLQVILKGLSLECQAYTKAWKRSYEIASVASKRCPSAGSCVGDFCTKVPPSTAIRELRETETFPGNSFCIDSTAFWGNQCLLAASSCLFYKWFAKPRSSAINEVIGCNSWEFGIHIQLRLDSTTGRSATVETVLLPGRVLKWHNISISTIGVSQAPAPLLNADFLIEGRSVAIVREKITDSFHCTDLKAAQAFNCTLGIDACTGCLPDHTDGTVSCHCRVANLEGLMEDPQRRLPLSFRHYELRNHGRRIFAITGYSPVQMNIQMDSLQMSLEMHQSLCTITPKHISGCYKCATGAQLSYSCHTDIGQTLADIQCEDGSHFTSKCGPNITDHTVVLPFQHAEISTTCQVMCLAGRTKFSLVGQLHYIPLRQQSEFGARVSESLEEASNSGWADFSFDWKSTFQALFGLKTGLIFFIVLMIGIVIIIFVVHFSPVYKLWRTFAWLLMNQAPRPNNATTFSVAAILFLAAGGSFGWEPRKGDSFPVSCGELRIPDPEFSFREAEVNTVPLHQKIDYRNRSPKTDIKEGNLMTISFLRHHQAPNNTQRLSKTMPIPFRERPPFFSAPTISRPTNEVVINDRLVIDIIGQYEAENGQRANNAPQPGADNAPPPWAEDQRGPWWFDQDWGPQLPMVPENSGQNRQMDDQRDDWGAHAPPQREPSPREHTERLNSWVERHHGQQWYETASIRRDAEEHLRRELRTGATLFAAHLGPFANVYFDGFSRFGPANTRMFPGRTVQEHFRRRGFQVDPNLPCLQEYGGFSNSQQGIHVDYFPIDMVNVRFQIGADQREAEPPRLPRIRAYLALEEAPNDQEGPNRGPPSRRFFEAIGLRRGNPNVGEMAENNGRQAPLQRGERAMDYGRPNSPDGSFENRPRRAVPNRPMRRWQNGLFIVAVALCLCNLAEGKEFPSTRTCHQPLEAANMARENQWGFSRMLFPWPLSHDQKANLIEELRPFNGSKTYLRAWICHVPPSLAFSKMPKPIKMASSSSSSSSSCSSYGSDTSEEPPPPPPPRKKAVELFNIAAATPERDAKSGRNFSVRDFIDAEAKEESSSKRMPTCSACQLSGHRRGAKACPLYVPPQKERTAAASRPGTSNTRRDSPEEGEITADKAGRDRPP

SEQ ID NO: 152209 - protein, 190 aa, Heterodera glycines
  Coding regions on vcDNA: vcDNA=SeqID_78632; Strand=-; Position=1 -255,725-966,1060-1135
  Homolog annotation: Hit_ID=CAE61648.1; Match level="QueryCoverage =84%, HitCoverage=15%, E-value=2e-12, Identity=28%"; Hit description =Hypothetical protein CBG05582 [Caenorhabditis briggsae]
MKEHPLWRMAHIAILCQRVDIFTDDGLAYLERFDYSVTDLVQVACSPEGLFPLMLAVQTNQDSIVRFLLKHGADLTARDPVGNNALHYAALVSTQMLETLLEQEAGKALINSRNNAGETPSMVALRAVNPLCMKTLFNHGGDLLNKSTDKNPLIELIQSSKGNTPEPLGVGYILHENFASIYLLFFELFC

SEQ ID NO: 152210 - protein, 108 aa, Heterodera glycines
  Coding regions on vcDNA: vcDNA=SeqID_78633; Strand=+; Position=1 -100,388-614
MSTLNLHFAYFLLIVVFLLVDYSLATRKKNKNKGGVTFTKSVHEKRKTIKQIKRRRKDDAHCRRTTNAIVSRRSGRKRHKFTGNGAGRETAKNCRQIGDESERNAEEH

SEQ ID NO: 152211 - protein, 152 aa, Heterodera glycines
  Coding regions on vcDNA: vcDNA=SeqID_78634; Strand=-; Position=1 -343,902-1014
MENEEERPSQKEPIEAYFAKFKQFMAHLQDNPTKGQSDKLLAILREIEGRKETVKFAKEMAEMDEIREHIDELEQGFREKNAELANKKTTEREKDSSLKANIAEGADKIGEGVKRPIQQIFTEKVLKHDQMANLHEIMQMALLEGKPISEEQ

SEQ ID NO: 152212 - protein, 46 aa, Heterodera glycines
  Coding regions on vcDNA: vcDNA=SeqID_78635; Strand=+; Position=1 -51,373-460
MACFQRGMVVSERTAIKDVSVPSTKKAPRCLTCQIGRDGVLSTWYG

SEQ ID NO: 152213 - protein, 272 aa, Heterodera glycines
  Coding regions on vcDNA: vcDNA=SeqID_78636; Strand=+; Position=1 -280,950-1488
  Homolog annotation: Hit_ID=CAE62667.1; Match level="QueryCoverage =67%, HitCoverage=14%, E-value=6e-10, Identity=28%"; Hit description =Hypothetical protein CBG06805 [Caenorhabditis briggsae]
MALWAECTRRRGGKADTRHLCAGKFIGIYINATDKWLSVHNQKGNQDWTNSLRFNLTVSVSPNGALVQQSFPLPIINRKQRSHFFEIAFDKKCEGASRPSIVRFSKGNRLVTDEVDIGPQVVHVYTITNHGPFYARNVSLKINWPLQLMSGDPLSPRQIASGSWALYTLEEPLIRHNGQIRRCAAPPQLHGQKSINPLGVYNDETLKLDYQMTSRRQRPKRAPNQRTVGTNAEGGTFSATAPLTSIFDNGRIRRKEIEESSGAKVRIADIVS

SEQ ID NO: 152214 - protein, 20 aa, Heterodera glycines
  Coding regions on vcDNA: vcDNA=SeqID_78637; Strand=+; Position=1-96
SPMDSLSPVFKIIIYLWKSH

SEQ ID NO: 152215 - protein, 372 aa, Heterodera glycines
  Coding regions on vcDNA: vcDNA=SeqID_78638; Strand=+; Position=1 -152,435-685,737-1104,1547-1771,2218-2340
  Homolog annotation: Hit_ID=NP_505818.1; Match level="QueryCoverage =89%, HitCoverage=78%, E-value=1e-161, Identity=88%"; Hit description= actin (41.8 kD) (act-2) [Caenorhabditis elegans] emb|CAB04675.1| Hypothetical protein T04C12.5 [Caenorha
MVGMGQKDSYVGDEAQSKRGILTLKYPIEHGIVTNWDDMEKIWHHTFYNELRVAPEEHPVLLTEAPLNPKANREKVSQSPSVDQWSNRTARPPVQMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQVGLWPMPCQNYQSVRLQEMATAASSSSLEKSYELPDGQVITVGNERFRCPEALFQPSFLGMESAGIHETSYNSIMKCDIDIRKDLYANTVLSGGSTMYPGIADRMQKEITALAPSTMKIKIIAPPERKYSVDQQIRVRRVGPVHCAPQVLLIERRPAGSRKKEENVADKI

SEQ ID NO: 152216 - protein, 72 aa, Heterodera glycines
  Coding regions on vcDNA: vcDNA=SeqID_78639; Strand=+; Position=1 -73,137-189,236-329
  Homolog annotation: Hit_ID=EAL28191.1; Match level="QueryCoverage =88%, HitCoverage=20%, E-value=2e-10, Identity=55%"; Hit description =GA11580-PA [Drosophila pseudoobscura]
FTRWGPIKVDASFLVVAKALKAVVTISAGHENIDTVECARRGIRMGFGGAILTEATAETAMALLLTVSRRLV

SEQ ID NO: 152217 - protein, 219 aa, Heterodera glycines
  misc_feature (198)..(198): Xaa can be any naturally occurring amino acid
  Coding regions on vcDNA: vcDNA=SeqID_78640; Strand=-; Position=1 -21,81-157,642-885,1298-1388,1440-1578
  Homolog annotation: Hit_ID=NP_502032.1; Match level="QueryCoverage =72%, HitCoverage=10%, E-value=7e-55, Identity=61%"; Hit description =RetinoBlastoma binding protein Related (rbr-2) [Caenorhabditis elegans] pir||T27924 hypothetical protein
QEPRVSCDRVEREFWRNVIDRVEREFWRNVIDIDKGVQVKYGADLISSKVGSGFPRREDASVRGVAADAQDRQQYANHPWNLHNLPKVRESVLCHMTTDISGMIIPWVYIGMLFSTFCWHVEDHWSYSINYNHWGERKIWYGVPGEEAELFAKVVKESAPELFMENKDLLHQMITSAPELFMENKDLLHQMITHMYDXLLFLIPFLHYFFDRNPQFLID

SEQ ID NO: 152218 - protein, 56 aa, Heterodera glycines
  Coding regions on vcDNA: vcDNA=SeqID_78641; Strand=+; Position=1-170
IAPPFRARDEAELLLLPFFHCFGFTQLNMALLNGSTGVVLSKFEQNSFCRVVEQYR

SEQ ID NO: 152219 - protein, 132 aa, Heterodera glycines
  Coding regions on vcDNA: vcDNA=SeqID_78642; Strand=+; Position=1 -94,176-401,451-529
MRFKCKGGLLLLTFLVGFAGGDLAHNPIYKPDKNDAVVFHGQIWEENEVKEYQMEAEVLDEQQPIKEPKIIWATDKLGDRHFRMTFKFAGGTGKRQIDKLKLELFTSRTVTSFREKNGRVEKVKKKKGDTEK

SEQ ID NO: 152220 - protein, 182 aa, Heterodera glycines
  Coding regions on vcDNA: vcDNA=SeqID_78643; Strand=+; Position=1 -152,202-367,416-534
  Homolog annotation: Hit_ID=CAE72182.1; Match level="QueryCoverage =91%, HitCoverage=23%, E-value=3e-32, Identity=47%"; Hit description =Hypothetical protein CBG19289 [Caenorhabditis briggsae]
RVSDQYLAVVGDQTVIRWWLIIGDIVLVDKYGFITVVDRLKELIKVNGLQVAPSELEDLLLSHPVAPSELEDLLLSHPKLQDCAVIGVPDKVSGELPRAFVVPKNGAMNELEIQQFVKERMAYYKQLKGGVEFVAEVPKSPKERMAYYKQLKGGVEFVAEVPKSPAGKILRRILREKMTKGN

SEQ ID NO: 152221 - protein, 61 aa, Heterodera glycines
  Coding regions on vcDNA: vcDNA=SeqID_78644; Strand=-; Position=1 -133,1601-1653
MYRDPIGKRNAKKNNAAVSSSSSAPIERKRKRVVAAAAPAIPTTDTGRRNCAAALCPSVPL

SEQ ID NO: 152222 - protein, 52 aa, Heterodera glycines
  Coding regions on vcDNA: vcDNA=SeqID_78645; Strand=+; Position=1 -107,350-401
MGIKYGHKCQNMDKYGNMDINRKIWKNMENMSIEIRRTNRACEELSNDIQIV

SEQ ID NO: 152223 - protein, 155 aa, Heterodera glycines
  Coding regions on vcDNA: vcDNA=SeqID_78646; Strand=+; Position=1 -74,1469-1862
MFCGSVSKGVFCFGNFSFGYQNRKSKIKQNLIITERLRMSTSGGSSNEFPFGTSQAFGQETKMFLSGKEDESSISAIDRKLWQGKTTIKISDLEKAQNDMGKLEDGVNRAFRYMNRSLNQKVNNAYTTQQIQTLCRPRNLTMALFDRFGLQLALA

SEQ ID NO: 152224 - protein, 236 aa, Heterodera glycines
  Coding regions on vcDNA: vcDNA=SeqID_78647; Strand=+; Position=1-711
MVGNGNELVETEDDENSVNFMNLFENLELTDSEKLPSLMEIEKIFTDTTPTPADLPPIESSVMGFVFISHPILWALVQPDILGEQNELLDRKNLSLESDQFVFQSTPSYVTTITLDPNNNWPHFTQISLNWNKQSLLGTRLKTIDLKQMTYPPKLGPSVSQIVPSSCCGIIREVIQNKITSEIMAIDVFLYGEESNQRFFPHQIDSSVNLMELEGTRVQTTGFRAKTSENEWTNFG

SEQ ID NO: 152225 - protein, 143 aa, Heterodera glycines
  Coding regions on vcDNA: vcDNA=SeqID_78648; Strand=+; Position=1-429
MQKPTPSNRPNSSVSKTLACGLEKIVNLSGNEPLSVPVLADRSDPLGLKSVQPDTVPMESAEGTKEVEIMEVDEMSGEKGKKGEMGKEKVKSGGMEEEEESEGSESELLGEGGFDNLQLNPSLRAGNKAVEKEDKGKPYLVAQ

SEQ ID NO: 152226 - protein, 28 aa, Heterodera glycines
  Coding regions on vcDNA: vcDNA=SeqID_78649; Strand=+; Position=1 -53,322-355
MSPIWPNLSSKMAQALIKLLGFLHFLKY

SEQ ID NO: 152227 - protein, 63 aa, Heterodera glycines
  Coding regions on vcDNA: vcDNA=SeqID_78650; Strand=+; Position=1 -112,400-479
  Homolog annotation: Hit_ID=CAE59223.1; Match level="QueryCoverage =82%, HitCoverage=11%, E-value=7e-09, Identity=53%"; Hit description =Hypothetical protein CBG02541 [Caenorhabditis briggsae]
MRFLLIIPAQLFQVRFISELKKLQEPSLMNSVLENFTVLQIVTDKQSNDTLMVIAFMFGIREE

SEQ ID NO: 152228 - protein, 96 aa, Heterodera glycines
  Coding regions on vcDNA: vcDNA=SeqID_78651; Strand=-; Position=1 -159,278-409
MPTFASREALQPTKTTRNCDHRGLAVVHMLWYENNWYCNFTGGSWNRGHPPPVFSFLMALIESFKFVKIGQFGKKFDPKKLAHNQTETTRFATCLA

SEQ ID NO: 152229 - protein, 20 aa, Heterodera glycines
  Coding regions on vcDNA: vcDNA=SeqID_78652; Strand=+; Position=1 -3,164-223
MFYSTFFLVHVKILRYKLCD

SEQ ID NO: 152230 - protein, 251 aa, Heterodera glycines
  Coding regions on vcDNA: vcDNA=SeqID_78653; Strand=+; Position=1 -81,697-885,1026-1511
MKSNYIKGFYTWIIILYKLIKPSFFADFNGKFHAVRRFKYYDGIELEYFAECFENFFIAQTNEDGEFDVNLRGNIGETIFFQIFPLYNNKAPIRSDSFPSTFLQSIHRKPDWRLCVHFEQHFYFLIHKEKKTKIGTMLDNWQRSANANPSDEEAFFLKACLQEIASRIVDTFTKGIKLTNNEISIQRKYWSAFQQMKGHGILAGKLAQIDGMPKLMKDLCRFTVADYEANSADGFEFNDKLFALAFFCAEL

SEQ ID NO: 152231 - protein, 45 aa, Heterodera glycines
  Coding regions on vcDNA: vcDNA=SeqID_78654; Strand=-; Position=1 -48,97-186
MINIAQLTNADDVTLLKGRYRVRLIDSELVPLCYEHYIAWQSDRH

SEQ ID NO: 152232 - protein, 384 aa, Heterodera glycines
  Coding regions on vcDNA: vcDNA=SeqID_78655; Strand=-; Position=1 -294,336-447,511-716,788-1328
MEPRSRSVRPYLIQSNEVDKFLRKQRLPSPYRRPLAYTLEKFPKNDSDDNKNPRTNTHFSPPLSTRINGSNGTANSVNCYSDSNSVQPSLSNKFLENRRRTSGRSPSVPPRNYSSSYSGKIDGYDTKSTYGQRLKEGFFDYQQQNGGRVIPVQINADEARKNKTSALKILRSFFKKHLGFSNPTHKRDYSVEPIDSKRFSSTLNVNGGLPSSSSSSDPYERRRSNSIISSAFPRRQSFSYRNGGTTDYAPIPATNNMPSSQFNHDRRKNGVTSTDCESDEPPQFAELMQRFSDISTSDIRPRLPSASMYQFPTKIGSTSTKFSTSTLPPTPSPFSRPMHNSLKPLQPRPTTSDAQHSFREKSAANDGELMLKQHSRSSQVPCLK

SEQ ID NO: 152233 - protein, 36 aa, Heterodera glycines; identical to SEQ ID NO: 147448
  Coding regions on vcDNA: vcDNA=SeqID_78656; Strand=+; Position=1 -79,102-131

SEQ ID NO: 152234 - protein, 37 aa, Heterodera glycines
  Coding regions on vcDNA: vcDNA=SeqID_78657; Strand=-; Position=1 -5,175-283
MTIFLTIFAGSQPVRIGPRAGRGGRDVKCGVLLIREI

SEQ ID NO: 152235 - protein, 176 aa, Heterodera glycines
  Coding regions on vcDNA: vcDNA=SeqID_78658; Strand=+; Position=1 -326,2158-2249,2296-2407
CTSLITVVPLLITVVPLLISVVPLLITFVPLLITVVPLHHICTSSISVAPLLITVVPLLSLLYLFITFVPLLFTVAPLLITFLSLFHCCTSSIHCCTSSNHCCVFPFREDPSNSDDAIVDANEQVEANNEEMKKNRKGKAIIEMIMSPKFSKIVGRKGKPIEPPQTKDVDEQRVKK

SEQ ID NO: 152236 - protein, 177 aa, Heterodera glycines
  Coding regions on vcDNA: vcDNA=SeqID_78659; Strand=+; Position=1 -122,375-540,944-1018,1738-1908
  Homolog annotation: Hit_ID=CAE59001.1; Match level="QueryCoverage =74%, HitCoverage=15%, E-value=1e-28, Identity=44%"; Hit description =Hypothetical protein CBG02276 [Caenorhabditis briggsae]
MIRLCLAQCGLITIVAFLISWTLCRTPQIGGWTNLCVSTMNSVFGTNEKHPWYFDTQPAFAGKPPIAPLMCQEPNNKLDYPPYRTWNAYKWDSKNTKRTLNEKTLCMIGKSGRRNWTMYDTSSGHYGGHWLGDNQSRWPDLRLSIIGVMEFNMFGIPQVGADVCGFIGDSNEVRKIG

SEQ ID NO: 152237 - protein, 246 aa, Heterodera glycines
  Coding regions on vcDNA: vcDNA=SeqID_78660; Strand=+; Position=1 -118,167-308,353-455,500-662,707-921
  Homolog annotation: Hit_ID=NP_502882.1; Match level="QueryCoverage =80%, HitCoverage=39%, E-value=9e-23, Identity=32%"; Hit description =DNA polymerase like family member (4Q408) [Caenorhabditis elegans] emb|CAB60306.1| Hypothetical protein Y
MEAEDDDSDDNDAENNYMLGYDEEGEKPRSVTTYAFAHAGSRYDHVLIYGEMLRMGVRPELVRHGNQLLEMKARKRGAITTTIFRDSYKLIPIKLASFVKTFGLEIEGVDNKKYFPHKFNKAANYGVVLDTLPPLEDYYPGGHFPEERKKLKQWYEENRNTPFDLREVIADYCKADVQILAHGMVKMRQLFAAATSQELTDSITIPSACMKFFVVLSHVGKERVAIIPHLGYEKRGKQSAIARKYL

SEQ ID NO: 152238 - protein, 262 aa, Heterodera glycines
  Coding regions on vcDNA: vcDNA=SeqID_78661; Strand=+; Position=1 -187,234-712,761-881
  Homolog annotation: Hit_ID=NP_001004509.1; Match level="QueryCoverage= 89%, HitCoverage=15%, E-value=9e-22, Identity=31%"; Hit description =si:busm1-180o5.3 [Danio rerio] emb|CAD60788.1| novel protein similar to DNA polymerases [Danio rerio]
MNFKFSFAGFSTTIPHIELEAALRSGYRVTHVYRAYVWPLYCEWSNGLFHSYLNKFLRIKFEASGFPADCAADEIDEEDRERRKEQYINNPWKGCTVRLDANNIKPNPGMRYLSKLCLNSLWGRFALRNRITKTEIIDCHADLAKLLNDVKTDISSIDQLTEKFWMVCYKAKDEHVVEHDTSNVAIALWTTAAAHVHLLNSLQLVYRQENLVQRYDTRILYMDTDSIFHDFKTALGDPLKGGNQLGELADEYPSHTIVEFIC

SEQ ID NO: 152239 - protein, 16 aa, Heterodera glycines
  Coding regions on vcDNA: vcDNA=SeqID_78662; Strand=-; Position=1-49
MALAFSALYASITKKE

SEQ ID NO: 152240 - protein, 288 aa, Heterodera glycines
  Coding regions on vcDNA: vcDNA=SeqID_78663; Strand=+; Position=1 -175,281-587,817-952,1236-1484
  Homolog annotation: Hit_ID=NP_491741.1; Match level="QueryCoverage =24%, HitCoverage=8%, E-value=4e-11, Identity=50%"; Hit description =related to yeast Vacuolar Protein Sorting factor, LEThal LET-512 (103.1 kD) (let-512) [Caenorhabditis eleg
MPTVREILESLQKRVKKPRIATNEDSVLNVERTDAEQQIEGTSTRNNLGVASSDDEENCFRFIKNRKDGSWFRCEQRNCPATAKLDDNDLMTGILGAKGHHHGCAPSRYDAETKRNQMKRLIKEEPKTKPCQIRAQIRTDIDDEVFELLGTNEALDQMANSASDNVPRSYIQKWDEWLTLPVCYSELSRDAILHFTVWEVGNTIEPVLVAQCAKPLFSKHAIFRNGLIDLTLDFVANAATTDKQQRRPAVQLQAAHSKSPSKGMATENARPAEQSVEADDSTPLHQHN

SEQ ID NO: 152241 - protein, 152 aa, Heterodera glycines
  Coding regions on vcDNA: vcDNA=SeqID_78664; Strand=+; Position=1 -145,311-624
MPKEEASAAPFRNAFQPLLMGKVRMCQEGAKEEEEEEEENGHEVPTSEESSQSEDDGILAKDGEQKVEMKEEEEEQDFGESELKMEQEHKQTKAEGKREGDERDKGNTTPREGAFEQPYQWKLVIKTKVPPGHTVLSKREGNGDGGIRKAKE

SEQ ID NO: 152242 - protein, 453 aa, Heterodera glycines
  Coding regions on vcDNA: vcDNA=SeqID_78665; Strand=+; Position=1 -39,504-632,725-1021,1081-1686,2610-2687,3017-3101,3157-3284
  Homolog annotation: Hit_ID=AAG00553.1; Match level="QueryCoverage =44%, HitCoverage=68%, E-value=7e-24, Identity=33%"; Hit description =retinitis pigmentosa GTPase regulator [Bos taurus]
MAPGGKTYARLKNAKGNTAAPSSSSVSVRNPTRRAPSTRKAVAQQPQHHKLEKRKAATPQLDDNCPGDHRHPSQTLLEQQNNALYRLLFDGSNENYFTHLERARHLVHTCAVCEKKYEFVLVRFPDTGVETPWHPVLPTHRNIRDGWTLLDLAMLEPDTIYAFDAAWQQCVAPDDAIGGNENDDGGDDENGRGNNSGGRNKKKGGGGGQKDGGGSKDGANGGGREEEEQNDNNGKRGEREREEERREEEEEEEQNGNNEERGEKKRREEGRGKEGGEQDRREDEEDEGRGEEETRERGDEEETEEAREKLKRGEEKGGGEKGGGKAKEGRSEGGGKAKEGRGGGVGEKKQPPPGSKMLCQIILTLFYGYRRRRRRPRVRFPTNKPRTFPFNNKAVMDGLPNNKRNKDKPLYALASIPEEEETKKNGREKTALVKDDKYGDNYFEDCYYQSTWV

SEQ ID NO: 152243 - protein, 105 aa, Heterodera glycines
  Coding regions on vcDNA: vcDNA=SeqID_78666; Strand=-; Position=1 -142,266-441
MSPCRRFKSRPQKKNSEYKWLHIVKRQKHRQQRHQQNHFNEMCVAFQRCAFLKEEIDKQMTNLIFTITKIEERSNGLPDPQAAHLYGIVKEQLERTVRQIEKDCL

SEQ ID NO: 152244 - protein, 97 aa, Heterodera glycines
  Coding regions on vcDNA: vcDNA=SeqID_78667; Strand=-; Position=1 -133,177-337
MAEQFVQPETAEEQQVKAKKPHVDERFLWKITRGQFVLAIRLCSEDWNNLFHNKDKARRLEDGRVAIGLEMCEECARINCCVSDMIADQKKKPKTTK

SEQ ID NO: 152245 - protein, 164 aa, Heterodera glycines
  Coding regions on vcDNA: vcDNA=SeqID_78668; Strand=+; Position=1-495
MVLVIEFCAQILGCSPKSLRDKLNHPEDRVKALKELVGKKVRTTYQDRNGMQKTFFVDGISDHGAALTPAYGRLRQPYNINIAAHFYARHRIKLHLPYVPCVVEKYSGCGEDRYYPMELLEIVDEDYTIKERWLGNCLPKSRTTSFLSTAVVELTKTKKLTLVV

SEQ ID NO: 152246 - protein, 532 aa, Heterodera glycines
  Coding regions on vcDNA: vcDNA=SeqID_78669; Strand=-; Position=1 -299,352-1115,1160-1386,1436-1744
  Homolog annotation: Hit_ID=NP_001004509.1; Match level="QueryCoverage= 85%, HitCoverage=31%, E-value=1e-58, Identity=31%"; Hit description =si:busm1-180o5.3 [Danio rerio] emb|CAD60788.1| novel protein similar to DNA polymerases [Danio rerio]
MLMPNGKTAGEVRERDEKRLEFIESQVSRVDVYWECQIERMLHRDPYMRESFGDYVDDGPLNIREAFMGGRTGPLKLYHKAGEGEKISYYDFTSLYPYVIFSTTYPIEHPKVLILNEDVEWTTARDNPYKLSLLKVWVIPPRKCDVPVLPVKVNKRLCFPLCMQCCLDYPKGGVDFDYHCEHDDQQRGWVTTCTSIELDAALEEGYRVTKVFRVLKYRHGDDKLFRPYIAEFMSQKIEASGFDASIKGNTELEQQFITECAEKFGISIDKDNMKVNKGKRSLAKLCLNNLWGRFSLRNFGLAQTLITDDPSVLTEYVENSSIDIISIDELDEKHQLISYVQKKEWVEEHECSNIVISLWTTSKARLLLLKAMQKVMRTPGCRLLYTDTDSLIFVHPIGMNPLETGPHLGQFTDEYPKHEIVEYCSGGAKQYGLKLRRNGQDEFVLKLRGITLNYDVMQNQSLCYDTFKEEVLRYAQTGEYEPINVMYPNFLRPDIRGGGHVTSGPLQKCYRPYVGKGIVGSNYNVLNFGHTL

SEQ ID NO: 152247 - protein, 82 aa, Heterodera glycines
  Coding regions on vcDNA: vcDNA=SeqID_78670; Strand=+; Position=1-249
MPFVMGPSESGAKSKISQFNMATPVDQNVIRLNDLNAFETLKSNNLHFYVTMNKAKGMDIFHGQSQLGNVKSVMFGVKHSKK

SEQ ID NO: 152248 - protein, 118 aa, Heterodera glycines
  Coding regions on vcDNA: vcDNA=SeqID_78671; Strand=-; Position=1 -8,849-1197
MGYSFTPNGENNGAAEGVVSGFNRALATVVCETVAKEEAEEAEAEPGGQCRWKAGDELDGTTETRRWWEKPLGQGCFCSVCACFCGKGDVGVEFNSDVVSCLEIDEQKAVLLVTKVGN

SEQ ID NO: 152249 - protein, 89 aa, Heterodera glycines
  Coding regions on vcDNA: vcDNA=SeqID_78672; Strand=+; Position=1 -38,416-618,978-1006
MSQPYAKRGGIKRIILIQKQQRRQLMVKNRSILTSQVQQQMCAEIDLERELHVVYTNLATHMDTLCDHNWCCRFECARCDVKKKRCHML

SEQ ID NO: 152250 - protein, 76 aa, Heterodera glycines
  Coding regions on vcDNA: vcDNA=SeqID_78673; Strand=-; Position=1 -73,962-1119
MRIIRNFFFITKAIRKWLAINYNDGRGVCSGERCRTETECQFVIEKVPLPMPIFDDAATAFSTRRVTLTMPLTLFN

SEQ ID NO: 152251 - protein, 186 aa, Heterodera glycines
  Coding regions on vcDNA: vcDNA=SeqID_78674; Strand=+; Position=1 -58,341-388,561-679,963-1238,1531-1590
MGQKPVICHWCETFDFVRYGYRIKGKYFTIFCHIIEWREAQNFMVRNNPLNRPLKSDQIPEKGISNGQRMVKHLQRNHYSKAELKTQSDRLLVPDFCNCPNGSDRCGPSTNCINRSLLQECPKGCGEDFNLGCANRRISEGNNCIKIEIKFFPGKGYGAIAKEKVPSLCEPFLQPQLCDPANPKRF

SEQ ID NO: 152252 - protein, 117 aa, Heterodera glycines
  Coding regions on vcDNA: vcDNA=SeqID_78675; Strand=+; Position=1 -198,878-1033
MRNLRVPILLMLLSTVIIFILQFLLHENMPTKITINPVAGNFMQRRILFFDSDVDSPKLLLGMNTQFIPSLKLAGCLIAKNSNVFLEALFCYLTNMNKINTTNIDYELFNLFVFNYL

SEQ ID NO: 152253 - protein, 55 aa, Heterodera glycines
  Coding regions on vcDNA: vcDNA=SeqID_78676; Strand=+; Position=1 -100,503-570
MPNLLVYIFFNNFKILFNLFLTPFIYIFKIDLAEHHCIDLMPLVDDNIAMAVGQI

SEQ ID NO: 152254 - protein, 122 aa, Heterodera glycines
  Coding regions on vcDNA: vcDNA=SeqID_78677; Strand=+; Position=1 -191,599-776
  Homolog annotation: Hit_ID=CAE68767.1; Match level="QueryCoverage =38%, HitCoverage=13%, E-value=9e-15, Identity=78%"; Hit description =Hypothetical protein CBG14705 [Caenorhabditis briggsae]
MQTMRQRTDGRRARDRRSTLLLEMPRFGRKKHLKEYLGGVNSMCFYRWEFQFVVLVTGPSRKEWTKFYEFDMKPTCKKCYDRFPTELKKRISDNLKEREAETLRRRSASPAQPQKSKSPGLK

SEQ ID NO: 152255 - protein, 48 aa, Heterodera glycines
  Coding regions on vcDNA: vcDNA=SeqID_78678; Strand=+; Position=1-144
MADEAEVDEELIDVLRETDLVKFQPMMVFDKQLTRIEHFRDVTDFELM

SEQ ID NO: 152256 - protein, 124 aa, Heterodera glycines
  Coding regions on vcDNA: vcDNA=SeqID_78679; Strand=-; Position=1-375
MEANCVREEVGMAFEWEGIEDEEFGGRDANCVREEVGMAFEWEGIEDEEFGGRDANCVREEVGMAFEWEGIEDEEFGGRDANCVREEVGMKFKGGGIEDEEFGRREEEGRCWVFIKFEDEPENG

SEQ ID NO: 152257 - protein, 411 aa, Heterodera glycines
  Coding regions on vcDNA: vcDNA=SeqID_78680; Strand=+; Position=1 -89,133-1030,1254-1502
  Homolog annotation: Hit_ID=AAK31375.1; Match level="QueryCoverage =73%, HitCoverage=36%, E-value=4e-18, Identity=32%"; Hit description =ppg3 [Leishmania major]
SGFTLGHLLSVVYTRAFKDGHVDICRARKIKIFMDNSKKGYYIDDEDASAFQPFSGSSSNLINTQHLPSSSLLPNSSSSIPPPLNFIPTSSLTQLASLPPNSSSSIPSHSNAIPTSSLTQLASLPPNSSSSIPSHSNAIPTSSLTQLASLPPNSSSSIPSHSNAIPTSSLTQLASIPPNSSPSIHPQLNPNAGPSITQLASIPPNSSPSIPPQLNPNPGPSIAQFSSIPPNSSPSFPPHLNPIPTSSPTQLSSVLPNSSTQAALLPSDFMEPTSIFIIDYQLYKKYRFLLAENPLFSDISDASAYLQIDERDYGNEQSASAQVLRSILDLRPTSSTASSQTSSTTSRNFRDHMRKLYTELGETNRDERDRAMKALEFKNKQIETRSEDGQRRRSKGSTSEDDKKKSVFCNI

SEQ ID NO: 152258 - protein, 133 aa, Heterodera glycines
  Coding regions on vcDNA: vcDNA=SeqID_78681; Strand=-; Position=1-402
  Homolog annotation: Hit_ID=NP_608540.1; Match level="QueryCoverage =83%, HitCoverage=54%, E-value=2e-10, Identity=35%"; Hit description =CG2839-PA [Drosophila melanogaster] gb|AAF51469.2| CG2839-PA [Drosophila melanogaster]
MAQNAAQNDDQVVFALTEEEMVEWDERERRWQEEVRLRCEERRREAEERRQERGDWHSDMLRRQHVWEQQKEERERDRERWEQRMEDEGRKCEERSAAIRKKEKEEKDKNDVTDHYSFKWEEWREKEKLFFGK

SEQ ID NO: 152259 - protein, 124 aa, Heterodera glycines
  Coding regions on vcDNA: vcDNA=SeqID_78682; Strand=-; Position=1-375
MEGCSVIESLCHEDLKFGFTKYKTKFYFKNPFLINAEENFKLILASIIEEIYKNEQGKFKSILKLSFGFESFYCPLRCPSENTAEALFQHVILKEELYSLFYPLDDVITLEVTIIPDVDNRPRN

SEQ ID NO: 152260 - protein, 151 aa, Heterodera glycines
  Coding regions on vcDNA: vcDNA=SeqID_78683; Strand=-; Position=1-456
MNSEKSEKANTILVEAAKKETERAWRDAAALAEEVGDFAKSSRETLNQAIKSREKAPYANGVRELYLKMSDSIWEIFKIEDQINLESVKAESAWREFERCKTFDQATKFEEQAQNSLMEARRLHFESRRVQSQMLNYENRLKTIVWEHVGI

SEQ ID NO: 152261 - protein, 16 aa, Heterodera glycines
  Coding regions on vcDNA: vcDNA=SeqID_78684; Strand=+; Position=1 -39,375-386
MVFYFFRLVESVHDYV

SEQ ID NO: 152262 - protein, 318 aa, Heterodera glycines
  Coding regions on vcDNA: vcDNA=SeqID_78685; Strand=+; Position=1-954
MFLSGKDDESSISAIDRKLWQGKTTIKISDLEKAQNDMGKLEDGVNRAFRCLNRSLNQKVNWVKDVVANTNANFETLKVQFETLTERVDMLEQDSDGTNSGGTVSITNLNRASRAPFVTPMGNAQPNQVVPNQVPIHQLSSEDEDDGPTLFGLNMLSSGPTVGSGLEMFCEESVFAFDDWAERFKDYLSVSGKAYTEREKVTRLKLALRDTPRALFKELLPAQTDTLDSALSELRQKLDSPQRREIAKRTLSLCKQREDETVAQFLRRLTPLVDATNSSLTGDIRKEKICEEFLDRLKPNISFLIRLVGLSRAKDLDL

SEQ ID NO: 152263 - protein, 90 aa, Heterodera glycines
  Coding regions on vcDNA: vcDNA=SeqID_78686; Strand=+; Position=1 -143,237-366
MSKFAPTASGGVAGGAQQQFMTAPQCRCKDLDECSKEIEKLVAKCKTEPKCEAHLKKIGNSQKIRQCLADEQKDMEKLEQCVEKAVGPIG

SEQ ID NO: 152264 - protein, 44 aa, Heterodera glycines
  Coding regions on vcDNA: vcDNA=SeqID_78687; Strand=+; Position=1 -83,346-397
MPPNERQEKAFGDCEQKLGLTAQKRLKKSCECLKASGIKIVCPK

SEQ ID NO: 152265 - protein, 26 aa, Heterodera glycines
  Coding regions on vcDNA: vcDNA=SeqID_78688; Strand=+; Position=1 -22,199-257
MATVHFAYKPNKNTVSVSNSAYRKLK

SEQ ID NO: 152266 - protein, 152 aa, Heterodera glycines
  Coding regions on vcDNA: vcDNA=SeqID_78689; Strand=-; Position=1-459
MSFQNTPKEVRRARNTRHFFKATPDKGKCLEKIESHVNERAKFGIREHVTSFYFKCPPNEDAENNFRIIIDKLIHEAKEKEPAQGWKTERISLNLYCAALSDPVMIPVRPLQQVTSDVVLNEFMHRQQSFGDVNLMDERISVIVTTFAYPLK

SEQ ID NO: 152267 - protein, 232 aa, Heterodera glycines
  Coding regions on vcDNA: vcDNA=SeqID_78690; Strand=-; Position=1 -163,243-778
  Homolog annotation: Hit_ID=NP_001004509.1; Match level="QueryCoverage= 93%, HitCoverage=15%, E-value=3e-31, Identity=34%"; Hit description =si:busm1-180o5.3 [Danio rerio] emb|CAD60788.1| novel protein similar to DNA polymerases [Danio rerio]
MKIFFESVPDKGPINPRDAYAGGRPMPFCLYAKATEAVEISMFDIISLYPYVNYVSRDFNVNWTVPDDIPYDGLLKVKVVPPKELLYPLLPVHIDNMLLFPNCGICARKAKNEFVTTKDVKKCNHRPEQRAFLGTFTSIELRKALELGYRIVGLYRAYHFEQFDNQLFKGYVRMFLKIKVEASGWPGEVKSEEEKSAFTDMYKAKYDICLDHDKIVFNPGLRMIAKLVRNVY

SEQ ID NO: 152268 - protein, 341 aa, Heterodera glycines
  Coding regions on vcDNA: vcDNA=SeqID_78691; Strand=-; Position=1 -70,132-373,415-1127
  Homolog annotation: Hit_ID=NP_507780.1; Match level="QueryCoverage =48%, HitCoverage=12%, E-value=2e-16, Identity=28%"; Hit description =predicted CDS, DNA polymerase type B, organellar and viral family member (5T899) [Caenorhabditis elegans]
MSRFCPLVETKELGRLSVMKGKFCLFYALELSRNYQLIDNGISRKAFRYFMETEKKQSEMTFKLMEKAGINAEEKTFGLQHLEMIQIFWDKEFPDMFRIVAFDMRTGIKPIFKGEGIRKNEVCVIKEGDHWDGIKSVTQFFCVRNYCVSCEVTCERPERHRLECKERCKKCCRMGFGFPCADVCEEIHCEGCNRNFYNTDCFESHKKTACREYKKCEKCDETYQTRSKHTCGEKFCRICKIYHPKRGCFIQKLKIRSTRKYRIVAYDLETTLYNGVHAPNLVCAALTCSECVGEKRKCEICEEPSMLTWSAADVEDPIGGFIDWIMGFKQFETVAFAHYAG

SEQ ID NO: 152269 - protein, 143 aa, Heterodera glycines
  Coding regions on vcDNA: vcDNA=SeqID_78692; Strand=+; Position=1 -19,969-1103,1152-1261,1384-1551
  Homolog annotation: Hit_ID=NP_502244.1; Match level="QueryCoverage =88%, HitCoverage=21%, E-value=3e-13, Identity=34%"; Hit description =BTB domain containing (67.7 kD) (4M616C) [Caenorhabditis elegans] emb|CAB01179.1| Hypothetical protein F3
MAEGGGASADCPHVIEVTDVEAEAFKVMLSFIYAEDLSELNGQNAMAVLYAANKYNVSLMVKALLDVPINELPNVFLAFVEARLLNEHDFSRRCLDYIDQNAETLFESEEFLQIGQNLLCKIFGRDQLKIDDELTIWKAVLIN

SEQ ID NO: 152270 - protein, 37 aa, Heterodera glycines
  Coding regions on vcDNA: vcDNA=SeqID_78693; Strand=-; Position=1-5,83- 191
MKEKLPKKERKLSNLFTTHLSVHFLSHPSFTLNLFIF

SEQ ID NO: 152271 - protein, 76 aa, Heterodera glycines
  Coding regions on vcDNA: vcDNA=SeqID_78694; Strand=-; Position=1 -93,140-277
TNIITHQFATEADGGEQFGQRQQTNAFVQSGAIGRTQSVSEAAIENAEAENQQLTLSRMQSVNGSFEKIGDEPNEF

SEQ ID NO: 152272 - protein, 215 aa, Heterodera glycines
  Coding regions on vcDNA: vcDNA=SeqID_78695; Strand=-; Position=1 -634,1419-1432
  Homolog annotation: Hit_ID=XP_522969.1; Match level="QueryCoverage =99%, HitCoverage=88%, E-value=2e-16, Identity=30%"; Hit description =PREDICTED: similar to putative protein family member (XC187) [Pan troglodytes]
MIRRGTNLMKRYKCDFKRYKSDKRGTKVIRRGTKVIRRGTTEIRRGTILMKRYKSDKRGVTVIRRGTTEIRRGTTEIRRGTTEIRRGTNLMKSYKCDLKRYKSDLKRYKSDNRGTKVMRRGTKVIRRGTKVIRRGTMVIRRGTKVIIRGTTVIRRGTMVIRRGTKVIIRGTTVIRRGTMVIRRGTKVIIRGTTVIRRGATVIRSGTTVIRREILE

SEQ ID NO: 152273 - protein, 205 aa, Heterodera glycines
  Coding regions on vcDNA: vcDNA=SeqID_78696; Strand=+; Position=1 -96,548-677,1396-1522,1934-2103,2452-2543
  Homolog annotation: Hit_ID=NP_500611.1; Match level="QueryCoverage =68%, HitCoverage=19%, E-value=9e-11, Identity=28%"; Hit description =PHD finger protein 2 (103.2 kD) (4F429) [Caenorhabditis elegans] gb|AAK29800.1| Hypothetical protein F29B
MDPKFAPTNSMPIFPVNLPTPLGPICCCCSTPEAKLLRKRRDLACQSAESVPAAGDDEPSVSEWIFCDLCRKWFHLKVRRLSHRYAFDDESEREMPEQIGTEQWIRHFRERYNQFPEAHQPSLIQVFDHGAEMLANFDFEKGWHLPIKVCHPHGLGLRMPDDPYFDVLDVCRLLSDAVTVDTIDVYAQRSYTMSLGRFYGLWRKR

SEQ ID NO: 152274 - protein, 210 aa, Heterodera glycines
  Coding regions on vcDNA: vcDNA=SeqID_78697; Strand=+; Position=1 -102,281-382,857-973,1346-1657
  Homolog annotation: Hit_ID=AAD01597.1; Match level="QueryCoverage =76%, HitCoverage=36%, E-value=4e-33, Identity=50%"; Hit description =peptidyl-prolyl cis-trans isomerase [Brugia malayi]
MLDAEKLEHAVKMKERGTTFLNQGKHNLALAKYQSVISLLEYAKPTKSDEESGKELREQFEQTFIAALLNSALVSLRMGESVEAIKHCDKVLEKQPTNVKALYRKAQALQNRKDYAEAIEQYKHVHQLDPSNRAAAQQILECGQQLAAQREAERKKYRGMFERMAKGTDSKSGGGGDGGASAATPSASDNNAEGVKKTILLFFKKLNQFS

SEQ ID NO: 152275 - protein, 30 aa, Heterodera glycines
  Coding regions on vcDNA: vcDNA=SeqID_78698; Strand=-; Position=1 -27,404-469
MAKMKLIFNIEFPFFVHFLAHDKSLCLLNA

SEQ ID NO: 152276 - protein, 181 aa, Heterodera glycines
  Coding regions on vcDNA: vcDNA=SeqID_78699; Strand=+; Position=1 -99,259-357,406-439,492-548,620-638,1220-1455
MPLKVPHSPQLPSLVINNPSGAEAKKGMPIAVMNTLLSKNVELEKKEQQRPATKLNNTQPMSQHDQPKTVRVAKKSTMNNGTTLMANALQISKNSTDYLIDEVQREEETVSAFLKRLTPLVEVVYANLGKKQLRERLVEELLDRLKPNISFLVRVAGLAKEKDLDQVKAQAEELETLLATQ

SEQ ID NO: 152277 - protein, 217 aa, Heterodera glycines
  Coding regions on vcDNA: vcDNA=SeqID_78700; Strand=-; Position=1 -35,1883-2501
MAIQFWAASTINVLFEWALEKGCQTISNASVIQIKEFAQEINEIKQIVEQICAKKGINEQGIRILGQKVLDQLKVSEKKQTKVPLENFGTQLMQLAKGLPDELPVKSAVIKQLEPINGSLATPNDAFKFLNGMVSSTLNNSDSAKKQVNSQKNLIVLKNSSARRRRRFDRRKLPIVVVIEVLLVFAIMLQKPILVFIACSIFFSFLPFLLQIRDDIE

SEQ ID NO: 152278 - protein, 55 aa, Heterodera glycines
  Coding regions on vcDNA: vcDNA=SeqID_78701; Strand=-; Position=1 -70,402-499
MVCLRSGMIRPPRCNMKGLCDLVSICHHFSDHPLTESRAFAETRRRDLPHSKAIL

SEQ ID NO: 152279 - protein, 243 aa, Heterodera glycines
  Coding regions on vcDNA: vcDNA=SeqID_78702; Strand=-; Position=1 -123,180-788
MSNFLMSNISAVSIFPEPHFNFVTFWVGDLLEWWGCHFELVIYDDLLIAFIKNEQEIQMISEYTLKKQAAYLGIVYFMRKNWQCDKIGAKSEQYERTECQKYRNYLDILYEYLYREYAAIPTAKPNFVIKKKQIGIDGPLIYVLNCLVRISQFYFNEPISLKYEYELNKLFELEFEPKLLNEERFNYHNQPLITINKLILKLATETANGRPTNENVEGIIRQNFEKYLKKLFGKAEENALEGV

SEQ ID NO: 152280 - protein, 59 aa, Heterodera glycines
  Coding regions on vcDNA: vcDNA=SeqID_78703; Strand=-; Position=1 -62,716-833
MMPKKLKWCKNLRNTKPKTQMCESIGEFHFLNNFFKQLNGPPTYPKRHPPSVSAQNLTS

SEQ ID NO: 152281 - protein, 134 aa, Heterodera glycines
  Coding regions on vcDNA: vcDNA=SeqID_78704; Strand=+; Position=1 -61,236-579
MAKLMDHFMAGLRSLWHIIKNKHLLPKDGKHQKRLTRRKKRMYADDYNPNYERPTANFFGATSSKFIVCFGSLILFSFFGGFGIFFALKLAQHLQNEHNDMTWVDGGLISILIFCVLVLMLSGLAFYRSCISAN

SEQ ID NO: 152282 - protein, 212 aa, Heterodera glycines
  Coding regions on vcDNA: vcDNA=SeqID_78705; Strand=+; Position=1 -247,654-839,943-1148
MAIFDPSPLIAILAFSLYTPLALATLLLNLFAIVVLAHGHRYFSQRFFFIVGRHLLAADLMSTAAQLSIAVPVSAMSTESAKTYLESTFAQFMLTLEALAHLDTFHFVTLQACSFLGCFQQEQMAFRLNAFGSIIGLVVWMLIAGQLLLFGFVPCAKRFDPVTLHFFDSCNWPNPNARGSGFALLNIWLTVLLCSAFSIYAIALSHVRRRIQ

SEQ ID NO: 152283 - protein, 129 aa, Heterodera glycines
  Coding regions on vcDNA: vcDNA=SeqID_78706; Strand=+; Position=1 -144,509-643,694-804
MPSQTLMPSALGSVPSTSPSGSLSPKSRELKERKQIKELARLREMIMQGFLIMQSLLLRFVGFFVLPWLAFAAGANGIDQRALLCVLANTLILLSLISHSLIYWWWNSKIRELCKEVVETLHKKLLKSR

SEQ ID NO: 152284 - protein, 30 aa, Heterodera glycines
  Coding regions on vcDNA: vcDNA=SeqID_78707; Strand=-; Position=1 -79,912-925
MIKRGTKVIRRVTKMIKRGGTKVIRREFLE

SEQ ID NO: 152285 - protein, 1204 aa, Heterodera glycines
  Coding regions on vcDNA: vcDNA=SeqID_78708; Strand=-; Position=1-3615
  Homolog annotation: Hit_ID=NP_508324.1; Match level="QueryCoverage =40%, HitCoverage=18%, E-value=2e-33, Identity=24%"; Hit description =predicted CDS, peptidase family A16 and RNA-directed DNA polymerase and Integrase, catalytic domain and Z
MSRSRFRPFPKLQTTLLLLTPCAFTSCARAQVVSITASAEKCQRSDFGSVCHLESSTTVTLLPSGLPVRLLLRHPDERVLGTLEISMRSLTLHCLPKSEQWLRSYHIETVSVKRCPSRGNCTREFCDDVNNGRKTEVHELSEWTKHPGFNRCSASCSFWWCGCLNAGASCIFYRPHAIANSPIVYEQISCPTWEYRLRTSLKLSVNANFTKEPSVSLTPGITFRWKDLSITPIASSVPPAPIMATKFLSDGNNMAISDEIQSDLQCPSRANAKRLNCTLRWGSCPMCLPDHDSAKINCQCRDVKLEPALADPEKRLPIQLKNLLLRNERRDIFAEITYAPIQLSIQFEGLRIATEEDLTKCHAMSKGLFGCYSCHTGAHLHLQCHTDFGSALGYVRCSDGTEFTALCHKTPEVLNVSLSFNRAEVDINCTIECSGGRNPFVINGHLRYVPKHFQAPNEGSSFASKAKPSNSCLIWCPDWNFDFSDVFWYFFGLQNALRTVGIITLALFIVYILLRCNPALRSWRAISRVVLLFLALWPTTDSSAAGGLSHLLSIQNSAPKLQFEGHSSVSRRVTETLDIFDAQIGTIHLAKNQKSPMDFAIKAVSVPVHSPFLQIPESAFHIQTQAQFPPFPMATLLSFLANTMNIEVERFGLAVTTSLSRWNEARTIVEGLHERGYELKTRHLHPRERNVRLHGSELSRSGANRLGAYNGSARGPTVSELYRSRHGITLRHPSAPCLMEPGGNGHHDFFPIEMIRVVAPDQVSTPRGLSTRPLPRPRPSHFALWDRIDHPPRSRELVINVMPHGDSTSRGAAEEYRIGVGRELTISGPLVLRIYAGALLLALFSVALVDGQSSIAGLCPAHSFALCSSRLHKFSCLGPSLFGPSAFDFVQITNKFASLAYSPLPGSEHFAESYAEAADSPISPLCSAILPFLLSGLVRIWPLFKPWIARTGHHSFPSDYPILNTFCAMPAKPNLLSQELAELERRKMELEQMIASAKKEVPEGKSRRPKKCQSSDEPAPQDEPEEKGPKAAALSDAPTTQPSHPPLGIVPPPPPSPVGSDMADLLHGHVNKWAMEREEAVHFLQKKKRDVAVPVHDALKKFNGGIKRLRTALDDVQESVGSIAAGVNELASSTSDGLVIAVTLLQAEVDRQAVELRSLRRALHPPPDVETLSVASSDEGTIVAEPSSAASVAKATKKEEKKKK

SEQ ID NO: 152286 - protein, 860 aa, Heterodera glycines
  Coding regions on vcDNA: vcDNA=SeqID_78709; Strand=-; Position=1 -1243,1339-2675
  Homolog annotation: Hit_ID=CAA82797.1; Match level="QueryCoverage =56%, HitCoverage=77%, E-value=1e-29, Identity=26%"; Hit description =gag protein [Ascaris lumbricoides]
MSSARCRMALGPALFRLRQHVTTAENLLDEPVINAKTTENLEQERGHITRILSRMEVELDAWGAIMNGLQGPAREAEEALFTAFVRDDRHLTEWLEDAREMLAHIAAELADEPNQQIAAGGQQPAVAVNPPVPAVPFVNNAVFPGGANAQQPAAVANAANQPPPMPINAGGVHGQQPFAVANPANLALPVPINAAPVPLATARLPQLSLPIFSGEPMEWPAFWQSFESAVDRAALEPVDKLNYLHGCLRGKAARAVTAYRGGENYAHAVAALRRLFGDPRKIAEALQSELINLRPVDDSVGSLQHFLETLERVCRQLLNLNMPDDSPFMYQIIRSKLPSTVLSELIKMERAAGIPWSTPQLRAGLAEVLGVREEVERCLREANADRQTRFRHEARPNRPQRPERHENARVFPLLKTRKRCLLQQNRCLNCLRKGHQLRECRSKQVCRVCKERHHSAICPSAKGTSSARSKQQKPSPRNKQSFGNERNSRPLVSSAVANEADSIPEPKTVNTIMAIVSPSVPHLVMLMALRAPVFSESAPNKRRDALFFFDPGAQVTMVKTPLIRQLSLPKLQDDQLEVNPFHTRQPIKMKAPQHVLCVQREDGGYETLVAHRTDWIVPSVRRATFLQGMLVPVDEEPDILVGMADFWKFFNGVQRVSPQLFKVQTSIGSTVCGRDEIPSRPTADHPLSVMPVTVHVPANEDEMPNTAVSGIQRNESISDLDSLRQFWDLQNIGIRDDPLENDDETAQQIFDQTTTRLANGRYSVGWPWKNFPPDLPSNFAITRSKTKALASVLFILMCLFLIGASQTNASSTTKPKRRNGHPIRCRGCELTCTKTGVDILIPNGIAKFLLCCADGTHKGE

SEQ ID NO: 152287 - protein, 85 aa, Heterodera glycines
  misc_feature (3)..(3): Xaa can be any naturally occurring amino acid
  Coding regions on vcDNA: vcDNA=SeqID_78710; Strand=+; Position=1-255
TGXGELNFRRRKKYGRHNHQATDAHIGFTFFENDIEKAKRKSFISRPEASFSKNKKKFIIQRGGNLPTLKVSFGSPMVTWVPLLC

SEQ ID NO: 152288 - protein, 192 aa, Heterodera glycines
  misc_feature (116)..(116): Xaa can be any naturally occurring amino acid
  Coding regions on vcDNA: vcDNA=SeqID_78711; Strand=-; Position=1-582
  Homolog annotation: Hit_ID=XP_313526.1; Match level="QueryCoverage =100%, HitCoverage=51%, E-value=7e-34, Identity=38%"; Hit description= ENSANGP00000024994 [Anopheles gambiae]
STSPDGLPYILNKQCADCRFLAPIISELFRIILDYGEIPNLWHTSFIILIYKKGDKSNPNNYRPISLTCTLCRVFERLLAWNIVKHLEKTITDEQFGFLKTRSTTTLLLVSLDYFXKSIENGQNIDIIFIDFEKAFDSVPINLLIVKLQNIGISGKILKFLQNFLYRSYQVKIGENFSKSFKTYSGVPQGSL

SEQ ID NO: 152289 - protein, 22 aa, Heterodera glycines
  Coding regions on vcDNA: vcDNA=SeqID_78712; Strand=+; Position=1-67
NGRYSVGWPWKNFPPDLPSNFA

SEQ ID NO: 152290 - protein, 27 aa, Heterodera glycines
  Coding regions on vcDNA: vcDNA=SeqID_78713; Strand=-; Position=1-122
TQTQGGIELETPFLLTNSQTTKTKKPT

SEQ ID NO: 152291 - protein, 160 aa, Heterodera glycines
  Coding regions on vcDNA: vcDNA=SeqID_78714; Strand=-; Position=1 -192,627-915
MDFQNIFLHCQTTNEAALCLYRAHGFEVVQQIHGHYQCRAIDGESADAFLLERRFTNENDEERKSVATALHTEERLRALQDRCWALCWHHNGKLLASCGEDCTVKVWHCVDTAAMVPMCSKSDATTDIEGNGDGIWGSTGNTTSTKLALLCTMRGDQTRS

SEQ ID NO: 152292 - protein, 84 aa, Heterodera glycines
  Coding regions on vcDNA: vcDNA=SeqID_78715; Strand=-; Position=1-253
KLNNLFKKQHKSNFIHNTLIKCHNVFLVHLAHPGRLIFQVFDKFFISAQLSPRRSRKHENGQRIGADANHRIVDAKIEHRHNQE

SEQ ID NO: 152293 - protein, 143 aa, Heterodera glycines
  Coding regions on vcDNA: vcDNA=SeqID_78716; Strand=-; Position=1 -64,534-712,1328-1516
MHLLFAFFVSALQFHSNANPNVAISNPAVEAVRSSDQLATLVQAAVDVAHEFGLIKRLSDDDSRKRCASDRTAQGQLFRAWGMQKLYFLVSCDFDFLVKATEGMVKSNNLYGRMIEMMKEIHREGQRQPYTLFLTRSVIEIFY

SEQ ID NO: 152294 - protein, 37 aa, Heterodera glycines
  Coding regions on vcDNA: vcDNA=SeqID_78717; Strand=+; Position=1 -70,589-632
MRMSWIVGWSFCIPLFPKNTVCNKLGYAKILKQLLLA

SEQ ID NO: 152295 - protein, 332 aa, Heterodera glycines
  Coding regions on vcDNA: vcDNA=SeqID_78718; Strand=-; Position=1 -101,408-582,831-888,1007-1139,1610-1704,2028-2216,2556-2635,2685 -2738,2869-2981
KAPAADDQMARLLDRLNECVGQLKKEANGGEEKGIDTKSGEGQTAADDGTTAMEMRGDEEEQQQKQPDEDAEEKAPKRTPPQQQKEQHDEDGPSLADCVRELGQLVDTFADFATPPPTNCWLPFRENFIHRRHRPAILTLASVYAIYRVLKSADELETVSSSVDGDRREREALADVFVFFKLPKVLSKMLSRGVPRASVTAALGHLCASASLLDELDAKKSDNMFRFFMDALRRADIVGQTDHEALVLRRDADRGQNDELLQQLRSTIVGISSSATTAAEAAQSGEGALGADQPEVPIDMLCSIYSASGELSQFSGWLAALNAQTQMGGTNE

SEQ ID NO: 152296 - protein, 210 aa, Heterodera glycines
  Coding regions on vcDNA: vcDNA=SeqID_78719; Strand=+; Position=1 -51,131-169,226-315,363-461,524-661,870-959,1034-1129,1188-1217
PFDKFTQRTQAIEGLLGEISPKEDEKGKYVSAEQFTQLQNDQKKLLERVNELEKQGPTIAMINEQFEQLQNDQKKLLERINKVANSQQQEKYVSVEQFEQFQSDQKKAIFERISELEKQMKERMQKQADEETGPLAKKALLVDEQFVQLQNDQKAILERINEIENKRYAAADYVIGVKNDLNKEAKELKEKQKQFARETIANFERLSKKY

SEQ ID NO: 152297 - protein, 543 aa, Heterodera glycines
  misc_feature (206)..(206): Xaa can be any naturally occurring amino acid
  misc_feature (300)..(300): Xaa can be any naturally occurring amino acid
  misc_feature (406)..(406): Xaa can be any naturally occurring amino acid
  misc_feature (416)..(416): Xaa can be any naturally occurring amino acid
  Coding regions on vcDNA: vcDNA=SeqID_78720; Strand=+; Position=1 -69,939-1107,1230-1318,1368-1437,1491-1570,1618-1687,1773-2191,2337 -2866,2966-3052
  Homolog annotation: Hit_ID=CAE71381.1; Match level="QueryCoverage =97%, HitCoverage=91%, E-value=2e-89, Identity=37%"; Hit description =Hypothetical protein CBG18288 [Caenorhabditis briggsae]
MSCNPCCCLKLKDAAISIGIWSTIYSIMQLAIFGWQMAAIKYEKDRAANTLLPNYNTYGRYDIPTYYESYWQSPEERYYTGLFVIQILCLIAAFFLLFASIMMIYGVHTWSRFLLVPWSRFLLVPWMVTMCASILTSFAYCLIWWAGLIWWAGDVRDYWLLLTIVEMFGVLLNVYCFLVYCFLVIVMFHRRMLVELEYYARKEHGXLGKTFSRNGQNRPEAQQDGTYVPTPRRGKPMAPPHHPLAGAQLAGDFDATTNQRPNEMADEIHTARQLEQRHQKRGKREGGGVAWQNVNSNICXFKESVSLFTKVLSFSALDSPIILSHLHQIRSLSAMEQALPAECHRDQSHRRCHCCHASKHCHWHGHSAESTKGRSHRQVRILHLANIRQRNCRPLDEEQAEKDTEXEKKEQRKSTXKHHGRTERANCKRGGGGQRKRGRRISGQLSSELGHTVRSEREYGNVGSLERRWQDRHPTSNSQLSRRGGDSSSNKASARGGKGGGEEKPFLEFGGIAIPGIAIPQHIVIPPAQMGAKERNMDSRVIN

SEQ ID NO: 152298 - protein, 122 aa, Heterodera glycines
  Coding regions on vcDNA: vcDNA=SeqID_78721; Strand=-; Position=1 -82,513-796
  Homolog annotation: Hit_ID=NP_504179.1; Match level="QueryCoverage =63%, HitCoverage=7%, E-value=3e-15, Identity=53%"; Hit description =predicted CDS, protein of unknown function DUF32 and RNA-directed DNA polymerase family member (5E747) [Ca
MSISILTLYEPFHQFFQFFKPFDDWDKEFQFGFVRNRSTTSKLISVVEDWYEAIIEGKNVDCIYIDFQKAFDSVPHNLLLYKLEKIGIRGKLLKWIKEFLSNRFSDHILQITRNAYSRMRSL

SEQ ID NO: 152299 - protein, 328 aa, Heterodera glycines
  Coding regions on vcDNA: vcDNA=SeqID_78722; Strand=+; Position=1 -316,503-1173
  Homolog annotation: Hit_ID=BAA88337.1; Match level="QueryCoverage =72%, HitCoverage=24%, E-value=4e-16, Identity=27%"; Hit description =ORF2 [Platemys spixii]
MPEAMDGRALVEQIAEECGIKDKLSPDIHRHPRTPPESGAKRDRILKVPFLDKLSRDKFLYNFRNALKKFPNFPQFIKVRRDMTQSELKILYSLRQQAYQANIAAEHIAQKYDPSIFIINETWLNPRNTIENELSINGRYRVILANRNEKKGGGSAILTKTNIPYQTLFSGTKFQSEILHIKLLFKKPIQIINIYRPPNCTVQNTKKLLKFISDQSNSENIIYCGDFNIPNILWDDNKVLQRNEPVSNLLIEFIDQKQLKQHVKQPTREKAILDLVITSESEIINDLTVLENFSTSDHKMVGFKIKGKFSRNNHRVYRRDLKILIFRN

SEQ ID NO: 152300 - protein, 41 aa, Heterodera glycines
  Coding regions on vcDNA: vcDNA=SeqID_78723; Strand=-; Position=1 -25,337-437
MAGGGGWSVPVCIKIRIGSPDRDPRITDSRIEKSVDQNPYA

SEQ ID NO: 152301 - protein, 281 aa, Heterodera glycines
  Coding regions on vcDNA: vcDNA=SeqID_78724; Strand=+; Position=1 -119,791-951,998-1225,1272-1499,1546-1655
  Homolog annotation: Hit_ID=AAP80689.1; Match level="QueryCoverage =87%, HitCoverage=100%, E-value=1e-122, Identity=90%"; Hit description=polyubiquitin [Griffithsia japonica]
MGYPIRSLCIRILIHGFFDPRISDSWITIRGSDPDLYAYGEYSLFIIMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKNCIDE

SEQ ID NO: 152302 - protein, 35 aa, Heterodera glycines
  Coding regions on vcDNA: vcDNA=SeqID_78725; Strand=+; Position=1-106
MTAFSVTTSAMTTANWRRMEIPTISTNLRLLLCTN

SEQ ID NO: 152303 - protein, 212 aa, Heterodera glycines
  Coding regions on vcDNA: vcDNA=SeqID_78726; Strand=+; Position=1 -30,100-708
MEPTQHILIKNFHRQRLSTSSDPLLKRNFCKSLGLESCLGFLVLGIESRGQVSESVSSLGVKSRNRSRVSGSSLGLESRLEKSLGFFGSRYRVSGSSLGIGLESRGQVSVSTREKSRVFWFSVSSLGVKSRNRSRVSGSSLGLESRLEKSLEFFGSRYRVSGQVSESVSSLGVKFRSRVSGNFWSRASLLSAPLALLPMPRQDIVPFFDHSD

SEQ ID NO: 152304 - protein, 20 aa, Heterodera glycines
  Coding regions on vcDNA: vcDNA=SeqID_78727; Strand=-; Position=1-62
MWKNYDFINNNCKNWTRDMI

SEQ ID NO: 152305 - protein, 220 aa, Heterodera glycines
  Coding regions on vcDNA: vcDNA=SeqID_78728; Strand=+; Position=1 -388,435-709
  Homolog annotation: Hit_ID=CAE56395.1; Match level="QueryCoverage =99%, HitCoverage=30%, E-value=4e-35, Identity=38%"; Hit description =Hypothetical protein CBG24082 [Caenorhabditis briggsae]
MYTDRGLEFVAKPLKEFYAEKGIQKFETSSKKKAAVAERAIRTLKTRLYKYFSANNTSVWVDVLPKFLSAINNSVCRATGLRPNEISDANAREVWKRVYGEGLAQLDKSPKIRAGETVRIPEPKHIFEKGYIPNYSDHVYTVDEARSTNPQHYLLKDYYGTKLKRKFYLPELTKVQVDENTMYRIEKKYKERVRDGKREMLVKFIGFPEKYWVTNEEINE

SEQ ID NO: 152306 - protein, 88 aa, Heterodera glycines
  Coding regions on vcDNA: vcDNA=SeqID_78729; Strand=+; Position=1 -102,151-314
PHIFRLRFCATDPFSSQSLPNLCQLFRHFALNFQFVRVLSLLLVREHLGINPNKISVVWRNDHFVCAPFEQLRTFLDEEQTVRVNDQT

SEQ ID NO: 152307 - protein, 557 aa, Heterodera glycines
  Coding regions on vcDNA: vcDNA=SeqID_78730; Strand=-; Position=1 -203,245-353,408-697,742-903,967-1126,1177-1375,1420-1536,1755-2189
  Homolog annotation: Hit_ID=NP_001004509.1; Match level="QueryCoverage= 81%, HitCoverage=31%, E-value=5e-27, Identity=26%"; Hit description =si:busm1-180o5.3 [Danio rerio] emb|CAD60788.1| novel protein similar to DNA polymerases [Danio rerio]
TDSKTSVKWKAQEKTARNTVLFNGRLRSQLIGRATRLQYLEDSPAMKAFFDNCPDSGPIDFHDAFFGGRTGPEYLGASVINPETGDWKSRTIKVKDFNSLYPSRNMFTNYPVGHPTVVQFDKDVEWRRQEDVVGDDGIRLEGIIKCFVVPPRHCHYDIPVLPYRLNNRTLFPLCRTCSEMYPRGLIDPEYNCDHFEDSERGFSTTVTHIELEAALRSWYKVTHVYRAYIWPLACDWSNGLFHSYLLKFLKMKFEASGYPASCTEAGISEEESARRKQEHIDKAKEKAQVPLEADRIKHNPGLRYLSKLKIYKKLKKINRNRLTKTEIVECHAELAKLLNDSKIEVSSIDQLTEKFWMVCYKAKDEHVVEHSTSNVAIALWTTSAARIHLLESLKKLYGPAPGVERYDTRILYMPAGPKAYGLWLRNNATGEDEYKLKVRGITLDSDACERITFEKMKDMVQNKLGQPDNNVRFNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 152308 - protein, 280 aa, Heterodera glycines
  Coding regions on vcDNA: vcDNA=SeqID_78731; Strand=-; Position=1 -184,228-355,566-728,777-991,1036-1188
  Homolog annotation: Hit_ID=NP_507780.1; Match level="QueryCoverage =88%, HitCoverage=20%, E-value=1e-13, Identity=25%"; Hit description =predicted CDS, DNA polymerase type B, organellar and viral family member (5T899) [Caenorhabditis elegans]
MEPGAKKRRKRKNIDNTNGEAMECEEEEDAVDEDAENNWMLGYEEAGEKPESVTTYAYAHAGSRYDHVLIYGEMLRMGARPELIRQGNHLLEMKARKTGVYTPTAENYGTVLDTLQPIENYYPGGLFPAERTKFEQWYEENRETGFELSEVIADYCKTDVQILAHGMVKMRQMFLSETRHDITDSVTIPSGCMKYWVQLAHHDKERVAIIPHLGYEKRGKQSSIARKYLKWRAEEELRENGRVLRHVESPGGEFKFGNYSLDGMMERPDEDKNLAIEVNG

SEQ ID NO: 152309 - protein, 160 aa, Heterodera glycines
  misc_feature (60)..(60): Xaa can be any naturally occurring amino acid
  misc_feature (138)..(138): Xaa can be any naturally occurring amino acid
  Coding regions on vcDNA: vcDNA=SeqID_78732; Strand=+; Position=1-630
FFLLWHLFFCHLLFMCQIGIIITMAPFFVPFCRNLLALFCPLISQFISCQFLALFCPNFXLYFANFAHFCAKFPYLFLANFWHSFATIFNPFFCQFLHIFVPNFPIYFLPNFCTFLCQISLFISGQFLAFVFPIFSFXIFKILAFCFFSKLNYGILFFQI

SEQ ID NO: 152310 - protein, 269 aa, Heterodera glycines
  Coding regions on vcDNA: vcDNA=SeqID_78733; Strand=-; Position=1 -132,192-327,467-1008
MSQFSDTSQPPMLYGPYSPVGDDGTELMDKAPPLEDIIKHMPNTVVPSEENECKARREPSITRELDAELFNGDGFACLSAAQAEAGRFKAFRFIGQFLMSISFGAVFPEDILRNLFTMCLAYAIEGAESMKITADHFIFLLTSKHLDYEVAVHFKKIDNTATERILTRFEMVDQSNKAKERPSLLEEPFVIDITAIESKCAKPKMAGKGRNDLNIDYRIADGATYELLNNDNLCLFRSFEMLRMKFVLAQQRFSEYKRDERKQLEGVYA

SEQ ID NO: 152311 - protein, 93 aa, Heterodera glycines
  Coding regions on vcDNA: vcDNA=SeqID_78734; Strand=-; Position=1 -225,285-340
MPFFHATCNQCKNHPNSETYLENQELRLYIGIVDFFTPFSGTRKQKYIGGLKNYINVETKDAKDLMAYVKTGRIWETFGPIPPPMYADRMLAF

SEQ ID NO: 152312 - protein, 300 aa, Heterodera glycines
  Coding regions on vcDNA: vcDNA=SeqID_78735; Strand=-; Position=1 -241,329-609,1141-1365,1628-1782
MVGKLNFYAAGILYKEKDEKVQPIDKGPDEKLAIEKMPDEKVPDEKLAIEKVPDEKVPIGKWHKFEGQEIELMPREIDMTDENDNICIEFLALADADEMKDDAHFKMDDKERIQAKLGKYICKNMKENEKNKQKNPKKLNYDFDWTTVDDVQFYAEEAMGEMRVKFGITYKKLADSFLSDDLTDLGVKGKSSNGFYRTKDEIFLLKQIPKDDEAKIIEKTLENYFEHMMKMGDKSFINKIFMVFRVQIKNTPTLFLLMENVFKNAKDLPLLNFDVKGVFSRQPKLVEVDPKQRLNDVVLK

SEQ ID NO: 152313 - protein, 98 aa, Heterodera glycines
  Coding regions on vcDNA: vcDNA=SeqID_78736; Strand=-; Position=1 -142,767-921
  Homolog annotation: Hit_ID=NP_499279.1; Match level="QueryCoverage =91%, HitCoverage=94%, E-value=3e-15, Identity=66%"; Hit description =UNC50 (3L404) [Caenorhabditis elegans] pir||T24631 hypothetical protein T07A5.2 - Caenorhabditis elegans
MTAAAKLSRFFRRLVHVRQMDFEFAAWQMLYLLVNPQKVYRNFMYRKTLPTLKNTQFFLYPITFLFIFFVAATSAGWNVSITAMDFYHFRVTNADLRG

SEQ ID NO: 152314 - protein, 153 aa, Heterodera glycines
  Coding regions on vcDNA: vcDNA=SeqID_78737; Strand=+; Position=1 -76,115-500
MSGSGSYINLPRSGLTLGIQLGYDYPNRGKLRKSKSPALLGAEAFSDREQRTLEKFHERFERERKIAREERKRRSNERRLESETEEESDEEMVLDKENTDSEEMEKTDIRKGGESDEKGRNNNGKEKVERNDKRKSHSGDREEKKAQKGRKEY

SEQ ID NO: 152315 - protein, 87 aa, Heterodera glycines
  Coding regions on vcDNA: vcDNA=SeqID_78738; Strand=-; Position=1 -64,281-480
MEHFHCTAKPAQAPNFRRTSKVFPTISRFIEVLRMDQRARDADYVNIVNGEEPPMKKKKFGRRKSEFLNVIENFDAQNIIVSQGNFK

SEQ ID NO: 152316 - protein, 168 aa, Heterodera glycines
  Coding regions on vcDNA: vcDNA=SeqID_78739; Strand=+; Position=1 -85,135-454,1612-1664
  Homolog annotation: Hit_ID=NP_499097.1; Match level="QueryCoverage =97%, HitCoverage=11%, E-value=1e-30, Identity=45%"; Hit description =yeast CLU (mitochondrial clustering) related, related to yeast mitochondrial CLUstering (139.9 kD) (clu-1
SALKLLYRARHLLLLAHGEQHPYMGQIDANIGIILYALQEFDTSANIGIILYALQEFDTSLKFLNNALTLYQKYGVPVKTALLHHVIARAHSCRGDFRTALNFEKETFNIYSRVFGKEHEKTLVSNECLRHLTKQAVNFQKHMNDASQGLNISKLWSSSCPTMSFSAV

SEQ ID NO: 152317 - protein, 91 aa, Heterodera glycines
  Coding regions on vcDNA: vcDNA=SeqID_78740; Strand=+; Position=1 -150,602-727
MDNECAQLKFEKAEKEKHIKYLEVEGAKKDEQLDKKDDQIKNMQNDATKKGWHGIPTSEFRLPTFLGSEFRLPTSENFWGLGIPTSDFRNF

SEQ ID NO: 152318 - protein, 38 aa, Heterodera glycines
  Coding regions on vcDNA: vcDNA=SeqID_78741; Strand=+; Position=1 -25,119-210
MRVTWPRFAIEIAHIFLVAPVTALALCPNILCRFFATS

SEQ ID NO: 152319 - protein, 285 aa, Heterodera glycines
  Coding regions on vcDNA: vcDNA=SeqID_78742; Strand=-; Position=1 -384,438-613,659-830,874-999
  Homolog annotation: Hit_ID=NP_492712.1; Match level="QueryCoverage =97%, HitCoverage=38%, E-value=3e-29, Identity=29%"; Hit description =nicastrin, Anterior PHarynx defective APH-2 (81.4 kD) (aph-2) [Caenorhabditis elegans] pir||T27570 hypoth
MDSFSTFRGAKGGDLSVLSSLVSLLLVAHSVGQKMDIFNRLASLSRRQLLFAFLHGESLGYIGSSRWVWDMGRGHFPAVAKNFSEESKNVRQIGVDELSFFMELQQIGASPKLYAHTDAQIYKQNKSLIDTVLHNAKGSGEHFHFVDPSSVPFGAAPPSSYHSIMKASDKVPGLILSSFGSADYEYPYLNSFLDDQIRTHPKQLDEFLRKIIDASNIALRAALSYLFANNNATEVDQFKIDENYAKELGECFFVANWSCPLFRTLTNATNDRQIDAYLNDTGITL

SEQ ID NO: 152320 - protein, 264 aa, Heterodera glycines
  Coding regions on vcDNA: vcDNA=SeqID_78743; Strand=-; Position=1 -105,167-296,353-471,529-847,889-1012
  Homolog annotation: Hit_ID=AAV28475.1; Match level="QueryCoverage =95%, HitCoverage=34%, E-value=1e-16, Identity=25%"; Hit description =nicastrin [Danio rerio]
FAYDGVEDQIFIRLNNTDVQCVRMLNGTHSIGCQSSRNGNVGVLTEIVHAKDVQNAIGILPLGLSNIIAVIQLTNINDALIGILRSHAQVVGILLIHRGKDKPKEFSEDGSCPNRQFTFYSNEKTIESCHGWNQKNAIHSDGLKFIDFNKPLRLVTSNEEIDLIFDKVLPAQFAFTNLLLQCIEPFNKKLMAEGLRCVGRMTQFMSAAGNTKICLERTADFGESSLCEVLEDMNVFLMLPPLSKQNHSADQFVLAARVSSLFHT

SEQ ID NO: 152321 - protein, 54 aa, Heterodera glycines
  Coding regions on vcDNA: vcDNA=SeqID_78744; Strand=-; Position=1-170
IVQFVPPPFSKFFYVFKSHKNTFYGVFGIADHESGAHLDQFLIPDPNSNKKSEI

SEQ ID NO: 152322 - protein, 248 aa, Heterodera glycines
  Coding regions on vcDNA: vcDNA=SeqID_78745; Strand=-; Position=1 -327,371-566,616-837
  Homolog annotation: Hit_ID=NP_507845.1; Match level="QueryCoverage =95%, HitCoverage=34%, E-value=3e-50, Identity=42%"; Hit description =transposase family member (5U321) [Caenorhabditis elegans] emb|CAB81975.1| Hypothetical protein Y116F11B.
MRVTVCLTARNNGQKLKPYVLVNRKRPVPQIVKQFAGKLVINFAGPIWMNDDTTEDYLHKIIGAKLFVGERLLVWDAFGSHKSERTTKVVKELGVETVFVPGGCTKFIQAPDVSWNKPLKERIRHFYNTWMSNDAEKEFTPAGNPKAPALHMVLDWIHRSWQEISKAVIIKSFEVCGLTTPLDGTGDEKIACFKPEGAIGPIGTKFLREFRENETVKDGRNDHEEAGLSDDDGDVELDGVGDDDEFFI

SEQ ID NO: 152323 - protein, 168 aa, Heterodera glycines
  Coding regions on vcDNA: vcDNA=SeqID_78746; Strand=-; Position=1 -15,72-239,604-758,826-994
MAHKRKRQNKDAPCSSTNSDLVNQCSFPLDQLPLNALVIVASQLPFKDFKRVGTISKQFNRSISNGRELFTEVRRLNVQKCVIELRDMEFLAQLMPKVWYIRCSGQTLVIPEDIDQSKMALSVEQMRQLHAKLDNFDYVASKCTKKHLWFINKLTELFAELEIIQLDN

SEQ ID NO: 152324 - protein, 351 aa, Heterodera glycines
  Coding regions on vcDNA: vcDNA=SeqID_78747; Strand=+; Position=1 -56,324-668,720-995,1055-1432
  Homolog annotation: Hit_ID=AAL78214.1; Match level="QueryCoverage =49%, HitCoverage=89%, E-value=1e-38, Identity=48%"; Hit description =putative esophageal gland cell protein Hgg-20 [Heterodera glycines]
MTSAFSGSWSSGNEHWLTSISGHSIPKHINNSFLNIITASVLRPCRHQQIKSTAAQPAAEVRTNRRHQTKLGTAQSKPSSSSSSDEEEKKVAQEEPTVDKQKQSEAKQAEQHQQPQQEEKGQQDAPPRRRMDNTDQIWLDTLAWLNRGEVGTNIALVNARFAKLVDKQLQQRHWWLEELHICEQKPKGTGAEAMSLNSDGSYYSLPLATVPLPENVVGFNSTFNIWYFDAEVIVFLHRMRRLFTTDISLQFAIRMTEYRAWKAMARHIWPLLKNGLIILVNLKRKQLSMMRKHVSPTVLLDCPNLVQITSSVLPERPTDDDTFSADLSGRDLYMWLHTPRPDDRLLVYKLT

SEQ ID NO: 152325 - protein, 173 aa, Heterodera glycines
  Coding regions on vcDNA: vcDNA=SeqID_78748; Strand=-; Position=1 -5,213-360,409-777
MGIKKELIAFFAKEKVEFETRIECLESGALLPAPEEFVTIGRSNAVEDVVPDSILDGDTARSEGGESTKKRRNRGGGQRKRERRRNAEEAQSRAGDDSAAPQLNEQQQQLNANGEEEGEETIANPMPKTRALDEQSNASSTLSSKQRRTEEWQAKQWYKNARGKGSGGKEKEN

SEQ ID NO: 152326 - protein, 230 aa, Heterodera glycines
  Coding regions on vcDNA: vcDNA=SeqID_78749; Strand=-; Position=1 -74,113-384,441-594,644-836
MEGWEVVFKQQQEEHFESSAAAIKRLKDACPLLTHTHSSSVHTTAKKPTLRQGRSSSTISLGRLPRNARPADEIELLQKYDVQQLIRCFCCGVQRPLGRGGHTQLSCPYRHPDSYPLCENASARDPDKCWNCASIAHKTNQCPEPRRKPSRRNKVALPREQLLDKNLCSSCNTTGHFAKNCPKKRQRHGQQNQKNTKMPSTSNCFSYQHDSSGSSVNDESDDVIYLSSDD

SEQ ID NO: 152327 - protein, 154 aa, Heterodera glycines
  Coding regions on vcDNA: vcDNA=SeqID_78750; Strand=+; Position=1 -176,228-312,827-1030
  Homolog annotation: Hit_ID=NP_499725.1; Match level="QueryCoverage =88%, HitCoverage=18%, E-value=2e-40, Identity=55%"; Hit description =leishmanolysin-like (76.1 kD) (3O317) [Caenorhabditis elegans] emb|CAB16471.1| Hypothetical protein Y43F4
MEDSGWYRANYRSINRWSLLLAQLIHVISIAEQLHWGHGLGCSFAMESCGKWIWEKLESNQSTAPFCANIKHDGSRSLATTRCTDQRDSLALCNLVPYKKPLPVDYRNFAHLHGVRHEGTKYYGGSVELADFCPYNQVDVSPEGGGGGGTVRSG

SEQ ID NO: 152328 - protein, 122 aa, Heterodera glycines
  Coding regions on vcDNA: vcDNA=SeqID_78751; Strand=+; Position=1-369
MNETDKEEGKAQRGGGREGKTERKERAKGREKEEKGKEEEEDEESGGVVVCPLTTHRSVIVTCDICVGRAKMIKGKVTECGQVGGADEQRIGKWARKQDNVRGQQTQRGNNAMPEAKKVIRK

SEQ ID NO: 152329 - protein, 77 aa, Heterodera glycines
  Coding regions on vcDNA: vcDNA=SeqID_78752; Strand=+; Position=1 -130,174-219,505-544,593-652
  Homolog annotation: Hit_ID=CAE64368.1; Match level="QueryCoverage =62%, HitCoverage=18%, E-value=2e-11, Identity=58%"; Hit description =Hypothetical protein CBG09055 [Caenorhabditis briggsae]
MFVRCFILPFISLAFFVSFCTAMRRNPSDYDQSRVPPNLRIISWLLGVWRSEHDGKAMFPTIPKFTYGEEISIALSD

SEQ ID NO: 152330 - protein, 18 aa, Heterodera glycines
  Coding regions on vcDNA: vcDNA=SeqID_78753; Strand=-; Position=1 -44,194-206
MCQKAEIKQRVNMFSVYN

SEQ ID NO: 152331 - protein, 282 aa, Heterodera glycines
  Coding regions on vcDNA: vcDNA=SeqID_78754; Strand=-; Position=1 -91,223-404,748-903,1028-1447
  Homolog annotation: Hit_ID=CAE61925.1; Match level="QueryCoverage =26%, HitCoverage=3%, E-value=1e-11, Identity=46%"; Hit description =Hypothetical protein CBG05922 [Caenorhabditis briggsae]
MEDPWSPSLCAPPNSLLMDDGGAADAKSTKTSLAPHPVPPIITVTTTDDRANAEGSEEEEEVETADEHHRRPSSSSSEEEEDGDYPDTVQPVPTVSAATIAQLQEQQEMEQQKMAAQVLQQIQAFGEAADDEFDVQWAKPKTKISVDDNQMHQPTEQRDNFFLEDQANVYSPPEAEEEAASAKSIGIARRCSGTDQSAAQSGEVQQQRDGGGACEEASGSSSRSTTIVYRNQQQQQMTNPFLSDENGTLHNDGDEEEEEDEQSGEGHEGGIVVRQVVNATIE

SEQ ID NO: 152332 - protein, 436 aa, Heterodera glycines
  Coding regions on vcDNA: vcDNA=SeqID_78755; Strand=-; Position=1 -171,348-1133,1410-1760
MFFSSAQKPATATSTAFAGFGNKFGKFASETLKGAKQAKEMAVTAMAQAGQTLETAMTTTIPASSQQDDQQPQTVQLQPETVPQRPHSSLGLSAAGPAGGDQQIAPGTGGGSASLNKSASLYDVALPPGFDHLSEEEQLCIISVMQCAELDAQMDAERAQAVQAAPPLPQTVPSALRHKATDDVTTITAFGIMSQPLAKFEPSQAEQTAVPPSSSAAFADQQHQGNAGAETAIELAVEVRADEAEGNNGLGTAAFIDTSAAAAVQLDLARYGHPLGLFQTETEQSAAEKGQDQTVEDQKRHNIEEDDEPWMQPPTQKFTAPLDQWDDMPMNTVTPRKQLWTTVFTEDTDQQQQHQQHQQPNVLQADGAVAAPNAEETEEDELLEQISMETVRGCWERSNGDDRIANQFGRARINTDQIDKRKEGQQMMMEEDELTR

SEQ ID NO: 152333 - protein, 102 aa, Heterodera glycines
  Coding regions on vcDNA: vcDNA=SeqID_78756; Strand=+; Position=1-309
MAVSSVWPACAIAVTAISLACLAPFSVSEANLPNLLPKPANAVDVAVAGFWALEKNILPIFKDGADCSADDDAMATPKVEDGLGGSGGGGGRGTAGRANQKI

SEQ ID NO: 152334 - protein, 469 aa, Heterodera glycines
  Coding regions on vcDNA: vcDNA=SeqID_78757; Strand=-; Position=1 -1109,1644-1939,2073-2077
MERGRESGEKPLRGTEEKEKKSERTSIAENDMGTEAESDEGKLSDNDAAPLAVTLAQPMERQDEENGDDILAYSFNASGSAVVRPNCASPQIMPTPCEYSERGICLAGDGGFDGQIVPPAWQMEKEDDDERMGSITDAREREDDERGGKCIADAKEKADDEKVGSTGDAREKEGDEIVGSFANARERLRDENVRSIGETTEWEDDERVRSFANVDVMASSGQPVHASLSVIASRGLELSPSSPAKTTTSTASAAVVAPPLADANPFSLPQFPCPAASIVHQQQQKGEEENQKTKQNAAAAAAVAFPFPFIVPPADASSSSSISSHCSAAAVPIVSQEQKQHQQQRQNAETEHGTESADGQQHGGSTKEQKSLSVAQEIGDAFWTEEGQPQQNNLSTNTTTSKTTTTTTAIGTNYHHQQQRHHQFVGGQKDGKRVPKPFVGDEEGEDEQQKQKHTVQEAVPIAKAAAAGG

SEQ ID NO: 152335 - protein, 102 aa, Heterodera glycines
  Coding regions on vcDNA: vcDNA=SeqID_78758; Strand=+; Position=1-309
MCSRSSVLSPASALSGNSSVTAAAPSSGDPPLDVLRNSSMMSPPPPAAVSPAAAPPMDKRLVVVLLLPLVAVVVVVLIENVVARGAKKGVNLADQGRALLDD

SEQ ID NO: 152336 - protein, 126 aa, Heterodera glycines
  Coding regions on vcDNA: vcDNA=SeqID_78759; Strand=-; Position=1 -108,446-719
ALYFDDKYCELLKDGPQHSHEQQPQQMCSSPDSDGWDGAEMSCWQATAEHHHANKEEEELLLYEVHHEMGEQQQQEEQPAEAAARAGFKQELISGLNVFAGLMRRSSTATTTAVSMRNVILDILGN

SEQ ID NO: 152337 - protein, 789 aa, Heterodera glycines
  Coding regions on vcDNA: vcDNA=SeqID_78760; Strand=-; Position=1 -2301,2708-2775
  Homolog annotation: Hit_ID=ZP_00151052.2; Match level="QueryCoverage =58%, HitCoverage=73%, E-value=4e-34, Identity=28%"; Hit description =COG0810: Periplasmic protein TonB, links inner and outer membranes [Dechloromonas aromatica RCB]
MARIEAVQRRAQEEEMARIEAAQRRAQEEEMAQIEAVQRWTKEGEPKMPELTDEEMAQIQSVQRRAQEEEMARIEAVQRRAQEEEMARIEAAQRRAQEEEMAQIEAVQRWTKEGEPKMPELTDEEMAQIQSVQRRAEEDEMARIAAAQRRVQEEEMAQIEAAQRRAQEEEMARIEAVQRWAKEGEPKMPELTDEEMAQIQSVQRRAQEEEMARIEAVQRWAKEGEPKMPELTDEEMAQIQSVQRRAEEDEMARIAAAQRRPQEEEMARIEAVQRWAKEGEPKMPELTDEEMAQIQSVQRRAQEEEMARIEAVQRRAQEEERKVLKLTDDAIKKFNRTDDDEHEMISSSTSPADSNPSPLDSSTDLHSIKEFHGDHFVRQDFRHLSTNAFPPDSRHDPHEIVHEVQSVQQQQQQPPVDAACPSPAPSSSPSTSGADSIRSSAEHSQLYEPSTPLLLSDNDMEPLDAAQHRQNLPQKVEPDLSAETTMSQSEKTLAQSRVPLYNECPSEFDVPLSQEGNDSMPPEQLPTQPLVLPFAEFPNVPMETDYENNLVGMSHKRRQSGGGDASCTVMLLSGRHQQRWLSLGTVSGMMADSFDGGDNILTPLPSLPFLQTAKLYGDNAKNIVADVAEPAVVEHQQQFKRNSSSTKATNSRSRSSSCTSSNVNIMFTDECLRRSFCDDQADDSEKQHEAEGEQYRRHGAVDTVNIGTDNRNSIVLQRTNRMAFGEKSMTENGGSVEKDDETDTEANKQWAEQQQTDWANDVDFMYKLNFFAQRLSEQIAEEAARDITN

SEQ ID NO: 152338 - protein, 63 aa, Heterodera glycines
  Coding regions on vcDNA: vcDNA=SeqID_78761; Strand=-; Position=1 -75,417-533
MPFFVSFSYTKIFFCDFRTSLLPMNVKNHIKQILRQKGKSLDEKETELEEYVQSLQEDKPKEA

SEQ ID NO: 152339 - protein, 30 aa, Heterodera glycines; identical to SEQ ID NO: 141344
  Coding regions on vcDNA: vcDNA=SeqID_78762; Strand=-; Position=1 -12,102-182

SEQ ID NO: 152340 - protein, 364 aa, Heterodera glycines
  Coding regions on vcDNA: vcDNA=SeqID_78763; Strand=+; Position=1 -112,378-577,689-742,873-1131,1836-1964,2020-2064,2144-2373,2708-2725
  Homolog annotation: Hit_ID=NP_505697.2; Match level="QueryCoverage =99%, HitCoverage=71%, E-value=8e-97, Identity=49%"; Hit description =putative protein family member, with at least 6 transmembrane domains (5K988) [Caenorhabditis elegans] em
IGSLEMPRSEWLFSSVATFQQSYGQVHPYLAAVLCIVGTLMNAITVLVLTRPSMRSPVNVLLSAVAVCDIVVMSSYLVFVVHFLLTAASRCEPSDFSYGWALFMIFHAHASVIFHAASIWMTVSLAQIRVLTIRRATAASSPLVTERFTVLLAVLMLCAMTLVNLPNFLTFEVVASARSIKTQSFDNRRSIAGSINKTIFTDNGSALLQLAFWSNGMIFKVIPCLLLTLSIWALLRIIADVAHKRRNLAQVMRKKVVPKVMRKKVVPKDHTTPMLAAVLLIFLAAVLLIFLLAELPQGLFLVLNGIFSAESFHKRVYLPLGDLMDLLSLLNSAVGFFIYVGMSRKFRTVFLQLLFSVLRQTILS

SEQ ID NO: 152341 - protein, 93 aa, Heterodera glycines
  Coding regions on vcDNA: vcDNA=SeqID_78764; Strand=+; Position=1 -94,777-854,954-991,1036-1105
  Homolog annotation: Hit_ID=CAE75243.1; Match level="QueryCoverage =100%, HitCoverage=21%, E-value=3e-30, Identity=52%"; Hit description= Hypothetical protein CBG23195 [Caenorhabditis briggsae]
PIQVLFTIGLYQIIEVNEPQQYILLNSWIVEVWIPDTTLYNSLVMDDEQSRRILNVKLNTLQKEKSALVEMLYPTLYQFSCMLDLRFFPYDIQ

SEQ ID NO: 152342 - protein, 28 aa, Heterodera glycines
  Coding regions on vcDNA: vcDNA=SeqID_78765; Strand=+; Position=1 -22,217-278
MVPGQIQKGRKYGQWKCFGARKVPGNGQ

SEQ ID NO: 152343 - protein, 263 aa, Heterodera glycines
  Coding regions on vcDNA: vcDNA=SeqID_78766; Strand=-; Position=1 -35,193-283,347-409,502-535,582-633,802-835,1031-1124,1239-1303,1371 -1533,1960-2093
  Homolog annotation: Hit_ID=CAE69091.1; Match level="QueryCoverage =95%, HitCoverage=53%, E-value=3e-79, Identity=63%"; Hit description =Hypothetical protein CBG15112 [Caenorhabditis briggsae]
VRVVSLAFGNLFVITAILIERDLRCRPQYYLVFSLAVADLMVGLIVGLIVTPLGALSTLRQSWELGVTLCDFWISVDVLVCTSLVCTSSILHLVAIALDRYWSVTNISYSNNRTPRRIFSMLMVIWVLSLLISLAPQFGLKDENFVTRVREQQVCLISQDIAYQVFSVFSTSTAFYIPLFAIMLIYYKIMRAAKKRFRRERDRRTVNRTVVETVPPKASKMPVFPTRCFFPSAVSVSDSQPNGSTSNNNNYSNSHSNNMLGAN

SEQ ID NO: 152344 - protein, 276 aa, Heterodera glycines
  Coding regions on vcDNA: vcDNA=SeqID_78767; Strand=+; Position=1 -93,151-468,735-823,1098-1240,1292-1465,1569-1582
MTISDNLFDDIWKRSGILNLPRKSENVPKIKVEPFDEHSSAAAADAKANTKFGKIKKENFEIFEKNAKIKQEEFGGSESRQFGAIKIKTENASNTEVKEENENYRNLSEIYEKWNKNEHEKTVISRTDQQNPSLSSNSIRHRALIMVTVITRMMIAVIMVMMMPVLRESEKEEFVRKYNQIQREKPEMKDEETVQMLNIPRRTIFRWRKQLAEKIKLSENDEMREIVSEFERRKEQLAQQWGRVPERRTQNKIAKELGVSARAIAFWKKEFGERKA

SEQ ID NO: 152345 - protein, 74 aa, Heterodera glycines; identical to SEQ ID NO: 141220
  Coding regions on vcDNA: vcDNA=SeqID_78768; Strand=+; Position=1 -217,263-270

SEQ ID NO: 152346 - protein, 52 aa, Heterodera glycines; identical to SEQ ID NO: 141219
  Coding regions on vcDNA: vcDNA=SeqID_78769; Strand=+; Position=1-157

SEQ ID NO: 152347 - protein, 421 aa, Heterodera glycines
  Coding regions on vcDNA: vcDNA=SeqID_78770; Strand=-; Position=1 -81,165-806,1023-1563
  Homolog annotation: Hit_ID=NP_510849.1; Match level="QueryCoverage =91%, HitCoverage=33%, E-value=1e-41, Identity=37%"; Hit description =predicted CDS, zn-finger, CCHC type and RNA-directed DNA polymerase and Integrase, catalytic domain conta
MPTLWKRPHAQGLHLSKGCQMSNVMVVARDWIMVPIQINGHKIELAADSCSHLTIIQRPMWLSLGGPKLIKSGKIVGSFSGHKLCLLGQFKCSVEFKGVHKCLDCYVADTNAPNLMGLDWIAPFEQATEQPIATTLSSEHFQPKTLAIAIPDEPQGLAEQLKNAFPQVFAPGIGRCSKMKAILHLKPDASPIFCRARQVPHDVQDAVDKELDRLLEMDAIRPVDFSRWAAPVLYVRKKNGARLPFGVKSAPSIFQKTMDQLTAGIPGVFTYLDDVIIASRNANEHVSTLLKLFSRIHSYGFRIQIEKCHFFKKEIKFLGHVVSTEGIHPDPERSAAIRDMPPPHDLPTLRSFLGALNYYGRFVREMRKLRSPLALLHKKDTPWFWGEEQQSAIEKAKQVLQSDFGLTQYDPKKPVIVAADA

SEQ ID NO: 152348 - protein, 202 aa, Heterodera glycines
  Coding regions on vcDNA: vcDNA=SeqID_78771; Strand=-; Position=1 -246,322-684
  Homolog annotation: Hit_ID=XP_313035.1; Match level="QueryCoverage =85%, HitCoverage=23%, E-value=1e-12, Identity=27%"; Hit description =ENSANGP00000011760 [Anopheles gambiae]
MQQRQMDSQQKQFLDLLNAFTNRTAPVANNSDLFSQINGQIPEFRYDPEQDSTFALWFDRFGPFIEKDGMALGEDMRVRLVLETITCLKNLIGETKLIFVRRFECFQLSCAPSQNVLDFGALVNSKCERADMNITKEEIKCLIFISGLGDAHKDLRHECLRQMEKNDRNKDRNANVVQTRTCSRTALIERMSNVMVVAISAI

SEQ ID NO: 152349 - protein, 16 aa, Heterodera glycines
  Coding regions on vcDNA: vcDNA=SeqID_78772; Strand=-; Position=1-50
MVVIILPLLFCFYGEC

SEQ ID NO: 152350 - protein, 50 aa, Heterodera glycines
  Coding regions on vcDNA: vcDNA=SeqID_78773; Strand=-; Position=1 -48,322-423
MPTDLYEVIGCPKEATFAKEVLSDEKKRKHYDRWLLSGQGMALADLDGNQ

SEQ ID NO: 152351 - protein, 79 aa, Heterodera glycines
  misc_feature (66)..(66): Xaa can be any naturally occurring amino acid
  Coding regions on vcDNA: vcDNA=SeqID_78774; Strand=-; Position=1 -36,84-310
VKRSTNEFRNEHIKRSKSTTAKHFLITDKEFSDHRPFPLTSAVTQQLQKLVTFFRIAQVIGKCERXSPFGISLTFVGSV

SEQ ID NO: 152352 - protein, 143 aa, Heterodera glycines
  Coding regions on vcDNA: vcDNA=SeqID_78775; Strand=-; Position=1 -130,1101-1250,2000-2150
  Homolog annotation: Hit_ID=XP_422174.1; Match level="QueryCoverage =73%, HitCoverage=4%, E-value=1e-11, Identity=40%"; Hit description =PREDICTED: similar to KIAA1728 protein [Gallus gallus]
MECRAAAKFVNGEPSDDVFFSRIVFTARPCPDYDSVPVRNGHTIKSLIERGANVNFADEDGLSPLMGACVFGNVGIAHCLVELGATIEQKDDEGLTALGHAVIAGQLESVKMLTGKNANCLVFAEDNRSPLVIACQEGRMEIR

SEQ ID NO: 152353 - protein, 98 aa, Heterodera glycines
  Coding regions on vcDNA: vcDNA=SeqID_78776; Strand=+; Position=1 -240,293-349
MNTSSDKNAEKGPAGEKPVRERHLRHSNVEEAEVEAMDVEAEAEEEEDDDDIHYSPFSNDAKLLPALHKPAFQVKQFTLKTFFELHLEVMGRRDTRAS

SEQ ID NO: 152354 - protein, 29 aa, Heterodera glycines
  Coding regions on vcDNA: vcDNA=SeqID_78777; Strand=+; Position=1-92
KERRGTNKMDPKMNDEEVAREGPVVLKRE

SEQ ID NO: 152355 - protein, 131 aa, Heterodera glycines
  Coding regions on vcDNA: vcDNA=SeqID_78778; Strand=-; Position=1 -99,384-503,762-938
MGPGSRRIFWAHIPAFKNGSGPGPQQKQDLSPGFNPKKMPSDFKSAVGRRQLSVQCNSNRFFSREASDLESLEARLQRSRKSFEESLNKLDEMTKMLERDNLRIQYCIYFLVFSIVAYCCYDFISETSSRK

SEQ ID NO: 152356 - protein, 174 aa, Heterodera glycines
  Coding regions on vcDNA: vcDNA=SeqID_78779; Strand=-; Position=1 -93,152-277,641-742,968-1171
MNTLANRCSFSNLSFFSRSFHFLATAKDLQKFNPMKMPSDFKSAVGRRQLSVQSNSISREASNLKSFDELFTEADLQRVRKAYEEKLKKFEELKKTAADLEALDQKFLELQRNRKLGEEEIKRFEELKKIAADLEALDQKLVLWKYASGSLVFKFLNKILFSMVICGADQRVLP

SEQ ID NO: 152357 - protein, 46 aa, Heterodera glycines
  Coding regions on vcDNA: vcDNA=SeqID_78780; Strand=+; Position=1 -74,1060-1126
MHRIRTQDPFLFTFSLPLTREHSELIERGRIGQFLCKISHFMRRRK

SEQ ID NO: 152358 - protein, 319 aa, Heterodera glycines
  Coding regions on vcDNA: vcDNA=SeqID_78781; Strand=+; Position=1 -70,490-709,1060-1256,1518-1990
MDKFSHINNCKMLKFRGEVIQFMVENQLMDEDDSLYTKRNLLSMANCAKIGKFLEENEPNKSNKNNAVPPEVAEYLNEVKEAHYKVFFSLLFSDSICDFSQYFDSKRMENEKNFAFSMRMLRLENLESNEKIAKIKTNIEQAFFDTELMRQIELKFPFYMAIDIINDHSLAETYANILSRDETTRHNAEHLLAIRICSARIWQIFQQIHLALKQQHNGKKAKLKDAKTNEILAQIQSNWRRFWKTRHATYKYMPNDLYAHWVAVQDQWQDLTFLACQLVQQLATDKDNVAKYFQHIKQLLPERNLFYQLAEEHAKNITR

SEQ ID NO: 152359 - protein, 160 aa, Heterodera glycines
  Coding regions on vcDNA: vcDNA=SeqID_78782; Strand=+; Position=1 -194,330-380,440-550,679-753
  Homolog annotation: Hit_ID=AAH78266.1; Match level="QueryCoverage =99%, HitCoverage=43%, E-value=4e-38, Identity=50%"; Hit description =Zgc:101057 protein [Danio rerio]
LLAAPRSELGLPETRLAIIPGCGGTQRLPRVVGVAKAKELILTGRKVRGDEAAQIGLVSEPWQQNHLTDDPYAKALEIARDLFPQGPLANRVAKLAVELFPQGPLANRVAKLAVEQGFDLELRSGLVVEQQCYAQLMPTKDRLEALEAFAQKRPPKFKGE

SEQ ID NO: 152360 - protein, 171 aa, Heterodera glycines
  Coding regions on vcDNA: vcDNA=SeqID_78783; Strand=-; Position=1 -436,550-629
MVADGVLSELVLCESRPTVADAAASAENAGPPAGTTGDNETSPQPHHQQQCHRPQRVYDALRQRSAEVADFLMPTDNEAEELGEGGLFYACGDVKNMSRELWACLSDILQREKGERYLADLNRDGIEPMVLVETNPEYPFVKKPQGFSPVEAIQLLKKLREKERLIEDVWS

SEQ ID NO: 152361 - protein, 86 aa, Heterodera glycines
  Coding regions on vcDNA: vcDNA=SeqID_78784; Strand=-; Position=1 -83,179-356
MSSKKNSYFKKKFHSFFLDPFGVFYLRRTMKHLNAQHVLQFFFVFTLQISLNTGIESAADEPLITYTDDDGNKLQMKLPGNYLVKA

SEQ ID NO: 152362 - protein, 103 aa, Heterodera glycines
  Coding regions on vcDNA: vcDNA=SeqID_78785; Strand=-; Position=1-312
MWYHKRIGASNPNAEPAVQLPVAGPRNTVEEPICGAARQGSQHTRMLLPPGGFNAVPFAGAQDTVGDRERTRWRLLSWSVINRNDDQAQRAKNSTHYEMAFVN

SEQ ID NO: 152363 - protein, 82 aa, Heterodera glycines
  Coding regions on vcDNA: vcDNA=SeqID_78786; Strand=-; Position=1-249
MTKQRMEAEKKKRKEMRDLKQKIKKKKKSLTDQLKQLKREIADGDYSFLEHLKIVAYRECPNPVQYCSESPVYCPTYNYHDL

SEQ ID NO: 152364 - protein, 30 aa, Heterodera glycines
  Coding regions on vcDNA: vcDNA=SeqID_78787; Strand=+; Position=1-93
DECKELFAQEEENRKRLDIMMVVNPHWSRV

SEQ ID NO: 152365 - protein, 25 aa, Heterodera glycines
  Coding regions on vcDNA: vcDNA=SeqID_78788; Strand=+; Position=1-75
TCTCGVVVKLSIFHNFSPGFNSPLG

SEQ ID NO: 152366 - protein, 62 aa, Heterodera glycines
  Coding regions on vcDNA: vcDNA=SeqID_78789; Strand=+; Position=1-187
MFSVINLVKTSNNDNNKATATSNNGNGSGNAAQQPQHSQPLHGGVDYLLGIGQSVQRALMNF

SEQ ID NO: 152367 - protein, 473 aa, Heterodera glycines
  Coding regions on vcDNA: vcDNA=SeqID_78790; Strand=+; Position=1 -252,420-558,613-947,1089-1248,1395-1688,1968-2206
MYFKSANSSSPNTPSAPLPPRPALDQQQQQAALMAAIAMAQDTVKKTLPVALSGLEATSAVIGEFLSGFDPSTGQAANRVGQTVLTEMLSPEFAASVLQLPTPVVVPPTNHGQTNGEPKQQTDEKKTADKHSPNANPDNNTSINSEAASVDQNLPHLMHRMEELQTKLMSLNMNLANRNRDEIVNDGKEKEEPKKGDKAEDEANKEEEIVVLNPYLYLTNEAMEKTEKEHKEKDSAEANSDTTNANSLDKEKQPTAPIQLGNKRKLGDGVNKDNGEEDLMKLSTHNSEEPVDNGNVSYVSSFSSRSSTTTMSSVEDEEDSGTNTGDDGWMVVKKESFKKLCDFYEKRRRVECGGGTVAADPFAEQLEREFREATMADNNRTDERVDEKLTAESEPKKADEFVKEVGQEPAAEVYVAQIVDLTTEKDGKSEKSEKVVHNSSVKEGKGTFFKTTPCVHSVVMRGVCAGCGQDFRQ

SEQ ID NO: 152368 - protein, 34 aa, Heterodera glycines
  Coding regions on vcDNA: vcDNA=SeqID_78791; Strand=+; Position=1 -60,105-147
LNRRLIHNERAKGRSFFRRLFRLRFNATVRFAIG

SEQ ID NO: 152369 - protein, 69 aa, Heterodera glycines
  Coding regions on vcDNA: vcDNA=SeqID_78792; Strand=+; Position=1 -84,164-289
MPSLFAQCRFLPLMRKCQLPFPFVNFVPLFFIFSNSLTILNILAVNFFYKISFYIYGMFLRDSPNSLAI

SEQ ID NO: 152370 - protein, 52 aa, Heterodera glycines
  Coding regions on vcDNA: vcDNA=SeqID_78793; Strand=-; Position=1 -96,158-220
MSIREQNNTSKEAIDQQDYPSSSIEHHQSNDLETKVKMEKVRIVNVFLERRK

SEQ ID NO: 152371 - protein, 200 aa, Heterodera glycines
  Coding regions on vcDNA: vcDNA=SeqID_78794; Strand=+; Position=1 -293,480-789
MYKLTYYFCLIFSFDQFFDHFSAEAKKTKNWQFKWTMLYMKSVLKVIWTLTVPNVPLSRTFALPPNPTHYHSAMRPLARKRIIAHYMLQRRSRHHCEGICAAELSFRRRILIEKSVDESVVHYEFSLARINRILLLPPSSTWKRNMRAVITTMPKTTTCSATMKRERSRGPSRHTPTHQGWAKLKNKKRKAKFAKLKNAK

SEQ ID NO: 152372 - protein, 139 aa, Heterodera glycines
  Coding regions on vcDNA: vcDNA=SeqID_78795; Strand=+; Position=1 -101,146-396,674-741
MITSMAFLPVHHLRAGLNVLQTQLPQQLIGVFDWFMDNYTGRPWFNGGLTVPRFAQEEWSVHQRTLDGGDRTNNYAEAFHRKLQQAFDCTHPSVFHFINTIRCEQKSIDADISRCVAEKNQNITHVAQKQLARLKRPPD

SEQ ID NO: 152373 - protein, 37 aa, Heterodera glycines
  Coding regions on vcDNA: vcDNA=SeqID_78796; Strand=-; Position=1 -14,135-234
MSKVRNIENDHEQSDDYNNCSAIEISAKLGLASLNVK

SEQ ID NO: 152374 - protein, 21 aa, Heterodera glycines
  Coding regions on vcDNA: vcDNA=SeqID_78797; Strand=+; Position=1 -50,174-189
MFFTGIDRLYVVIFDEMYAIC

SEQ ID NO: 152375 - protein, 140 aa, Heterodera glycines
  Coding regions on vcDNA: vcDNA=SeqID_78798; Strand=+; Position=1-420
MLEGSGNPTLVPVIERLEKLEKLEKLVERLIAGENRYGNRFADPQHISSSPSAHTSNNGPQLQWGQPPPFAGNGAVSRMITDAIINSEQLKEKANRAVIEKLPEAIDERALVEQIADECGVKDKLSSDIHRHPRTRTDGG

SEQ ID NO: 152376 - protein, 63 aa, Heterodera glycines
  Coding regions on vcDNA: vcDNA=SeqID_78799; Strand=-; Position=1 -104,498-587
  Homolog annotation: Hit_ID=EAL31000.1; Match level="QueryCoverage =93%, HitCoverage=17%, E-value=2e-14, Identity=64%"; Hit description =GA19925-PA [Drosophila pseudoobscura]
KVPKEAAENESDEIGILRTRTYDLHITYDKYYQVVPRFWLIGYDENGTPLTVEQMKEDFSQVE

SEQ ID NO: 152377 - protein, 127 aa, Heterodera glycines
  Coding regions on vcDNA: vcDNA=SeqID_78800; Strand=-; Position=1 -130,178-241,283-385,565-648
  Homolog annotation: Hit_ID=CAE68280.1; Match level="QueryCoverage =90%, HitCoverage=38%, E-value=2e-41, Identity=62%"; Hit description =Hypothetical protein CBG13964 [Caenorhabditis briggsae]
MNVNDLVNQFKSAALSVGEYLTPVLRESKFRETGVLTPEEFIAAGDHFVHLCPTWLWSKASDSSRARDYLPIDKQFLISKKVPCHHRCSEMNYNDSLEKIIKEEGDEWVDTHHFDTQTNLAPKELDD

SEQ ID NO: 152378 - protein, 77 aa, Heterodera glycines
  Coding regions on vcDNA: vcDNA=SeqID_78801; Strand=+; Position=1-232
MRSVKTGKRQFEPRRNRSGWVLVLHQVKHFSVFNYLNRCSDVGLPINRSGILVFAVTQWSLRNNCTKFSKKAAFGNA

SEQ ID NO: 152379 - protein, 136 aa, Heterodera glycines
  Coding regions on vcDNA: vcDNA=SeqID_78802; Strand=-; Position=1 -16,71-146,279-484,533-643
MLVAAGNEYGVVRGCMSDFYHGQTTSTNTDKCYFGEYPHNVTIYDPTNGAKTYSQLYVGVRYCSTVNGACNNKFMPKKEAAEGSGAFAETFCRQTQQMPTTACLSCWRYDSAGDCNSNWKETCQGQWCTKTTGYVN

SEQ ID NO: 152380 - protein, 37 aa, Heterodera glycines
  Coding regions on vcDNA: vcDNA=SeqID_78803; Strand=-; Position=1 -57,396-452
MSQQKLACNLKDCATWSQWKVNDQNYSKNCHNFLKIQ

SEQ ID NO: 152381 - protein, 99 aa, Heterodera glycines
  Coding regions on vcDNA: vcDNA=SeqID_78804; Strand=-; Position=1 -132,412-462,510-627
LHGPHVRHRAEVLAFSSVLACAPRAVGAMAGRAARVSRAIGSVTCPAPLAGDAVKWSEWVIPVDTVFRQLRSWQPSALPSMHNNTLNTHTAHRVLYMLT

SEQ ID NO: 152382 - protein, 166 aa, Heterodera glycines
  Coding regions on vcDNA: vcDNA=SeqID_78805; Strand=-; Position=1 -23,1159-1255,1741-1866,2350-2527,3486-3529,5256-5286
  Homolog annotation: Hit_ID=CAE70246.1; Match level="QueryCoverage =99%, HitCoverage=15%, E-value=5e-50, Identity=52%"; Hit description =Hypothetical protein CBG16735 [Caenorhabditis briggsae]
FHFNPLKIPFQSQVDGQWSDWSPFECHQCFCSDISGAIGVTLSERNCSNPAPQNGGAECSGPAHRAAVCSRKCPQERQSVNQYISAKCTEHQRVRQDPELTGTGSQLTRFPQRACKVFCDVKNEGGAPRNYRFYGDDLPDGAPCGWNRYCLNGECTLTDRLINVLI

SEQ ID NO: 152383 - protein, 28 aa, Heterodera glycines
  Coding regions on vcDNA: vcDNA=SeqID_78806; Strand=-; Position=1 -78,233-241
MAFLTKMFMFITVLEDSVESKVMQETNF

SEQ ID NO: 152384 - protein, 98 aa, Heterodera glycines
  Coding regions on vcDNA: vcDNA=SeqID_78807; Strand=+; Position=1-416
FFGGHSAASRFQDGRFAPIFNFVESIRPLRGLRTGASRPFFNFVGNIRPLRGLRTGALRPFLILLRTFGRFAASGRALRARFLILWGTFGRFAASGRA

SEQ ID NO: 152385 - protein, 47 aa, Heterodera glycines
  Coding regions on vcDNA: vcDNA=SeqID_78808; Strand=+; Position=1-142
MVTQNDHLMANLSDQLTNLQKELDTLKKDMTANNDAFFNCAMALIIF

SEQ ID NO: 152386 - protein, 57 aa, Heterodera glycines
  Coding regions on vcDNA: vcDNA=SeqID_78809; Strand=-; Position=1 -145,204-228
IKHSDKALRFYAKKCSLSVPRGMQKRPRNFVRRLLAFVRRLFHGIFRSGSNCVDLKA

SEQ ID NO: 152387 - protein, 155 aa, Heterodera glycines
  Coding regions on vcDNA: vcDNA=SeqID_78810; Strand=+; Position=1 -208,329-588
  Homolog annotation: Hit_ID=CAE68613.1; Match level="QueryCoverage =99%, HitCoverage=25%, E-value=4e-38, Identity=54%"; Hit description =Hypothetical protein CBG14494 [Caenorhabditis briggsae] emb|CAE68611.1| Hypothetical protein CBG14492 [Cae
GWMAASGFVVDDAHQVTYVDFAGSGMVHVCGGTISLIAAVLMGPRIGRFPERTVSVPVGGPRRKQKEPKKFMQIKLAQFASLGGFILMFGFLAFNGGSTSEISSPGIGQTVAKAMVNTILCGAFAALSYLFVHFIRKGKWTVLLTINACLTGILP

SEQ ID NO: 152388 - protein, 68 aa, Heterodera glycines
  Coding regions on vcDNA: vcDNA=SeqID_78811; Strand=+; Position=1-207
MYGSQAFTLRQNPQHYEHPEHWERAREPNIYKRVREWENDYCTNRDYCNHSFTTPKRTVWDQWKDTDK

SEQ ID NO: 152389 - protein, 89 aa, Heterodera glycines
  Coding regions on vcDNA: vcDNA=SeqID_78812; Strand=+; Position=1 -141,593-718
  Homolog annotation: Hit_ID=NP_294987.1; Match level="QueryCoverage =98%, HitCoverage=39%, E-value=1e-11, Identity=39%"; Hit description =hypothetical protein DR1263 [Deinococcus radiodurans R1] gb|AAF10836.1| conserved hypothetical protein [D
MYYKARVFGDEASAVAILRSQDPKAIKRFGAHIRLFDTAKWRKVSILEMLIGNWKKYEQNPMLRQFLFETGDAWLVEASPDDIYWGCGV

SEQ ID NO: 152390 - protein, 79 aa, Heterodera glycines
  Coding regions on vcDNA: vcDNA=SeqID_78813; Strand=+; Position=1-240
MARTWRQKCVGPAADPDPGHVQGARPVQARVGRGAVEVARIVWHQQWRRRRDAETDDLNGRSAKKFSIDYAVLKLYLWQ

SEQ ID NO: 152391 - protein, 59 aa, Heterodera glycines
  Coding regions on vcDNA: vcDNA=SeqID_78814; Strand=+; Position=1 -82,452-549
MVARENISEFFNQRLPQMPDEVRHYLTDLLKENEDDMGTEQDLTEMVGDHIQVGQLNEC

SEQ ID NO: 152392 - protein, 38 aa, Heterodera glycines
  Coding regions on vcDNA: vcDNA=SeqID_78815; Strand=-; Position=1 -79,564-601
MSRGKKMQHEETSKEENQRNKIHKTKSAQNKLYFTNRD

SEQ ID NO: 152393 - protein, 51 aa, Heterodera glycines
  Coding regions on vcDNA: vcDNA=SeqID_78816; Strand=-; Position=1 -78,156-230
ACNPPKSVGRGNLALKRWWWDGRSCKQFTYKGQGGNTNNFPSKKHCVQVCK

SEQ ID NO: 152394 - protein, 55 aa, Heterodera glycines
  Coding regions on vcDNA: vcDNA=SeqID_78817; Strand=-; Position=1 -75,352-444
MTPPTIESFLTIKNSPSAALSADHWEKIGQKSQFSQSMITSNALLAIAPYFVIGY

SEQ ID NO: 152395 - protein, 26 aa, Heterodera glycines
  Coding regions on vcDNA: vcDNA=SeqID_78818; Strand=-; Position=1-77
IQSRKRNEAIIQLPAFRIRLSCALCG

SEQ ID NO: 152396 - protein, 70 aa, Heterodera glycines
  Coding regions on vcDNA: vcDNA=SeqID_78819; Strand=-; Position=1 -136,246-322
MCCGDALFLCVWGFANQMTNGRRNGQMENERDKRSTDNTQNQCFYKNEKTKRMLLVDLATKFAHDGEFEL

SEQ ID NO: 152397 - protein, 90 aa, Heterodera glycines
  Coding regions on vcDNA: vcDNA=SeqID_78820; Strand=-; Position=1 -172,333-433
MKNDSRENAEEGQQSVGRGENCRQQQNKAMDGTDQISFTNKFLRNEWAKGKETKTPGVISYKSFNSQKFRPLMATFRGAPPWPCRSQMCT

SEQ ID NO: 152398 - protein, 140 aa, Heterodera glycines
  Coding regions on vcDNA: vcDNA=SeqID_78821; Strand=+; Position=1 -12,106-207,351-474,1484-1617,1743-1793
  Homolog annotation: Hit_ID=CAE66005.1; Match level="QueryCoverage =96%, HitCoverage=44%, E-value=2e-53, Identity=67%"; Hit description =Hypothetical protein CBG11196 [Caenorhabditis briggsae]
MTLTACICHTIHYAKRLYETQFVHRFSNGTMPFQNLFKNCTYYWGFSAFIAYFVNHPLYTSPSFTQVMIGLVGFTISELGNLSIHLLLRDLRPPGSRERKIPYPNSNPLTLMYNFVSCPNYTYEVYSWVFFCVMTQSLPG

SEQ ID NO: 152399 - protein, 51 aa, Heterodera glycines
  Coding regions on vcDNA: vcDNA=SeqID_78822; Strand=-; Position=1 -57,418-516
MAARDLQCVQCQQFMHNWGREGNWRGQLINLLGNYGVENGRNADGVLLRHF

SEQ ID NO: 152400 - protein, 98 aa, Heterodera glycines
  Coding regions on vcDNA: vcDNA=SeqID_78823; Strand=-; Position=1-468
KLLQEISQTPSGRRKREKCHFWSGAISCGGKNANKKWHKHSLILTPLIEGLRVVENGETIGQQQEQELGTEKKPPVWVGTFLIWHNLWRNDKKQIKIK

SEQ ID NO: 152401 - protein, 129 aa, Heterodera glycines
  Coding regions on vcDNA: vcDNA=SeqID_78824; Strand=+; Position=1 -67,248-334,437-570,784-885
MLHEASLMHSVKHEHLLPVAGICHGIFGQQKGGPSRLGRSKCAGPQRNARGGDRLRLGCHAATARRFGGGGRTRGGQMAGAGKSKAPNLQSEDGCVVLWRYVLGNFDVWRVALQGFAAEKGEIGFRVGL

SEQ ID NO: 152402 - protein, 140 aa, Heterodera glycines
  Coding regions on vcDNA: vcDNA=SeqID_78825; Strand=+; Position=1 -253,302-471
MTHSNISKNNFSDGASSCRGDDDEVHYLMPKRSKSADPRTSRSSDDGTTQPQQHPTTVGYNTVVGGGKETVGARVSELYTPVVEAEHLPNYINGMPKNVIEYANGTLVPQPMPNGYQNTPNSMAPTMTKINAKCQSESVM

SEQ ID NO: 152403 - protein, 63 aa, Heterodera glycines
  Coding regions on vcDNA: vcDNA=SeqID_78826; Strand=+; Position=1 -78,132-245
MPSPLFLPGAFPGVTLRPTGINLVEERTEDHAVDAGPVYAPTVSSARIDVHTEQAEEEEDDEF

SEQ ID NO: 152404 - protein, 290 aa, Heterodera glycines
  Coding regions on vcDNA: vcDNA=SeqID_78827; Strand=+; Position=1 -226,306-952
MADAMQDGARWKKAKTAINVLGNLLLAESLDNNNNNKVTNSPAAEEDNVQEEEHKEEEKNEDLGDIDKTLDEFFNNVCFKLPFGLIISGPSSSGKTEFLLKFIAESDQLITPKPISMLYCFGEMNAAVPALQKAGVDVYAGVPSEELVKRLPKPLLLILDDLMLSIDEKYLSDLFTKKSHHQQFAVVFVTQNLFERKIKVARLSAQYLVLMRAPNSLLSIRNIGVQLFPRKLDFFLDAYRKATARPYGYLLIDMHAASDPSLRLRTNIFKDEQEDEDEGTVVFIPKNGAA

SEQ ID NO: 152405 - protein, 393 aa, Heterodera glycines
  Coding regions on vcDNA: vcDNA=SeqID_78828; Strand=+; Position=1 -158,380-1403
  Homolog annotation: Hit_ID=CAC39319.1; Match level="QueryCoverage =20%, HitCoverage=11%, E-value=1e-18, Identity=57%"; Hit description =VMP4 protein [Volvox carteri f. nagariensis]
MQETDKESEHRTIAFTCGNLSKPSRFAFPTDHPPEKEIATPCGYRTPNEQSEKGLTSMSDTGDINLDAVRHDLNRTRGERTNPSAKNVNYNQQLRRYLKMRRELTNMPTKVEMSKGISILLRRGGEDEDGEVVDTPPRPPAPPPPPPPPSGKCPPRGPNPPAPPPPPPPGRRPPRPPSPRSPPGSPPPRPQRPPRPCRAAAPSRRGGLIEQWRKRRYDIQQRRPVVRDLLAEAAAAPLPESDDEYDYMLESGFALPAPSQYYGDLPVLPDNADEIEEMDTVQRRIATRRRLKKDLADDDDDDEVDLQRKRNRIYHPSPPRLPSPPRKSEPRPPLTAKREHQKQTKAELKSSTSKKTGHPTPTPRPKREPEFALDPAHPHQGKLGTTRLPQHLK

SEQ ID NO: 152406 - protein, 427 aa, Heterodera glycines
  misc_feature (16)..(16): Xaa can be any naturally occurring amino acid
  misc_feature (370)..(370): Xaa can be any naturally occurring amino acid
  Coding regions on vcDNA: vcDNA=SeqID_78829; Strand=+; Position=1 -160,2455-3120,3160-3607
  Homolog annotation: Hit_ID=CAD22154.1; Match level="QueryCoverage =96%, HitCoverage=65%, E-value=3e-55, Identity=37%"; Hit description =pherophorin-dz1 protein [Volvox carteri f. nagariensis]
SNKEPKPLPYSEKRAXNGVNPTTTTTTPPPPAAIVEEMPLIPPQERDQTPPPPTSPQPPPTPSTAKPAPPPPPPPSTNSTPISIKTPAVQPPKPTVSTPPPQTTITKAPPPPPPTKSAPIVNPSITTTTKTIPTPPVTKPTTPTPPVAKPTTSTHSVTKPTTPTPPVTKPTTSTTQSPKPPTAAPKPIKPASPAPQPPKPSTPASLTTTTKPPVPSPSVKPTISAPPAQQPKSPTPSTKPIVPKTDAPPKPPPPVSLSAKLIPSAPTPPLDSTPPKPPPPPTKPPPPPTSAAQIDPSRLIHTLDPPRYFKTPPANQNPLNYVPNSVIVLFNNDVERFKVVFNEEIISHLSFSPQLGYVIGFETPACGVKXSSKYGHDFEVASQALLSTQKDTENMIIGNTLSSLLRVVSISGATPGDYTEKIYDSPI

SEQ ID NO: 152407 - protein, 228 aa, Heterodera glycines
  Coding regions on vcDNA: vcDNA=SeqID_78830; Strand=-; Position=1 -109,152-240,284-472,520-819
MCNNDNNKRRLPSELVWEIVAAIPIMYLFGGVVKKPGVTRPPSGIPVVNRGFEIFRANRHCFFVKLIEIALDFELACAKRNLPGGELFIQFSFKDDQLLDPQYFTDFVHYLCFGRSGTIATTRIITYAASAQIGELFGILLDYALSSVNPLTMKKRTAGGYLSRQHFPPILKLTATEMASRGVGLLVRTDGMEMYRLMNPHHSNDVGQLIVIERSRHPGSFYFNFSVE

SEQ ID NO: 152408 - protein, 753 aa, Heterodera glycines
  Coding regions on vcDNA: vcDNA=SeqID_78831; Strand=+; Position=1 -1110,1154-1862,1911-2253,2299-2398
  Homolog annotation: Hit_ID=NP_507780.1; Match level="QueryCoverage =85%, HitCoverage=44%, E-value=8e-56, Identity=26%"; Hit description =predicted CDS, DNA polymerase type B, organellar and viral family member (5T899) [Caenorhabditis elegans]
MATMEVLRLSTKPTWTTGELQHDAIQLMNQIGAPLNLNAYDADTYVPRVINYWNNNNNNNQQHRFSVFIFGATGHYKPIYKYVDNTYNTPLLLYFNNSHFDGVQKQGGLFGKPYCLECERPYSRAPQHNKSCRARCLLCSRTGPLFPCQAHAGFFMHCDGCNKNFNNNDCFRHHLQSGFCKRSKKCKDCGVVWDVNDNNRNGRKGHVCGERYCNLCKNFHNPERGCFIQPLEPREMEPYRIVAFDLETMQHQPVSPREPEKREHQPNFIAAKVFCPECIDNSRWRNGTAGCKVCGPHRTVAFCQRRFVNTTVDKQVVADNPLEAFVGWLINALPKKFDTYAFSHFGGRFDMVLVFRELFKIGFNPEMIRQGNKMFEMKVKKQKNRNPNIVFHDSFNLMPCALAQLVPSYGLEVEDKPFFPHLANRPENYGRHIYPTVDDYLANGMMPEKRRQFDLWYEQHQHEPFQLDEALASYCTNDVEILSAALIAFRREFFEVSKRNDYVDGVDDRENHDGIDALRQCMTIAGACMKHFRLNHLPAEHLAIVPEKGYDNAQNQSRLALQFLHWYAEENNVQIQTAYSPQGEKRIANYTVDGWIEEERRVIEVNGCVWHGCKRCFPSDNMMLPNGKSAGEQRRRDANRLEFLRTQVARVDIFWECDIQQMVERSKAIRKSFADYVDAGPLIIRDAFTGGRTGPLKLFQKAGEGQKISYYDFTSLYPFINFTTRYPVGHPKVHVLNEDVNWTNPADNPSLWH

SEQ ID NO: 152409 - protein, 203 aa, Heterodera glycines
  Coding regions on vcDNA: vcDNA=SeqID_78832; Strand=+; Position=1 -55,102-293,341-436,487-617,664-801
  Homolog annotation: Hit_ID=NP_001004509.1; Match level="QueryCoverage= 96%, HitCoverage=13%, E-value=2e-16, Identity=30%"; Hit description =si:busm1-180o5.3 [Danio rerio] emb|CAD60788.1| novel protein similar to DNA polymerases [Danio rerio]
MAVNKGKRSIAKLCLNNLWGRFSLRNFGLSQTLITDDPVFFREHLDNRSIDVTAIDELDEEHILLSYENKKEWVEEHDCSNIVISLWTTSAARLLLLKAMQKVVRTPGCGLLYTDTDSLVFLHPEDICPLKTGPHLGQFTDEYPQHEIVEYCSGGAKQYGLKLRRLNAPADAEFEYVLKVRGMTLNYDVINNQGLRYDSSSRC

SEQ ID NO: 152410 - protein, 104 aa, Heterodera glycines
  Coding regions on vcDNA: vcDNA=SeqID_78833; Strand=+; Position=1 -168,241-387
MEANSGSLTASLQAAEAEIGALKEMVKLQNEKMKDMRHRFVNFRSRLDQLEAWAADNKQTKFVRPDTRKRVLLNDSPEKEMPATSNAAASGNFFLVINLTLFTL

SEQ ID NO: 152411 - protein, 96 aa, Heterodera glycines
  Coding regions on vcDNA: vcDNA=SeqID_78834; Strand=+; Position=1 -135,1783-1825,1878-1990
  Homolog annotation: Hit_ID=NP_741756.1; Match level="QueryCoverage =48%, HitCoverage=12%, E-value=2e-11, Identity=68%"; Hit description =endophilin B2 (40.8 kD) (XE420) [Caenorhabditis elegans] gb|AAB52640.1| Endophilin-related protein protei
MLLPSFNRAGFVGLLLLCQLALAPFATAFPLATDAQRMATEESAVLTEEKLLNAEKTELDPHFEQLLAKADKTEEQSKKLLSAMEAYLQPNPGQCQ

SEQ ID NO: 152412 - protein, 78 aa, Heterodera glycines
  Coding regions on vcDNA: vcDNA=SeqID_78835; Strand=+; Position=1 -143,189-282
MKKLLLCVFLLLQFLLATDAISVQSEVGQPFFDQQSEFGTVPLSEMEKRRRRRFSKLKAAALGAAAGLGAAVIAKHAG

SEQ ID NO: 152413 - protein, 33 aa, Heterodera glycines
  Coding regions on vcDNA: vcDNA=SeqID_78836; Strand=+; Position=1-99
MRRSIQRKTDKAELVNYEGKQLPFAKAPPPNGI

SEQ ID NO: 152414 - protein, 233 aa, Heterodera glycines
  Coding regions on vcDNA: vcDNA=SeqID_78837; Strand=+; Position=1 -204,613-1044,1316-1381
MALSQRLLVRLRRLCGPAVLCACANLRFVNVDDENFAMKSPADDAAGASPGQALLKWLYTPREDGQPKEFSTATTPVSFIVRFRKSSWDAYDDAALKPFELSNELTGERLTLRHVIDQQRNDLGLPAPPPPRPSNNKKMITYSSVVSRRSKFDIWLLERTPSERDEKQWTHWANEGPFDTCYWEEDNVVYVNFDERRQLGWVRIRKRKGTNAAIMEAFDNSLLTFPGREWSDE

SEQ ID NO: 152415 - protein, 57 aa, Heterodera glycines
  Coding regions on vcDNA: vcDNA=SeqID_78838; Strand=-; Position=1 -55,99-217
MALGELRKYVNHLELFADDRQKIFFKIDIDISSVPESTPEARPALRGWFVLPLILWL

SEQ ID NO: 152416 - protein, 203 aa, Heterodera glycines
  Coding regions on vcDNA: vcDNA=SeqID_78839; Strand=-; Position=1 -116,167-270,362-433,1138-1306,1812-1892
  Homolog annotation: Hit_ID=CAE75210.1; Match level="QueryCoverage =99%, HitCoverage=36%, E-value=8e-45, Identity=43%"; Hit description =Hypothetical protein CBG23158 [Caenorhabditis briggsae]
DKYEKDIAKLGLEYSSKFNMGMAVDRTLWKAVQNCSKLFCSYDDYNWDWTLLQLSVKCCSKLFCSYDDYNWDWTLLQLSVKCMASKMRVIYTKAPRVLHIGDCGVHTHRCKAERAANDALKLFERVNSSFFPASMRVLEIGKRMLKPAKPNGGWGDPRDIRLCELNTHPTESNTATGRVAFCKSCNYKKDFPPRSTGIPISFC

SEQ ID NO: 152417 - protein, 93 aa, Heterodera glycines
  Coding regions on vcDNA: vcDNA=SeqID_78840; Strand=-; Position=1 -84,137-234,452-551
  Homolog annotation: Hit_ID=AAO33475.1; Match level="QueryCoverage =100%, HitCoverage=88%, E-value=7e-35, Identity=65%"; Hit description= gland-specific protein g5d08 [Heterodera glycines]
MAVLIIYITMHGKAQSKDPAPPNPDGPMLLLNGKQSAANEKGKASSGESNPNPGQNPSGERDWAKSQWNDANWLADVVNRNGWENTGTPTGGR

SEQ ID NO: 152418 - protein, 107 aa, Heterodera glycines
  Coding regions on vcDNA: vcDNA=SeqID_78841; Strand=-; Position=1-321
MSHHTQIQQYFCPPSAPAVTYYNYGNITNIDLSPQQAVPQGFQQQVQLTAPAYTVAQYWHDVPSQNGGYQMPQNNGHHAAAYSSGDHPKMGKHKGIGKRFHPQKHQQ

SEQ ID NO: 152419 - protein, 89 aa, Heterodera glycines
  Coding regions on vcDNA: vcDNA=SeqID_78842; Strand=+; Position=1 -102,152-253,295-357
MMSHSSIQIPSAVPADVSVVVEQCQQKKEMEEEKFFVFKEWLHWLHSVAADERLKLVARQRITIRHFIWFTQMREEFWERRAAIVDHLL

SEQ ID NO: 152420 - protein, 58 aa, Heterodera glycines
  Coding regions on vcDNA: vcDNA=SeqID_78843; Strand=-; Position=1 -121,984-1039
MPTNQEAEFYVQAVKLFRQIEREHMANFKMSTYDYERLKRILFDNWTSFFTNFCGVAK

SEQ ID NO: 152421 - protein, 50 aa, Heterodera glycines
  Coding regions on vcDNA: vcDNA=SeqID_78844; Strand=+; Position=1-150
EFLKNFKNFFEFLNFPVGPGSRSRRKIEVLVPASQARQVPVPVLPKIPGP

SEQ ID NO: 152422 - protein, 18 aa, Heterodera glycines
  Coding regions on vcDNA: vcDNA=SeqID_78845; Strand=+; Position=1 -48,180-188
MRGLPIFAAANKARFVLM

SEQ ID NO: 152423 - protein, 52 aa, Heterodera glycines
  Coding regions on vcDNA: vcDNA=SeqID_78846; Strand=+; Position=1-158
MVRTPPEKQLRHRQLTNFRLGPNSEQTLLHACLCASTFALRPKSLEYMLRIR

SEQ ID NO: 152424 - protein, 101 aa, Heterodera glycines
  Coding regions on vcDNA: vcDNA=SeqID_78847; Strand=+; Position=1 -115,157-347
MSRGTTVIRRGTTVIKRGTTVNRRGTTAIRRGATVIRRGATVIRRYTTMMRRGTTEIRRGTNLMKRYKCDLKRYKSDKRGTKVIRRGTKVIIRGTKVIEEV

SEQ ID NO: 152425 - protein, 148 aa, Heterodera glycines
  misc_feature (14)..(14): Xaa can be any naturally occurring amino acid
  misc_feature (51)..(51): Xaa can be any naturally occurring amino acid
  Coding regions on vcDNA: vcDNA=SeqID_78848; Strand=-; Position=1-654
  Homolog annotation: Hit_ID=CAG06679.1; Match level="QueryCoverage =58%, HitCoverage=13%, E-value=9e-12, Identity=46%"; Hit description =unnamed protein product [Tetraodon nigroviridis]
RGGNREREEEESKXKRAMEENDTERGTERGRKSRRIYRLMKEEERERERKXRVRERQRGRERERERERGKRERESKRNMIEREESEFSNLLASSSSYLKNIILISFSTGQRLNWLKRNCRNRNASFQFKMALVFGFLKKIFVFLCYCR

SEQ ID NO: 152426 - protein, 243 aa, Heterodera glycines
  Coding regions on vcDNA: vcDNA=SeqID_78849; Strand=+; Position=1 -289,782-1020,1728-1931
  Homolog annotation: Hit_ID=NP_501970.1; Match level="QueryCoverage =86%, HitCoverage=5%, E-value=1e-36, Identity=41%"; Hit description =EGF motif related, Lin-12 and Glp-1 X-hybridizing, abnormal EPIthelia EPI-1 (407.8 kD) (epi-1) [Caenorhabd
MAPFGWVKIKVLFSHTIAPPPPHTPQEERVADCRTKLGALKERIAMARDKANRVRLGAHFEQRGGVGAFLELPLSAADELSVYNDIRFFFRTRETNGQLLFLGADNAHLSGEYIGVELENERPKLTVSLGARSVDAAQLQTPVNDMQWRELVVKRVGRAVTLALSKPSTDERAEEKSFTVGGPPPKSVLNLFDDSRRLFVGGTPRDFRMPATLKQNQFTGDMDKLRINGELVGFWNSERTQVW

SEQ ID NO: 152427 - protein, 79 aa, Heterodera glycines
  Coding regions on vcDNA: vcDNA=SeqID_78850; Strand=+; Position=1 -95,150-243,296-346
  Homolog annotation: Hit_ID=NP_501970.1; Match level="QueryCoverage =93%, HitCoverage=1%, E-value=1e-10, Identity=41%"; Hit description =EGF motif related, Lin-12 and Glp-1 X-hybridizing, abnormal EPIthelia EPI-1 (407.8 kD) (epi-1) [Caenorhabd
MGKDRDQLMVELVGGRISLSFDLGSGLGKLLSNGQRYNDGKWHLVQMDRQERSAKLKIDDTDKVSKFSWNWKDNCVFYD

SEQ ID NO: 152428 - protein, 542 aa, Heterodera glycines
  Coding regions on vcDNA: vcDNA=SeqID_78851; Strand=+; Position=1-1629
  Homolog annotation: Hit_ID=CAA82797.1; Match level="QueryCoverage =78%, HitCoverage=57%, E-value=2e-42, Identity=31%"; Hit description =gag protein [Ascaris lumbricoides]
MNKTEWNSEWKLQKIFREKHNYLKTIKEIDEILDTIKDINLEVKRRLKALKPNSPSESDLENESIDEEQENDDEEAGEEEDEDEKEYDSDQEDESQEMHSSDQTHRNRIPFVHQRSRIKLPAQTLTHFSGKFSQWPSFWDDFKSSVHNDPNMENIQKLKYLRGLLHDEPYRIVSPYPLINKNYPIIIKLLKSRYGNPELIRENLHSELRNLKRPSESTIELRKFILLIDRIILQLKSEGEDINHPQIKQSIETKLPYNLRLKLREKFKIYSTKQLMDFLNAHTQAREDMERMEDLNRQIRNFPSNRPNSNRIQRQPYQNFSQNKPKFNQRNQYQTPITPFPYTSALTTKSKPLHPAQIKPIPTQTKTQYKIFCRFCERENHTSKECKIYSTPEKRNERVRELKLCLNCLNKGHMVNECKSTYLCYNCKHKHNTLLCTRKQTQYKTKEQKTRVNMAQNYENHEETQTFMTMEGDKNLPNSDEEELLMTTEVNCINPDKYKVKREIILFDNGSQKSYITEECAQTLQLNTIEEKLLAISTFQPK

SEQ ID NO: 152429 - protein, 149 aa, Heterodera glycines
  Coding regions on vcDNA: vcDNA=SeqID_78852; Strand=+; Position=1-447
  Homolog annotation: Hit_ID=NP_508324.1; Match level="QueryCoverage =89%, HitCoverage=6%, E-value=4e-09, Identity=26%"; Hit description =predicted CDS, peptidase family A16 and RNA-directed DNA polymerase and Integrase, catalytic domain and Zn
MVNKETVDVLGVKIPISHARPQILIGIDYYWHFMLPNSQIQLLPSGFYSINTKLGKILSGKGTIEDTNCNSVTEKRKKDETNQILQKFWELENIGIIDSPHMTDEDAAMIHFDKNVTFKNNRYHVRWPYKRENPNLPTNFGLCMGRLRN

SEQ ID NO: 152430 - protein, 220 aa, Heterodera glycines
  Coding regions on vcDNA: vcDNA=SeqID_78853; Strand=-; Position=1 -194,348-536,591-868
  Homolog annotation: Hit_ID=CAE59959.1; Match level="QueryCoverage =88%, HitCoverage=44%, E-value=2e-34, Identity=32%"; Hit description =Hypothetical protein CBG03449 [Caenorhabditis briggsae]
MNPGPLSDQDRPIEFRFGFSCGDGVQRREGMCVREPDGQRLEEKDCEPRERIVEKQCQMAACPHWKLGTWSPCSVSCGQDGFQTRLVQCVDSEGRKVSDQKCMGIKKQQQTEKPQSYKVCSPGPCPYWRAAKWGHCSVSCGNGVRMRHVECVLKGQIVDDSLCMKAMRPKTSFRCVLLACTVWHGVPQAAATGQIGERRVDLKIKLKAQEGEVDGMFDHP

SEQ ID NO: 152431 - protein, 198 aa, Heterodera glycines
  Coding regions on vcDNA: vcDNA=SeqID_78854; Strand=-; Position=1 -167,464-623,665-735,1150-1305
  Homolog annotation: Hit_ID=NP_501792.1; Match level="QueryCoverage =99%, HitCoverage=8%, E-value=3e-42, Identity=43%"; Hit description=a disintegrin-like metalloprotease with thrombospondin type 1 motifs 9B, abnormal GONad development GON-1
QGAAGIDITQTAHNGLKEDDNYLALRTTTGEYLLNGQFQVSVFRQQIPILDTVLEYSGSDLPIERINGSGPLRSDIYLHVLSVNINKPNIRYHFMTPIASSTKSEAAGSNSFYWQAENNWTECSNSFYWQAENNWTECSMKCQGTQNQHVRCVEAFSNNFVMDAHCAAVVRPNTQKRMCNVDCFYKYLQRLNTDSSGK

SEQ ID NO: 152432 - protein, 252 aa, Heterodera glycines
  Coding regions on vcDNA: vcDNA=SeqID_78855; Strand=-; Position=1-761
  Homolog annotation: Hit_ID=NP_491240.1; Match level="QueryCoverage =64%, HitCoverage=12%, E-value=3e-19, Identity=35%"; Hit description =zn-finger, CCHC type and RNA-directed DNA polymerase  and Integrase, catalytic domain containing protein
FCDSNGICHLFSPPYHAQSNGAAEKFVDFFKRQLKKCSGDKNWLKQSLLSYRSIPIAVLNNRSPAELFLGRPLRTKLSLMKPERPSPFFRGPYQQRMAQQFDKKHGAKRVEFNIGDKVQFVNYRDGKTLWLFGEVVTKKGLIFGIRSPQIANRIVTRHANAMRLTQALGTDQTWPNFDEEPKKNRSPVRAPQIQQNVTPTPPAERNHDQFEQNEEQERNQQQTPVLRRSERVPKRVRFLSPSMTGQRHNIRQ

SEQ ID NO: 152433 - protein, 469 aa, Heterodera glycines
  Coding regions on vcDNA: vcDNA=SeqID_78856; Strand=-; Position=1 -91,136-234,442-1661
  Homolog annotation: Hit_ID=NP_510849.1; Match level="QueryCoverage =68%, HitCoverage=23%, E-value=5e-61, Identity=40%"; Hit description =predicted CDS, zn-finger, CCHC type and RNA-directed DNA polymerase and Integrase, catalytic domain conta
MKDWDSFSQFKNFTNTFLVENSFYALITVHSSRLQRWALILLNYDFSLEFVRTDNTGQADALSRCLVFNGRSVIPPSLRHRVLKALHLAHPGIVRMKNLARTLVYWPSIDSDIEEIVRKCRQCQEAAKQPQKQPLQPWPTTTQVFQRVHIDLAGPCSDGNTYLVIVDSFSRWPEVFMLRHTSSQHVIEQLQWLFDRFGIPKTLVSDNGPQFSSSHFKDFCDSNGICHLFSPPYHAQSNGAAEKFVDFFKRQLKKCTGDKNWLKQSLLSYRSIPIAVLNNRSPAELFLGRPLRTKLSLMKPERPSPFFRGPYQQRMAQQFDKKHGAKRVEFNIGDKVQFVNYRDGKTLWLFGEVVTKKGLIFGIRSPQIANRIVTRHANAMRLTQALGTDQTWPNFDEEPKKNKSPVRAPQIQRNVTPTPPAERNHDQFEQNEEEQNQQQTPVLRRSERVPKRVRFLSPSMTGQRHNIRQ

SEQ ID NO: 152434 - protein, 87 aa, Heterodera glycines
  Coding regions on vcDNA: vcDNA=SeqID_78857; Strand=+; Position=1-394
LEKIDFFVFGAVPPNRCAQIYGETESFGNSFPIACTLILRWIFTPHNCLSTPNGHLKKSIFLFSGQSPRADAPRFMGRPNPSGIASL

SEQ ID NO: 152435 - protein, 944 aa, Heterodera glycines
  Coding regions on vcDNA: vcDNA=SeqID_78858; Strand=-; Position=1-2832
  Homolog annotation: Hit_ID=XP_318550.1; Match level="QueryCoverage =59%, HitCoverage=55%, E-value=1e-135, Identity=44%"; Hit description= ENSANGP00000020240 [Anopheles gambiae]
MSITSEQLKAILADQQNQFVKLLQNMQLNTGQGQHNQAQSSDMDLFCKLSGQISEFLYSPDDNHTFEEWYERFGPFVEQEGKHMPDQSKARLIVSKLGPDEYRRYTEVIQPKTPDQVGLNETLAKLRQIFPEIKSIFIKRFECFQLKCGQNQDVLAFGSTVNAMAERSKLDLTKDQIKSLIFVTGLGDHNMELRHRCIKLLDNNATFDQLLSECKEVIALRQSSAALSSKQDFNSNAIQIRPHKIQDFPKKRKPSHTRTPSRTRSWSSQPNNNSNTPHGGTRQSRTFPSSPCTRCGGQHWNSDCRYPISVKCHICGKTGHISTICRARKPKSNNFGKNTNVVECLHITPTERQCSWSTPRVEHEPYIEQEVKFGTKSVKMVADTGSKLTILTKVTWHKLGKPKLFKTNLCGRSYTGDIFQFIGKGQAYVALSGGCQLFLDFYVTDKGSLDLLGVGWIRAFEREYNRPVATTLPFDHTTNNIQHINNCELTSEQLKDKLQAQFPSVFANGLGLCTKVQAQLKLKGSSTPVFCGARPVPLGVQNDVDTELDRLIELGVLKKVDYSRWAAPIVAVRKANGKVRICFDFSTGLNAALEPHHHPLPRPEKLFAKLNGAKIFSQIDFKDAYLQISVDEQSRQLLGVNTHKGLYQCQRLAFGIKSAPGIFQWTMDQLAAGIPGVVGYMDDFIIASSTANEHFSTIFKFFKRIQEFGFRIQMDKCKFLVKEIKFLGQIVSSDGIRPDQNRTRALQEMPAPTDITTLRSFLGAINYYGKYIKNIHQIRAPLDELLKQGVEWQWNEKHREAFEQAKSILLSDLALTHYDPNLPIIVTADASNKGIGATISHRFPDGKEKVFQHAARTLSKTEQNYSQIEKEGLGLIFAIQKFHQYIFGRKFILRTDHRPLLGIFGSKNGIPIFSASRLQRWALILLNYDFSLEVRRTDNTGQAD

SEQ ID NO: 152436 - protein, 80 aa, Heterodera glycines
  Coding regions on vcDNA: vcDNA=SeqID_78859; Strand=-; Position=1-595
LFEYPKRTLEKIDFFVFGAVPPNRCAQIYGETESFGNSFPIACTLILRWIFAPHKCLSTPNGHLKKSIFLFHKYFFQKVL

SEQ ID NO: 152437 - protein, 779 aa, Heterodera glycines
  Coding regions on vcDNA: vcDNA=SeqID_78860; Strand=+; Position=1 -444,503-782,949-1601,1910-2492,2920-3297
  Homolog annotation: Hit_ID=AAA93301.1; Match level="QueryCoverage =25%, HitCoverage=53%, E-value=7e-31, Identity=37%"; Hit description =HASI
MCKWGFCAVGCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACSLPYGYLLTTRRESFLPPKMVKREQKIGERVVHNYDYLKKLGKTTSEKKRRHLLNSAGCEELLTLVEICLNVLNGSFCLSRKQKQRLAPFAKDIRQLARVRTRETKNDDDDIAERTNLGFVKRQVTAAVQKRKGNVSERNAMYNQQLRRYLKMRKEHKERPVRVQLSNGAQLLNKTVETGVQVRPGPDEPKDKSVMVTDEDEEEEIEVPKFLTPTSQTQGSSRSPRTNKKAAKQQKLIEKKDRLLAIIMSDPQRFGATDRGKIINPKTGREFIDSDLAWSIERLVDPRPENAPSPSGTKELKRKLAQNPLASSLLNRLFGSDVQADLADFQALSRKNSGYRYLLLAVDVLSRRMFGAPVKSKRPVDMKRAFEELFEQMPRVPDTLYTDRGLEFVAKPLKEFYAEKGIQKFETSSKKKAAVAERAIRTLKTRLYKYFSANNTSVWVDVVPKFLSAINNSVCRATGLRPNEISDTNAREVWKRVYGEGLAQLDKTPKIRAGETVRIPEPKHIFEKGLFASFLVVANAFSNVKAKTHSRRISSMASSSSKLPALWNPLNVAFEKLRKRENSKENGINSKVKTPKGNGQLRTIVFSKAGEELADSTGPTTKLLKADTERKLSAVDGTITNKAASSHAIRPVQN

SEQ ID NO: 152438 - protein, 131 aa, Heterodera glycines
  Coding regions on vcDNA: vcDNA=SeqID_78861; Strand=+; Position=1 -80,130-445
MFVGCCAILWLYWDRFRKPRGHHKKKIFISGDGWLCVFDLLEPSQLGLGIALVSHRFDFYVDEHFKTRRWALKAMEIKAKFEADGTKEMEIVNCDGNPLPIPQKALPKKVVGKIFVVRQKVRFRVMVYGIS

SEQ ID NO: 152439 - protein, 49 aa, Heterodera glycines
  Coding regions on vcDNA: vcDNA=SeqID_78862; Strand=-; Position=1-148
FSVSSPATVGFVCSICLSLLNWALELHLSATVLTFTSTNTSRRGVGRSK

SEQ ID NO: 152440 - protein, 76 aa, Heterodera glycines
  Coding regions on vcDNA: vcDNA=SeqID_78863; Strand=-; Position=1-235
  Homolog annotation: Hit_ID=NP_497618.1; Match level="QueryCoverage =69%, HitCoverage=43%, E-value=2e-23, Identity=84%"; Hit description =cytochrome C oxidase (14.8 kD) (3D877Co) [Caenorhabditis elegans] gb|AAK29974.1| Hypothetical protein Y71
FLLELMSLKIPLDKSCHFCLQIKYYVDFFRCKELMGEDYKPCKFFQNVYKDICPSFWTEKWDELREEGRFPAKFDR

SEQ ID NO: 152441 - protein, 225 aa, Heterodera glycines
  Coding regions on vcDNA: vcDNA=SeqID_78864; Strand=-; Position=1 -191,282-316,376-467,561-669,906-966,1017-1204
  Homolog annotation: Hit_ID=XP_521029.1; Match level="QueryCoverage =98%, HitCoverage=71%, E-value=2e-23, Identity=29%"; Hit description =PREDICTED: similar to XRP2 protein [Pan troglodytes]
FTFSQKPEKRPKKDDRNENNDTFEHNTQSNSFVGAAISALQLSAKDVDTTFQGIVEQTVFRGSADGNPFAIRECTGSVLVLLGHAATITIDKCSNCVIICGPCRGSIFMRNCANCLLLAACHQFRLQNSRDIEAHLHCSTNPTIEDSDLIVAPLLMRYDGFKEDMESARLDNAPNLWDKVQNFTAETGQFQRMNFDPFANGAISSEVVSDELLEKLSTFMEEPEA

SEQ ID NO: 152442 - protein, 62 aa, Heterodera glycines
  Coding regions on vcDNA: vcDNA=SeqID_78865; Strand=-; Position=1-187
LLVTLADLYDDYEQCKSSGHFGAEDGSPSLVCDSEGRLTPQALAQLNGILTDMGRDAGCQCA

SEQ ID NO: 152443 - protein, 461 aa, Heterodera glycines
  Coding regions on vcDNA: vcDNA=SeqID_78866; Strand=+; Position=1 -795,965-1555
  Homolog annotation: Hit_ID=XP_318550.1; Match level="QueryCoverage =58%, HitCoverage=28%, E-value=2e-66, Identity=44%"; Hit description =ENSANGP00000020240 [Anopheles gambiae]
MQNNLICKTYWLSLLTDHKPLLAIFGSKKGVRQCSANRLLRWSLILLAYDFSIEYISTNDFGQADVLSRLIAKGKSDEDRVIASLRSDSEIDDILIGSIEALPIKFKEIVAAAEADKTIQKVKKFLTNGWPRNVGDESAEIKLFHLIKEQLCITRNCLMYADRVVIPEKLRQKTLHSFHKGHPGIKRMKQLARNYAYWPNMDADIQQMVENCQPCQMEAKAPVKSNLQPWPKPSLPWQRVHIDYAGPFFGKEYLIIVDAFSKYPERRIIQCPTARLNVSWTRSKEHFEIERGGSPKQRRPPPAQPIERDVEMARRFNKRFGTKLREFSIGNKVFARHRISQNWQQGKISKRTGVIYDVTFADGKSGRYHANQLRPRKTSDSDEQLSVMLEVFDIPRPVAVEEQREIPVEMPLEDPQIWEVKLTMDSNDGTLSEIAVRRSAFHRNLGTALKGGGVRGTAAEV

SEQ ID NO: 152444 - protein, 209 aa, Heterodera glycines
  Coding regions on vcDNA: vcDNA=SeqID_78867; Strand=+; Position=1 -124,648-868,1163-1447
MIFRGGDWPRGIDCATICGQMFGPWGIKSAEAAADVWLCFADLFRAIYLFFLNLFCVNVPNFWPNSAFCSLSILFAHLFLLATQKCVLSVKIYGLLAIQRRADDIYFIIIDNTTELIIFHFHLSFQTLQIASMDEHIAAAGAKSFVPPAPAGTTHQKTSVQHELDRVEREKFWNEVSWNGPILRCQSAKWPAFGLAMCPIKAGPEQGWT

SEQ ID NO: 152445 - protein, 208 aa, Heterodera glycines
  Coding regions on vcDNA: vcDNA=SeqID_78868; Strand=-; Position=1-624
NMIVLDESGQAPLLAVCSVLSPLQEALKLFITGDRYRLAVSMKDIPEQLRVGFGFDTVLLNTDSSPGVDKTTLEVNYRSHPEIVNCVEYAAYTPHGERLRSGPGIFRMLTSFAKMPIAESPIVLIHQDSPMEAEETSFSATNSGQTRTVIDLLRSWRGFPGSVRIISLYSGQAAQIGCELRANGLERMAASATADSMQGHEADLVIVT

SEQ ID NO: 152446 - protein, 265 aa, Heterodera glycines
  misc_feature (260)..(260): Xaa can be any naturally occurring amino acid
  Coding regions on vcDNA: vcDNA=SeqID_78869; Strand=-; Position=1 -147,218-303,390-486,546-665,843-1154
  Homolog annotation: Hit_ID=NP_501180.1; Match level="QueryCoverage =96%, HitCoverage=50%, E-value=1e-40, Identity=36%"; Hit description =phosphate (57.5 kD) (4I161) [Caenorhabditis elegans] gb|AAB03157.2| Hypothetical protein C48A7.2 [Caenorh
VGATIGFVFIFNLNLPVITPTHTLIVFSYSMLLHGTEGIRWVKVTKIFASWFVSPILSGCASWFVSPILSGCVSILIFLFIDHSVLRRDRPLHCGLLLLPFLYFVCVSVNMFAITYQGSHYIGLIGLDKWPLWAVVALSVVSGLVTMVVTRFFVVSRLKRYILEGKTERDEPSTKVKMAENGGGGGAEVAQNKFGTTKSNSLDIAMFPAGSSSIRPASSVLSFFRSSKPEDPYASKLFTFLQVLTACFSGFAHGGNDVRXLKSEL

SEQ ID NO: 152447 - protein, 169 aa, Heterodera glycines
  Coding regions on vcDNA: vcDNA=SeqID_78870; Strand=-; Position=1 -51,125-170,225-335,395-609,907-992
  Homolog annotation: Hit_ID=XP_392582.1; Match level="QueryCoverage =53%, HitCoverage=18%, E-value=3e-28, Identity=62%"; Hit description =similar to phosphate transporter family member (54.8 kD) (5H667) [Apis mellifera]
MVVADLAVFQLDLFWTIILGFLIAFVLAFAIGANDTANSFGTSVGSRVLTLQQAYLLASIFETMGAALLGYQVTDTMRKGVIDLNIYEGREKELMLGQIAVLVMPFRFECLHFFIPSSSIRPVVVLGCSLPLSLKCPSPPRLLLGSSPPFCPAVFPFSFFSSLTIPSSE

SEQ ID NO: 152448 - protein, 50 aa, Heterodera glycines
  Coding regions on vcDNA: vcDNA=SeqID_78871; Strand=+; Position=1 -33,1301-1420
MAEWQNTAERWEIIFVKKARLFGATNVLYLPRVVSFIGLMPNQHQKNYGN

SEQ ID NO: 152449 - protein, 139 aa, Heterodera glycines
  Coding regions on vcDNA: vcDNA=SeqID_78872; Strand=+; Position=1 -111,165-311,536-697
  Homolog annotation: Hit_ID=XP_392201.1; Match level="QueryCoverage =89%, HitCoverage=97%, E-value=6e-22, Identity=39%"; Hit description =similar to ferritin [Apis mellifera]
MAYQAAQARQNFSPSVEEAVNKQIRNELNASYAYLAMANYFNRVDVALSGATEFFGKQSVEERAHALKLIDYVNARGGHVKLMPLPFTNFLEEFYLREQVDEIQRLARMANQLLRMGTSGLSEHLFDQELRKGTVLSDE

SEQ ID NO: 152450 - protein, 72 aa, Heterodera glycines
  Coding regions on vcDNA: vcDNA=SeqID_78873; Strand=+; Position=1 -26,864-1056
  Homolog annotation: Hit_ID=CAG30975.1; Match level="QueryCoverage =83%, HitCoverage=17%, E-value=3e-09, Identity=50%"; Hit description =hypothetical protein [Gallus gallus]
MPMLAQSQKKFFRPSPIPSIGLKPTGRSCDSARPRGKCRGKLRDTTLDWEDALPTAEFQRAWEYAKLAMASG

SEQ ID NO: 152451 - protein, 62 aa, Heterodera glycines
  Coding regions on vcDNA: vcDNA=SeqID_78874; Strand=+; Position=1 -122,792-858
  Homolog annotation: Hit_ID=CAE69354.1; Match level="QueryCoverage =100%, HitCoverage=31%, E-value=9e-15, Identity=59%"; Hit description= Hypothetical protein CBG15443 [Caenorhabditis briggsae]
DDKPLKGSDRLKISSQKDEKDPQGMVLLLDIHEPQKEDQAKYKCVVKNAEGRNEQSLNLQFE

SEQ ID NO: 152452 - protein, 362 aa, Heterodera glycines
  Coding regions on vcDNA: vcDNA=SeqID_78875; Strand=-; Position=1 -55,174-338,381-601,654-829,875-929,1519-1933
MSGGKSGKERTLLNFSLAATNTNGEQRNQEIKTKRNKQKLEHEGALYVLHQISDDGLRKYWRCEFFGPNNKCKGRLHTDINGNVLKIIGSHTCDMSAAQVECQRRVTQLKRRAVETCEAPATIRAQVLQNTATPVLAAFATKAATKKVIKRVRHDEDVPPAAPLSLEALELPPEYRMYNRTETEEENFLLADTGVFQIQGQAGPQRILIFARASTSEWAGIMKNVHVQLHLKADVQWALTVPRFASDEWSVHQRTLDGGDRTNNYAEAYHRKLQRAFDCTHPTVFRFINTIRCEQKSIDAEISRCIAGELPPQKAPKYCAADARILRLLQSYSAINNNQAHQNDHNYHALINNPYNIINFLL

SEQ ID NO: 152453 - protein, 405 aa, Heterodera glycines
  Coding regions on vcDNA: vcDNA=SeqID_78876; Strand=+; Position=1 -50,201-1368
  Homolog annotation: Hit_ID=AAR05665.1; Match level="QueryCoverage =96%, HitCoverage=99%, E-value=0.0, Identity=100%"; Hit description =stabilization of plasmid protein A [Salmonella typhimurium] gb|AAO61293.1| ParA [BAC cloning vector pEBAC19
MLGYADAESASDNKRLRMKLMETLNQCINAGHEMTKAIAIAQFNDDSPEARKITRRWRIGEAADLVGVSSQAIRDAEKAGRLPHPDMEIRGRVEQRVGYTIEQINHMRDVFGTRLRRAEDVFPPVIGVAAHKGGVYKTSVSVHLAQDLALKGLRVLLVEGNDPQGTASMYHGWVPDLHIHAEDTLLPFYLGEKDDVTYAIKPTCWPGLDIIPSCLALHRIETELMGKFDEGKLPTDPHLMLRLAIETVAHDYDVIVIDSAPNLGIGTINVVCAADVLIVPTPAELFDYTSALQFFDMLRDLLKNVDLKGFEPDVRILLTKYSNSNGSQSPWMEEQIRDAWGSMVLKNVVRETDEVGKGQIRMRTVFEQAIDQRSSTGAWRNALSIWEPVCNEIFDRLIKPRWEIR

SEQ ID NO: 152454 - protein, 95 aa, Heterodera glycines; identical to SEQ ID NO: 124528
  Coding regions on vcDNA: vcDNA=SeqID_78877; Strand=-; Position=1-811

SEQ ID NO: 152455 - protein, 117 aa, Heterodera glycines
  Coding regions on vcDNA: vcDNA=SeqID_78878; Strand=+; Position=1 -107,212-371,442-497
  Homolog annotation: Hit_ID=NP_507683.1; Match level="QueryCoverage =100%, HitCoverage=33%, E-value=9e-36, Identity=62%"; Hit description= tryptophanyl (W) tRNA Synthetase (wrs-1) [Caenorhabditis elegans]
RFGCRKITDDLVTRIENLTGKKAHAMLRRRLFFAHRDLTDLTSILDRFEQKKPFYLYTGRGPSSGSLHLGHLIPFFFCKSLQDSFDIPLIIQITDDEKFITDDEKFLWKDMDLERSK

SEQ ID NO: 152456 - protein, 59 aa, Heterodera glycines
  Coding regions on vcDNA: vcDNA=SeqID_78879; Strand=-; Position=1 -84,543-638
MSEEQKEYEMMKLVDCMDKMMVFEEIKQNDHFIFLSTICSKTVFLTKSAKSHMPTSLAW

SEQ ID NO: 152457 - protein, 108 aa, Heterodera glycines
  Coding regions on vcDNA: vcDNA=SeqID_78880; Strand=-; Position=1 -135,262-454
  Homolog annotation: Hit_ID=NP_494762.1; Match level="QueryCoverage =85%, HitCoverage=54%, E-value=1e-30, Identity=64%"; Hit description =putative protein of eukaryotic origin (2E613) [Caenorhabditis elegans] gb|AAF39886.1| Hypothetical protei
WPVTNTPNIRSDQHRYPFCIVWTPIPLISWLFPFIGHIGIATSKGIIRDFAGSNYVSEDNMAFGWPTLYHQLNPEKVNGGSEAWDNSVAEASDVSIFYYSNVEIAFLG

SEQ ID NO: 152458 - protein, 237 aa, Heterodera glycines
  Coding regions on vcDNA: vcDNA=SeqID_78881; Strand=+; Position=1 -133,295-524,574-781,814-956
  Homolog annotation: Hit_ID=CAE73548.1; Match level="QueryCoverage =99%, HitCoverage=99%, E-value=3e-83, Identity=64%"; Hit description =Hypothetical protein CBG21017 [Caenorhabditis briggsae]
MTSRKFFVGGNWKMNGTFTSIAELVNLLNQSGGNSDVDIVVAPPVTKVAKGAFTGEISPEMIKDVGATYVILGHSERRHVFGEEDALIAEKAAHALSTGLSVIYCIGEKLEEREAEKTKEVVNFKQLEALLSVKNLVWPKIVIAYEPVWAIGTGKTATPEQAQEVHGWIRKFLSEKVSQEIAEKTRIIYGAFKCFFCLGSVTAENCKDLAAKQDIDGFLVGGASLKPDFVNIINAKS

SEQ ID NO: 152459 - protein, 48 aa, Heterodera glycines
  misc_feature (21)..(21): Xaa can be any naturally occurring amino acid
  Coding regions on vcDNA: vcDNA=SeqID_78882; Strand=-; Position=1-188
WHYLVIFNFIICEWAATNTPXIFDLTSTGILFAFVGRHPPHQLVISLY

SEQ ID NO: 152460 - protein, 30 aa, Heterodera glycines
  Coding regions on vcDNA: vcDNA=SeqID_78883; Strand=+; Position=1 -49,924-967
MAQLFGFFVWAHALFHLFLVFMKSQEGMHF

SEQ ID NO: 152461 - protein, 39 aa, Heterodera glycines
  Coding regions on vcDNA: vcDNA=SeqID_78884; Strand=+; Position=1 -20,200-299
MNGAAKIFCPYNHFWATVSRCISSAVWHRDQSLSEKRYS

SEQ ID NO: 152462 - protein, 108 aa, Heterodera glycines
  Coding regions on vcDNA: vcDNA=SeqID_78885; Strand=+; Position=1 -56,252-521
MTAFGEQMKKMNKRTLKKIWICSEVLMDILPFFDRPQLGLKLALLSPRFNALVDTHFDDKTTELTIWKLIKINGPKPQLSVLIDGKFVGFPLPDRPLPNKIRFNQLRI

SEQ ID NO: 152463 - protein, 48 aa, Heterodera glycines
  Coding regions on vcDNA: vcDNA=SeqID_78886; Strand=+; Position=1-596
LQMSILPSISKRSEFFYNKLIESKKHDCIIFKNLSMHLLNVPKPDQIF

SEQ ID NO: 152464 - protein, 18 aa, Heterodera glycines
  Coding regions on vcDNA: vcDNA=SeqID_78887; Strand=-; Position=1 -19,417-454
MTNSNLGNDKFQPSTHFR

SEQ ID NO: 152465 - protein, 60 aa, Heterodera glycines
  Coding regions on vcDNA: vcDNA=SeqID_78888; Strand=+; Position=1-592
KGSEFFYNKLIESKKHDCIIFKKFIYAFVECSQTRSNFLNLYMKTFIAGNDKFQPSTHFR

SEQ ID NO: 152466 - protein, 95 aa, Heterodera glycines
  Coding regions on vcDNA: vcDNA=SeqID_78889; Strand=-; Position=1-288
  Homolog annotation: Hit_ID=AAG25718.1; Match level="QueryCoverage =80%, HitCoverage=56%, E-value=2e-09, Identity=39%"; Hit description =ovarian fibroin-like substance-3 [Cyprinus carpio]
MGTKGNGKGKAQGTAQGRRRARHGKGAGHGKGARARHGEGAGHGTGKAHGHGTGKAQGTAQGRRRARHGEGMETSEGTNERSEITENPAPFIRLF

SEQ ID NO: 152467 - protein, 66 aa, Heterodera glycines
  misc_feature (6)..(6): Xaa can be any naturally occurring amino acid
  Coding regions on vcDNA: vcDNA=SeqID_78890; Strand=-; Position=1-514
IEGRMXHLKLKLISVIRTDYLVNRKQINHKIRTKNDFILECRLKMHNKLIYSNLFEITVQQIISCF

SEQ ID NO: 152468 - protein, 137 aa, Heterodera glycines
  Coding regions on vcDNA: vcDNA=SeqID_78891; Strand=+; Position=1 -39,289-663
  Homolog annotation: Hit_ID=NP_704784.1; Match level="QueryCoverage =67%, HitCoverage=8%, E-value=1e-09, Identity=33%"; Hit description =hypothetical protein [Plasmodium falciparum 3D7] emb|CAD51927.1| hypothetical protein [Plasmodium falcipar
MLAKSRGIAANQKKQILIKKLTANFSGTHQQHNTNTNGQNDDGDGTDNEQSFGDGTYGQSDDGDGTDNEQNFGGGGGGTNGQSDDGDGTDDEQSFGGGGGDNNVEGEQEGGQQQQQSTEFTRRQKIKKIFRKLKKSF

SEQ ID NO: 152469 - protein, 156 aa, Heterodera glycines
  Coding regions on vcDNA: vcDNA=SeqID_78892; Strand=-; Position=1-471
MESFKKDFLEAKMKALVEEKVAEAKELAEFAIADAERKMEQSLNNAIHAERERGQQQLRSVVEEQHMRCRHLALQSYRAATMTKPTSVRTSDVSPKWEPHCMFCLIDEPMFGSEWCAHVNVCAECSIVWSGDDQCKCLTCQTTCNKFVYFGPNPSP

SEQ ID NO: 152470 - protein, 202 aa, Heterodera glycines
  Coding regions on vcDNA: vcDNA=SeqID_78893; Strand=-; Position=1 -187,865-1284
MSSSSSPEKILAQPSCPKKAKVDERALWKIFKGKYMLAIYLCDDDWRNLFENKEKVRRMDNDHGMAMESFKKDFLEAKMKALVEEKVAEAKELAEFAIADAERKMEQSLNNAIHAERERGQQQLRSVVEEQHMRCRHLALQSYRAATMTKPTSVRTSDVSPKWEPHCMFCLIDEPMFGSEWCAHVNVCAECSIVWSGDDQCK

SEQ ID NO: 152471 - protein, 186 aa, Heterodera glycines
  Coding regions on vcDNA: vcDNA=SeqID_78894; Strand=+; Position=1-561
MPSLNKLSFYESEMVLVNVFCAQLLDCPVKSLRDRLNHPEDCVNAMNGLMGKKVRTTYKDRNGMHKTFFVSGITERGAAFVPAYGNLRAPYNVNVAAYFYARHPIKLHFPYVPCVIERFSGRGEDRFYPMELLEIVDEENKGRLFGRMFMEIGEDDDDDNDEDVSTSFDSTLRFDMGRDECSQLWR

SEQ ID NO: 152472 - protein, 79 aa, Heterodera glycines
  Coding regions on vcDNA: vcDNA=SeqID_78895; Strand=+; Position=1 -98,1344-1482
MFCRWAAVPIVPSADQSKNETPLGAELFVSSTILEYRYMRLAEGRETDQSVRTSCALIESDVDGSEEEEEEGVKQQGQK

SEQ ID NO: 152473 - protein, 199 aa, Heterodera glycines
  misc_feature (75)..(75): Xaa can be any naturally occurring amino acid
  misc_feature (155)..(155): Xaa can be any naturally occurring amino acid
  misc_feature (194)..(194): Xaa can be any naturally occurring amino acid
  misc_feature (198)..(198): Xaa can be any naturally occurring amino acid
  Coding regions on vcDNA: vcDNA=SeqID_78896; Strand=-; Position=1 -288,1046-1313,2211-2251
  Homolog annotation: Hit_ID=CAD22154.1; Match level="QueryCoverage =96%, HitCoverage=51%, E-value=7e-69, Identity=61%"; Hit description =pherophorin-dz1 protein [Volvox carteri f. nagariensis]
PPPPPPPPAYEPPEAPCNEPQQPPSYGAPAPPPPPPPPPPPPPPQPPAYEKPEPPSYGAPPPPPPPAYEPAPPSXEAPEPPSYQPLPQPPPPHKPPPPPPPPPPPPPPPPPPPPPPPSYEQPEPPSYGAAPPPPPPPPPPPPPPPPAYEPAPPSXEAPEPPSYQPLPQPPPPHKPPAKRINRYQIRPHHCIVCXQNKXK

SEQ ID NO: 152474 - protein, 223 aa, Heterodera glycines
  Coding regions on vcDNA: vcDNA=SeqID_78897; Strand=-; Position=1 -375,424-583,634-771
  Homolog annotation: Hit_ID=CAD22154.1; Match level="QueryCoverage =91%, HitCoverage=51%, E-value=1e-41, Identity=44%"; Hit description =pherophorin-dz1 protein [Volvox carteri f. nagariensis]
KMKLISLAPLVICSLFFVGIPVVLSDGKGAPPPPPPPPSSYGGPPPSYGAAPPPPPPPPPPPPPPPPPPPPPPPSSYGGPPPTYGAPPPPPPPPPPPGYGGPTTGYGAPPPPGPGPYPPSPPQKCKGEGLSAPKYCASNVYYACSGGVSTKLNCPKGLVFDQANQVCNYPSDCGKKQPPQPQPPSKGYGKYGRGKRDASGAPPAPEPAPPPPPPPPPPPPPPP

SEQ ID NO: 152475 - protein, 170 aa, Heterodera glycines
  Coding regions on vcDNA: vcDNA=SeqID_78898; Strand=+; Position=1 -88,644-877,1539-1729
MNIRPSLSPAELDARRQLQKECAEKRKDGETFYSHNCVVLGDFNFPNKDLVWKEGQPYSMSKFGEIFCHFFSKLPFLIATNGLTRENSWLDLVLPANDQIVKQCTIEGLKIFSLFVKLIEHVKSFRMIPTMLDLDDKEKSYSGKACWGPTVRAELTGSGQETFSHLPKNS

SEQ ID NO: 152476 - protein, 19 aa, Heterodera glycines
  Coding regions on vcDNA: vcDNA=SeqID_78899; Strand=-; Position=1 -43,318-334
MYLDPALYFSWIQPVKTCL

SEQ ID NO: 152477 - protein, 62 aa, Heterodera glycines
  Coding regions on vcDNA: vcDNA=SeqID_78900; Strand=+; Position=1-288
QGWAEVSLFAFRLSHYSHFLAFRISLFAFRFLARNATFTPLRIGLNSHKIFKNFTYKLANFQ

SEQ ID NO: 152478 - protein, 173 aa, Heterodera glycines
  Coding regions on vcDNA: vcDNA=SeqID_78901; Strand=-; Position=1 -26,196-482,1053-1145,1264-1378
PGQHNNQPEDLTGSVRLHLGTCTYDDGLYFEGGTFVFEGLCSPSGDRLDVERMALPTMTTLESAESVDGAPGLATRTQEMARRTRGDPNDRIVLMSDVHLDNEREAKNVHFATNPCKLVFKDRHIVIFRDDVVEKFCDTIWAQRHFSPLPLFINPIQPHFDPLFQLFPSPDAL

SEQ ID NO: 152479 - protein, 140 aa, Heterodera glycines
  misc_feature (127)..(127): Xaa can be any naturally occurring amino acid
  Coding regions on vcDNA: vcDNA=SeqID_78902; Strand=-; Position=1 -64,168-259,570-834
  Homolog annotation: Hit_ID=XP_396497.1; Match level="QueryCoverage =82%, HitCoverage=9%, E-value=3e-27, Identity=56%"; Hit description =similar to mKIAA1601 protein [Apis mellifera]
TGFPVCILTPCSNSHPFEERRLVTRTEEDAVKIGRSVVRLQPSSNNAIFDCKVLSRNHAVLWANGAGHFMIKDTRSSNGTFINNERLSASGEENEPRELFSGDILQVFIITPDISVESKKNRGNFSXWRLSLNCSVYIQK

SEQ ID NO: 152480 - protein, 111 aa, Heterodera glycines
  Coding regions on vcDNA: vcDNA=SeqID_78903; Strand=-; Position=1-336
  Homolog annotation: Hit_ID=CAC84371.1; Match level="QueryCoverage =87%, HitCoverage=19%, E-value=7e-09, Identity=40%"; Hit description =hypothetical protein [Saimiriine herpesvirus 2]
MGTKPPVTSNCHNDGNTEIGKAARRGRVGAATASEEGAKFVRATGRWAEEKGKEQLLAGGEEAAEQEEQQQDEEEEEKEEEQWEEEEEEGRKLATEWEERPVEKQQREGEG

SEQ ID NO: 152481 - protein, 354 aa, Heterodera glycines
  misc_feature (348)..(348): Xaa can be any naturally occurring amino acid
  Coding regions on vcDNA: vcDNA=SeqID_78904; Strand=-; Position=1 -53,3263-3482,3567-4352
  Homolog annotation: Hit_ID=NP_921250.1; Match level="QueryCoverage =89%, HitCoverage=23%, E-value=4e-42, Identity=33%"; Hit description =Helicase-like protein [Oryza sativa (japonica cultivar-group)] gb|AAP53537.1| Helicase-like protein [Oryz
ISTSNRKIRLISTSNRKNFSKACLARGLTKDDDEWKHCLNEASQFRFPAALRSLFTSILLYGDPKQPEILWEQFKNNLSEDFLIKKQPNIETSLTTSLTEENENINYEEEKKIAENLYKSMNADQKIIYKKIKQIASGKLNPKLIYIDGPGGTGKSFTLNALYIYSYKKHMTNMAFSGIAATLLKNGRTIHNRFKFPLNLNAHIISGVVQGTKAAEEIIKSDFFVIDEAPMTPRFALDAIEKKLRELTNCKQLFGGKTIILAGDFRQTLPVKKFAVRSEIIDLTIKKSIFWSKFEQMKLTINNRAKDQFSLNRYLKMVMELLASLFNYHNWIIGNDSILDEIYDDGFXERNFNN

SEQ ID NO: 152482 - protein, 193 aa, Heterodera glycines
  Coding regions on vcDNA: vcDNA=SeqID_78905; Strand=+; Position=1 -112,165-530,659-762
  Homolog annotation: Hit_ID=NP_702063.1; Match level="QueryCoverage =66%, HitCoverage=3%, E-value=2e-17, Identity=36%"; Hit description =hypothetical protein PF14_0175 [Plasmodium falciparum 3D7] gb|AAN36787.1| hypothetical protein [Plasmodium
MRYAVYRLIGSNERLRADTERMERTNALLFQIYARLSAGPPNLEQQNLPVAGANQPNLPVAGANQPNLPVAGANQPNLPVAGANQPNLPVAGANQPNLPVAGANQPNLPVAGANQPNLPVAGGNQPNLPVAGANQPNLPVAGANQPNLPVAGGNQPQPAVHPIWRILVQDAGLVAANQYMHLLYGVCLYILYY

SEQ ID NO: 152483 - protein, 182 aa, Heterodera glycines
  Coding regions on vcDNA: vcDNA=SeqID_78906; Strand=+; Position=1 -142,218-337,655-829,1202-1312
  Homolog annotation: Hit_ID=CAE62158.1; Match level="QueryCoverage =100%, HitCoverage=2%, E-value=1e-66, Identity=67%"; Hit description =Hypothetical protein CBG06205 [Caenorhabditis briggsae]
PPIKYVFLTPLPNTMEIYRTKQGVLTCKLNSARAPLVWQRDGKPIDVDDPRYQIEKDAAGRFTLTIRVVEQIDQGMWTAFVNKDVTSKCQVYVEEPRDTFVVPLKSQRANEKENATFECDVNDKDIDVEWFHDGAKIKMDGRHFKEERAGRRRRLLITNVLIEDHGEYKCTTKDDKTMAQLI

SEQ ID NO: 152484 - protein, 185 aa, Heterodera glycines
  Coding regions on vcDNA: vcDNA=SeqID_78907; Strand=+; Position=1 -354,752-943,1056-1067
  Homolog annotation: Hit_ID=CAE62158.1; Match level="QueryCoverage =97%, HitCoverage=2%, E-value=7e-55, Identity=58%"; Hit description =Hypothetical protein CBG06205 [Caenorhabditis briggsae]
MPGSKYECQSRSGVHTMKISKIEMNEGDKYEIDVAGLRGACRITVLEAERKPVIKWKPQKFECEAGKEKRIKVPFEVKGTRRGDPKPILLRNGKPVDLNKMKDLVEASLKNSGQNRYFVIINGDVAEIVFKNPQKSEAGKWSLQLENTGGVSAAAPFELVVKGKPKTPKGPLDTLDVKSDSCSTN

SEQ ID NO: 152485 - protein, 115 aa, Heterodera glycines
  Coding regions on vcDNA: vcDNA=SeqID_78908; Strand=+; Position=1 -139,585-790
  Homolog annotation: Hit_ID=CAE62158.1; Match level="QueryCoverage =100%, HitCoverage=64%, E-value=1e-41, Identity=37%"; Hit description= Hypothetical protein CBG06205 [Caenorhabditis briggsae]
PPAFTAGGIQDQRLRVGETIKYEVAISGEPLPAVTWEVNGKPLKACGRVKMTTEKGKTVLKIEDAQRGDSGKFTIKLKNKSGECASTANVTVVGRPEPPKGPLEVSNISADGAVL

SEQ ID NO: 152486 - protein, 235 aa, Heterodera glycines
  Coding regions on vcDNA: vcDNA=SeqID_78909; Strand=-; Position=1 -71,120-286,515-705,1052-1203,1269-1394
  Homolog annotation: Hit_ID=NP_031996.1; Match level="QueryCoverage =92%, HitCoverage=32%, E-value=1e-12, Identity=24%"; Hit description =enhancer of zeste homolog 1 [Mus musculus] gb|AAH07135.1| Enhancer of zeste homolog 1 [Mus musculus] gb|A
MDNMFRVVHQQFPNKASFHELRALYPDLQRRFQPETIDKQRFTNEQGELVEKFKNDRLLNSYELLLCHKCFSYDCIMHNAATSNGYGNSKKLRTKRQSSSGVSRHSGGKENCSKLRRSCSANCYLLSNSSGAAQPAMAAMPRANSIASRPQQQQPSIAIGGTAPADSAKWTPHEEAIFNVLRSTGEEEFCRIAIMLNLSLGETARKRTCQEVYEYACRAGPQSTNGESSSPVKNA

SEQ ID NO: 152487 - protein, 109 aa, Heterodera glycines
  Coding regions on vcDNA: vcDNA=SeqID_78910; Strand=+; Position=1-330
MPSKKCTKCAIAINDLNIKESQEISSSVDSVPKLLPFFYGTLLALFMTQLGAILFNHSHLGGLSMFDTIFLLIARADIAQVHKWMFVVSFLLRFLLQSSGVHFQGQLIG

SEQ ID NO: 152488 - protein, 24 aa, Heterodera glycines
  Coding regions on vcDNA: vcDNA=SeqID_78911; Strand=+; Position=1-74
IGRTVKHNDMHIPTAKYGSRRVIN

SEQ ID NO: 152489 - protein, 124 aa, Heterodera glycines
  Coding regions on vcDNA: vcDNA=SeqID_78912; Strand=-; Position=1 -80,185-477
MDIASSSSSALVDNKALLMERSWTACRPPDQRLLLNGILAIVDKAMCAVDRTKTVFWGAVDRQKAEARLGDEAKRTEDDEEGDGVDWRLAERTGEGDSRRRRASGRFGGDGVDERMTGQTGAGE

SEQ ID NO: 152490 - protein, 44 aa, Heterodera glycines
  Coding regions on vcDNA: vcDNA=SeqID_78913; Strand=-; Position=1-171
KKKKDGRHNHQATTLTLALHSLKMILKRQKGKASYLGQKLHLAK

SEQ ID NO: 152491 - protein, 244 aa, Heterodera glycines
  Coding regions on vcDNA: vcDNA=SeqID_78914; Strand=+; Position=1 -187,727-1274
MDVQRLNRLLKVVDRAWTLPKFGSSEPIGSNFQVNEWKGHFGIPYEANALSTRRHVPAFTRREKSEGLAERKSEGDTTQIQQERRQRMFRETAEDGAEMGEETITKRVPFWQRLMVRKRMEDKGRREKEGDEERAEKEREEEIRWMEKRYGGRRETEVKSTEEKRQTEKEEEIRWADKQYGGRGETEVERTRESADWDGQRWEGTTGKVNATTFEFVGKHSLLTQFDSVNARNARSLTNEATIA

SEQ ID NO: 152492 - protein, 191 aa, Heterodera glycines
  Coding regions on vcDNA: vcDNA=SeqID_78915; Strand=-; Position=1 -198,250-329,413-544,589-661
  Homolog annotation: Hit_ID=CAE61696.1; Match level="QueryCoverage =100%, HitCoverage=32%, E-value=4e-42, Identity=52%"; Hit description= Hypothetical protein CBG05644 [Caenorhabditis briggsae]
VASGKLKKDKDGNWEFEYDTSDEENSSDPENATIQQSASGERPTVSRASSEGKGEEQMPPLQTLNLVLRVRNQQRELNDIKFDYSVLRVRNQQRELNDIKFDYSPNADSVDGIAHELIAHELVTAELIDGHDLVVVAANLQKLIDLAQKKAERRTITFALNSGVASNSGVASNEIPDERSLTGFAQLSLLD

SEQ ID NO: 152493 - protein, 99 aa, Heterodera glycines
  Coding regions on vcDNA: vcDNA=SeqID_78916; Strand=+; Position=1 -17,378-660
MSSKIPFISADCWLEVFALLPPSQLGLGIALISRRFYRRVDKHFKARKWILDTELRIQEKELWFGRKQMEIVNANWKRLPIPQNLLPNKVIGFKHITFM

SEQ ID NO: 152494 - protein, 222 aa, Heterodera glycines
  Coding regions on vcDNA: vcDNA=SeqID_78917; Strand=+; Position=1-667
MEEYFGQASFRKRMLAQGHRLRESLACEGNKNRILAETAFGFGRNEGNCEFGGPSVHSNFGEKRIERSGFEGRTEQEKNLVERLKAELVRVKAERDEANAKIEILREKLSDSEKLCVFLKADHKKVLAQAEKVRTESKAIEIELNEAKENLEMAEEENGHFSILSVQQNLMVQEQGRKIMDLIEEVEELKAKKNAKKKEKLSKSPEHQITEPKKLISKSPPK

SEQ ID NO: 152495 - protein, 24 aa, Heterodera glycines
  Coding regions on vcDNA: vcDNA=SeqID_78918; Strand=+; Position=1 -41,124-157
MPRKRVPQLDEPDLHAMQMRGTNA

SEQ ID NO: 152496 - protein, 199 aa, Heterodera glycines
  Coding regions on vcDNA: vcDNA=SeqID_78919; Strand=-; Position=1-601
ERVARLPILLQLLLLLAVVEAVQEIRRVVVPRATGVERHRATGTEGRVVVRHAPGTRRAEARTEAGRVVRLPPGKRLAEARAEERRVVRRPRGNRRADVSRTEAERVLRLPPAKRRADGRTQGRGVRHPPAGMRRADVRTEAGRVVRHPSGKRRVDIVGGLCRANRSRRSGPSRPSGVDVDARGGQGVATDAQKIRIRP

SEQ ID NO: 152497 - protein, 95 aa, Heterodera glycines
  Coding regions on vcDNA: vcDNA=SeqID_78920; Strand=+; Position=1 -240,328-374
PFCCNSPVPRTPAADCCFCVCHFFALCSFAAEPRRLRPDDVRTNGTDRHQQGEGEPEMCADATVRNAAAKLERQQRIPCLLFKWRILIDGPPETP

SEQ ID NO: 152498 - protein, 94 aa, Heterodera glycines
  Coding regions on vcDNA: vcDNA=SeqID_78921; Strand=+; Position=1-285
ILFRNDPAQYREEVRRRVERASASTPRARSSSTPPPVAQPPGEQQQGTPPQPPDGQGMQPPGEQQQGTPQPPATPPQGQEAPQQQQQQTGEWYL

SEQ ID NO: 152499 - protein, 197 aa, Heterodera glycines
  Coding regions on vcDNA: vcDNA=SeqID_78922; Strand=+; Position=1 -205,1025-1413
TSKRILDGETKLALINEFHKRKRECQKREKKLKKNYNKYKVKIEGEIARDLGTNRKMIYKWKKALGQKWKRRFRDSEKLELVRKFDEIKRKNRMLNSDRVAETLAVTKESIRKWRTEFGIEAKCKIFKSILNQFNLILPDLNLGNCNYTEEEKMKLICKFDKIKGKNPRLNSGRIAEELGTTQKSIRKWRAKLGTKS

SEQ ID NO: 152500 - protein, 79 aa, Heterodera glycines
  Coding regions on vcDNA: vcDNA=SeqID_78923; Strand=+; Position=1 -110,371-500
MHKFNELLEKEELCFHYSNPPLFTLYYFSILKTEITKNIKYNLTINEKTFFKFTTFTMKSLVNEANEFNEDCPSFLSQP

SEQ ID NO: 152501 - protein, 49 aa, Heterodera glycines
  Coding regions on vcDNA: vcDNA=SeqID_78924; Strand=+; Position=1 -72,163-240
MDADSVLQPVFIFAFAAVELLINLSGSILGVNCAENEQKERKDCAKLGN

SEQ ID NO: 152502 - protein, 76 aa, Heterodera glycines
  Coding regions on vcDNA: vcDNA=SeqID_78925; Strand=+; Position=1 -130,902-1002
MVSIVDNPIDHKNIGGMSENLLYALADGSRAASDRTVPGHAGRAPALGAETFVVVVSVVVTVVARVSFFPPATNYP

SEQ ID NO: 152503 - protein, 159 aa, Heterodera glycines
  Coding regions on vcDNA: vcDNA=SeqID_78926; Strand=-; Position=1 -323,407-561
  Homolog annotation: Hit_ID=CAE58430.1; Match level="QueryCoverage =89%, HitCoverage=64%, E-value=1e-18, Identity=36%"; Hit description =Hypothetical protein CBG01565 [Caenorhabditis briggsae]
MSGPISRQHNFSSVSNGCSKKRKDRPAHKGSALLSAEENSQLFEVLGRDRISLVAGIAQLLDAPAESPNVWRKTNVGIVYLVKDYRERNYQLCMYDIFKKELQWSQILYKDFAVNSYSNCPRLLVFECDTCIKALNFTDFNEAEEFKVAMEKRRESNQK

SEQ ID NO: 152504 - protein, 36 aa, Heterodera glycines
  Coding regions on vcDNA: vcDNA=SeqID_78927; Strand=+; Position=1-110
LVFECDTCIKALNFTDFNEAEEFKVAMEKRRESNQK

SEQ ID NO: 152505 - protein, 118 aa, Heterodera glycines
  Coding regions on vcDNA: vcDNA=SeqID_78928; Strand=+; Position=1 -126,1334-1402,1528-1689
MTCSTEESNVAWWSISQKSDLLSFADGLMTHYTSIEHSKEIDRDGSLQLDGGEITLLECDCDSVRVGFVHEPPQNILALKVGDVDENKPDQFDLIILYTSTEARQTNKRSDEFLTEHF

SEQ ID NO: 152506 - protein, 59 aa, Heterodera glycines
  Coding regions on vcDNA: vcDNA=SeqID_78929; Strand=-; Position=1-177
MGPKRTQAESDFWEGMCKLAAIQSKAEEASDGGKKKAKSKAISSELQQKWPKLDKKMPK

SEQ ID NO: 152507 - protein, 177 aa, Heterodera glycines
  misc_feature (172)..(172): Xaa can be any naturally occurring amino acid
  Coding regions on vcDNA: vcDNA=SeqID_78930; Strand=-; Position=1 -178,681-851,1407-1593
  Homolog annotation: Hit_ID=NP_741442.1; Match level="QueryCoverage =79%, HitCoverage=7%, E-value=4e-55, Identity=73%"; Hit description =voltage-gated Calcium Channel Alpha subunit, putative L-type calcium channel alpha 1 subunit, EGg Laying d
LVADVLSAAMLSAPLVAPHHELLPHQFLEKQWLGSWKKLPKSSHDCRRICRRVEELWLFYWLVIVLVFLNTLVLTSEHHGQEQWLDHFQTGANLFFVVLFTMEMLLKMYSLGLLQYMNSQFNRFDCFIVISSIIEFVLVYFEFMKPLGISVLRSARLLRIFKVTKDWTALRXKKTVE

SEQ ID NO: 152508 - protein, 101 aa, Heterodera glycines
  Coding regions on vcDNA: vcDNA=SeqID_78931; Strand=+; Position=1 -285,981-1001
MPSLVWWSHRRRPSPRPTRRAYRLRLDHATAPAATPAVHPLQQSPLRQQRGRSLRLAVAVLAVLVTVAGARLAMFVRVFVVAQLLDVLRLRDPVQAFLWNN

SEQ ID NO: 152509 - protein, 34 aa, Heterodera glycines
  Coding regions on vcDNA: vcDNA=SeqID_78932; Strand=-; Position=1-103
MLIDSQINKHIMSDQKQLFYSAKLFPAIRVDFLK

SEQ ID NO: 152510 - protein, 250 aa, Heterodera glycines
  Coding regions on vcDNA: vcDNA=SeqID_78933; Strand=-; Position=1 -11,399-834,902-1155,1205-1256
MNRRCIDHSVITFLRSNQQIFDGRGTNLSLWLRPDANDYQPIWDAFVREIWPIFVPNIRRLGIPKGDQLDNLLRRTSPTILTDLNQLNSIHLDYLFTNIGDQNGPNATPTVCQALFEWLCTPISDGKPKQLTCCGYPAGTTEWLNNFKEAFLGSTNSSASYIIRIELYEPTEIGPFELTNNGIGEKLTLEKEGQLGNQLIIKRCQIGETIQWEDENSNNLNNVHFWMDNAKCIGPMSPPKPGQNKKRKKN

SEQ ID NO: 152511 - protein, 26 aa, Heterodera glycines
  Coding regions on vcDNA: vcDNA=SeqID_78934; Strand=+; Position=1-81
VLSMSIWNANRSRISDLDGQELQADE

SEQ ID NO: 152512 - protein, 164 aa, Heterodera glycines
  Coding regions on vcDNA: vcDNA=SeqID_78935; Strand=+; Position=1 -141,752-875,1006-1235
MSKQIAMECAFNLLLKKTTTLPLDARHQTVPTVAVADDDDPDYASVPGLGLGAVLPTMAPPTANALKAAENGDEEATTLGKHSYVRCLSGLNKGSYGQVMSMDEENASIFVELAWPPANVGKTVRVSQWAVEVVRRKEYRECVKGGSGGGGTAENGRRLERVRV

SEQ ID NO: 152513 - protein, 151 aa, Heterodera glycines
  Coding regions on vcDNA: vcDNA=SeqID_78936; Strand=-; Position=1 -141,197-363,426-573
  Homolog annotation: Hit_ID=NP_508800.2; Match level="QueryCoverage =83%, HitCoverage=27%, E-value=4e-17, Identity=37%"; Hit description =putative protein, with at least 3 transmembrane domains, of bilaterial origin (50.4 kD) (XF295) [Caenorha
CFCAHFFPTKSATICRPIGVGISATVAMAFLWPNNTLALYAFWKTVEFAFFRLADAGTLPVLPWADALLFSVLSSYLLGLAVLEPHALRQNYYKFLCSVTGNRLQLLNRPMFDKFLGTSSSAVLYSDYRPEFLPYLRTINPAQYLPQMQIV

SEQ ID NO: 152514 - protein, 108 aa, Heterodera glycines
  Coding regions on vcDNA: vcDNA=SeqID_78937; Strand=-; Position=1 -271,561-616
MAAKKRFNPSVRNAKTFQKKKLKVGRTLRHENGTDTRVSVKKIGILEQLREGDEGTPAKEVETRHPQKGIDELVAQLGHYNENICRDAIHAKIDRNSQSVEAADRNGL

SEQ ID NO: 152515 - protein, 138 aa, Heterodera glycines
  Coding regions on vcDNA: vcDNA=SeqID_78938; Strand=-; Position=1 -328,516-604
MSFLDKLSNGAIVWLLELNNPSCRTSGAEHTLACANFYRDVIAFVPGGCVCAILVVLFFMDIRRLGQRSAQQQQQIGAGRGGEEEEAGDSGEAAENSRSSGRVRIGPEFDLSRPAPPVHTLTQIGEEEPPNPNIIHLP

SEQ ID NO: 152516 - protein, 123 aa, Heterodera glycines
  misc_feature (40)..(40): Xaa can be any naturally occurring amino acid
  Coding regions on vcDNA: vcDNA=SeqID_78939; Strand=-; Position=1 -293,456-532
  Homolog annotation: Hit_ID=NP_501697.1; Match level="QueryCoverage =100%, HitCoverage=5%, E-value=4e-17, Identity=37%"; Hit description =predicted CDS, integrase, catalytic domain containing protein family member (4K310) [Caenorhabditis elega
SLNSCFFRGPVLLPDLAGMLLLFRCVVSSPFILAATLRHXLQQFDSPLSREISESIYVDNVLLECETVQEALEKYKFSKDILQQGCFNLREFISNSKEVMKQIPQEDQLDKPKAKVLGLPWDT

SEQ ID NO: 152517 - protein, 1023 aa, Heterodera glycines
  Coding regions on vcDNA: vcDNA=SeqID_78940; Strand=+; Position=1 -1196,1352-1676,1927-3089,3252-3637
  Homolog annotation: Hit_ID=AAM51140.1; Match level="QueryCoverage =48%, HitCoverage=53%, E-value=5e-53, Identity=28%"; Hit description =SD27140p [Drosophila melanogaster]
MSTVDTSKGRANKVPKCKKPHAYLMTRRLLAKSSRDSRNIIKVAVLFDPGSQTTYGADPLIDKLRPHKLTSEEMEVHGFGGKREPLRFHSPIYSVLLQRADGKWEEIVLNRTEKISTHFSMVEWSADESVTNHHEVCEAMCFTKEEPMILLSARHFWQFFQGKREVSPGLFVINTTFGPLVNGESTIGPPNSSQKALSMMAIHSTNVEQMPTINEVEHFFNLESLGIQDDPAQDDDQTAMELFNKSIRQETDGSYSVKWPWKESNPDLSSNFKMAHSRLSSVLTKLRHSPEILEKYDATIRDQLQQGTIEKAQRAPGQLEHFRPHHGVLAKKLRVVYDASAHTRGTPSLNSCFFRGPVLLPDLAGMLLLFRCPTFPLLADIQAAFLQISLEPEDREVTKEISESIYVDNVLLECETVQEALEKYKFSKDILQQGCFNLREFISNSKEVMKQIPQEDQLDKPKAKVLGLPWDTEKDEIVFKFPTTDPLRPVTRRLVLSHLASLFDPLGRRLKEIRECLGCTFHFVRTGDNPADLATRGATTSELRNHHLWWKGPTWLTQESHLWPNEFCFKVTESDQQNSENVGPSGAFLAYTHSKQPNEQVLIDPSRFSSWKRLMRTTMFVLRFLALMFKRGEETIASLEKHRKEIRQISKSGEFKAEDFALAERVLIRLDQMDDAEEFQHFKTVFEDDGILRLNTRLEMSEKPYSFSHPILLAKHSALAKLIILDRHQKRHHLGVDTTLTEFLSEFWMPSARLNVKRALRDCLLCRRMNAQQFALPTMPPLPGERVRRHAPFQSIGIDFLGPTTISLAGEKIKAWILIIICLATRAVYLEATLDLTSESFINVLRRFISRRGKPDIIWSDNATTFKLAQKTLELLSAPGPDQEVQNFLTHNRIQPITAVSDAVDGPVPLRPINLLQPEIHSNWETTTDPIDSEEMFSSTHERLASRIQALREAKDIFWAKWHSEYLTLLRERAQWDHKGPRLQNFGEPKKGMVVLISQDLVPRNQWPMGRIVETHGRPGAIR

SEQ ID NO: 152518 - protein, 25 aa, Heterodera glycines
  Coding regions on vcDNA: vcDNA=SeqID_78941; Strand=+; Position=1-75
MAFDDQFYEKTINKLAETKAFYLML

SEQ ID NO: 152519 - protein, 114 aa, Heterodera glycines
  Coding regions on vcDNA: vcDNA=SeqID_78942; Strand=-; Position=1 -108,608-715,774-902
VAALKSRCETHLINCVEIPLIDRFLLIERFGLDNLKVTALKSRCETHLINCDEIPLIDRFLLIDRYGLDNLKNSFLHLDVNKLRAFFAVNHELFFPVISKEFLYALSVRAMAGL

SEQ ID NO: 152520 - protein, 199 aa, Heterodera glycines
  Coding regions on vcDNA: vcDNA=SeqID_78943; Strand=-; Position=1 -146,372-572,2018-2269
DFYALESVAPVGSGLKSDLKAKVRYLLQSSSESEQQASLFNFKHIRPGNWGLFYMHNDATTDAAHRRLDKSALNVTYSDINIEMHDQGGIYAIIVSGTMEKVKMSLRYSHFKFSFCFYYEYRVNTDESSTNADNDDDDEDEFEEAEELRKIDEKRGPLEAKFEDKAADDEKRNEQNIIKTKVKTTNGNRKNGEINVIIM

SEQ ID NO: 152521 - protein, 33 aa, Heterodera glycines
  Coding regions on vcDNA: vcDNA=SeqID_78944; Strand=+; Position=1 -97,181-185
MSPKWKNVTKMMIISPMATVKNQQAWSRVFIEA

SEQ ID NO: 152522 - protein, 70 aa, Heterodera glycines
  Coding regions on vcDNA: vcDNA=SeqID_78945; Strand=+; Position=1 -204,423-431
MISKDAKNMDIKSQNMAIKYGPKIAKYGHKMAKMSKYGHKFFKIECKISSNLLVEIAYEIHFQIFFDSKI

SEQ ID NO: 152523 - protein, 47 aa, Heterodera glycines
  Coding regions on vcDNA: vcDNA=SeqID_78946; Strand=-; Position=1-157
LHRIAEKIRDQFPNVDRLIAKTKAVFVKAPYRVKKNLEMYLICNFNQ

SEQ ID NO: 152524 - protein, 68 aa, Heterodera glycines
  Coding regions on vcDNA: vcDNA=SeqID_78947; Strand=+; Position=1 -88,334-452
MLNKKCVTFALFLLLSAAVLFVSGAKKSAIFIKTKSVNMISEIQGVKNKKLYRKACIVEFNLLNGYFF

SEQ ID NO: 152525 - protein, 25 aa, Heterodera glycines
  Coding regions on vcDNA: vcDNA=SeqID_78948; Strand=-; Position=1 -3,621-695
MPFSPTLLREILISLIISQFSSITD

SEQ ID NO: 152526 - protein, 136 aa, Heterodera glycines
  Coding regions on vcDNA: vcDNA=SeqID_78949; Strand=+; Position=1 -114,363-659
  Homolog annotation: Hit_ID=NP_494384.1; Match level="QueryCoverage =69%, HitCoverage=6%, E-value=3e-13, Identity=39%"; Hit description =patched family member (ptc-3) [Caenorhabditis elegans]
MVDDIPDQVSWTNLDPEHVVSQVTATFDLGTMRNFFMRSGIGKGYLERLCIDPLDPACPPTAPNHYGGTVLCDAIRHFEQRIVGVGQMTNRTIEDILAPYKSVDGTNNAGNKQKKQNTSPFDILQAFCEYCLRVYV

SEQ ID NO: 152527 - protein, 38 aa, Heterodera glycines
  Coding regions on vcDNA: vcDNA=SeqID_78950; Strand=-; Position=1 -90,165-191
MSEKRNGTSIWAEISQNLPFSGQKWKKIATDLTCKNLY

SEQ ID NO: 152528 - protein, 201 aa, Heterodera glycines
  Coding regions on vcDNA: vcDNA=SeqID_78951; Strand=+; Position=1 -147,625-754,987-1185,1232-1296
  Homolog annotation: Hit_ID=NP_495662.1; Match level="QueryCoverage =79%, HitCoverage=13%, E-value=2e-46, Identity=57%"; Hit description =patched family member (ptc-1) [Caenorhabditis elegans] emb|CAA86843.1| Hypothetical protein ZK675.1 [Caen
MTNINIGMTMAQHQNPLRTKVPPKTIRAEALQSVILVASPTEVFRRFKVISAWARAFTDSLYNHAFNRRDIEQSARVVHPLASTSISDMLAEFCDFNYAIILAGYLLMLLYALYSQCRFDGCCSLGVESAVGLALAGVFTVTMASIAGLGLATWLGINFNAATTQIVPFLALGILGINFNAATTQIVPFLALGIGIINFFL

SEQ ID NO: 152529 - protein, 126 aa, Heterodera glycines
  Coding regions on vcDNA: vcDNA=SeqID_78952; Strand=+; Position=1 -82,142-236,562-765
  Homolog annotation: Hit_ID=NP_494384.1; Match level="QueryCoverage =46%, HitCoverage=4%, E-value=4e-15, Identity=61%"; Hit description =patched family member (ptc-3) [Caenorhabditis elegans]
MFLLLHNYPQVVGNVARNELGFLMRETGMSILTTSFNNIFAFWAGTILPIPALRSFCGQRRKAGRRDLEFLCYYCLCVDDDDDDNVDAETAHKIRRSDVTGKKIGKLMGHHPDVSQSIRIQIEVVR

SEQ ID NO: 152530 - protein, 225 aa, Heterodera glycines
  Coding regions on vcDNA: vcDNA=SeqID_78953; Strand=+; Position=1 -3,179-445,959-1043,1111-1433
MLTHQFLSTGLHALFPSLNGTLPTANGADRAGLALLERDPLLCRASGGFRLFVRKFTDQQLLKCLRTPALNTLGQWAPPNLRYIHLLRSAWKKLTQFERFDWQELFEQYAKDGHDSTLGIVVDQNKQLLEASANKEDEQRLCQFQWLSTVDSEHLPCPLCSFGNQRRYAIGQLLVTKNGGMDMKHEICNTEICRHSFPKNGIYLLIKSFCFFVFLCQGFDSTHNN

SEQ ID NO: 152531 - protein, 60 aa, Heterodera glycines
  Coding regions on vcDNA: vcDNA=SeqID_78954; Strand=-; Position=1 -44,286-424
MVYGQMSYIPNFCILPKQWGGVEFGWTFRALQHALVVDGPIPMLHGTVPFQFHRRVPTGA

SEQ ID NO: 152532 - protein, 47 aa, Heterodera glycines
  Coding regions on vcDNA: vcDNA=SeqID_78955; Strand=-; Position=1 -46,166-263
IAEKIRDQFPNVDRLIAKTKAVFVKAPYRVKKFGNISHMQFQPINLK

SEQ ID NO: 152533 - protein, 28 aa, Heterodera glycines
  Coding regions on vcDNA: vcDNA=SeqID_78956; Strand=-; Position=1-104
LFNFFCFLRLVSSTIIDQFGRMCVKRKK

SEQ ID NO: 152534 - protein, 1065 aa, Heterodera glycines
  Coding regions on vcDNA: vcDNA=SeqID_78957; Strand=-; Position=1 -221,471-2474,2523-2641,3010-3864
  Homolog annotation: Hit_ID=AAK52058.1; Match level="QueryCoverage =43%, HitCoverage=43%, E-value=2e-88, Identity=36%"; Hit description =RNA-directed DNA polymerase [Drosophila melanogaster]
LPMLPNLNAISPHHAVVQTLINSTPVRCLMDTCASLTVAPRSVADELNCRTFSSDLEAMSASGHVIRLKEYAQADSQILVDASIESSPNPKNSFCIDRPDISLIKKGLSVINSVSPAGQKQIKVAVVNPTMEPKWIWKGTHLAFVNELLCDRNGLLRENSTKEILTLISERKEMEIDPTFVVDFSRAMVKDKDLEKLKALIEEFSDVFSKFRYDLGLFTAAEHHITTTTEEPIASAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDKVYQMITMPFGLKNATAAFSRAMAIVLSGLEDTSLAYVDDVLIFTKSPNFSEHLTAVRKVLERFRLYNLKLSPKKCIFASNEMNFLGFVLTAEGFKPSLSRIEILKEMPVPLNVKEVKIVLGQAGFYRRHIENFAMVVEPLLKLTRQGNKFEWGREQHNAFDKIKELLTQAPSLIFPDYDKAFHIFTDASSTGQGGVLMQKNDVTGTFSAISYCSRTLSAAERKWPAVQIEMSAIIYALREFRPFIFMSDIELHTDHKPLAFLLKKSETNQQLARWLIELQNYQVKIVHVAGKANTLADALSRAAEDKPLSEIYNVDELEDIIEFPVCLALAAHSRVVADPFLHTLTIRHEDGNTYEVNLLKEQAADPEAAAYISFVRDGEFPADLDEKEKELFADKGLPPRIYVPISLRGLIFESFHSSLLGGGHLNYRKTIAKEFCSMLYIDKKYACPHWSQGNASIERTFRTFHNILAKYISKTQPDFDEFLDAANFCYNTSVHASTGETPFFLMFGRDPIFCVDQIIDPKVRDPIAISDRNEFKQKLVVAIRHAWHAAADEYAKAQRKMKEQYDRKARPQQITIGDRVLIRNYDGRVGTSKKFQLPWRGIFRVIKIEGIYVTLISCTSPNSIPKRLHLNQIKKCFEILGPPCTTPMQPIEEQKCLENTPSVEEVSSERSEIRNEMDPESRKDENLDQIQARGPEKRPEIEAEAEKINKKTDMEPR

SEQ ID NO: 152535 - protein, 83 aa, Heterodera glycines
  Coding regions on vcDNA: vcDNA=SeqID_78958; Strand=+; Position=1 -56,116-232,784-862
MPRLFCRLAMNPTESQSKGTSQRHPPANSKSYWTTQRQIQEKCGNRLALTLRGMQRQKLEPEEIAEKLRTNLEYISCKFLWGN

SEQ ID NO: 152536 - protein, 46 aa, Heterodera glycines; identical to SEQ ID NO: 129896
  Coding regions on vcDNA: vcDNA=SeqID_78959; Strand=-; Position=1-236

SEQ ID NO: 152537 - protein, 233 aa, Heterodera glycines
  Coding regions on vcDNA: vcDNA=SeqID_78960; Strand=+; Position=1 -138,188-277,802-954,1180-1330,1560-1588,1622-1706
  Homolog annotation: Hit_ID=T30894; Match level="QueryCoverage=95%, HitCoverage=62%, E-value=1e-51, Identity=48%"; Hit description =lipase hommolog T08B1.4 - Caenorhabditis elegans
LATKYFFPIVNTNFLDFQVTFTGHSLGGALASLAAMRTVLEGMRRSDQIKLYTFSDQIKLYTFGQPRVGNVEFAFKHDELIPESFRVVFRMDIVAHMPPCAKNQHYEGVDENDSKPCDPSASNGIAYHHGTEIWYPYGMDPGDPYFECVGSPRDEDFHCSDSMSFEMSKYSIYISDHRHYFGHKVPAWGKLGCPEPTDEANSAEGEPTDEANSAEGGGIFQKLSQKFRSIGRI

SEQ ID NO: 152538 - protein, 159 aa, Heterodera glycines
  Coding regions on vcDNA: vcDNA=SeqID_78961; Strand=+; Position=1 -39,77-215,516-742,822-893
MFQFFIFSTLFCLVQLFGRAIKYLIMWLICFKEERFCHSMADNSVYKCVHCNDPKQEKICVNLRTLFETVSVSAKSETRLTLTTESDKTETLPPCIEFVQTETNAQLNHRSTIKAKTEANKVDGADGEHVQIAVIKETSKVDNNSAAANNDKQLPVAVV

SEQ ID NO: 152539 - protein, 275 aa, Heterodera glycines
  Coding regions on vcDNA: vcDNA=SeqID_78962; Strand=-; Position=1 -42,95-239,281-575,615-960
MPTVREILKSLQKRRTDAEQQIEGTSTRNNLDVASSDDEENCEPVQFKRGETILGALCLWYQGFRFIKNRKDGSWFRCEQRNCPATAKLEDNDLMTGILGAKGHHHGCAPSRYDAETKRNQMKRLIKEEPKTKPCQIRTDIDDEVFELLGSNEALDQMANRTKNKFVGGVNRADPLNIQIPPGLLIKNDESVLIYDSREVRTGQSDVVLIFSHSKASLPILMSFFKQNIQVSFINSKCFLFLQIRSVLSLALIPPVYVRHAFSIIVNAAPLGVQG

SEQ ID NO: 152540 - protein, 756 aa, Heterodera glycines
  Coding regions on vcDNA: vcDNA=SeqID_78963; Strand=+; Position=1-2269
  Homolog annotation: Hit_ID=NP_494149.1; Match level="QueryCoverage =93%, HitCoverage=47%, E-value=1e-105, Identity=33%"; Hit description= predicted CDS, putative protein of ancient origin (2C297) [Caenorhabditis elegans] gb|AAF39854.1| Hypoth
MSCSRPESIQQNEYVIETEQFSSQFSHMGMISNKKDTGKISRNQMTEEQRQIIMAKNAIAAKTYRKKVKNVDFLLLQASEQNTYNVELYELSEFKVKCKHCPAIHFSEEESKTSGANEFFDCCNYGKLCILEELIQEYPIELRILFQPELDKNNYTKIGEMHQDFLKNIRMLNSSFCCASLGCMKFKFPDKNIPIFKIQGGIYHSYNTFAQPDNNELPMNGQLYFIDTDQAMDYRINALNKKVVGDDKIIALIAYIESYLRQNYVYSQAYEMMKDVYENVLKEAKNDAIPELTMVFDVRKDVDLRRYNIPRSNEVCAIIWRDANDDIPAANVVVHTKGNKKLETIFPLSPLVEPMCYPIFYPNNYQGWNHTLKNSENKKISLCYFTKYKLFFRENGKFLPHHYSGKLFQQWIVDQAARVEWDRLNYIKQHQKEICKETYNAIDKFLFAKATEDGVHVKKKIILPSSFTGGPRNMYESFRSDIVARVFYLKITQFLKEIIDGQIFGRVSGFCYSIEFQKRGLPHLHMLLTLDGLNKWKETDDIDKFISAEIPDKCHDEILYELVTTLMTHGPCGQDFPNAVCWCQKKNKCNKKFPKNYREKTEINENGYPLYKRPNNGKTFLKKDWKTGKSMSMTNRDIVPYNRYLLKRFQAHINVEKVADIKAVKYIYKYIFKGYDAATVRCVTSGNENVKELVYDEAGSFLDARYLSPVEACWKIFKFPLQGKSHSVQRLPVHLENEQIIFFDENDEEETIIEKS

SEQ ID NO: 152541 - protein, 180 aa, Heterodera glycines
  Coding regions on vcDNA: vcDNA=SeqID_78964; Strand=-; Position=1 -235,537-844
  Homolog annotation: Hit_ID=H89251; Match level="QueryCoverage=96%, HitCoverage=34%, E-value=1e-14, Identity=29%"; Hit description =protein ZC455.6 [imported] - Caenorhabditis elegans
MSRLLDNAKSGAVFVSFGSFTNAQLMPSKMKMAFLNAMEQFSEVEFIWKFELTEEDTKVFAKYRNVHTMKWTDQKAILSGKFQILRNPSFRRNAQILKRKFQLTPFEPKDKLVRWVEFAAQFGELNELNLPWDDQLGLLAFYSVDVPLFAVSFVFFAWIAFKMTTLLVKCLLSKRKEKNT

SEQ ID NO: 152542 - protein, 61 aa, Heterodera glycines
  Coding regions on vcDNA: vcDNA=SeqID_78965; Strand=-; Position=1 -3,1229-1411
MLIITSHPMDFFSLLILKLAFLSLFGAFAEVPKKRLKSVGVFADFDMESHAIHGHNCGHFG

SEQ ID NO: 152543 - protein, 66 aa, Heterodera glycines
  Coding regions on vcDNA: vcDNA=SeqID_78966; Strand=+; Position=1 -13,72-258
MLLFSSLLLVLLSALLSLLCCVQLCRRSKSSTHCTDVHELMAIAAEAGGPVVSDGRGGHCGGNRIS

SEQ ID NO: 152544 - protein, 32 aa, Heterodera glycines
  Coding regions on vcDNA: vcDNA=SeqID_78967; Strand=+; Position=1-101
ILSVKSAFGILMSKSGTVNDILCFSCWIHGKK

SEQ ID NO: 152545 - protein, 48 aa, Heterodera glycines
  Coding regions on vcDNA: vcDNA=SeqID_78968; Strand=+; Position=1 -46,328-428
MTFYASLVGYTGRNNKILSVKSAFGIFMSKSVTVNDILCFSCWIHGKK

SEQ ID NO: 152546 - protein, 277 aa, Heterodera glycines
  Coding regions on vcDNA: vcDNA=SeqID_78969; Strand=+; Position=1 -316,484-1001
MEEFVGIYQFNSHPNLSGVPGLYPLKFPSHARISDWNKPNVNRGTLAMEIKKLSEFAREKEGTSRFSDAVPIKGFQWKIWAQIRTKKDSTEKWLGFILKCDASKEDENWNCICSATFRIVSQMRGTEDLIGKCNDHFFNIKIGICGFHGFITFEVSGKFGMPFKWFLLIKQLMDPSRGLYDKNEDKVTLTIDIAVEDQKSKKFDSDPNKPNGKIVMEIGKLSEFAREIFLSERSSEPVIIKGLPWKILTLINMKKDSTEKSLGFFLRCTAPREGWDN

SEQ ID NO: 152547 - protein, 121 aa, Heterodera glycines
  Coding regions on vcDNA: vcDNA=SeqID_78970; Strand=+; Position=1 -103,244-386,437-556
MQRFLWAVWASLNTAEGTTEKCLVFCLLCGAQTKDENGSCKVTATLRIVSKKGEAEDFTGKLNDQIFDNKLVIFSIGHITLTQLMDQNRGFYDKDEDKVTVTVEITVEEEKKGTKRKLPDE

SEQ ID NO: 152548 - protein, 97 aa, Heterodera glycines
  Coding regions on vcDNA: vcDNA=SeqID_78971; Strand=-; Position=1 -151,400-542
MRRRAQKREVISIRTTALGRERWHKRKLRRGKCDKGSFGLAKHFWNLAKIGRDLNIPCNLIKIAHLTEECPTPKCPPNRTLPIGTLRKYTLCINYTL

SEQ ID NO: 152549 - protein, 56 aa, Heterodera glycines
  Coding regions on vcDNA: vcDNA=SeqID_78972; Strand=-; Position=1 -127,573-616
MQNFFLYRYVKFGVDLTSRKKVKQDEVNVVLYIIKNEEIVRKIFFIDKNLTNKTLI

SEQ ID NO: 152550 - protein, 20 aa, Heterodera glycines
  Coding regions on vcDNA: vcDNA=SeqID_78973; Strand=+; Position=1 -4,571-629
MDGKPNLETEFYLKNNWIFS

SEQ ID NO: 152551 - protein, 86 aa, Heterodera glycines
  Coding regions on vcDNA: vcDNA=SeqID_78974; Strand=-; Position=1 -85,336-503,564-571
MGKISLKLFLVNFFAVIYVAVEAMYYCTHFVYESRQNLCPPTDPPLTYYASVHLCCKEDSEFGMALIYRTFATEPPTTFPQGCREN

SEQ ID NO: 152552 - protein, 27 aa, Heterodera glycines
  Coding regions on vcDNA: vcDNA=SeqID_78975; Strand=-; Position=1 -54,513-542
MALVETHEKHVVFFVVVKKNVFKISNI

SEQ ID NO: 152553 - protein, 127 aa, Heterodera glycines
  Coding regions on vcDNA: vcDNA=SeqID_78976; Strand=-; Position=1 -96,162-449
  Homolog annotation: Hit_ID=AAL27282.1; Match level="QueryCoverage =62%, HitCoverage=29%, E-value=3e-10, Identity=48%"; Hit description =spore wall protein 2 precursor [Encephalitozoon intestinalis]
MHSLLLLVNVTVYMIILLHFMPNENGLANAIPATLNGGDALLLRKKREDEDGAGEGEEGGGDDAEGAQEDAEGGEDEEKADEDGAEDEAKENEDGDDKEDKDEDGKDGEEGEECQIGDNWTGEHSTD

SEQ ID NO: 152554 - protein, 105 aa, Heterodera glycines
  Coding regions on vcDNA: vcDNA=SeqID_78977; Strand=-; Position=1 -85,492-722
IVIVKPKLNLFMFFVNLAAILIFLQFYLDLTEAGIECQPNGVCRDVSGSTPASTVCSKKCYSCTYKNCCNKVYTSQYAKCSIKGWRKKGYIGNVPVEIGATKKQT

SEQ ID NO: 152555 - protein, 156 aa, Heterodera glycines
  Coding regions on vcDNA: vcDNA=SeqID_78978; Strand=+; Position=1-471
MDKPRQRLAEANTTATDDAAHCSANCDERHDDHPLLLSFGEDEEEGTATSAAADNGRDNMNNHNGGEQVGGTAANGVGGNECGDSLGVSAGGSGGGGADDANFFLCSPLIYSEPALPSAFANGGAGAGGPTIGASWAYSEIALPQVLQFSLVWVMI

SEQ ID NO: 152556 - protein, 179 aa, Heterodera glycines
  Coding regions on vcDNA: vcDNA=SeqID_78979; Strand=-; Position=1 -156,237-348,506-568,617-673,722-873
MDSASDAIRQLQRAMREQQQMIFLLRSQIIDQRAVLLQNMTRIESTEGYLANSRGNQRFSPRYSPMAGVELSLLGRRLEERERRQQSRLEQLTPLSSRSGSNGTLQNRTNVSNVAGPSTASDGDDERENGPVLSAVIEGHMNRSRMRLIRDEMVHRAVQQQLEHQHHLLLQQAQQQQQR

SEQ ID NO: 152557 - protein, 448 aa, Heterodera glycines
  Coding regions on vcDNA: vcDNA=SeqID_78980; Strand=+; Position=1 -101,147-252,310-419,505-571,636-708,824-1298,1343-1569
  Homolog annotation: Hit_ID=CAE73387.1; Match level="QueryCoverage =95%, HitCoverage=95%, E-value=4e-64, Identity=36%"; Hit description =Hypothetical protein CBG20827 [Caenorhabditis briggsae]
IRLPSIPCQILFVFSAFMARLRCQFSPQSYPDPRIDPLSCRLLLPSQVIDPLSCRLLLPSQVCDPSEILTPDERRILNEKIVRLQQITANIKNTSPACADTTKLQQITANIKNTSPACADTTKSTNLFIMVALVDRLSNASDHSANIEKFTNQLRSKYQHFQDISLCDPLVLIVDISLCDPLVLIVNAHGDRQVFTVAGRDAKLSREVLQAAFQRNVGHFRGGNYALGLEGMAEYTVSAYGAAHIVQVPSSGRAEVSVGTTKTAKRLINCPSKHEERDEKQRKFNGPSTVSYGMGQFVAHGVRQQQRPTTEKKFHIESIPEEDRLWTRILAKAMAQCGGEEQEMVKYAQTVVEDAMDISLKLISDPHYNRIEEDAMDISLKLISDPHYNRIEEDSQSMENGLNAREKAWQSIKGHLEQIYAKYGGQIQMNAAEQCPGPKRGEKTLKIL

SEQ ID NO: 152558 - protein, 98 aa, Heterodera glycines
  Coding regions on vcDNA: vcDNA=SeqID_78981; Strand=-; Position=1 -64,173-405
MATGLLLKRRQLLQRLQVLFCAAAAAANSQQNSYSTKKDGQVIGPQLDALLSQQQTNEVNSAEPSNQQKQNATGNEEGGGTRKRNREEAGLEQDGSEN

SEQ ID NO: 152559 - protein, 162 aa, Heterodera glycines
  Coding regions on vcDNA: vcDNA=SeqID_78982; Strand=-; Position=1 -216,469-741
MALAQNAQITTEENCEKLHGKNGVGETATEEETMDECAFVTEPLIEAGQDLATSVQCTRDGSPLSSRSMDAVLLIKKALEEEDEAKDGKDDSGTEEEQIWGKGSQIDTDENGGKGGRSDIEQSQKRAKMGSESNGQIKEEDKSEKSASEGTLAEEKANANGR

SEQ ID NO: 152560 - protein, 146 aa, Heterodera glycines
  Coding regions on vcDNA: vcDNA=SeqID_78983; Strand=+; Position=1 -228,430-639
VVLFDQWHSSSELAEQQVDSLRNAVAKLETCDADAVARLSASVARFETGNFAKLKESGQRIIRPLSLERKRKIEVKVAAIERELGFNKSSIQHHSKNSLQIIDKEVLGVREWIEERDKDADLVGTLLKHGEKKHIDEIDALMARSK

SEQ ID NO: 152561 - protein, 455 aa, Heterodera glycines
  misc_feature (183)..(183): Xaa can be any naturally occurring amino acid
  Coding regions on vcDNA: vcDNA=SeqID_78984; Strand=-; Position=1-1401
  Homolog annotation: Hit_ID=XP_308624.1; Match level="QueryCoverage =98%, HitCoverage=57%, E-value=3e-58, Identity=31%"; Hit description =ENSANGP00000024486 [Anopheles gambiae]
TRPIPPEELRMRKLWWEGPNWLSQIPENWPDEQGHFTSSESVAPEPIVCAAVIPPPIVLFDRFGSWEKLIRTASFVVKFLSKLGKKRQLFTKIEGEGIFEYVNQKFIKNWLFKIIQRGMNPPTQYLDKNGVIRLNSRLSNIDDKDAHPIVIPTNSPVLSLLIRHSHIMLKHAGVDATLTDFLXKFWCKKARRTVRKVITECNTCKKDRAVKFGLPPMPPLPKSRTHPSLAFENVGIDFLGPTLYKAVNSGPNKAWILLITCLACRAVHLELVNSLSADHFLLAFRRFVARRGLPKGILSDNGSQFVLSKNVLQMHRILHKWTLIPAFSPWSGGVYERLNALIKNCFRRILGRRILNWEEIVTFLTEVEASLNSRPITFVSDEIDGPIPLRPIDFLSPKVNLSFEEPEISDQAEKLAARWWATAKSIRQFWKKWSQEYLLMLGQRNQTNHKGATDH

SEQ ID NO: 152562 - protein, 102 aa, Heterodera glycines
  Coding regions on vcDNA: vcDNA=SeqID_78985; Strand=-; Position=1 -52,95-172,260-346,413-504
  Homolog annotation: Hit_ID=AAP30758.1; Match level="QueryCoverage =95%, HitCoverage=57%, E-value=2e-37, Identity=81%"; Hit description =putative gland protein 25A01 [Heterodera glycines]
MSNFIFVAFLTAAFFSSGLALPAPYDAESVVSSELNVPLLSADANVQAAITIENVEIQIPSIPAPIEQQTAAHITHPTETGNEPSIGAQHIPFSIMNREFRN

SEQ ID NO: 152563 - protein, 194 aa, Heterodera glycines
  Coding regions on vcDNA: vcDNA=SeqID_78986; Strand=-; Position=1-585
  Homolog annotation: Hit_ID=XP_309989.1; Match level="QueryCoverage =74%, HitCoverage=53%, E-value=1e-23, Identity=36%"; Hit description =ENSANGP00000015194 [Anopheles gambiae] ref|XP_319667.1| ENSANGP00000022407 [Anopheles gambiae]
MDADQLKQILDAVLAKSEKRIQQMMNAQQNVGPSESLSHANLASSIDGRISKFHYDSESGNTFEQWFKRFGILIEEDGKDLPELAKVRLLLGKLSDEEYNKYRDSISPTQPDTVNWKESIDKLKGLFSETRSLFVRRYECFRIRQQPNQDVSTLIAHINASCENANMSLTKEQLKCMILVIALSDDQHDMRQKC

SEQ ID NO: 152564 - protein, 174 aa, Heterodera glycines
  Coding regions on vcDNA: vcDNA=SeqID_78987; Strand=+; Position=1 -240,338-622
MFLWRPSQNNQRYAFTPLLDNSEDENEDEVEEDELFTKSGGQRPAIFDAVQKRGAGEAKNEGEKATAEGANGAVGDDRLAEKVKKNLWRKFLSRNLEKTSEKVRNPKKFRSAAKLNYGLKIRGGWGFAKASQIHSSRQEDLKWIETNIPTSLAEALIDDEEEKEQRELEMSKML

SEQ ID NO: 152565 - protein, 111 aa, Heterodera glycines
  Coding regions on vcDNA: vcDNA=SeqID_78988; Strand=+; Position=1 -209,250-376
MFRVALFPLTCTLTQHVGCQGLIIDKMGYLRSKPWHFCGCSNTTKTAIKMVVLTNLATYEKENNFREYNYKSWCDTIRSIDWTHKSRLDAQTVLEPKKYLIIEIIEGYRQK

SEQ ID NO: 152566 - protein, 42 aa, Heterodera glycines
  Coding regions on vcDNA: vcDNA=SeqID_78989; Strand=-; Position=1-127
YEVSTPPTPIWCATNAMGAAQIAATMAPAFSCARNTVPTRGS

SEQ ID NO: 152567 - protein, 20 aa, Heterodera glycines
  Coding regions on vcDNA: vcDNA=SeqID_78990; Strand=-; Position=1 -22,96-136
MCFFVKKGQKFYTNVQKWKF

SEQ ID NO: 152568 - protein, 150 aa, Heterodera glycines
  Coding regions on vcDNA: vcDNA=SeqID_78991; Strand=+; Position=1 -233,635-725,857-985
GKLLAQKGRQNAAAAEIETIPARSCCCSTSAAAGGAKIQNSAEPKLPPPAAKLFELAHFEQEIRQIATKWNLNFSEKRGSYLFLPPKDTKAFKDGVLLSLTDRGDHIRMDEFHSARSQVDKIQRWPKERGHATVMRLASDQCAKMFANSS

SEQ ID NO: 152569 - protein, 204 aa, Heterodera glycines
  Coding regions on vcDNA: vcDNA=SeqID_78992; Strand=-; Position=1 -436,888-1066
MLMLNGRASFVSAFIFQQLVIFVVVGADPFFVVSTDDSSEQDDMAKALALSNRFFWRNMMAKWGCQYGIKIQPNQIRAKSVDELKRICESWKIKALAADAYVKSWECMVKKQQQQHVRNGGASSSTSSAPATISTAIIHDQMREEDVEFFRFDCLCVKPRFQVQLGELQLSSAMELVKAAYRILFGWSEAEGPIVGVRESPIKK

SEQ ID NO: 152570 - protein, 68 aa, Heterodera glycines
  Coding regions on vcDNA: vcDNA=SeqID_78993; Strand=-; Position=1 -40,87-253
MDLRTVAQIRKLKIIGILTSLKMSTIENRNHEPRNDRNRLSKIGNPNQHSVYSLLVYSLMNRDPIFRL

SEQ ID NO: 152571 - protein, 195 aa, Heterodera glycines
  Coding regions on vcDNA: vcDNA=SeqID_78994; Strand=+; Position=1 -234,876-1050,1273-1451
  Homolog annotation: Hit_ID=CAE67647.1; Match level="QueryCoverage =98%, HitCoverage=20%, E-value=2e-50, Identity=47%"; Hit description =Hypothetical protein CBG13206 [Caenorhabditis briggsae]
MGKYDTMGLKQLDKKLTECMNELKKYENVNKKALDQFMWVLFFIFSLRVNSQNVQFRRASTQKEELTKRVEELQNNEKVSFTGTQEVREISALSGGQKTLVALALIFAIQKCDPAPFYLFDEIDAALDQEHRRAVAEMIHELSEIAQFITTTFRAELLEHAEKFYGVRFRDKMSYIDDISQQQAQDFVQDDQTHS

SEQ ID NO: 152572 - protein, 125 aa, Heterodera glycines
  Coding regions on vcDNA: vcDNA=SeqID_78995; Strand=+; Position=1-378
MKGHKETLISEYSNQKYEAHLGIMHYMRKNWQCDKIADEFEEYERTECQNFRNYWDILYEYLSREYVGIPTMMPKFVFKMQIEIEGPITYALNCLARIWHFYFTLWSKIYEYKFNKLFNHWFEPK

SEQ ID NO: 152573 - protein, 88 aa, Heterodera glycines
  Coding regions on vcDNA: vcDNA=SeqID_78996; Strand=-; Position=1 -156,686-795
MKPKIVLPNELLFEAICFVPFHKKWSTIRVCVVFDHFLLKRMAQFLISYKNTDYFVPLIVSNLRQIFERLLVLRHLRMLAMCHYSTVL

SEQ ID NO: 152574 - protein, 19 aa, Heterodera glycines
  Coding regions on vcDNA: vcDNA=SeqID_78997; Strand=-; Position=1-56
SDTRHLCTCDEWFWWWCCG

SEQ ID NO: 152575 - protein, 55 aa, Heterodera glycines
  Coding regions on vcDNA: vcDNA=SeqID_78998; Strand=+; Position=1 -113,609-664
LPPPPALTGLLTVNKPKVLEKLLEGQVLGPESAVIENDLSTASSGPGPKHVQLST

SEQ ID NO: 152576 - protein, 213 aa, Heterodera glycines
  Coding regions on vcDNA: vcDNA=SeqID_78999; Strand=+; Position=1 -285,431-787
MIIINFSVILFVLISPILPSAFISICVRPNTLSYVGRLMCKSNNIMHEINKKTAEKEDAVTGRYSCISLWVDFRKCDQNETNAMIKITKTDTNETKIFEVQKTDLSFSDLPIVLPFGDQPSTDKTFNFKSKIPWINEGDTLGIKIGCDVGLEDYEHYAIGSAIYPEKINGQLASIHITVKLYGDMIKVVHLCGMFGDINNKIEIAIIQNGKWR

SEQ ID NO: 152577 - protein, 209 aa, Heterodera glycines
  Coding regions on vcDNA: vcDNA=SeqID_79000; Strand=-; Position=1 -119,424-622,669-896,942-1022
  Homolog annotation: Hit_ID=NP_445942.1; Match level="QueryCoverage =100%, HitCoverage=19%, E-value=1e-65, Identity=56%"; Hit description= exportin 1, CRM1 homolog [Rattus norvegicus] dbj|BAC65240.1| nuclear export factor CRM1 [Rattus norvegic
VVTLMNRSTGEAQKAASDILARFKESADSWTKVDTILEFSDLLETKYFGLQILEHLIQTRWKALPRDQCEGIKGYIVNMILDISADPEKSERMKLLLQKLNLVLVQIVKHEWPRLWPTFISDIVGSSRNGQSLCMNNMAILRLLSEEVFDFGTGLTSSRAIQLKQQFCGQFEEVYRLCYEILENSDNAQLVYATLYTLHGFLDWIPVGY

SEQ ID NO: 152578 - protein, 73 aa, Heterodera glycines
  Coding regions on vcDNA: vcDNA=SeqID_79001; Strand=-; Position=1 -77,567-711
MPFLQSKILREHYRTDPDPSPVVKQRALPPKCHLTVEFEKKDELLGPKEKKWKEKDERSKEKEAKRRERLGTI

SEQ ID NO: 152579 - protein, 279 aa, Heterodera glycines
  Coding regions on vcDNA: vcDNA=SeqID_79002; Strand=+; Position=1 -740,978-1077
MNLWMLILMFGPIHSVRIRKHWVKGQLNDEVNRKDFEHNVTDHSCANANHSADQIANFVLSDQSKNCGKDRNVFDQSQQSDEPNDRDEKANHSVDSLESDQCLSNKSKSERKCKFADHQKLRITNQYNHFISAYLRKGNHSKNEWGNFLKKLANVLGVKGRTIIKWKKQLGIDVEKKHTDEERMAKLEIYYKIKRQNPKMALMDVAEELGISMGTLINWKSEFKDIGQSVNQSEESIKQQRKSSKKGQASISPTKSFSSNDAFWAWKKSAKKRTVRIVL

SEQ ID NO: 152580 - protein, 163 aa, Heterodera glycines
  Coding regions on vcDNA: vcDNA=SeqID_79003; Strand=+; Position=1 -76,306-721
MAPLFIFLFVLLAVEKSIGPLSPNCKLPKTESQRKVSVNSAQQIVSDERKVSSSELEKVPGAFLEFSLPVEKHQNSLGQYLAELSNYYHSARLHVPPSTIARVLLRMKNEMNFHCIKTSATELPYPQPWKTFVSKKNRTIPTEWAETFASLSLTSAKFVVKVN

SEQ ID NO: 152581 - protein, 33 aa, Heterodera glycines
  Coding regions on vcDNA: vcDNA=SeqID_79004; Strand=+; Position=1-99
MTTNTTDSNWNSSFVLMKMDDNDQSERDCVEIK

SEQ ID NO: 152582 - protein, 53 aa, Heterodera glycines
  Coding regions on vcDNA: vcDNA=SeqID_79005; Strand=+; Position=1-162
GVSLCFSTLTLSAISIDRFRLIVTPLRQSIQKRCACRIVALNTAISLIISYDN

SEQ ID NO: 152583 - protein, 149 aa, Heterodera glycines
  Coding regions on vcDNA: vcDNA=SeqID_79006; Strand=-; Position=1 -163,209-385,463-572
GTTLKLRGLLTKQTSQNQDVSFVFTNESRIGFVEKKKPEKLALKLSDFTRRLCECNLRLSVSRKQAPINLSKKQDGTMVIDQENKAQLIFPNSVKLKIGQEIALKMTNVEVNEVGVVTLIVYDENTIEVHEEKTINSHLNNLEYPTIGK

SEQ ID NO: 152584 - protein, 167 aa, Heterodera glycines
  Coding regions on vcDNA: vcDNA=SeqID_79007; Strand=+; Position=1 -107,156-248,631-689,813-887,1150-1290
  Homolog annotation: Hit_ID=AAB38546.1; Match level="QueryCoverage =98%, HitCoverage=96%, E-value=6e-48, Identity=56%"; Hit description =globin gb|AAB38545.1| globin gb|AAA89171.1| globin gb|AAA89170.1| globin
MSTREEIQAVCVQSLKQLKIGVGEEELQNGKDFYKFFFTNYPTLRVYFFTNYPTLRVYFKGAEKYEAEDVQKSERFEKQGQRILVAMHLIANVYSNEMLFNAYVRETVNRHRQFKMEPSLWKFWTVWTGFLETKVDLTEQAKSAWMSLGEDFAKEALAHLKRLGIPH

SEQ ID NO: 152585 - protein, 97 aa, Heterodera glycines
  Coding regions on vcDNA: vcDNA=SeqID_79008; Strand=+; Position=1-294
MATNLTVTGTVIVDLISTGLINAGFKQFTFVCKLITALLITRLLLLARFRPAVLRVPELSRALRTFLCFHLAGAIVTMPYNAYVPIAYYTSLENEDV

SEQ ID NO: 152586 - protein, 17 aa, Heterodera glycines
  Coding regions on vcDNA: vcDNA=SeqID_79009; Strand=+; Position=1-52
VPVPVKKVGPGPDFSGP

SEQ ID NO: 152587 - protein, 26 aa, Heterodera glycines
  Coding regions on vcDNA: vcDNA=SeqID_79010; Strand=+; Position=1 -39,162-203
MLRASGTEPAFDNNKISRETSRKNAY

SEQ ID NO: 152588 - protein, 57 aa, Heterodera glycines
  Coding regions on vcDNA: vcDNA=SeqID_79011; Strand=-; Position=1 -108,422-487
MDSSSNTQSPAVALTDTNTAGAIAVEMVSDEYAAMPRCFNGSAGPSTVQKIWKNPSK

SEQ ID NO: 152589 - protein, 108 aa, Heterodera glycines
  Coding regions on vcDNA: vcDNA=SeqID_79012; Strand=-; Position=1 -115,196-404
MALLALYPFLHCAAFDSGETSAEMAEEMNRMSAGKAEFVSFEEVIALERPAAGDNGFGTSASVPPSLASTIHSGFIVLCFRLLDGQTDSNSQLENTWLSWTGANEIYK

SEQ ID NO: 152590 - protein, 140 aa, Heterodera glycines
  Coding regions on vcDNA: vcDNA=SeqID_79013; Strand=+; Position=1 -251,849-1020
MDGKVKNKREASKRQNKGEASKRHPTDDPNKPKDPFFGQTLKRHSFRVPNKTTHIPFIFFKLIFDSLFLSNFKLIKVTFTKYFLERDIPIGIYGIVCINLPVFAQYQRGVHPTLSGPFSVDSRPIAKRTPNCFRLVLCFE

SEQ ID NO: 152591 - protein, 116 aa, Heterodera glycines
  Coding regions on vcDNA: vcDNA=SeqID_79014; Strand=-; Position=1 -249,409-510
FYPDNGSDPFELCVYISEAGDNIYHSVPTSIDEIVKQVPSFPSLLIGLSFPWLLDYSKQRTKRKQFGVRFAIGRLSTENGPESLKECEYLRHEDEILEKLNHNLSYLVRERNNSEA

SEQ ID NO: 152592 - protein, 161 aa, Heterodera glycines
  Coding regions on vcDNA: vcDNA=SeqID_79015; Strand=-; Position=1 -373,419-531
MKGTISYPLVLLCLVFLALFAFSCNTTNDGKDKQKDKEKSKTNDERRMLVEQLMQIEAYLQFPAQQQWTVFNLARKYGIMDKEALINLVEEQWKNYKLEWDVERNNLIQQQLIQSFGPPKPAEEGMPISSALQQWQSQTGQQNSLNQLTPTTGKFVNFGVI

SEQ ID NO: 152593 - protein, 186 aa, Heterodera glycines
  Coding regions on vcDNA: vcDNA=SeqID_79016; Strand=+; Position=1 -216,263-304,569-613,887-1024,1082-1199
  Homolog annotation: Hit_ID=NP_499770.1; Match level="QueryCoverage =46%, HitCoverage=13%, E-value=4e-13, Identity=50%"; Hit description =exonuclease I (72.1 kD) (3O513) [Caenorhabditis elegans] emb|CAB07612.2| Hypothetical protein F45G2.3 [Ca
MDPGTGFCVIYEKHKLPNCVCPVLRRRFDFVTFRRICILAGCDYLQGGLQGVGLKTAEEVFTKASSHATLPSVLVRLQLYTNKRLKENLLDNEKKYHYAGEPKKSLVKRSADNESISTHCHDERKRTNKGEIDTIFTKRRRFSEIQIGSAAPRNGAYTNWTARDWMRIYGQLTQKEGEEEENSSSR

SEQ ID NO: 152594 - protein, 52 aa, Heterodera glycines
  Coding regions on vcDNA: vcDNA=SeqID_79017; Strand=+; Position=1 -153,550-555
MGQNGGQNDNGEAMPHNQQNTVEQFEALLRRVDKQYVWAKMANLTGIYELII

SEQ ID NO: 152595 - protein, 113 aa, Heterodera glycines
  Coding regions on vcDNA: vcDNA=SeqID_79018; Strand=+; Position=1 -38,87-147,193-310,368-491
  Homolog annotation: Hit_ID=NP_498474.1; Match level="QueryCoverage =100%, HitCoverage=60%, E-value=9e-28, Identity=56%"; Hit description= putative nuclear protein, with a coiled coil domain, of bilaterial origin (21.6 kD) (3H811) [Caenorhabdi
MPREENKDIEEERRAKTAYDLMRIRLKRLEKNIDKPVPIPTRREEPKPRPPPEFVRNVVGSSAAAGSAEFHIFRNNKRRELERLEYIEKMAVKDEKDKEFEERRKARRDEEEK

SEQ ID NO: 152596 - protein, 399 aa, Heterodera glycines
  Coding regions on vcDNA: vcDNA=SeqID_79019; Strand=+; Position=1-1197
  Homolog annotation: Hit_ID=XP_318162.1; Match level="QueryCoverage =87%, HitCoverage=43%, E-value=1e-101, Identity=49%"; Hit description= ENSANGP00000020700 [Anopheles gambiae]
MPAPNDIPSLRSFLGMVNHYQQYVKNMRFIRKPLDDLLKKEIDWSWSEGCENAFRKIKEILASDLLLTHYDPKMEIIVAADASELGIGAVIYHKFQDGNIKAIAHASKSLAPAEKNYSQIEKEGLALIFAVQKFHKMIYGRHFTLQTDHKPLVSIFGSKKGIRQCSANRLLRWSLILLAYDFTIEYINTKDFGQADALSRLIAKGNEPEDEKIIAMINAETDFETNFDNTISKLPLKFSDLIAASERDENIFQVQKFVKNGWPNEKAMDKENQIVRDLCRRKEELSTEKGCLMYGERVVIPKVFQSKILKLLHKGHPGMKRMKQLARQYVFWPKIDQDIEDFVHECVPCQAAAKAPIKTNLQSWPKTTGPWQRVHMDFAGPFFGKHFLIVVDSFSKYPE

SEQ ID NO: 152597 - protein, 108 aa, Heterodera glycines
  Coding regions on vcDNA: vcDNA=SeqID_79020; Strand=-; Position=1 -125,415-616
MMFNQTIKEVDNLDILNTEKDVFDSADQNDADDGQFPPVEECDDDDPDLFAVRAVPDIDDPPSPPDSDEISAGIRTAPIRQAGERRIKQLTIKYNNNKKKEKLLAFIY

SEQ ID NO: 152598 - protein, 209 aa, Heterodera glycines
  Coding regions on vcDNA: vcDNA=SeqID_79021; Strand=+; Position=1 -57,174-421,757-915,1020-1185
MASKVIDEETNEEKYVLKQVEQITALWAATALLRVLRHSTGECCPLPASTRHCRWCRRIKLAKCLRRHCTKHGKSMRKRGQTVQKHLEDSDNKKKKRMNIILEAFGNTEAVILFLHNPYRDYLLIEAREVQHDLEKIADGKVQCFFLTLKQAKERLTFPDDSDSAILDNKYVVAVALSRYTAYATSDEIVTARALRRSNAIVKKKNIFI

SEQ ID NO: 152599 - protein, 98 aa, Heterodera glycines
  Coding regions on vcDNA: vcDNA=SeqID_79022; Strand=+; Position=1-297
MLFLSSEGPLPPCDVLFTLHKGTLFALLDGTVSPLCAYLEGRVQIEGPVADAALLKHLAYAIGGVSATQPPQAAEEGMMGMEHAQEGEKGGGGQILDI

SEQ ID NO: 152600 - protein, 65 aa, Heterodera glycines
  Coding regions on vcDNA: vcDNA=SeqID_79023; Strand=+; Position=1-195
MLPITLPNRSTCRRLGAAVPSRNVINSCSLNARRPFAPNLSRHCANDSQLNSTDWSSQSEDRSAL

SEQ ID NO: 152601 - protein, 72 aa, Heterodera glycines
  Coding regions on vcDNA: vcDNA=SeqID_79024; Strand=+; Position=1 -321,491-623,1257-1319
FLSKKFFFGFFGAVPLNRCAQIYGETESFGNSFPIACTLILRWIFAPHNCLSTPNGHLKNRFFCFRCSPPEP

SEQ ID NO: 152602 - protein, 2445 aa, Heterodera glycines
  Coding regions on vcDNA: vcDNA=SeqID_79025; Strand=+; Position=1-7338
  Homolog annotation: Hit_ID=XP_315603.1; Match level="QueryCoverage =31%, HitCoverage=100%, E-value=8e-95, Identity=33%"; Hit description= ENSANGP00000017599 [Anopheles gambiae]
MKADEQLKSVVNEAKSIFKAAGMIIREFYGTDIEGLKQLPAEDLAKELEETKVLGIAWKPKHNRIAFKLPIFEGTITKRTILSHIAKVYDPLGLMSPALLSAKLFLQEVQNANSKWDETLSSHLVKTWLKIVETWSHSGTPINVEFPRFIPSTTKDEFHCFCDASNYGLGIAIYQKADTTYAKSECNLIFAKSLVKPLKLVAHDSTIPKLELQALTLGVKAVNFIQQQLNFDDKQVILWTDSQCSVERLKDGRKSDRFVTNRLNKIRAANFQVRHVRTDSNPADLASRGIDPRSIQASLLWRFGPIWLSKSDQWPESNVIYQPGEEIKAYEEVPIVEISCAVQEKQKFKPTIQFERFSNWNRLRATAAYANRFILRLLRAKRRNKQLPQNIQINGPLKAHELQLAEEWILTETQSTYPPTEDQIRDLRLFKVGRLWRCGGRLDNAESLSFDNKHPIFLPPDGWITKLIIRHYDQQHKHCGPRILLSQIREKFWIPRGRKTIQQVLNSPRHGCLKCRKERAKPYSYPEAPDLPAQRVNQARPFNSTGIDYFGPLKVKRGAEVVKIYVALFTCLVIRAIHLEIAEDYSAEAFIRTFRRFVSRRGTPTLIMTDQGSNFVAGSKIIKEHWTDTLLPEHVQTRLAHQGITWKFNTAHAPWKGGTWERLVGITKNSLRRTIGRNLLGFDEMQTLICEIEAIVNNRPLTFESDQEPYQSLRPINFLIPYEQIVINFPLLDENFNDPDFEPRTSNRNQLVTMLRKTSTLLDRFWHTWKTDYLFSLRETDRSNATNRFLHPKEGDVVIVGDDDQPRSLWSLARVIQLHKGRDNQIRSALLSINGQHRSRAINQLYCLEIPDSSETEAPAHTEVIAPIMASESIEVISLASSDDQMSDDYHIPKKKNVIKRKQRFITGHNVGLREVEQRPTDNDPVEGLLYSKRPDNKTKFFKDGNLKMLLESITLFKRIEGKKMAEKLLELYGKVPMIEWDKRLAKYEAKLRKMDEARDKKDKERENQRREKRKLDEEEEPEKRKKISVETDPLEETDPKKERQLQDENRIRWSAQRKAAVDELRQRIKLRKKQWSREEIEKEMKESEKEDQTQLRELAKNGSKEATQLLETAPSLRQQSNVQVTATIQRKAEDYPQNGEKVLKFCQRMYQDNLMSAWRRNRVQKELTQLLEDGRFKLRHVNGQQAILHRITEGKKDLCGEFLIGRICSWHYLDEIEFEDTKEPPPAQRDSTPEITVVETKNDQDRQQDEPQFVTIRAGRTPPPLFIPQRSKSPSPQFIVHRAAHTPPPAHRDSTQTQLVEEYHLAKSKPNTFVDFNIFTECDETHLTCAKNATYGQIADKHNREKIEEFVNCRARTLFEAIMLHWLNCNINRPNNEVWAMHELHTQQFDTLEESAKFFHQQQIVMRKRDIGKDKHFKEAIEIWRNSCDLFNENFQHVNKQLKFSPTHSPEMQKTDYAKWIERINQRTNEISSKERSRMQFPDFIYFNVRTILIGDNTAEALQSHFPKSRWYTHFADQPLRLTLGPQVKHAIFAYQSTDEDMIRQITPLLYQHKNTDIETTLILRKDNNNDWLYNKKEFIGLTKRLEAGFFVFNARIGEAKELADRMKETMEESMQLNTEPTTSNLAGNKKPYRKGFTVGQRMLNSLMLFSLFMLIALQGASAQPIRQKRFGGVGVWHGSHAISQLWGNNATRERFSTFSPSVQRYISRVFALNATATLPTVPTSSTAHTTPISTTPPPFTTTKPPAITIKPPISTTTRQWKTTKLRTTQTLPPTSTETPITRTNRPKIQPPLFFAQRQSQWKGDPINAKGMDIFWCTDRGSTICELKGPENSPFCRPPPVLTAKWTALTITLYTKIHRPETVQSGWNCAVRRISEVYYTNLIGDKFVDVNKTFLPVSKTMCRQMALHQICPMAKTEMTQTSKNTWTTNDELSVNFPGPIEGLFKGSQTSETTNCFVQPATLFVKRHNLQLLSPVHHVEHCDYSSGFCQLPDNTTIMWKPDCPAEGCYTCDFEKAEQIRGEFTKTRGQTSAIWISEDRQKALTFTDSTAIMACDGKSIVLSEQNFGIRKEQYDALMDNDHSRTKRFVEPEQLASQLSAAQIATNMALSQLYMKECQRNFRVANPTLQARKLLNRENLQARWIGETTIEVFPCVNITLTDISYRATKSCYKFIPVTVHLPNATMDAFLDPEMRILSLVTHIASCTHFRYHHLQLKKNPSIWLRIDVNFGIAKRLPQSAVHELYESIQNQTNNDFELNPLIFHQWQLSNDTDNAIFPHIDEFADLTDFKSKLEQHQTARAEALGAIPGGLEGWTIRKVKEWLNELINWWMRLACAYATFLLLRDVILPCIFAYLINPVRVTFMSLVGFRPRRQPLPQRRCFDEVVPMRQLPRAPKRPSIRLRADRPSSPIALDFDSRSATYRSRASSLTIDTPFGKSQPFKLADDD

SEQ ID NO: 152603 - protein, 1238 aa, Heterodera glycines
  Coding regions on vcDNA: vcDNA=SeqID_79026; Strand=+; Position=1-3717
  Homolog annotation: Hit_ID=NP_504187.1; Match level="QueryCoverage =45%, HitCoverage=41%, E-value=9e-68, Identity=35%"; Hit description =predicted CDS, integrase, catalytic domain containing protein family member (5E782) [Caenorhabditis elega
MASPIQQKLGAALKVISHVRTAAALTIATDPTASNFENALNFEAQLEKVQKEAKTLEIFLDDIRESLSSWTDLLRKLPATERETGETEFNAYNKKEKITDKVDDASSKLRDLRDLNGTLSIHAKLFRNKYDMEERATQAAQAQAAPATQGRTIPPSRPSSFFQIQPVQLERFSGSKRQWPEFYESFKSATGSHSLSKAEKFNILRNLLTGEARELVAGFRLEDANYDVVLQLLKDTYGAHDEHIRSLHFELANLRTCKTLRDTKEFLLQLERLTRELLNAGADIEGPPTYLMLEKKLTPPFLRTILNKKGEDPDHWNTSKFRNILNEAVRKETQIQEVMTEYGHHQQQRPTKPFIAGPRFRDRAPFNQFRERSFIASAVDENQRRFSNKQLAPKIAHNGPKPTQFAQRTQHNPAKPNQFNRPSQPQTSGNSQSNANPPRPCVFCNGNHWNSDCRKFSTIQQRVEIVKSKGLCFKCLFAHRTFDCPKPRKCFKCGQLHPTALCRNINAQNQIAAATIMPHLSIPSPQPIENAAIQTQPMCNAVNATDTRALLMTTTATIFNPAQPHLSMIASIFIDPGSHRSFVSNHTAQRLDLPIVNTEECLLTSFGERMPKKYISDMVKLGFLCINGERLIFNLNALQFLVNEMPMIQLSELDRDQLKQRKLTPPHEMKQPDILLGIDVWHELQVQFIERLPSGFTLCRSKMGKILSGTGRMEMGQASNVTFVLAVQDNQMAQASTTQSIEIEDNIFTSEDDLKRDDQLNSFFGLHLIGMDDSSTPIDRDEVMVNFKKNLTFINNRYQIALPWNDKVGTLPTNYHQAKARLIGLINKLRSLNLINEYQAILDDQLQKSVIELVEMPDQSIGPVHYLPHRAVIRADKATTKLRIVMDASAKPKSNPSAPSLNECLYTGPLLLKDLTGILLRFRRMERVLLADIEKAFLQLGVREQDRDTTRFLWLSNPKEAELNPLKREDILVFRYSRVSFGLTVSPFLLNATIREHLSLFDNDLAKRIDENLYVDNILIEMKADEQLKSVVNEAKSIFKAAGMIIREFYGTDIEGLKQLPAEDLAKELEETKVLGIAWKPKHNRIAFKLPIFEGTITKRTILSHIAKVYDPLGLMSPALLSAKLFLQEVQNANSKWDEPLSSHLVKTWLKIVETWSHSGTPINVEFPRFIPSTTKDEFHCFCDASNYGLGIAIYQKADTTYAKSECNLIFAKSLVKPLKLVAHDSTIPKLELQALTL

SEQ ID NO: 152604 - protein, 168 aa, Heterodera glycines
  Coding regions on vcDNA: vcDNA=SeqID_79027; Strand=-; Position=1-507
  Homolog annotation: Hit_ID=CAD32253.1; Match level="QueryCoverage =88%, HitCoverage=8%, E-value=5e-18, Identity=31%"; Hit description =gag-pol polyprotein precursor; hypothetical protein [Drosophila melanogaster]
NDLAKRIDENLYVDNILIEMKADEQLKSVVNEAKSIFKAAGMIIREFYGTDIEGLKQLPAEDLAKELEETKVLGIAWKPKHNRIAFKLPIFEGTITKRTILSHIAKVYDPLGLMSPALLSAKLFLQEVQNANSKWDETLSSHLVKTWLKIVETWSHSGTPINVEFPRF

SEQ ID NO: 152605 - protein, 31 aa, Heterodera glycines
  Coding regions on vcDNA: vcDNA=SeqID_79028; Strand=+; Position=1-93
FEHASPKFVCGVGVGEWSIGKMCPNSKANKN

SEQ ID NO: 152606 - protein, 64 aa, Heterodera glycines; identical to SEQ ID NO: 129150
  Coding regions on vcDNA: vcDNA=SeqID_79029; Strand=-; Position=1-831

SEQ ID NO: 152607 - protein, 217 aa, Heterodera glycines
  Coding regions on vcDNA: vcDNA=SeqID_79030; Strand=-; Position=1-653
  Homolog annotation: Hit_ID=CAA82797.1; Match level="QueryCoverage =93%, HitCoverage=30%, E-value=3e-11, Identity=23%"; Hit description =gag protein [Ascaris lumbricoides]
NHWNSDCRKFSTIQQRVEIVKSKGLCFKCLFAHRTFDCPKPRKCFKCGQLHPTALCRNINAQNQIAAATIMPHLSIPSPQPIENAAIQTQPMCNAVNATDTRALLMTTTATIFNPAQPHLSMIASIFIDPGSHRSFVSNHTAQRLDLPIVNTEECLLTSFGERMPKKYISDMVKLGFLCINGERLIFNLNALQFLVNEMPMIQLSELDRDQLKQRKL

SEQ ID NO: 152608 - protein, 212 aa, Heterodera glycines
  Coding regions on vcDNA: vcDNA=SeqID_79031; Strand=-; Position=1-638
  Homolog annotation: Hit_ID=NP_504187.1; Match level="QueryCoverage =89%, HitCoverage=15%, E-value=9e-26, Identity=39%"; Hit description =predicted CDS, integrase, catalytic domain containing protein family member (5E782) [Caenorhabditis elega
KEAELNPLKREDILVFRYSRVSFGLTVSPFLLNATIREHLSLFDNDLAKRIDENLYVDNILIEMKADEQLKSVVNEAKSIFKAAGMIIREFYGTDIEGLKQLPAEDLAKELEETKVLGIAWKPKHNRIAFKLPIFEGTITKRTILSHIAKVYDPLGLMSPALLSAKLFLQEVQNANSKWDEPLSSHLVKTWLKIVETWSHSGTPINVEFPRF

SEQ ID NO: 152609 - protein, 68 aa, Heterodera glycines
  Coding regions on vcDNA: vcDNA=SeqID_79032; Strand=-; Position=1 -116,604-694
MAAASGCTAAASAAGSSGRGNDCADNDGDDAEEKPVKSWLIFFPFIATIFKFCGEGKNGEVGEGHLGD

SEQ ID NO: 152610 - protein, 54 aa, Heterodera glycines
  Coding regions on vcDNA: vcDNA=SeqID_79033; Strand=-; Position=1 -141,396-419
MPEKAAPIEPPPPSPQLACAAHATVPEASFAAAFDAVAAVASQIVGIKSISEKT

SEQ ID NO: 152611 - protein, 62 aa, Heterodera glycines
  Coding regions on vcDNA: vcDNA=SeqID_79034; Strand=-; Position=1 -135,814-867
MEVAKSKQFGVLPPPTPPMALPTEPGVCTAPPVAPDDATLLTGVVKKQKNTPPAERGDLALI

SEQ ID NO: 152612 - protein, 119 aa, Heterodera glycines
  Coding regions on vcDNA: vcDNA=SeqID_79035; Strand=+; Position=1-360
MSRSPPADSSPSSRSTPTSGGGTMPLPSFTPAAVINDHHYPATANSTTAFGNHTAGTGGSVVQTSSIASSPEQPGATTAATTPTTVNAVPSIVFKDLRAFQLNSLELRDVETVKAAFSL

SEQ ID NO: 152613 - protein, 27 aa, Heterodera glycines
  Coding regions on vcDNA: vcDNA=SeqID_79036; Strand=+; Position=1-82
MEEELRKSAANNMAGPCKNIAELMLLL

SEQ ID NO: 152614 - protein, 83 aa, Heterodera glycines
  Coding regions on vcDNA: vcDNA=SeqID_79037; Strand=+; Position=1 -136,209-324
MKNEEEKKKHELKHNSAETKTKQKTKMEKNRKEIEKMGAKLNNLQRHAIQLKILEFLLTSDELFRINHRFDERVTKRNTLQHS

SEQ ID NO: 152615 - protein, 196 aa, Heterodera glycines
  Coding regions on vcDNA: vcDNA=SeqID_79038; Strand=-; Position=1 -64,109-270,318-513,562-730
  Homolog annotation: Hit_ID=NP_001004509.1; Match level="QueryCoverage= 86%, HitCoverage=11%, E-value=5e-13, Identity=30%"; Hit description =si:busm1-180o5.3 [Danio rerio] emb|CAD60788.1| novel protein similar to DNA polymerases [Danio rerio]
MYPRGLIDPEYKCKHFEDSERGFSTTVTHIELEAALRSGYKVMHVCRAYIWRLVCDWSNGLFHSYLLKFLKMKFEASGYPAKCTEAGISEEESARRKQEHIDKAKEKAQVHLEADRIKHNPGLRYLSKLCLNSLWGRFALRNRLTKTEIVECHAELAKLLNDSKIEVSSIDKLTEKFWMVCYKAKDEHWWNTARAT

SEQ ID NO: 152616 - protein, 507 aa, Heterodera glycines
  Coding regions on vcDNA: vcDNA=SeqID_79039; Strand=-; Position=1 -141,382-573,618-1023,1079-1220,1262-1364,1418-1580,1654-2030
  Homolog annotation: Hit_ID=NP_507780.1; Match level="QueryCoverage =87%, HitCoverage=30%, E-value=3e-24, Identity=26%"; Hit description =predicted CDS, DNA polymerase type B, organellar and viral family member (5T899) [Caenorhabditis elegans]
MPFHQQTQHTAKCKWKCHNCLRVGSAFRGNCVQGNDNFFETCLGCNKDQDKKKGHVCGQKFCKICLGFHDPRDCYIPYRPKVKKEKRFVFFDFECTTDFKPDPQLMRFKHQVNFCFAHVTCTRCIEKGVWDQELEKACALCGRFRTYAWSPFEFWHTDVECRKVVEDPLAAFTKWLLNFETEVLGMEPGAKKRRKRKNIDNTDGEAMEADEEEDAVDEDAENNWMLGYEEAGEKPESVTTYAYAHAGSRYDHVLIYGEMLRMGVRPELIRQGNHLLEMKARKTGVYTPTVFRDSYKLIPIKLANFVKTFGLEIEGVENKKYFPHKFNKAENYGTVLDTLPPIENYYPGGLFPAERAKFEQWYDENRETGFELSEVIADYCKTDVQILAHGMVKMRQLFLSETRHDITDSVTIPSGCMKYWVQLAHHYKESVAIIPHLGYEKRGKQSTIARKYLKVPKNDYKFTFCHFSVACRRRVAREWPSPAPCRKALEGSSKSATTALDGDDGAP

SEQ ID NO: 152617 - protein, 97 aa, Heterodera glycines
  Coding regions on vcDNA: vcDNA=SeqID_79040; Strand=-; Position=1 -124,326-451,1255-1299
RSGSERKAKRTTSEQTPPQTQPSPAEEVEPKAQQRIAAAGAKALLVGRKLDDKIRSSSNSMDKKSENGAMEQTLEFRPQHNSSEIPPVVFQMESLET

SEQ ID NO: 152618 - protein, 116 aa, Heterodera glycines
  misc_feature (8)..(8): Xaa can be any naturally occurring amino acid
  Coding regions on vcDNA: vcDNA=SeqID_79041; Strand=-; Position=1 -98,191-317,737-777,848-928
  Homolog annotation: Hit_ID=NP_502959.1; Match level="QueryCoverage =96%, HitCoverage=57%, E-value=7e-35, Identity=68%"; Hit description =small GTP-binding protein RHO RHO-1, small GTP-binding protein RHO, guanine nucleotide regulatory protein
SSHPLTFXISLPISNENYCNKFTNCTKHYFGNVPIILVGNKKDLRNDQQTIRDLSRNKQEPVKSEQGKAIAEQIGAYAYLECSAKTKEGGIREVFEKATQAALQQKKKKKKGCNVL

SEQ ID NO: 152619 - protein, 30 aa, Heterodera glycines
  Coding regions on vcDNA: vcDNA=SeqID_79042; Strand=+; Position=1 -77,169-184
MAKNGGKGEEKQPNDKLIAQKHILELISIN

SEQ ID NO: 152620 - protein, 72 aa, Heterodera glycines
  Coding regions on vcDNA: vcDNA=SeqID_79043; Strand=-; Position=1 -124,591-685
MRLSQVGTKPKTEFGLEIRSVFHIVPCHKVGRRIVFGEIGLTLIIMDEIIIKLLIMKNGKNAETMAKRMAKN

SEQ ID NO: 152621 - protein, 104 aa, Heterodera glycines
  Coding regions on vcDNA: vcDNA=SeqID_79044; Strand=+; Position=1-315
MRKKYATKKVIRADIMPKMIGEPLKFMHFDQRRRPNRLKRLQKSPLPMESKSVPPPAPRAPTSHWRRCRTNALSTAEGNVEKLRESMANVSSKSVAQNGRQKAF

SEQ ID NO: 152622 - protein, 120 aa, Heterodera glycines
  Coding regions on vcDNA: vcDNA=SeqID_79045; Strand=-; Position=1 -205,942-1058,1450-1490
MCRPSFPSMFAFLLLVAAAIALIILPSASCAPLDNAQGVVPDAAPGIGSASAVGIAPRHRRQWLSAARVSMPLNTAFFFVPSYETATVSALVMTRDSVSALRVVVASEFVVKVDKKLIAI

SEQ ID NO: 152623 - protein, 84 aa, Heterodera glycines
  misc_feature (82)..(82): Xaa can be any naturally occurring amino acid
  Coding regions on vcDNA: vcDNA=SeqID_79046; Strand=-; Position=1 -51,151-196,280-435
QSFECLFHILFFINLCYFPITFSSGSLFDPLRQQHFDAVFFFGRRPLSIKFTSEWNLFSHWRCFSRTCHPVNVPQTFWGLVXLP

SEQ ID NO: 152624 - protein, 75 aa, Heterodera glycines
  Coding regions on vcDNA: vcDNA=SeqID_79047; Strand=+; Position=1-228
MPTALAEPMPGAASGTTPWALSRGAQEAEGKMIRAMAAATSSRKANIEGNEGRHILLIGRRDILLWIFDAKILIK

SEQ ID NO: 152625 - protein, 58 aa, Heterodera glycines
  Coding regions on vcDNA: vcDNA=SeqID_79048; Strand=-; Position=1-179
RLAISDQIAPFATMGIALVHAFVRLATGTVLVTTRGNGTVIVNQNWTVRDGKGKKLEE

SEQ ID NO: 152626 - protein, 132 aa, Heterodera glycines
  Coding regions on vcDNA: vcDNA=SeqID_79049; Strand=-; Position=1 -219,545-724
  Homolog annotation: Hit_ID=NP_586209.1; Match level="QueryCoverage =97%, HitCoverage=84%, E-value=2e-24, Identity=44%"; Hit description =UBIQUITIN-CONJUGATING ENZYME E2 SUBUNIT [Encephalitozoon cuniculi] emb|CAD25813.1| UBIQUITIN-CONJUGATING
MEKNPLPEGCTARPLDQRTMTTWTVTIRGRAGTPYENGNFQLSMSFPRDYPFKAPQVTFTTRIFHPNIDTRGKKSLICFSVFTVVISIIVLLNDPNPDNSPLNAEAANLYRNDRAEFNRRAREMTLAYARMR

SEQ ID NO: 152627 - protein, 57 aa, Heterodera glycines
  Coding regions on vcDNA: vcDNA=SeqID_79050; Strand=-; Position=1-175
GSMVPFSLRLLHAEASSFSPLPYSSMVRVHKLIENTVKAIEIARRNFAATDSELGIW

SEQ ID NO: 152628 - protein, 483 aa, Heterodera glycines
  Coding regions on vcDNA: vcDNA=SeqID_79051; Strand=-; Position=1-1452
  Homolog annotation: Hit_ID=S08405; Match level="QueryCoverage=99%, HitCoverage=40%, E-value=1e-108, Identity=43%"; Hit description =hypothetical protein 2 - silkworm transposon mag
MDEILQGIEGVAVYLDDILITAPTQAEHLCRITQVLERLKANGLRVKRDKCEFMRESIEYLGHRVDKNGVHASEEKLEAIRKMPPPQNLKELQSFLGMVNYYGKFVPAMATVSEPLNQLRRMEEKWHWGSEQQKAFQRIKEILSSTEVLVHYDPSQPLYLATDASDYGVGAVLFHKSQQNGKEGVIAYASRTLNAAERNYSQIEKEGRGIIFGVEKFKQFLYGRKFVLQTDHEPLKKIFGPKSEIPVVAARRLHRWSLILMNFDFDIEYCPTKEFGNADGLSRLPCPEIAKIDLDSAEVRAVQLENIDSLPVTAKSIASETAKDQILKKVKELIERGWPKKVESDQLKPFEPNKNSLELVNGCIMLGNRTVIPRKFHGKMLELLHATHSGIVRMKALARQKIWWPGIDKDIEMERKRCKNCQSDAPEERKVPLHPWETPDRVWQRLHMDFCGPFMGHMWLIIVDAKSKWPEVIKMKNITANAT

SEQ ID NO: 152629 - protein, 123 aa, Heterodera glycines
  Coding regions on vcDNA: vcDNA=SeqID_79052; Strand=-; Position=1 -42,157-212,254-342,434-618
MDEAINELAYNYIKGQEQDKDLLGFPIFWSYFKNFCIFLCFCSRDEYLCSNWKLFGLTFPQTDTCCFGLHHGDYCIHWLSFYGYPTFEDLTFEDPTFEDPTFEDPTFEDLTFEDPTFADIPDI

SEQ ID NO: 152630 - protein, 103 aa, Heterodera glycines
  Coding regions on vcDNA: vcDNA=SeqID_79053; Strand=+; Position=1 -167,460-604
MGEQKFHFLKMLFAFGALLSAEIEQQSSIRERSFPRIFLKAYECVADKKFVGNEKNFLPFAIVSKMEGQTEQLNIEKVLLVIQNEEDLTDRSLQIGCKFLKCL

SEQ ID NO: 152631 - protein, 176 aa, Heterodera glycines
  Coding regions on vcDNA: vcDNA=SeqID_79054; Strand=-; Position=1 -105,239-424,861-928,1018-1189
MPECLMIQFPCTNRLTSDAIVPTSAADANADHGIAGTFDAISLTENRQKFMENYCLNIGKMFFVQKGVRNFLNILSLYFRSISAAALFPYHFLQFYDPSPIFYLGISSTTFLSQRAGDQTDELIAHFVKMPSEEASGEGTFQFVSPLPNAPEAFKFGGSIGTTTNGAVFRWIRNDQ

SEQ ID NO: 152632 - protein, 319 aa, Heterodera glycines
  Coding regions on vcDNA: vcDNA=SeqID_79055; Strand=+; Position=1 -76,302-960,1006-1143,1211-1297
MAPLFILLFVLLAVEESVGPLSPNCTLPKKSESQRKVSVISAQQIVSDEQNVSSSEVDKVPGDFLEFSLPIEKHQNSLGQYLAELSNYYHSAQLHVPPSTIARVLLRMQNEMNFHRLKTSATQLPYPLTLENFRSEKEADSNGMGGDIRITFIDQCQICSQNELTMSKLITMSPQQISVPKISILFLKIISKEMRLNSDQSDIAWFLGSVIHLLAFQTYPLEEWHIRDKILANQCQLGGTFKMPQTSESFCMFLLQNSVNKMLFSAEKLQIRTDFPRGFEKQYAILGQIMRNALHVDSEKRTFDGNGQLLKLAANLISH

SEQ ID NO: 152633 - protein, 110 aa, Heterodera glycines
  Coding regions on vcDNA: vcDNA=SeqID_79056; Strand=-; Position=1 -3,346-462,1340-1552
MRSRGFISLVGLDYSTNAIELAKKQASSCNDHQSMPIEFGGTFDAISLTENRQKFMENYCLNIGKMFFVQKGVRNFLNILSLYFRSISAAALFPYHFLQFYDVNSFFINI

SEQ ID NO: 152634 - protein, 78 aa, Heterodera glycines
  Coding regions on vcDNA: vcDNA=SeqID_79057; Strand=+; Position=1-237
MINFAIFLIYPFIRLNLFAQVLACTSELRPRKCRCTAVWDAMRAVMHTMTMANSWAAVHCWMARADGLDVIKANYGHN

SEQ ID NO: 152635 - protein, 126 aa, Heterodera glycines
  Coding regions on vcDNA: vcDNA=SeqID_79058; Strand=-; Position=1 -147,652-745,779-918
MDKRNDVENIKIIHFSEGKRIGKNFYIWQCSCCGQHFPYVACRICHEVKKKLSEDECKILAKKKDLPVRSYQMRPNAKEQEKFMDSPDWISDIQTPVSSLECRYWSNGPDPEWHFRVGNPPMIWVF

SEQ ID NO: 152636 - protein, 164 aa, Heterodera glycines
  Coding regions on vcDNA: vcDNA=SeqID_79059; Strand=-; Position=1 -212,274-556
MSLFRNRNLIFLMAPPAEKKKKHSSAYHRQISSPAIGEHEQQSMGSLITSLGKRRSVRVTNKMNKRILKKIWICTDVWMDILPFFGRPELGLKLALLSPRFNVLVNKHFDGKSELAILRRIEIRKGGGLKPKLSVFISYDKSMRFPLPDRPLPNKIRFNRLLIS

SEQ ID NO: 152637 - protein, 302 aa, Heterodera glycines
  Coding regions on vcDNA: vcDNA=SeqID_79060; Strand=-; Position=1 -124,175-615,669-997,1455-1469
MGKRKLLPKIHGKKGVKEREKKREERKAQTAKAIQARLAKKTASQSNPNAEMPQQDEAGPSTSAASAEEAMEPPPSTPGPVPTPEMDEEILEFGFSLPSTSVTPIGDLVPFSTTPTAPMDTGETTPPPLAIDERSERIEQLEKQLKDRDDTIKFLREQVRNREALISDLRRQLDEHMAPPMAPPTTSKTPPNRGRPKKRLEELQRSARRDIVDAIVGVIDRDRSRSASRASLDRIHRDIRHKFAHYTPKKGQERKEWMEAEDGLLLLAQLGTQMAYKRMKATLRLINRRFDTFPPLIKVSWR

SEQ ID NO: 152638 - protein, 108 aa, Heterodera glycines
  Coding regions on vcDNA: vcDNA=SeqID_79061; Strand=-; Position=1 -109,624-841
MAFPSANRREGGGPFPQLHGPVLGGQHQCAGNDKSAAAAVRQGADAMDKTTVRMQQVATAYSELNECLKDFVNRVYPQCDYVVTSPRLIEALLGLELSDTSTVGTFRR

SEQ ID NO: 152639 - protein, 27 aa, Heterodera glycines
  Coding regions on vcDNA: vcDNA=SeqID_79062; Strand=+; Position=1 -49,563-597
MHRTTVDVKAALNEKDTPIMDLNSIEE

SEQ ID NO: 152640 - protein, 104 aa, Heterodera glycines
  Coding regions on vcDNA: vcDNA=SeqID_79063; Strand=-; Position=1-315
MALVRFEEAKSNRGKILLSRLGFEYAYESDSRIEQGWEYWKCPKRPPYCPGRDCVQMAWHVDANGSRYKMGRMSADHNHAAVFGQLNVSQKSKPSIFGIDKTGK

SEQ ID NO: 152641 - protein, 52 aa, Heterodera glycines
  Coding regions on vcDNA: vcDNA=SeqID_79064; Strand=+; Position=1-156
AGLAILSGIVGIGGTIKTGEKAWAFGAALMLANIPYTFLCIFPVNKRLLATN

SEQ ID NO: 152642 - protein, 96 aa, Heterodera glycines
  Coding regions on vcDNA: vcDNA=SeqID_79065; Strand=-; Position=1-290
MALREGGSCSSAAAMGFLALGRDRLVQDSKCFTGTVKSDGRIVKIDELKTKVEAAIAAGKAMIVLPAGNVSDFLALEPEIRDGITRRSVNEVRDLL

SEQ ID NO: 152643 - protein, 190 aa, Heterodera glycines
  Coding regions on vcDNA: vcDNA=SeqID_79066; Strand=+; Position=1 -166,247-536,709-825
MPLKIDNAKRMQQIVPKVKSSENVTGYLENKNEEKQQRISFKNYFNEINAYFNYYVPKHIIGLIALKLINAIQWHLELNNGQLTHVLTPDHLVAIRVGDQFSKSELLGNVHLEIDAEIQRVEDPRQRALPSADQTKIIWLKDFSYMSPQQIKHNIITSGESDIIWSFGITLYEMISGETPIWHTNKQYFY

SEQ ID NO: 152644 - protein, 61 aa, Heterodera glycines
  Coding regions on vcDNA: vcDNA=SeqID_79067; Strand=+; Position=1 -48,108-167,616-690
MGLHVRRSKMSLPKIAEIDQMKEACDRLLMRREEFHIKDQRVADKMMCIRPEACLTIIVIK

SEQ ID NO: 152645 - protein, 170 aa, Heterodera glycines
  Coding regions on vcDNA: vcDNA=SeqID_79068; Strand=+; Position=1 -3,207-332,370-574,819-904,946-1036
MDQLEIYCGQDTEILMNAVLSMRRIFLEITKDADTPQGYDVIKEASTLAGVAMRIFRAKFLKEKHLAIIPEGGFEKTDTQSSIAIKYFEWFMYKNGVKGRHAGNGGEIKIGEQNFLKTQSRMNKLKHVAKKYGLNVEEIWECDLKSMLNRKNDTNYNSEMKNFFDELYDK

SEQ ID NO: 152646 - protein, 85 aa, Heterodera glycines
  Coding regions on vcDNA: vcDNA=SeqID_79069; Strand=+; Position=1 -89,140-308
MDLSFNSEKTPPKRAKRSPIQRLKAGETMIDIKLVLIMADSVRIVGEKSKVWTIIGSDGDDYINGGTSNPVVAAKTDSKNSFEVC

SEQ ID NO: 152647 - protein, 25 aa, Heterodera glycines
  Coding regions on vcDNA: vcDNA=SeqID_79070; Strand=+; Position=1 -72,245-250
MARRGPLLPIYKRRNVRRQIQINQS

SEQ ID NO: 152648 - protein, 80 aa, Heterodera glycines
  Coding regions on vcDNA: vcDNA=SeqID_79071; Strand=-; Position=1 -102,364-429,501-566,720-728
MTDLLLQINNNNTNDKGSVSGLIVVFFLFILITQSPAVPHGDECAARRSRRVGLEKSPTLPHGDECAMRRSQRVGLEKTE

SEQ ID NO: 152649 - protein, 63 aa, Heterodera glycines
  Coding regions on vcDNA: vcDNA=SeqID_79072; Strand=-; Position=1-3,84- 272
MDSESEEKQFLKQIKEFVTTKNKKDSSNNAKADQMSDCSKNAVKLELKEWKRGFLLGKPSENA

SEQ ID NO: 152650 - protein, 491 aa, Heterodera glycines
  Coding regions on vcDNA: vcDNA=SeqID_79073; Strand=+; Position=1 -148,211-308,362-510,571-799,867-922,973-1122,1167-1282,1328 -1418,1467-1590,1664-1767
  Homolog annotation: Hit_ID=NP_083296.2; Match level="QueryCoverage =96%, HitCoverage=56%, E-value=1e-95, Identity=45%"; Hit description =ATP-binding cassette, sub-family B (MDR/TAP), member 8 [Mus musculus] gb|AAH15301.1| RIKEN cDNA 4833412N0
LVGALFGSLLRRLSFQSQSQSALAAGVSGEALQNIRTVKVFAMEEAETELYRLYRKEVQTACSLGERLGVGIGLFQALSNFFLNGIVLGVLYGGGQLIVLGVLYGGGQLVADQQLSAGDLMSFMATAQIIQRSVSQFSLIFGNGIKAWTAWTSCARILQFLRIDPNCHNHLNGNEQIPRHSLIGDIHLHNICFSYPTRPEKAVLNGIDLHFAGGQTTAICGPSGAGKSTIKSTIAALVERLYEPQNGKVTLDGRDIRVTLDGRDIRSLDPLWLRQKAIGVISQEPILFSTSIRENIRYGRPNATEEEIRSAAELANAAEFIENFANGYDTLEIRSAAELANAAEFIENFANGYDTLVGERGATLSGGQKQRIAIARALIKDIAIARALIKDPPILILDEATSALDAESESAVQLAVQLALGRVMRDRTVIIIAHRLSTIRNADQIYVLKNGQMVEVGTHDQLVRNRRGVYHSLVGEQRQKSPGEDEPTKAG

SEQ ID NO: 152651 - protein, 153 aa, Heterodera glycines
  Coding regions on vcDNA: vcDNA=SeqID_79074; Strand=+; Position=1 -91,157-278,487-605,727-856
  Homolog annotation: Hit_ID=NP_609459.1; Match level="QueryCoverage =94%, HitCoverage=16%, E-value=2e-41, Identity=56%"; Hit description =CG6700-PA [Drosophila melanogaster] gb|AAF53017.1| CG6700-PA [Drosophila melanogaster]
MQSMFLGGDGELVVNPNFASLNIVGTCTDIEKSFFRLTAAPDPSQIRPQDVLKVALENVKEKYKQNNGYRYASDQLKSIRQDLMIQNIRNNFTVSVYETNARVALENRDREEFNQCQNQLKQLYKQVSSGCPNRWEFTSYRLLYYIYMRETLG

SEQ ID NO: 152652 - protein, 277 aa, Heterodera glycines
  Coding regions on vcDNA: vcDNA=SeqID_79075; Strand=+; Position=1 -108,187-414,469-618,806-952,1005-1205
  Homolog annotation: Hit_ID=AAP30770.1; Match level="QueryCoverage =92%, HitCoverage=99%, E-value=2e-76, Identity=59%"; Hit description =putative gland protein G17G01 [Heterodera glycines]
MRTIVYFKLLQIVLSLAFVWQLLSLHQFCGTFVCPKAFLHDISVGHCKRFTLIGKDSKTGEFGAVLDERKWHNQLFMSSTNGLPIKEQQQQFMDELAAKLPCPGRHCIPITTPSFFFWTEKNRNLLDTVVDSFSGQLLLALCSLLTIGIGFARMLRPAAEYECFDYCMALYSVFCWCCSAWASSCLLLYWTPYWSCMNFRADDTNVPLVTFVFDIVMVCSFVFEMFFNNSLVKKRPENASVAAANRKLRNDVATECANVAIHRQQQQKNGSAIIMQT

SEQ ID NO: 152653 - protein, 36 aa, Heterodera glycines
  Coding regions on vcDNA: vcDNA=SeqID_79076; Strand=-; Position=1 -70,275-315
MRCTQTKNDQADEAIQKRSKVPKERKKGSKKTLKYA

SEQ ID NO: 152654 - protein, 475 aa, Heterodera glycines
  Coding regions on vcDNA: vcDNA=SeqID_79077; Strand=+; Position=1 -79,814-2048,2080-2193
MDSGHNNQRHYNFRHRVTVNYMEQESAQTIPIPDIIMELHKVTLSNQYANTMREIPTLNGTEGSDKVQDFFLTVEMCVGEWRHEKKLEMLKTKLKGKALRALNMALSKFGNTAPFETIKTEIMSTLRETDYKEASAFQELTQTGKRKEGESVMKFGERIQRLVNCAHVGLSEAQRDEISKKIFVLNINDTNMAKFLECQSKPSQTYDELLMVANRLSLVEEKTEERSVQIRNSQNPFHLPNANQISYQNEQSRYFGQRNFQNSYQPQPKYFGRTGRPPSHSYGNNFGGRNFPVNQNFNRYPNNQQNRNFGSERAQSNKPRQEVNFQGQGSQNSIIPASNANAVPLNAQKQNFRPGYGSNAIIVTENTEDNSPVISVGHFGQKEPTDYEKFFNALSTHSSEFPPKNPALVKTSKCLDITLSVVDKKAKGLMDLGAETDIWKKELISQIGVSVPILALPNYLFPSHHLLVEKLHLLE

SEQ ID NO: 152655 - protein, 238 aa, Heterodera glycines
  Coding regions on vcDNA: vcDNA=SeqID_79078; Strand=+; Position=1 -267,1380-1388,1446-1592,1631-1703,2004-2221
MCNYQWSKAKGEMLGPLENAPFIGPAFDFVVSVGLPQIPHSDNPDDKDKVAGSMCKIDYGCDWGKCHPSAGKTASTCCADGFVFICCKDPPPVKPAQLIQIDDCEKAAKSCDCGWYSCIPHPGQPSTPCCAEHYNFTCCVKLNNGHSESTLKIGIGQGHLIIDSDSSTGMSTVSQCANYCNRTFVGLLKIKPPQIIQMDECEKAAKNCSCGWYNCIPKPGQSSTPCCAEHYQFSCCTD

SEQ ID NO: 152656 - protein, 69 aa, Heterodera glycines
  Coding regions on vcDNA: vcDNA=SeqID_79079; Strand=-; Position=1 -73,268-404
MAKLALYLPKFKDLGWQWLRFRMEATPQLDERGQRATEEEKAFCTHTLASFRDLLLNNVNDKSGAKDRK

SEQ ID NO: 152657 - protein, 21 aa, Heterodera glycines
  Coding regions on vcDNA: vcDNA=SeqID_79080; Strand=+; Position=1 -52,310-323
MAIKLEGFQGVKHTKGYVVEL

SEQ ID NO: 152658 - protein, 301 aa, Heterodera glycines
  Coding regions on vcDNA: vcDNA=SeqID_79081; Strand=+; Position=1-906
  Homolog annotation: Hit_ID=AAV44035.1; Match level="QueryCoverage =94%, HitCoverage=19%, E-value=2e-27, Identity=32%"; Hit description =putative helicase [Oryza sativa (japonica cultivar-group)]
MLNNTVIEVINRVCKEMAIYQHKDLLFGGKTVIFSGDFKQSLPVVPHEGLTAQVTSCFQTSPLFGQFTNMILTINQRLGQGQQDYLEMCRQIGLGKTGEFFWIPPQFLVKSREELIDFVYPNFQQLLGNDKELLNRLILAPHIDTCDEINAIMMANVPGQEREYLSTDKPLDERPLDIDEIESEVAALNRRTDSGMPPHSLQLKVGSVVVLLINKSDREGLINGTRIVIEELGDDRLVGRVINSNAVGSQVRLFLERTRNVYEDKTPGGVKYERLQFPIKPAFAMTILKGQANNQHGWNRS

SEQ ID NO: 152659 - protein, 185 aa, Heterodera glycines
  Coding regions on vcDNA: vcDNA=SeqID_79082; Strand=-; Position=1 -122,278-359,719-1072
MANNLVILIMMFNHHINTDLSAEDKSAAVKHHATYTELLKRYLESIYGPEEARQIYETVPKAFVMLNIVTEKAKELFRARVPTEDEKMLKHIKLAAEIFPTAADEKKEKEEKQQQNQQQMKLEEGKDGGDADQREVAAEDGAIGTVKGPRSSEKDQKAMPPATATVVSLKQEQHEDEEMDQQQTL

SEQ ID NO: 152660 - protein, 110 aa, Heterodera glycines
  Coding regions on vcDNA: vcDNA=SeqID_79083; Strand=-; Position=1 -116,647-863
  Homolog annotation: Hit_ID=AAD37372.1; Match level="QueryCoverage =93%, HitCoverage=13%, E-value=6e-11, Identity=31%"; Hit description =nuclear hormone receptor of the steroid/thyroid hormone receptors superfamily [Strongyloides stercoralis]
MLRRMVKVVKKLPAFNELSQSGRFALMKDAIIDMLTVRGAVSVDVENECWKRPLISNCEIRLNFNILDQMLNGSMQTRRVTGFYKQLHQTLMKDQVSQQSMILISSNQTI

SEQ ID NO: 152661 - protein, 59 aa, Heterodera glycines
  Coding regions on vcDNA: vcDNA=SeqID_79084; Strand=+; Position=1 -60,108-227
MRANGECGVYVVEYARAILDALSRNWNAEFDFSHINSDNISSIRRHWMKIIRERTALEK

SEQ ID NO: 152662 - protein, 101 aa, Heterodera glycines
  misc_feature (47)..(47): Xaa can be any naturally occurring amino acid
  misc_feature (56)..(56): Xaa can be any naturally occurring amino acid
  Coding regions on vcDNA: vcDNA=SeqID_79085; Strand=+; Position=1 -38,448-574,657-797
  Homolog annotation: Hit_ID=CAF99079.1; Match level="QueryCoverage =98%, HitCoverage=13%, E-value=2e-26, Identity=64%"; Hit description =unnamed protein product [Tetraodon nigroviridis]
FALSNDTQKIGFGRMNEQSSRSHAIFTVTVECAETVKAADGRQLLTXGKLHLAVAXGSERQSKINATGDRLKEASKINLSLSTLGNVISALADASPHIPYR

SEQ ID NO: 152663 - protein, 82 aa, Heterodera glycines
  Coding regions on vcDNA: vcDNA=SeqID_79086; Strand=+; Position=1 -63,1276-1458
MRAEAERKHTIGAAEAVKGGKLKIDAILEEYAKAVEKFKLEMAPKLEAMSLKEARSCGDHVVLIITDPKLSPAEKVARVNDA

SEQ ID NO: 152664 - protein, 214 aa, Heterodera glycines
  Coding regions on vcDNA: vcDNA=SeqID_79087; Strand=+; Position=1 -308,354-600,1679-1768
  Homolog annotation: Hit_ID=D86481; Match level="QueryCoverage=86%, HitCoverage=10%, E-value=2e-21, Identity=34%"; Hit description =189.6K hypothetical protein F10O5.11 - Arabidopsis thaliana gb|AAG51081.1| hypothetical protein [Arabidopsis t
MTDEHFRGSRQYYQREYANCMTICREVGKPDLLITLTMDPECDELEEMLPTDPDGHRQQWYDRPDVICRLFVDKFKELRHDLTVKEVMGPVRGWFYSLEHQKRGLPHVHFALILDWDRIRSGGTINTPEDYIEQYISAEIPDNPSGRSSEVLLKRELYKTLRMKHIHTCSARRCLVDGKCLKRFPSLSQNDEPLKNAFFYSALESCGTVVDMAV

SEQ ID NO: 152665 - protein, 229 aa, Heterodera glycines
  Coding regions on vcDNA: vcDNA=SeqID_79088; Strand=+; Position=1 -36,285-509,812-1240
MCWVIDIALSLQLLVAHVKAFAPCTSNLDPYLRKTIREQRGGEPIIDLSVSQEDDDVAQQQDPFGPLKETIGPEAEFVFQDPMVWASVPLGDWTLVKLLIESLRKWKPFSTQSLCSPPDTNSNSVADPVVVVQPQQQKHLVQHHDNGEFGQQNEQRMALLRRIEEEGNGQTMMNNGETEEEKRRKSTKSGEKEEKERRETEEEMNSVASVAGSSEQRSLLRSSTSPPKD

SEQ ID NO: 152666 - protein, 163 aa, Heterodera glycines
  Coding regions on vcDNA: vcDNA=SeqID_79089; Strand=+; Position=1 -138,193-546
MGNKESQFGTRYAVDGRDSQTLDPSLIRSFTEIRDSDTDFALDKFQIVRILSNLRQYRLLSGLYEKAIRLNGNDKFAWLQFSLSLSADRHFLRVSKILQQFISMEEEEETNQKGGADEDAIVAYMHLARIQLEHFGDCNLGTFVELSIKQHWRKCVYGGSPKK

SEQ ID NO: 152667 - protein, 107 aa, Heterodera glycines
  Coding regions on vcDNA: vcDNA=SeqID_79090; Strand=-; Position=1 -212,1557-1668
MPSKFEQIAQTILRKLLRQFMEEQNWFLAEISICQEMPNIVRIVDLLVPLSIPPTPPIPDNLVRVKSVDVDDDEEDGDELEEEEQEGGDKSEGSDMDIDELSEGMEM

SEQ ID NO: 152668 - protein, 357 aa, Heterodera glycines
  misc_feature (334)..(334): Xaa can be any naturally occurring amino acid
  misc_feature (352)..(352): Xaa can be any naturally occurring amino acid
  Coding regions on vcDNA: vcDNA=SeqID_79091; Strand=-; Position=1 -211,516-743,800-991,1182-1438,1721-1859
  Homolog annotation: Hit_ID=CAE61879.1; Match level="QueryCoverage =91%, HitCoverage=19%, E-value=3e-68, Identity=44%"; Hit description =Hypothetical protein CBG05865 [Caenorhabditis briggsae]
QITDPTPLNERAEIMVVQELADETDVFMEFGHLSQATRRKIEEFRRRRKEAEEYNEQSPIKPPKARRASKLNAKDKKAEEKQKEGAEKEEANKAEKENNEKQQQKEKPAKRKTSLKRQETTEKREKEQQRPAEKRSGAEEEKHGEKEQKSAVPKPQEQKSAVPKPQTVTMAAAVAAGSTTVPTSAATAAPTPATTIIGPAMDPQRYWRLETDSLNALMNQVLEQMERGPVSINLIARIKAHPFYDERPEVKELLESIIAAQPDEVQKQTSKLIQQQSKVKERSINQLVINTLITANELMSIKMPEERRKEERRWHSVEAKSLQLGHWDNYREFXERQQRFFKIHKLPMKVNXVGFST

SEQ ID NO: 152669 - protein, 60 aa, Heterodera glycines
  Coding regions on vcDNA: vcDNA=SeqID_79092; Strand=+; Position=1 -122,623-683
MTERDMPEPNSPLPRKRVGFKEPHTGLVKNDFFGYWYLQYWAPRRALAQPTTVALVTIQC

SEQ ID NO: 152670 - protein, 259 aa, Heterodera glycines
  Coding regions on vcDNA: vcDNA=SeqID_79093; Strand=-; Position=1 -63,106-402,470-526,576-851
  Homolog annotation: Hit_ID=NP_492636.1; Match level="QueryCoverage =100%, HitCoverage=100%, E-value=6e-71, Identity=53%"; Hit description=tetraspanin family member (tsp-7) [Caenorhabditis elegans] emb|CAB03397.2| Hypothetical protein T23D8.2
MVEGGITLVKYLLFFANFVLWTLGLAFLIATLGLAFLIAGVVLQLKYTGLLDILGDERLATPVLLLAIGCLCTLLGFVGYCGAIRENYCLTVSFAVLLALLLLAETAIAILVYALHEPLNEALISQLTQGMERYNRGMERYNRSKGVSVAWNQVQRQLHCCGVNNATRQLHCCGVNNATDWKIYAPDSCCVHFHDGCAKMAQPLLYGVGCVQAVQHWIVTNATVVGCASALLGALQIIGICFACCLSKSILKDFHDFYY

SEQ ID NO: 152671 - protein, 60 aa, Heterodera glycines; identical to SEQ ID NO: 124695
  Coding regions on vcDNA: vcDNA=SeqID_79094; Strand=+; Position=1 -46,101-237

SEQ ID NO: 152672 - protein, 56 aa, Heterodera glycines
  Coding regions on vcDNA: vcDNA=SeqID_79095; Strand=-; Position=1 -60,660-770
MYGCMKNDKPCQKNVNVMKKANRGHVGLSNNSKLINFVGSEKVLIRIFYDQNIRNP

SEQ ID NO: 152673 - protein, 856 aa, Heterodera glycines
  Coding regions on vcDNA: vcDNA=SeqID_79096; Strand=+; Position=1 -96,154-304,435-556,608-802,846-960,1024-1086,1130-1188,1249 -1360,1458-1583,1648-1707,1756-1884,1959-2135,2209-2274,2345 -2413,2466-2552,2608-2676,2724-2826,2911-3008,3069-3214
  Homolog annotation: Hit_ID=NP_740906.1; Match level="QueryCoverage =98%, HitCoverage=98%, E-value=0.0, Identity=59%"; Hit description =Beta-Ig-H3/Fasciclin domain containing protein (79.2 kD) (1K355Co) [Caenorhabditis elegans] emb|CAB03000.1|
MFFFGLFFLLFVSPFSEDLWTETARMSDLQQWRLLCSRYQVAQAYMWRLLCSRYQVAQAYMEDVNARVTVFAPVNDVFLYNPDLRAMDQKEVLSHIVTQVVEISSGRKWEKQTLIRSTINSGYIYVTQFENGPANFSYFASYFANAGAICNHVTNQWGIITGEQYLYKTCTPMGHRPYPGTALSFVRDDENAFFVDRHYDNRDLTELRDILDRVPDIALVIYGSSAWNGLTELRDILDRVPDIALVIYGSSAWNGFHTYFLPNNKAFAKVIDRNVIDRNRVDREVLLAHVSGMNRVLFTYPWLYDVLFTYPWLYDGGVHFYPSIRFSSNIIEDNYFSSNIIEDNYKLKLCLRNITDHRTGKWDLYAVSTVYERYGQFRRGAVWAKLLVPNIPVQNGVVHVVDNVLGIVTNTIDQMLMDNYRCTTLMRYMNTMLMDNYRCTTLMRYMNTIGQIVRNYFSATGGLVTFFAPWNEIGQIVRNYFSATGGLVTFFAPWNEAFERIPEPIERRLLRDRIWLEQILKLHIVPAKELTILKLHIVPAKELTTEEITNETVVATVDNMRHLYFVRGEWPKNNVTYYVIGGGVRTAIQMEDVTAVNGIVEDVTAVNGIVHYIDRVLGVPYQSLWEISLWEILRNESRAQRSFEMLGNLQLKYSLKYSLDPWQVLTPEQNFTFFVPIDEAWDKVAPSLKNRMMDGNHWQAVAPSLKNRMMDGNHWQALQYVYKRHVLQGQALMYTDLRERTRHVLQGQALMYTDLRERTYVMMNDEKVIIRRRGRYFELYWPRGNRVARVLEGGELAGINGFMHLVDGVLIVLIYEPDLRAAACASITDNNHTLLLCIVSLWTHRWRRRKLTTAKR

SEQ ID NO: 152674 - protein, 35 aa, Heterodera glycines
  Coding regions on vcDNA: vcDNA=SeqID_79097; Strand=-; Position=1-150
ISPLHLKLFRPYFANFLPLFRSLNWNFSPLKIPTL

SEQ ID NO: 152675 - protein, 251 aa, Heterodera glycines
  Coding regions on vcDNA: vcDNA=SeqID_79098; Strand=+; Position=1 -9,537-794,981-1469
MIYVIERLNEIVKDPHNFAELTENDLLVNALVTFSFPKLRHIFKKYEEKYGEKIEEQVDNAYIKEFKHLSKNRIKNLLKLDLHVEQHFWQTLNAILTDIQYGRPYFFAQLLKEKLDKLRGNEKWASADALKDVTRILLTRAPIDLADIDQEFQGLSGSLTIRISISAYIEQILGFEKEKKQKKGNVFRSFSIRSKSHEDIGTAVSSESNTAAAKGKPSQKIETLKAFKEIVDWATEQRRLSLARNGNSGVL

SEQ ID NO: 152676 - protein, 55 aa, Heterodera glycines
  Coding regions on vcDNA: vcDNA=SeqID_79099; Strand=+; Position=1 -92,444-519
MAGTGIGTWKMNRDGIPGPGLPFFRDSRSRCSVQGIISRLRVYVFRVLVLTNEHV

SEQ ID NO: 152677 - protein, 150 aa, Heterodera glycines
  Coding regions on vcDNA: vcDNA=SeqID_79100; Strand=+; Position=1 -149,204-333,384-443,501-532,584-664
  Homolog annotation: Hit_ID=NP_496105.1; Match level="QueryCoverage =92%, HitCoverage=50%, E-value=1e-19, Identity=36%"; Hit description =putative protein, with at least 4 transmembrane domains, of bilaterial origin (30.5 kD) (2K58) [Caenorhab
PKSFWNFAVAFLGGYSAFRLANSLWYYSQSYSTDHHQFYDSLPCALSYKVPFYCALLFELFGSFFLRFLLHRFPLSSRHFFAPPTIAAFLSFALTFIGVPGLNPVVTSSRLQGCPGLDLQWFIMTYWCCPVVGWLLASKLDKTPTKQKKK

SEQ ID NO: 152678 - protein, 253 aa, Heterodera glycines
  Coding regions on vcDNA: vcDNA=SeqID_79101; Strand=+; Position=1 -113,258-346,399-793,853-905,1204-1242
  Homolog annotation: Hit_ID=CAE72193.1; Match level="QueryCoverage =99%, HitCoverage=50%, E-value=3e-35, Identity=35%"; Hit description =Hypothetical protein CBG19301 [Caenorhabditis briggsae]
STEEERIANVHFDLEVVNSDFIRPMRMNFRRRGRDLYCCFHCLLSQLAALIFHTERKQLLFVKQFRPPVFVNVVRSLPENKNKSLVFVNVVRSLPENKNKSLAEVRWENYPIENGCTVELCAGLMDEPGKTPLEHMKKEILEECGYRVDESNIRPIRRYVTGISLSGAIQHLFYVELDESMWEPKAGGGNEHEGEFIQNVFMDIGEAEALLEKENLWIKVSPSWIKVSPSSFLFAISWWVLVSHPSVLSLFLS

SEQ ID NO: 152679 - protein, 128 aa, Heterodera glycines
  Coding regions on vcDNA: vcDNA=SeqID_79102; Strand=+; Position=1 -169,218-297,571-645,701-763
MNYPTDFSWLPVNNCVCPVKDNLCYHFPGYKKPVICAHKLVQNITAFLSTPPHIPNESAPASLSSGSVLMLLTVLQIFIILLTRLVLAPLVHWRFQTAPQGALLIVCRAEWCQLVNERMMCEEKADKI

SEQ ID NO: 152680 - protein, 464 aa, Heterodera glycines
  Coding regions on vcDNA: vcDNA=SeqID_79103; Strand=+; Position=1 -140,1706-1856,2196-2713,4855-5440
  Homolog annotation: Hit_ID=CAD22154.1; Match level="QueryCoverage =99%, HitCoverage=53%, E-value=4e-66, Identity=34%"; Hit description =pherophorin-dz1 protein [Volvox carteri f. nagariensis]
SEPMGENQKKTSQTPAVEKQQQPPPQQQQQDQQSSPVQEKPVTAPAPRPPAPPPPPPPPPSPPPPIPPSPPSPPDQQSSSSDDSHPPRPPRPPRPPPPPSPTLPPVYKRPDHPPPPPRSIPKVELKRDPQPTKLKKSASPPPPPLPPHRAKREPKIELAPPPPPRNVSKREPKIELAPPPPPPRHFAKKEPKFEVDPRPSTSKQAGYFPPPKIKTEPKHELQPTKRPVPYRIPKKEPKIEEKPLQQQQQQPPPPPAVVVEEMPYIPPPPQSPPRFDETEKEDKKVKETTPPSAAKQPIPPAPTLAPPSHPPTEAPKAPKQAAPKSATVPPQKPSVTPATTKTSPAPAPIPPIKQAPSAPKPSPSKTAAVPKPTPTPTPASKSTIPTPASSTKAQNIPKIPPPLAAKPKEPNVAKKSTVPTTVSTTSISKLTSQIESSPTTPKPPPPPIKPIPTSIPAPSPPPKN

SEQ ID NO: 152681 - protein, 133 aa, Heterodera glycines
  Coding regions on vcDNA: vcDNA=SeqID_79104; Strand=-; Position=1 -244,291-448
MSSPSKFSPTKSSPVKKENNVGKAEFVVPSLKAPTRKQPSKNVGMNGGEEQQPSMKKRKVEDRDLWKLAKGKYMLGFYLCVDDWNKLYNNKQRVLRKDDGRFAVNFELCEECALANVRATDILAPPKAKKRIE

SEQ ID NO: 152682 - protein, 132 aa, Heterodera glycines
  Coding regions on vcDNA: vcDNA=SeqID_79105; Strand=+; Position=1 -177,840-1058
  Homolog annotation: Hit_ID=EAA63638.1; Match level="QueryCoverage =45%, HitCoverage=2%, E-value=5e-17, Identity=65%"; Hit description =conserved hypothetical protein [Aspergillus nidulans FGSC A4] ref|XP_ 407204.1| conserved hypothetical prote
MISYMINEAGFLIVNREIVAADIDDFEFTPRPEFRGEFRVFNEPNECALLTRFFDHLLRALCGDACRRRAAARLAADERPPGLWPGRAGRVQTPQLRAHGRVPLGATGQLFADGLPVVEGCNAGEVAIRAGG

SEQ ID NO: 152683 - protein, 146 aa, Heterodera glycines
  Coding regions on vcDNA: vcDNA=SeqID_79106; Strand=-; Position=68 -115,177-569
  Homolog annotation: Hit_ID=AAP30767.1; Match level="QueryCoverage =100%, HitCoverage=100%, E-value=5e-74, Identity=95%"; Hit description=putative gland protein G21E12 [Heterodera glycines]
MATYLFIAAAAFGAGIYCWKAYLGPMLDQPKSDDEEKPKPEGGEEATTAGDKEEKKAGSKGDKHKKKDKKGEGAAAAAPAADKKEEKRKDKHRSKEAGKSDDSKAGKKDKHGKKDKKGKKKDTADASTVDEALGEQSTAETSQAEE

SEQ ID NO: 152684 - protein, 452 aa, Heterodera glycines
  Coding regions on vcDNA: vcDNA=SeqID_79107; Strand=+; Position=1 -111,171-364,416-511,558-669,727-1025,1069-1399,1474-1689
  Homolog annotation: Hit_ID=CAI21859.1; Match level="QueryCoverage =71%, HitCoverage=23%, E-value=4e-55, Identity=36%"; Hit description =ubiquitination factor E4B (UFD2 homolog, yeast) [Homo sapiens] emb|CAI14688.1| OTTHUMP00000044349 [Homo sa
MPAETANSNSNVNSSETANNNAISTHMLREKNSDEAMEVDQQIVTDTADILQSVLEFAFGVSIDDNNGIAQEFSSSPELLLQLQDSVRTILPSLNSDDSLAFGQNEFQPDFDRFFAFPEAYLEVAVEFLTLLVSKSKMSRIFLKNLSDFPKQVLHLLLNLESIKNPFIGSKVVDLLFMLCPLVNHDASVFYRQIVSDSLAVEGLFPSLVKFYSAVETTGPIFFFLLLYAPKTLGSHTEFFDKFNIRRNIQVIFKCMWSDLSHRDRMVQYAGEFSPNFVRFINMVLNDTTFLLDESLDKLKMIQDIESVMSNETEWDKLSQEEQQLKTDQLRDSKGQVKMWIQLGTDTMELFVTLTSDAPQIFRNEALGERVAAMLNHNLVQLCGPKCAQLKVHDAINRFEWDPRTLTQQIVKVYINLGSEMFAKQIAQDEVTYFRLIYLPGRNPPKKEKMNF

SEQ ID NO: 152685 - protein, 78 aa, Heterodera glycines
  Coding regions on vcDNA: vcDNA=SeqID_79108; Strand=-; Position=1 -85,296-447
MALFLYVSLFLSSLDFALRLLFLYLSGSVLVCQINYGLLLLSYRTNFPNGPEQSFLHYPSFVYLPYSVYRKTPVLWTS

SEQ ID NO: 152686 - protein, 106 aa, Heterodera glycines
  Coding regions on vcDNA: vcDNA=SeqID_79109; Strand=-; Position=1 -79,175-266,673-772,1147-1196
MLELKTIVKAYKNDEKKKDAVRRIYTVIVNYGEHLSSVPPGARQFEELNANIEDENFVETVLFECQALVSRYSDCGFADEDDADLNSLLHFGSHVFNCIYNVKSRF

SEQ ID NO: 152687 - protein, 75 aa, Heterodera glycines
  Coding regions on vcDNA: vcDNA=SeqID_79110; Strand=-; Position=1-226
QGLKCPAQAKNFFYFREKIEIFPKKIPVDRARKTMFWKWSPFLWEKSLKNPKIQKPENRFLGLARKIFKIFEILK

SEQ ID NO: 152688 - protein, 50 aa, Heterodera glycines
  Coding regions on vcDNA: vcDNA=SeqID_79111; Strand=+; Position=1 -115,540-577
MSEAGYPDRVRLKFYFNEKNLKASQPGLHAIGFAVTEIQPESKNRNCSRF

SEQ ID NO: 152689 - protein, 99 aa, Heterodera glycines
  Coding regions on vcDNA: vcDNA=SeqID_79112; Strand=+; Position=1 -228,733-804
MLIAPPPVKILYCYSEMNDSVIGLMKQGIETHNGVPTQTLVQSMPKPLLLILDDLMLSVNNDFLDLLFTRGFHNWDPKQKPKETLGRIRGLLSCNCTLA

SEQ ID NO: 152690 - protein, 232 aa, Heterodera glycines
  Coding regions on vcDNA: vcDNA=SeqID_79113; Strand=-; Position=1 -206,293-529,573-677,1064-1213
  Homolog annotation: Hit_ID=CAA45761.1; Match level="QueryCoverage =78%, HitCoverage=22%, E-value=5e-14, Identity=32%"; Hit description =unc-93 [Caenorhabditis elegans]
MKRRRSDPLHSLGRTRELSPLPLDEFCRRPREFERKKANSKTPMLGRKIMSGQLLNGAAERRARTKDKGAHLFRQTDESHLADALCGSETPLRVHVYDPYCPVHGSRRRMPRHGERVPKRLVDMHSFLASVDTTDEDVDEKLNPYLGSQAILAKQFRKERRAILRETEGPKLKAMKWRIRTDLYYSLIPTSIIAGMAASCIWASKCVYITESAIKYAKLNVESTGVVIPGHF

SEQ ID NO: 152691 - protein, 39 aa, Heterodera glycines
  Coding regions on vcDNA: vcDNA=SeqID_79114; Strand=+; Position=1 -83,174-210
MRAFWRLALVQKRLSDYFNAICEFNGKNHNKPSAKDKHL

SEQ ID NO: 152692 - protein, 132 aa, Heterodera glycines
  Coding regions on vcDNA: vcDNA=SeqID_79115; Strand=+; Position=1 -54,1236-1580
MKKFTEDLYEKLKTAESREVKALNASLCALQQNEGEAMEEKAHEKRLKEELVEKTKQYMEVGEKRKWKGLLAIGDECSEKEAAGSERRTRTERHTEETRRGARGTRRDNGQDGESQAEKEGKAPTDRSIANC

SEQ ID NO: 152693 - protein, 178 aa, Heterodera glycines
  Coding regions on vcDNA: vcDNA=SeqID_79116; Strand=+; Position=1 -97,440-563,2029-2162,2638-2819
MMQAEAQQLFPPALAFTASNEQIEKIEPTNRGVLDFSLAARGQPLPRRYTVPCQFPKFWAVVIVQCAVSKDQCSEFVREQFGFYSKHRVRFVLFVAPGKDASHAGDVHHTFKLQEIEHGIVTQHVSPKIVDKATGPRGAIMVLDNIMLKMNLKLGGANYDICTAQAFKQANGIRHDIV

SEQ ID NO: 152694 - protein, 303 aa, Heterodera glycines
  Coding regions on vcDNA: vcDNA=SeqID_79117; Strand=-; Position=1 -47,97-144,205-268,313-410,461-665,720-830,887-1039
  Homolog annotation: Hit_ID=AAC98796.1; Match level="QueryCoverage =97%, HitCoverage=97%, E-value=3e-84, Identity=58%"; Hit description =dolichol monophosphate mannose synthase [Caenorhabditis briggsae]
QQNTFLTPKFSILLPTYNEAENLYNEAENLPICLWLIIKYLKGLSYEVIIYLKGLSYEVIIIDDNSPDGTQEVAKSLQKEFGAGRIEVAKSLQKEFGAGRIKLLTREGKLGLGSAYVFGLKQAQLKQAQGEFVILMDADLSHHPRHIPEMVTLQEKHGYDIVTGTRYAMGGGVSGWDFRRKMISRGANFLAQFLLQPGVSDLTGSFRLYRKFLLQPGVSDLTGSFRLYRKSVLSKLVVESVSKGYVFQMEMMMEMMFRAKKGGFSIGEVPIEFVDRFYGESKLGGQEIVQYLHGLIYLFVAVS

SEQ ID NO: 152695 - protein, 96 aa, Heterodera glycines
  Coding regions on vcDNA: vcDNA=SeqID_79118; Strand=+; Position=1 -166,355-479
MQLSKICPLWSAAKNCKFAKETNSRCFNPFRIYVHLWREGLLTTNQHGKTVPTHYANENRLLQKNQRIFVGFIGKGSFRTFKRGPIAKYCTQIECI

SEQ ID NO: 152696 - protein, 184 aa, Heterodera glycines
  Coding regions on vcDNA: vcDNA=SeqID_79119; Strand=-; Position=1 -89,142-213,281-434,483-598,781-849
  Homolog annotation: Hit_ID=AAK54042.1; Match level="QueryCoverage =99%, HitCoverage=46%, E-value=5e-57, Identity=59%"; Hit description =G protein alpha subunit 2 [Strongyloides stercoralis]
KFEIKKVNFRVFLLGGQRSERKKWIHCFDNVHAILNVHAILFVVAISEFDQKLYEDDRTNRMIESMRLFRSVCNSRWFYETAIILFLNKTDLFMEKIKKTSIGCLFKSYCGSDSYDDQIQYIESDSYDDQIQYIEEKFKSLNTNPNKVIYIHETCATDTNQIQLILENVIDLLIQKILHVYGLY

SEQ ID NO: 152697 - protein, 88 aa, Heterodera glycines
  Coding regions on vcDNA: vcDNA=SeqID_79120; Strand=+; Position=1-266
ENAPRVHPTEGGPEVLQGERRHGQTAPEKLCQGFVNGRLQLLPLGVFLRSALISAEYRKRRWTTHLRCQAQIRTMFVEMYHCYYILWE

SEQ ID NO: 152698 - protein, 46 aa, Heterodera glycines
  Coding regions on vcDNA: vcDNA=SeqID_79121; Strand=+; Position=1 -25,192-307
MVIMFSINENKELNDRNFNNKIMKVHNYILIQKPNNKKARAIKHDY

SEQ ID NO: 152699 - protein, 379 aa, Heterodera glycines
  Coding regions on vcDNA: vcDNA=SeqID_79122; Strand=+; Position=1-1140
  Homolog annotation: Hit_ID=XP_318550.1; Match level="QueryCoverage =98%, HitCoverage=37%, E-value=5e-66, Identity=36%"; Hit description =ENSANGP00000020240 [Anopheles gambiae]
MLQTKTEQLPVTADEIAEATPKDEILKKILAFTQSNWPKKSSDPDIAPYFPKRENILEIEGCLLFQNRVVIPQSLRNRMLKSLHMAHPGIVRMKALARQHVYWPGMDSEIERIVRQCEECQKAQKAPIKAPLAPWTPTDKVFQRVHIDFAGPCQDGHVYFILVDSFSKWPEVYQMNSMTAAATVFTIRSIIHRLGIPDEIVSDNGTQFRSSEFASLCKEFGIKHTFTPPFHPQCNGQVERFVDTFKRAMMKCKGDKNSLEKVLLSYRSTPNSAIDGYSPDQLFLGRKLRTKLALVHPKGQIDQSEKFEKGKFKQHQKDYSAKMAQQFDRNHGTKAIEFLPTDPVLLLNYRLGKSHWLPGTIVERLNNSPTYRVYVPTLG

SEQ ID NO: 152700 - protein, 182 aa, Heterodera glycines
  Coding regions on vcDNA: vcDNA=SeqID_79123; Strand=-; Position=1 -111,482-583,809-976,1306-1473
MPSDFKSAVVRRQLSVQSNSISREASNLKSFDELCTEADLQRVRKAYEEKLKKFEELKKTAADLEALDQKFLELQRNRKFGEAEIKRFEELKKIAADLEALDQKLVLWKYASGSLVFKFLNKILFSMADLQRSRKADEQEQKMKRRDRIFFIYVCCCFIIVWSIIAYYLYCIATSIFRAQTP

SEQ ID NO: 152701 - protein, 185 aa, Heterodera glycines
  Coding regions on vcDNA: vcDNA=SeqID_79124; Strand=+; Position=1 -378,446-625
  Homolog annotation: Hit_ID=NP_388504.1; Match level="QueryCoverage =68%, HitCoverage=26%, E-value=8e-32, Identity=56%"; Hit description =hypothetical protein BSU06230 [Bacillus subtilis subsp. subtilis str. 168] emb|CAB12442.1| ydjK [Bacillus
MLFSRVLLGLAVGCASATVPVFLAELAPSEKRGQMVTRNELMCVTGQLIAFLSNAILGNVWADNLHIWRWMLVLAIVPAFVLLFGTWAFVPESPRWLMASNLHNEAFEVLKSIRTNEEQAKAELEERGASSNCHLRFLLTLEDGPANAFLLALAPHCANKSLGSMQLCSTGRKFCRRVACPTKLR

SEQ ID NO: 152702 - protein, 578 aa, Heterodera glycines
  misc_feature (16)..(16): Xaa can be any naturally occurring amino acid
  Coding regions on vcDNA: vcDNA=SeqID_79125; Strand=+; Position=1 -334,398-601,641-813,853-1003,1049-1226,1276-1441,1495-1625,1662-1791
  Homolog annotation: Hit_ID=NP_508560.1; Match level="QueryCoverage =97%, HitCoverage=66%, E-value=1e-138, Identity=45%"; Hit description= sulfatase FP (XD886) [Caenorhabditis elegans] gb|AAA83618.1| Sulfatase domain protein protein 1 [Caenorh
FLLTSLFQNGFVSLTXILMFLLIIIASFYTNDRPNIVLLITDDQDIELGSMAFMPKTLRLLQQRGTEFRNAFVSTPICCPSRSTILTGLYAHNHKVMTNNGNCAGEEWRQLFEKDFEKDTFAVYLERTGFLTGFFGKYLNNYDGSWVPPGWTKWAALVRNSRYYNYSLNKNGHNEWHGNRYENDYLTNLVANLSLQFIDESVLLNPRYENDYLTNLVANLSLQFIDESVLLNPHGQPFLVVLSFPAPHGPEDPAPQFADLFEGVETHRTDSWNYAPNPDKTDSWNYAPNPDKQWLLKRTGKMEPIHVAFTDQKHRRRLQTLQSVDDAVNRLVQHLRFLVQHLRFLNRLHNTFILYTSDHGYHLGQFGLVKGKSMPYEFDIRVPLLMRGPGIPRGKMFRSVVSNIDIAPRSVVSNIDIAPTILDIAGLNAKLDGRSMLELDEINGINRRKKMAWRETVLIERGKMPKLKRIGERLKQKMPKLKRIGERLKQQKEGLSRKKLIQRECDKSKRGSSRSSGKSWQCAKDAHGKWHIIRCPLSQCAKDAHGKWHIIRCPLSEEEECECEEERKRGKREKDARD

SEQ ID NO: 152703 - protein, 154 aa, Heterodera glycines
  Coding regions on vcDNA: vcDNA=SeqID_79126; Strand=+; Position=1 -66,220-318,472-570,724-822,976-1074
MAISFLEQISSEQMLASKSRGARISKVLGYARKMAISFLEQISSEQMLASKSRGARISKVLGYARKMAISFLEQISSEQMLASKSRGARISKVLGYARKMAISFLEQISSEQMLASKSRGARISKVLGYARKMAISFLEQISSEQMLASKSRGA

SEQ ID NO: 152704 - protein, 45 aa, Heterodera glycines
  Coding regions on vcDNA: vcDNA=SeqID_79127; Strand=-; Position=1 -123,402-416
MKSRTRSIPNILENRSGRIPRSGSRSCPVSSVHLDDLTNMYNYHS

SEQ ID NO: 152705 - protein, 100 aa, Heterodera glycines
  Coding regions on vcDNA: vcDNA=SeqID_79128; Strand=+; Position=1 -164,545-683
MHRWDTTKKEPKSIFKTDETLGLRQLPTLLEYSLTQGRHVEGRRVDLDEQFLSVECTLETGQDRDPDLGIRPERFSKMFGIDRVRDFIGIPPDHLPIPRD

SEQ ID NO: 152706 - protein, 118 aa, Heterodera glycines
  Coding regions on vcDNA: vcDNA=SeqID_79129; Strand=-; Position=1 -154,656-858
MCTIGDPAHLPETNSMSNILALLTYCAEFTCYALIWLVNHFRNGHHGQSFAAKNIEKHFANMFAEQNMDQMLLCHCIISVLLRFMLELCFHILHIHSDSNDVISFNLFISDHIPLLTL

SEQ ID NO: 152707 - protein, 417 aa, Heterodera glycines
  misc_feature (406)..(406): Xaa can be any naturally occurring amino acid
  Coding regions on vcDNA: vcDNA=SeqID_79130; Strand=+; Position=1 -237,305-528,590-639,754-841,892-1048,1102-1460
  Homolog annotation: Hit_ID=CAE64382.1; Match level="QueryCoverage =88%, HitCoverage=49%, E-value=6e-70, Identity=41%"; Hit description =Hypothetical protein CBG09069 [Caenorhabditis briggsae]
DGSAIAVLRSPDRFLGGDALWELRDGVPPTPFASPIELGFTVFKQLCLSPDQRALYCLASGPRRASSLIRLDLSTDCPTVAVIREVAVIREARAHSELSQLPLSVPTLITFTADGHSLEGYFYAPHSHTHCAPEGKLPPVVLFVHGGPTACTKNDLNMKIQYFTSRGFAAFQYFTSRGFAAFDINYRGSAGFGREFRDSLLGQWGVADRDDLIGGAKFLISSGLVDPFLISSGLVDPSRVFIMGSSAGGFTVLSVLAHSDVFAAGVSLYGVSDLGQLAMASHKFERDNTMRLIAQLPDASHKFERDNTMRLIAQLPDGIQTYRDRSPIHNCNRINKPVAFLHGTEDKVVPKEQSEVMHEMLRAKGTPTLLKLFPGEGHGFKKADTIAQSLQIAHFLLPDNGLLSTXQFVFFVFLISI

SEQ ID NO: 152708 - protein, 445 aa, Heterodera glycines
  misc_feature (8)..(8): Xaa can be any naturally occurring amino acid
  Coding regions on vcDNA: vcDNA=SeqID_79131; Strand=+; Position=1 -84,365-433,909-1020,1196-1242,1835-2316,2567-2813,3367-3460,3517-3675
  Homolog annotation: Hit_ID=NP_505017.1; Match level="QueryCoverage =99%, HitCoverage=40%, E-value=1e-81, Identity=30%"; Hit description =thrombospondin (5I321) [Caenorhabditis elegans] gb|AAC25868.1| Hypothetical protein C37C3.6b [Caenorhabdi
RKGAWKSXKTKWYYNALDGTCNRFHYGGCDGNANRFDTEKQCKNICWNYKDPCVLPKVSGPCEGHSRRFFFDLHTNQCLLFEYGGCLGNSNNFHTMEDCQARCPGTFVVATTTNPWPIRLTRANPSTPTPAAAAAVELDHRDGILAIDNNNDRLISSNSDQQTPHQLDAADQQSDQQQTADIVGDNRSDQQSEWNQNGDQKPSDQSEANDDQQEEVEIEEGEEEEELIVVPREHLLYGQLPGKLSNDLLYYRNQSVNCEKWATYKIPPPPCVEELCLLPEQRGTCFGEQLRYRYDASVGDCVGFFFTGCDANVNNFDSYEACARACGAWKADAVCERSPDAGRDRSNVPKWYYDAALGKCGLFFWSGCGGNGNRFQSKSECENLCRREMLAKKSECENLCRREMLAKTHQKSDMCMLPMDAGPCADLVTMWYFDAVQQQCRRQVH

SEQ ID NO: 152709 - protein, 167 aa, Heterodera glycines
  Coding regions on vcDNA: vcDNA=SeqID_79132; Strand=-; Position=1 -92,144-377,482-659
MRDYSKTNTTNYGLISATTARHCPDNREPYRNPETGELRSCGTAAALHGDLDSVQHGICPSSFVCKRDVQRRKPATKGEEAPRVCCSPIAFCPDARLPQVDPRTRHAKRCLSADVKASPTAGAVKRHHHYYGDSYNDYGNCTPPYTCQPSTVSGIFVCCKVPPMTGI

SEQ ID NO: 152710 - protein, 57 aa, Heterodera glycines
  Coding regions on vcDNA: vcDNA=SeqID_79133; Strand=+; Position=1 -55,296-414
MLKLNLNEKIKNSNMKAASFQNRRSLCTSSQNGHFAGVRAAGGPYTRVGSTRRLSTK

SEQ ID NO: 152711 - protein, 174 aa, Heterodera glycines
  Coding regions on vcDNA: vcDNA=SeqID_79134; Strand=+; Position=1 -90,140-281,339-414,469-515,653-715
  Homolog annotation: Hit_ID=CAE67072.1; Match level="QueryCoverage =98%, HitCoverage=23%, E-value=3e-26, Identity=43%"; Hit description =Hypothetical protein CBG12481 [Caenorhabditis briggsae]
PFSHFFRCFFTLTLDQVPIWGLFINSVLLGFFMTGYLPLGFEFAAELFFMTGYLPLGFEFAAELTFPIAEGTTSGLLNGSAQAFGIGMTFGMGLVMHSLSILWCNVMHSLSILWCNLIMSAFLLIGFFLTAIIKSDLRIIKSDLRRQRAHNQQEMISHKPNELITTEIPINSHS

SEQ ID NO: 152712 - protein, 82 aa, Heterodera glycines
  Coding regions on vcDNA: vcDNA=SeqID_79135; Strand=+; Position=1 -57,198-286,1046-1148
MMRCIEDMQEQDEQTLRKSIEEKAFELAELRNDEKMKVESKRAQLMGKRSQFDRNEVVCKKWKDIEQNNFNVDAISMADIVN

SEQ ID NO: 152713 - protein, 163 aa, Heterodera glycines
  Coding regions on vcDNA: vcDNA=SeqID_79136; Strand=-; Position=1 -15,965-1301,1526-1664
MQIMGYPEIHSLQRIQSNWVPLIRLKVINFHHEIDIVFASIPGEKQIHFNDDDNYDNDGDQWQQNILSKIEEMIEKLGNQIGAVDQETKMQKDDDKNDQSVLINTKEQMLRSLRSLAAHYIYNNALGFFNGTSLAILAAKIMLLYPDATVPFLLERFFLTYAT

SEQ ID NO: 152714 - protein, 112 aa, Heterodera glycines
  Coding regions on vcDNA: vcDNA=SeqID_79137; Strand=+; Position=1 -111,198-425
MSSSFGVFKLTDDDAMKFLVIESHIGTKKMDYQMEHYQRFVAFFEKKERGVDMHASIKRRKDYINPALYEALRNAYGIDEKGTYFAVPCTTRTHFAADDFYNALDEVNTDGV

SEQ ID NO: 152715 - protein, 31 aa, Heterodera glycines
  Coding regions on vcDNA: vcDNA=SeqID_79138; Strand=-; Position=1 -51,147-191
MLAHTDVRCSEVSRDEWTLNYDELIGNQNTY

SEQ ID NO: 152716 - protein, 18 aa, Heterodera glycines
  Coding regions on vcDNA: vcDNA=SeqID_79139; Strand=+; Position=1 -18,62-100
MGISFKVPEAPPGPNQNG

SEQ ID NO: 152717 - protein, 144 aa, Heterodera glycines
  Coding regions on vcDNA: vcDNA=SeqID_79140; Strand=-; Position=1 -70,309-673
MLGPALFKIRFPLIPKEDFTKGVVSTDVLTIKEVISIYQYYSNPKLSDVQALFPLKFPTQQRYKKGETISMEIEKVSEFGLEPVESRLSDAVDIWGFSWKIWAQIKTKVGNNEKWLGFYLYNDGPEKGDKKDTFVNLSVEKIKK

SEQ ID NO: 152718 - protein, 58 aa, Heterodera glycines
  Coding regions on vcDNA: vcDNA=SeqID_79141; Strand=+; Position=1-357
SWIFRVAITISIWDRLEFEHSLKLKFSKFQLLGLKLSKMHRNKLKIANTIISDHVDKS

SEQ ID NO: 152719 - protein, 37 aa, Heterodera glycines
  Coding regions on vcDNA: vcDNA=SeqID_79142; Strand=-; Position=1 -58,248-303
MPSARTLRRQFFGVHRQQGDDLNLANSLAVIFVKYQK

SEQ ID NO: 152720 - protein, 50 aa, Heterodera glycines
  Coding regions on vcDNA: vcDNA=SeqID_79143; Strand=+; Position=1-154
SCKSSGIFRIISQKKGTENLIGRSGDRIFNKNISRGFHNFISFAVSGDSN

SEQ ID NO: 152721 - protein, 17 aa, Heterodera glycines
  Coding regions on vcDNA: vcDNA=SeqID_79144; Strand=+; Position=1-66
HKHLFDLFYHIHNLIKI

SEQ ID NO: 152722 - protein, 270 aa, Heterodera glycines
  Coding regions on vcDNA: vcDNA=SeqID_79145; Strand=+; Position=1 -100,369-557,602-744,978-1043,1904-2216
MVALLYHFHPDQQMPRMLYDSLQFPTHRRATYDDPNKPQGTLIMEIKKFSEFLKENDNVTRLSDAVVYITALPWRLIVYKTKHSLMFEAKYDTAQMTLNYKCPYSTTFRIASQKEGKTDFVKKKMGKIGSDAYNRCTFSYISLSKLMCPDNGWYNKEEDTVKVTVEELLDPSKGFYNKDEDKVKLAIYFIVDEPKTEKFVSNPNKSNGTLSMEIEKLSEFAREIEESERKSEETVYIKGMPWKIWANIKTKNESTEKWLGFFLLCDASEK

SEQ ID NO: 152723 - protein, 95 aa, Heterodera glycines
  Coding regions on vcDNA: vcDNA=SeqID_79146; Strand=+; Position=1 -73,391-605
MDKDIVPKEGNRFKKHFDPLTTKEAHEYLDFSLFRLVPPHLVDPGTIVVKTVRQPNVLEEHNYHKRPIMYIINQLIIKSINHLTQGIKPNALFLT

SEQ ID NO: 152724 - protein, 70 aa, Heterodera glycines
  Coding regions on vcDNA: vcDNA=SeqID_79147; Strand=+; Position=1 -124,177-263
MVSTRSKTDKFKKMGNSSTEAKRKRKEWRQEHARKAGSTPKSPRQTTKAPSTTGEGTSTETMPSTLNAEP

SEQ ID NO: 152725 - protein, 44 aa, Heterodera glycines
  Coding regions on vcDNA: vcDNA=SeqID_79148; Strand=-; Position=1 -46,242-330
MKFIHQLIYVVRPIYAVFHQKLLFLPFWSPFFNKYGKMGVRQCR

SEQ ID NO: 152726 - protein, 41 aa, Heterodera glycines; identical to SEQ ID NO: 129572
  Coding regions on vcDNA: vcDNA=SeqID_79149; Strand=+; Position=1-163

SEQ ID NO: 152727 - protein, 69 aa, Heterodera glycines
  Coding regions on vcDNA: vcDNA=SeqID_79150; Strand=-; Position=1-207
MNNNCQLILVLFFSKIFLGIFCAKGGDSPVEKDENVAPNDDKKSSLASPSTAAAEQIDVDEKKELLKKE

SEQ ID NO: 152728 - protein, 74 aa, Heterodera glycines
  Coding regions on vcDNA: vcDNA=SeqID_79151; Strand=+; Position=1-225
TPRRGWFSHPRHFFGEFTPRSPTFLSPRVRKVVWALSLEVFPFLLSHFLPHSASFWHQKYSKLNYYYYYNKLFL

SEQ ID NO: 152729 - protein, 51 aa, Heterodera glycines; identical to SEQ ID NO: 124998
  Coding regions on vcDNA: vcDNA=SeqID_79152; Strand=+; Position=1-155

SEQ ID NO: 152730 - protein, 253 aa, Heterodera glycines
  Coding regions on vcDNA: vcDNA=SeqID_79153; Strand=-; Position=1 -213,477-606,916-1105,1294-1357,1435-1498,1558-1658
  Homolog annotation: Hit_ID=CAE58408.1; Match level="QueryCoverage =87%, HitCoverage=16%, E-value=7e-40, Identity=39%"; Hit description =Hypothetical protein CBG01538 [Caenorhabditis briggsae]
MPIAFAAEPSRPQLVKESIGEDHFNITFVPGAFNEASGAPVGNAFLVRYREADDETAPWQEKHPVDKSTLQLTVDGLTQGTKYDVKVVAVQRDEAGSTLSSTESRVHHITTAGVSPRRATLYWVLAVLLILLLLLFCVCVACCLVYQRGRKYPVAEKERLHGREPMLPKERQFEEFGKGEETNRSLSGHVWGGGGESESDSLTEFGTDNDRGYNEDGSFVHMYGPGSKNAGLATTSQPTVESSSAGAQQQQQR

SEQ ID NO: 152731 - protein, 109 aa, Heterodera glycines
  Coding regions on vcDNA: vcDNA=SeqID_79154; Strand=+; Position=1 -170,585-744
MSANISEKDEALSDLNCLFVQMKNKKFSFSLMSKVAQKFGDGGVAAKVLLPYEVYKDLLCWKMPISTKKLTGLLSFSSLTMETWPISLTIASNANAVNCLFSFYWREKR

SEQ ID NO: 152732 - protein, 527 aa, Heterodera glycines
  misc_feature (442)..(442): Xaa can be any naturally occurring amino acid
  Coding regions on vcDNA: vcDNA=SeqID_79155; Strand=+; Position=1 -172,211-310,377-497,559-718,770-1213,1272-1348,1638-1970
  Homolog annotation: Hit_ID=CAE65942.1; Match level="QueryCoverage =94%, HitCoverage=79%, E-value=2e-70, Identity=33%"; Hit description =Hypothetical protein CBG11119 [Caenorhabditis briggsae]
FIYIHSFISLFPFKCQFRRCSIRSVCRNCTLLMEKDAPELGEHIIEKGCAEVDISAEILKAEKPCLGKGKILKAEKPCLGKGKSVGGRCQCEQGFSGEQCQYRDDCTEDGDCGHGGRCVAGDCTEDGDCGHGGRCVAGAIHHGQRSCFCPFGFIGTNCERSITPKDTHCFAHGGPRSITPKDTHCFAHGGPRSSEVFIYGIFNPNCYSSRELNEDGDRIYWRLVGNQLELVGNQLELLLDFRTNSWLSLGWRPLNIPPSCRLFPQMHGTAGRSARGGRSADERIWLVVTWPTNGHSLESALSLPLHPMDCTDVIMASVLEGTDLLHIADMYSRDRSSPLRDAWLDGEDSLSAAYGSTDDGRTVVMFRRMVPEIEPTDHPLGPGELFLIWAKIEPTDHPLGPGELFLIWAKGQPKKPGKSKGKRKSMKKEKQRKRESIKKEKXGIKKLNVHQVTKTTIATTSSVPTTESDQTTKVSSPEATTNSKSTLTTQSQTTDKEQNLTKTEAKNEQIQTEEKEEIMQNEKETTA

SEQ ID NO: 152733 - protein, 124 aa, Heterodera glycines
  Coding regions on vcDNA: vcDNA=SeqID_79156; Strand=+; Position=1 -27,2199-2418,2477-2552,3807-3846
  Homolog annotation: Hit_ID=CAE65942.1; Match level="QueryCoverage =98%, HitCoverage=21%, E-value=4e-30, Identity=55%"; Hit description =Hypothetical protein CBG11119 [Caenorhabditis briggsae]
GVNQIFCEMALSLPLHPMDCTDVIMASVLEGTDLLHIADMYSRDRSSPLRDAWLDGEDSLSAAYGSTDDGRTVVMFRRMVPEIEPTIEPTDHPLGPGELFLIWAKGQPKKPKSGRGKRRRREQL

SEQ ID NO: 152734 - protein, 369 aa, Heterodera glycines
  Coding regions on vcDNA: vcDNA=SeqID_79157; Strand=-; Position=1 -47,105-380,427-847,893-1185,1236-1308
MSDNRKEAEEKMAKAIFISNDCWLCVFDLITPSQLGFGIAMISHRFDIYVDEHFKTRKRTLALIRIRSKIGENGTKEMEIVNSRWKPLPIPQIQMPRKVIGFEWINISFIDRNVITFLHHFRQLFAVCPIFVAMDSSKSYIFDMLVTHIWSLLGKNIHGLRSPAPYFHRLRKFAPSFLDDCPSLRFFNLFHDGFFAEFPCDDSAAASDGQALAKWLFTPRPDGVPKTFKCTLHLVLEKWASKIEPLKKTFASASSPVNFIVSIWIRPTSVDTSVVPFVLTNELTREQLALKRTYNSSYRFLLVRHPIARDESKWTKWEEEAIEWKCFDQWNKIDIRVHRDEQIGDGLFDANPGPSDQLQQLMNDLLRND

SEQ ID NO: 152735 - protein, 209 aa, Heterodera glycines
  Coding regions on vcDNA: vcDNA=SeqID_79158; Strand=+; Position=1 -123,515-653,729-1096
  Homolog annotation: Hit_ID=NP_504349.1; Match level="QueryCoverage =99%, HitCoverage=76%, E-value=4e-41, Identity=42%"; Hit description =saliva like (5F508) [Caenorhabditis elegans] gb|AAB94225.1| Hypothetical protein K11D12.5 [Caenorhabditis
MSCWFKHGYLTNDNLNMLINGINLCLFAFYIAAFAFYQPKRKYLCVQLTSLVIALFTLFSYVNNKPAEAQPDSMGSIAAAAQVASLAGNVYDLVSFVFSFGCLSLFGISFKKRAIFDLKTTEYIPASIQFGLFALTIQWSIFALIVGNSYMLVSFEALLVFLLQKWAFKVANLAGLAVNLATLATFVAYPPKTWKVPIFGVGGEEKKQK

SEQ ID NO: 152736 - protein, 222 aa, Heterodera glycines
  Coding regions on vcDNA: vcDNA=SeqID_79159; Strand=+; Position=1 -124,549-683,945-1063,1246-1309,1367-1475,1525-1603,1646-1681
  Homolog annotation: Hit_ID=NP_492762.1; Match level="QueryCoverage =77%, HitCoverage=28%, E-value=1e-31, Identity=41%"; Hit description =collagen type IV alpha 3 binding protein like (64.7 kD) (1L133) [Caenorhabditis elegans] emb|CAB02094.2|
MNCSGDGQLRVVAISVSNCLVVNGVEVVGAIDETVLNDDAPSEAAINLLAVTTTHQHIFGGRNGALFVEIRRIAEQQLEHALAPVDVAGGKWELFVKDGELRMYSRELEVENGIAVDPLKALHVIDGVSAHEFIDLFFRPELKKEWDDTLELGKVVETLSPHTAVIHQIHRRVWPAAQRESLFWSQRLNVLSECSSVTDHVPGELLGAWMVCNQSVERDDVP

SEQ ID NO: 152737 - protein, 146 aa, Heterodera glycines
  Coding regions on vcDNA: vcDNA=SeqID_79160; Strand=+; Position=1 -149,199-490
MAPPVVKKKKLSSVVENQQQQPLGSIVTPFGRRQSVRLAKKMNNRTLKKIWICNDVLMDILPFFDRVQLGLKLAMISPRFDGLVDTHFDSGKTELALRREYIIRKNTDEAQKPIFVVAEHESVQFPMPDRPLPNRNRFSKAYDCVI

SEQ ID NO: 152738 - protein, 24 aa, Heterodera glycines
  Coding regions on vcDNA: vcDNA=SeqID_79161; Strand=-; Position=1-80
RTLSTAVRQRSSKIYSMPQILWAG

SEQ ID NO: 152739 - protein, 87 aa, Heterodera glycines
  Coding regions on vcDNA: vcDNA=SeqID_79162; Strand=+; Position=1 -206,849-906
MEPFELTNEATQEMLTLEKLRNTNLQCLKRQQCSIGAKTDDGDSTASKRWNFYASNTVIFDLRPPNCIGPLSPPTATKAGKSSEKGV

SEQ ID NO: 152740 - protein, 116 aa, Heterodera glycines
  Coding regions on vcDNA: vcDNA=SeqID_79163; Strand=-; Position=1 -72,145-197,347-437,603-737
  Homolog annotation: Hit_ID=NP_505448.1; Match level="QueryCoverage =95%, HitCoverage=24%, E-value=8e-26, Identity=52%"; Hit description =gelsolin (54.6 kD) (5J979) [Caenorhabditis elegans] emb|CAA94782.1| Hypothetical protein K06A4.3 [Caenorh
MGTAAIKTVELDDSLNGLPVQYREVQDHESSLFLSYFKDGIKQIQLRKDRRNPPTSYQSQLLNLTNSLTKMQVKCIKESLNLGDVFILDMGLNLYVWTPPMSGRLERIKGMNVGNR

SEQ ID NO: 152741 - protein, 52 aa, Heterodera glycines
  Coding regions on vcDNA: vcDNA=SeqID_79164; Strand=-; Position=1 -24,699-833
MTKLFGNLGKNGKKWSKQRQHFHTGTVASFGNQFFTTTVGNCTKALQGTDVY

SEQ ID NO: 152742 - protein, 126 aa, Heterodera glycines
  Coding regions on vcDNA: vcDNA=SeqID_79165; Strand=+; Position=1-381
  Homolog annotation: Hit_ID=EAA57250.1; Match level="QueryCoverage =74%, HitCoverage=67%, E-value=1e-21, Identity=63%"; Hit description =hypothetical protein MG08219.4 [Magnaporthe grisea 70-15] ref|XP _362829.1| hypothetical protein MG08219.4
GNYSVKKFLKACNFFDKRPSSKLSPLADKIWSGQSVSGQSVSGQSVSGQSVSEGQSVSGHSVSGQSVSGQSVSGQSVSGQSVSGQSVSGQSVSGQSVSGQSFSGQSVSGQLFCEGQSVSNGQSVSG

SEQ ID NO: 152743 - protein, 175 aa, Heterodera glycines
  Coding regions on vcDNA: vcDNA=SeqID_79166; Strand=-; Position=1 -238,1021-1176,1656-1783,3049-3067
  Homolog annotation: Hit_ID=NP_648224.1; Match level="QueryCoverage =97%, HitCoverage=19%, E-value=5e-42, Identity=48%"; Hit description =CG7037-PB, isoform B [Drosophila melanogaster] gb|AAF50416.2| CG7037- PB, isoform B [Drosophila melanogast
HPSLVKLSRISLFHWVVRWKSFPIFCLSKIHGLRSLYVSILDGSREGFYLYPNGRNKNMDLSYVSQFPPESGKVVSSEQYQIYCEMGTTFELCKICDERNKNCKLEPCGHLLCKLCLISWQVKNGRKNCPFCRCEIKGTESIVIESYDPCPSSSTLLTNGHTKQRSRADDEDLFD

SEQ ID NO: 152744 - protein, 88 aa, Heterodera glycines
  Coding regions on vcDNA: vcDNA=SeqID_79167; Strand=+; Position=1 -102,342-504
MSAKVKTEASSPKQMNEKAEENELTERLELDFVEESVGDDWDGNAIMECDDTLATADEAEEEGPLKPSPDSPRSLSAPRSPEDEVETI

SEQ ID NO: 152745 - protein, 73 aa, Heterodera glycines
  Coding regions on vcDNA: vcDNA=SeqID_79168; Strand=+; Position=1 -55,107-272
  Homolog annotation: Hit_ID=XP_420517.1; Match level="QueryCoverage =95%, HitCoverage=10%, E-value=3e-15, Identity=51%"; Hit description =PREDICTED: similar to Deoxycytidylate deaminase (dCMP deaminase) [Gallus gallus]
EMNAILNKNSASVVGATLYTTLFPCAECAKMIIQSRISRVVYLSDKNTVQMEASRRLFNITGIKFRSVLPYPS

SEQ ID NO: 152746 - protein, 66 aa, Heterodera glycines
  Coding regions on vcDNA: vcDNA=SeqID_79169; Strand=-; Position=1 -27,427-600
MAVNNEQMMFERKPTNADIPYNNDTIGTDGEGNENQLGIVNVVGVDKRRRMTQVVWKIGHDIFTIV

SEQ ID NO: 152747 - protein, 69 aa, Heterodera glycines
  Coding regions on vcDNA: vcDNA=SeqID_79170; Strand=+; Position=1 -30,472-651
MLKIRNCICKKGPGNPIQLGSHSPASTDGSFNEGGYVLMMCEKITRESGTETWKKAPWKHQWDPKIPGP

SEQ ID NO: 152748 - protein, 50 aa, Heterodera glycines
  Coding regions on vcDNA: vcDNA=SeqID_79171; Strand=+; Position=1-285
IPIKFFKILPINWLIFSEKLFINDQNFQFFSPAAPIGTAAPPKLLFFLRK

SEQ ID NO: 152749 - protein, 87 aa, Heterodera glycines
  Coding regions on vcDNA: vcDNA=SeqID_79172; Strand=-; Position=1 -105,970-1128
MIKISNFFPRRRLSAPPRPQNSYFFLENGPKSQNLLVADPTRLLGTLPYMDEVLRNLNKDAADVAVAADDLAKREEEDSEQYTGKIL

SEQ ID NO: 152750 - protein, 167 aa, Heterodera glycines
  Coding regions on vcDNA: vcDNA=SeqID_79173; Strand=-; Position=1 -149,448-634,733-900
MDNPMNKDNEHNERRSSVGSVRRHFANASVKERREDKLRKKESTVTNESNSFDSDSDSGDNKSGNAKRIIDSTQRGEYKPQLPSALSMYSFLGDEEEENAEESNVFSKSSANQLKVAIGQKTLPTVARPSLLQSNVSLGWKMQLMRFPGAVQSYRQKRTVVPNGGEF

SEQ ID NO: 152751 - protein, 518 aa, Heterodera glycines
  misc_feature (32)..(32): Xaa can be any naturally occurring amino acid
  Coding regions on vcDNA: vcDNA=SeqID_79174; Strand=-; Position=1 -181,295-364,422-547,588-718,827-895,948-1169,1262-1346,1396 -1574,1640-1744,1789-1992
  Homolog annotation: Hit_ID=NP_499856.1; Match level="QueryCoverage =92%, HitCoverage=29%, E-value=2e-66, Identity=34%"; Hit description =FERM domain (protein 4.1-ezrin-radixin-moesin) (frm-5) [Caenorhabditis elegans] gb|AAF60494.2| Ferm domai
LMSRKGDSTTLFWTPMELSVASPGTKRKSGAXKGQSKGRNDDERAKRAISTQKFTRTFATVPEFLSPNVRPIIRLRAQSMKRKMVSLHRKMVSLHRSDSAVVFVRLLNGHSVEVNCRTDTLIGSVFHTVAEHLNITEHLFFGHLNITEHLFFGLALQRQFGENIFLEEHQRLEKWAPPGWKGGAGLGGVEQFALLLRFRYYPKKREFVKTANTAHQLYLQTANTAHQLYLQLRQDILSGTLRFSPKERAMEMAALALCAEANSIPKGDEEYFRMEDYMPTVKQTRTYEILMSYLIAERHIAERHRRFAASFGYLEAEEQFIARCQAEPLYGAHFYRVHKIKPKRGYAQAEPLYGAHFYRVHKIKPKRGYATPSRPFLSDTRIVAVLPSGIGIWERNGAQRLLNSTHEWHTIRTLQFDRKRFLLGTIEENIAVDHVFYTDHHSKASYLVRFAASYLVRFAASQHRFMLKMRQWQGTLNRMHLVEWQKDVGVEQRRRSEGRRAKRGNWKTKRKKPFLMGG

SEQ ID NO: 152752 - protein, 46 aa, Heterodera glycines
  Coding regions on vcDNA: vcDNA=SeqID_79175; Strand=+; Position=1-142
LNPVNVTTIPLNGAKNGAATEVPTFSKSISDLTKCYENCIRRCFLF

SEQ ID NO: 152753 - protein, 189 aa, Heterodera glycines
  Coding regions on vcDNA: vcDNA=SeqID_79176; Strand=-; Position=1 -162,747-1154
MTVNALYVLVAGKSRTGKMFQATENYQPEKCLKMDHGPAMVQSTLTFANRFEKQELRHAEEETAVAVDEGRQLPARPLELTLELDRGIASAKADILAFLNTDYCNDEFVEAMSNYYGRIGHLVGFNPPSNRNEAEEMIIEEDARLLLEQSLDENGLLVDQYFEEMGLNEVQDENSPDVNSEDGEVDIMN

SEQ ID NO: 152754 - protein, 83 aa, Heterodera glycines
  Coding regions on vcDNA: vcDNA=SeqID_79177; Strand=+; Position=1 -145,259-365
EITVSGFPGADRVDIGRLVELHGGVFTGQMNRSSCTHLIAATNSGEKFRISFIGESFCAFTRRRQTAKGFPKFFSDNEKMKDI

SEQ ID NO: 152755 - protein, 378 aa, Heterodera glycines
  misc_feature (13)..(13): Xaa can be any naturally occurring amino acid
  Coding regions on vcDNA: vcDNA=SeqID_79178; Strand=-; Position=1 -154,205-496,593-748,823-1019,1074-1125,1156-1242
  Homolog annotation: Hit_ID=AAQ06433.1; Match level="QueryCoverage =88%, HitCoverage=42%, E-value=6e-92, Identity=54%"; Hit description =ABC7 protein [Caenorhabditis elegans]
APSFSISCFLDMXTMFSLIKLESRVVDRIDAPILNVSPPNSQISFRDITFAYIPGKPILRSLSFDVPSGKKVAFAYIPGKPILRSLSFDVPSGKKVALVGGSGSGKSTIVRLLYRLCDPQSGQIRINGQDIAAVKLDSLRRAIAIVPQDSVLFHDTILYNIHYGDSAAPVKKVFEVAKTADLHNAILGMPAGYDTIVGERGLKLSGGEKQRVAIARAILKDAPIIVYDEATSSLDAITEENIMRSLKKAFSGRTSLFIAHRLATIVDADIIYVLDRGMVVESGTHSQLVGVGGKYADLWHSQVGGKYADLWHSQHRIGARQKKREEEEVMLDMELSEGKCCGGMHRIGARQKKREEEEVMLDMELSEGKCCGGMTCNR

SEQ ID NO: 152756 - protein, 159 aa, Heterodera glycines
  Coding regions on vcDNA: vcDNA=SeqID_79179; Strand=+; Position=1 -198,536-817
MNLSRHIPSQAFFPDVSWSNPNQAFFPDASYPLRVSSQAFFPDAHYQLFSSVKIVFNINSLPIISPFGISVANFSIGDEKAGANPPRRARVLAFNKGMDGQRIGRELDTDEEDRHGDSVFSVPNTNPWAGPSKTKKYRKKSRKATRRSGGLPIHQFLNR

SEQ ID NO: 152757 - protein, 224 aa, Heterodera glycines
  Coding regions on vcDNA: vcDNA=SeqID_79180; Strand=-; Position=1 -123,171-268,641-773,800-915,1294-1364
  Homolog annotation: Hit_ID=NP_508644.1; Match level="QueryCoverage =95%, HitCoverage=62%, E-value=1e-32, Identity=39%"; Hit description =ForKHead transcription factor family member (30.4 kD) (fkh-2) [Caenorhabditis elegans] gb|AAA82436.1| For
GDDEKQSNLLIPLALRQSPSGRLTFYAIYEYIMNKFPFYRTNRKAWQNSIRHNLTNRKAWQNSIRHNLSLNKCFKKDPRPYDDPGKGNYWMLDPDFKDEIFIGATTGKLQRRRRPNGIGHNYHHQQYGMLRAERRPAQSPARPSAAAVNAMPAAEQQYGMLRAERRPAQSPARPSAAAVNAMPAAESVRSSDFVPIAAMPEIGNSTLLLHLFIGCKMHLYTKKH

SEQ ID NO: 152758 - protein, 81 aa, Heterodera glycines
  Coding regions on vcDNA: vcDNA=SeqID_79181; Strand=-; Position=1 -68,475-652
MAEGNARVGKRQCGKAEKCAEEYAGEQKHEFIAAKKGIIFAIFWLKFHKFGKIWVTDDGSLKTPYTGTTRIRSPTVTNQEI

SEQ ID NO: 152759 - protein, 57 aa, Heterodera glycines
  Coding regions on vcDNA: vcDNA=SeqID_79182; Strand=+; Position=1 -8,299-464
MHYEALLDSFWLKFKDVGNVLEQNVPLAQIILWAWDDNGAQVIKEVITDQNAVSQNS

SEQ ID NO: 152760 - protein, 64 aa, Heterodera glycines
  Coding regions on vcDNA: vcDNA=SeqID_79183; Strand=-; Position=1-356
  Homolog annotation: Hit_ID=AAG29105.1; Match level="QueryCoverage =93%, HitCoverage=12%, E-value=4e-17, Identity=63%"; Hit description =zinc metallopeptidase 2 MEP2 [Ancylostoma caninum]
QPWCDQPDDFETYLQLIGDSHSPAKFRVFGSLRNFPAFRNAFNCPLNSKYAPEKHCNVWVSPVT

SEQ ID NO: 152761 - protein, 212 aa, Heterodera glycines
  Coding regions on vcDNA: vcDNA=SeqID_79184; Strand=+; Position=1 -251,299-615
  Homolog annotation: Hit_ID=AAG29105.1; Match level="QueryCoverage =83%, HitCoverage=30%, E-value=7e-47, Identity=50%"; Hit description =zinc metallopeptidase 2 MEP2 [Ancylostoma caninum]
PMIISDYIVLIMRFCQITTGSNGTPKVRPTWMDAHSQRAFDRMAKCVVDEYSQLCPFPPDGIVQPACIDGDKTQAENIADNGGLHAAFRAYRSALEVDGPSKALPGGGLHAAFRAYRSALEVDGPSKALPGKLVGRFNHDQLFFLSFAQPWCDQPDDFETYLQLIGDSHSPAKFRVFGSLRNFPAFRNAFNCPLNSKYAPEKHCNVWVSPVT

SEQ ID NO: 152762 - protein, 25 aa, Heterodera glycines
  Coding regions on vcDNA: vcDNA=SeqID_79185; Strand=+; Position=1 -47,123-153
MLPSSFTTISRKVRSRCALSISGKV

SEQ ID NO: 152763 - protein, 75 aa, Heterodera glycines
  Coding regions on vcDNA: vcDNA=SeqID_79186; Strand=+; Position=1 -76,158-309
MDKVTPNFKEEKRTNAIVVPPKDAIVKRNNKTAVIAHLHVFYQKWALFVVKHRTLIMAICSILSTLGAVKIFKTP

SEQ ID NO: 152764 - protein, 119 aa, Heterodera glycines
  Coding regions on vcDNA: vcDNA=SeqID_79187; Strand=+; Position=1 -132,374-600
LVHHQQQQQLATSGLFQRQQQQNFYAERTSNSSSVVTTALLAQHPLVVNMDTNNVAVAGDDNDVAIVEQQQQQQCRNGGVAADEGENAAATKMTATTPVVVEAVAAAHEGQQQPTEPNK

SEQ ID NO: 152765 - protein, 107 aa, Heterodera glycines
  Coding regions on vcDNA: vcDNA=SeqID_79188; Strand=-; Position=1 -66,860-934,1328-1510
MRRSNFVKTQLETLPHIFARAKNDEALEAMNNAQMINPSMSETWLPHCSICSRVGFTCGAFLAFGRSGGIFLRAEEFGKRSEGGQNNGQKQRADSDVSQSEEAKHFH

SEQ ID NO: 152766 - protein, 164 aa, Heterodera glycines
  Coding regions on vcDNA: vcDNA=SeqID_79189; Strand=-; Position=1 -210,435-564,636-789
MSFQELEAQWILVENEFDAKKLSEKLKNNGGNVAEGMPLSSSDCEESFRNALLLKCLIRAGEIGTSYELQAIAFAETDIEDTLISAQIFIAKGQRQLANTQLVNAAKEGEWTDTPNDWRVFYWLSENLLAIGMLEKAKICVEHARKTNTKSELCAKLLDEILEN

SEQ ID NO: 152767 - protein, 48 aa, Heterodera glycines
  Coding regions on vcDNA: vcDNA=SeqID_79190; Strand=+; Position=1 -98,440-488
MPAALSRAASANVRLSIVLHIFATTAPAAMLLRWRRIWQIIKSMPCPF

SEQ ID NO: 152768 - protein, 94 aa, Heterodera glycines
  Coding regions on vcDNA: vcDNA=SeqID_79191; Strand=+; Position=1 -87,196-289,850-953
MFRRMLTKTYTKQQKQQMAKMVKEMLEKKQMKKERGTGKHQIHGQKLSDDEHQLRALPNDDSSKMPIVLIGHLDPEQTNALTKAVIPIGLEKLA

SEQ ID NO: 152769 - protein, 389 aa, Heterodera glycines
  Coding regions on vcDNA: vcDNA=SeqID_79192; Strand=+; Position=1-1170
  Homolog annotation: Hit_ID=EAL51210.1; Match level="QueryCoverage =71%, HitCoverage=26%, E-value=1e-10, Identity=26%"; Hit description =conserved hypothetical protein [Entamoeba histolytica HM-1:IMSS]
MDAPKVPAEEPFNEEGLIAEKVRLLNEIEDLKHRLEETEKRKAEAEKKRSKNNEQRPVDEIVLDMDEEDEEEEEEEEEAPQESKRARLDPLATKEIVQKTINEKWEASGLIMIDPRPVDSKEAPKGVESRDWEDSRRLLTREERDRGWSDFVSTIRKEDRLSVIGKVGLGFNGRRMAGNCIRSAEKSILQSEIIQPEGMRKQIPVRNELEAKETEEELERRKRFAAKTPATQGQFANCVWEETAQNTKEEKMKKIENSICQKINQIQQQMTEAFGGLKELAKEMDELTKIAKKEEMEKAEEFHPNSNRFANTNTSTWRQHDEFRYRNRGTVGRWVNNSRGRGRQRPYHHNWRGNEGWPEMIIHNQNHQQVAHLPLTKDQFKNDSNKYRP

SEQ ID NO: 152770 - protein, 32 aa, Heterodera glycines
  Coding regions on vcDNA: vcDNA=SeqID_79193; Strand=+; Position=1 -19,104-183
MPYVNERGEMQDGASFSIVRSFWSLVYFLAFL

SEQ ID NO: 152771 - protein, 25 aa, Heterodera glycines
  Coding regions on vcDNA: vcDNA=SeqID_79194; Strand=+; Position=1-75
MTVVVTGEEETKSVKKHKEKDEMTK

SEQ ID NO: 152772 - protein, 51 aa, Heterodera glycines
  Coding regions on vcDNA: vcDNA=SeqID_79195; Strand=-; Position=1-155
LQIYWLKLHMKYISKFFDSVRRFDKDGFRFAISRSTFGNWSRIFSAITCNH

SEQ ID NO: 152773 - protein, 42 aa, Heterodera glycines
  Coding regions on vcDNA: vcDNA=SeqID_79196; Strand=+; Position=1 -31,418-515
MQEIAWMSWKDSSKKCQRYVKYLRVCKSQLKGPEFQQMKTSY

SEQ ID NO: 152774 - protein, 137 aa, Heterodera glycines
  Coding regions on vcDNA: vcDNA=SeqID_79197; Strand=-; Position=1 -126,242-331,912-1109
MPLKSYVCDPEEVLSADERQKLAEMLDSFQEQTKNVTKVMLIDGGQNGCKKKGVTGAVALSKKPLYFEINVMQQAVLSANLVVAHSSSMFAHFMLSICSILASVALTLGILWIFRARIFFMRYDIPLVQFNARTMAD

SEQ ID NO: 152775 - protein, 2329 aa, Heterodera glycines
  Coding regions on vcDNA: vcDNA=SeqID_79198; Strand=-; Position=1-6990
  Homolog annotation: Hit_ID=NP_498959.1; Match level="QueryCoverage =66%, HitCoverage=72%, E-value=1e-162, Identity=27%"; Hit description= zn-finger, CCHC type and RNA-directed DNA polymerase  and Integrase, catalytic domain containing protein
MPVMRSPPLTRQRALNLGIQLRNEGIGVAQEQQRVQQQHSDVGNAPLSENENRQSHVSSVSSVLGPDTIHRRLLQIPNPRNDMDAQQNRNDLDEDALLDDHGDSIFGNENPHEQNLGGENVRNAVSVMRSIDQGRVRVDIVDDFGFHPGMTSTPNVVANYQRGEPSFMLNQPPAVHQRNLMLEEQHFRFVAQPNAGERAEPRDQLYFRQAQQPTNVGPQQNAEYHHQYIHQRNFPQFETREPHQQNQRNFVENNQQMRFYGNAAPKFCHDPINVPQTNCQGPVQSPLSNLEYVLILDRLPELKGNEGADKVRYFFKKFVSATEGWPDNKRISSLESKISGRAERAFNAALANQPYRFDAIRRAMQAHLEETDCREMGAFDELMNGVKRKPNESMDALADRVQNVVQRAYPGLTQNLIDEYATKHLIRALSNPELSLSLEMARRPGMCFDEFVALAARAESIQKATKNVSTERQNIDERNRPTQRNFSQFGQQFQTQQKSKFLQSFQPRENIVCYNCNEPGHFSRDCRRRKQNFDYRANQSHAVPATGANSFQIRPNGPENRALPQTSTKESDQRRSQNFLKQNCIIMQEEAPPEVFCRGVQLSSEIEEFFENEFKGKNEEQNEVKSLGRVGKILVIKVETFGAKTEAMIDGGAQISLIGATFLYKLIRENGLDLQKANFARTKDRIADVNGKELQCFGTLTMPILRKGCIEVPIHFYVTSAPFGFDILFGTNSLTALGFSLYDAPNKELIKFEEATKNENAVRIIFNTILQPRTSKFVQMEVGKQWNGQDVLICPVPNKTEIKLEQSVGKVENGKVVCQISNLSSMTEQIESKTIVGNVETLESTWEADNSLLPSKIFRIDHCQNGNKIGEAEQALKIGQIPPEGKDDLMDLLHNFEQIFAFSEEELSQTNLASHHIDTGNSVPVRSRMRPVPYAYREKVSEMIQNYLGRGIIRPSSSPWASPIVIVPKKDGTLRFCVDYRGLNSVTVKDAYPLPNIDNTLLALGGKKFFSTLDFLSGYWQIKMSPDSIEKTAFATEFGLHEFVVLPFGLCNAVATFQRFMTQLFEGLINDFVFIYIDDILIASETWKKHQQHLKAVFERIQDAGLKLKISKCHFAASELPFLGHVLTTEGIKMDVNKVRPVMELPIPTSKKALQSLLGFLAYYRKFIFGFGAIAAPLYSLLKKDTSFAIGKLEKEAINALKDKILDNAVLHFPNFEAAKNEPSRQFIMMTDASKIGIAAILCQPDDNGNVRPIYFASRKCNTYESKYCPTELEALAVRFGAKRFSQFITMLPTRVFTDHRALIHMFKSKTETGNSRVDKWLMQLNSRFILQVEYQPGKKNVIADILSRSPALKCPEPPAKSEISRIAQIKICQIQSSVEEANNRMEWIEKTKQSELNFVYEFLSKRIVPQEPKNKQRLTAFLPNFTILDGLLYKCEADGKLRLFVPFTFREALIRERHSGICAGHMSGKKIYLQLAHQFFWPNMYADCVKIALKCRICAHSRKPRANEPPMKIVQTSEPFELVCIDILSIGPANSSHKYILVAVDHFSKYLVAVPIPNKSADTIANEFVKNFILILGTPKKLHSDRGKEFVNETLNEITKVLKIEKSLTSGYDPQANGITERANQTILGMLKRSTASNWTWDERLPFVVFAYNITPSETTKFSPYHLIFGKTPNFPSEISLPVNPNYTIDVDTYIQLFRENIVQLSEIAQKNSEIARKNMKNQYDQQPKVTANKFRIGERAMVIYPGVNTRSAHRKLLWNHFGPFKILDLTDSTASVIPIDKPNFEPIKVPIERLVKVPEGVPNISTLPRGKNPFKNQLNALISVVCLISREMENEPCGKSAAMEKIKDRETENETTNLGNSQKLEHLGRHLIGQLRTIANSVGGKVMETENSCGPLLWDTQCGGLGIEHRNCVQMTAADLDPVLERAGLGLKVIRKWKKIQNGDECGDFKVIGTPMKALLSNFLLKSNAVSSVAGGRKLTQLIVSAPVGFELITYSGAREDQVKSGNFPTEKDIESAFTAWVERCAVTRDKLLKTGYTPIEVPMPNVVAELPESEKLGWNEVLKKASFVLEKVRATTIHRKPLFVEKPRVIVGDSSAKQLLKMWPKSQFIGTEEGTITEVIRAFDGAILSSKVKAVIVMIGRDSIRGEETIENVLERVGRLEQLLKRFSHAPVFWLPPPFIKEKMIEYEELIIRMKEHFGTAQGNVKFVTTTPAGRSVLELWRYGSGFNTDHVSNDGKMTEKGLLVLRAWVMSQIKGMPKEDEKEESEPKKKSEEGPNGGTSRIGRGRGQFNQSGSRGARHVHQHHPYRRQFAQSFPSRSRFGADRR

SEQ ID NO: 152776 - protein, 270 aa, Heterodera glycines
  Coding regions on vcDNA: vcDNA=SeqID_79199; Strand=+; Position=1 -78,132-865
  Homolog annotation: Hit_ID=XP_319741.1; Match level="QueryCoverage =92%, HitCoverage=56%, E-value=1e-25, Identity=29%"; Hit description =ENSANGP00000006515 [Anopheles gambiae]
MPIWQALSMLAFRPFITIRRSAPHLKEASKVRLLLGKLGEEEYSKYRDTISPTQPDQVNWNDTISHLKQLFAETRSLFVRRFECFKIRQQQGQDISSLIAQINASCENADLSLTKEQLKCIILVIALNDEHHDLRQKALKMLEDSQKNGTNISLKKIEEELRAIQVVKESALSLVNPPIATNAIRTRPRQWADPAQRQSGGSNQKQTPNANSSGKPTRGQPTHPCGSCGKSDHWRSDCTFKDATCLKCNKKGHISTICRQKKAKAPPNSH

SEQ ID NO: 152777 - protein, 188 aa, Heterodera glycines
  Coding regions on vcDNA: vcDNA=SeqID_79200; Strand=-; Position=1 -127,193-632
  Homolog annotation: Hit_ID=XP_309989.1; Match level="QueryCoverage =67%, HitCoverage=45%, E-value=1e-13, Identity=30%"; Hit description =ENSANGP00000015194 [Anopheles gambiae] ref|XP_319667.1| ENSANGP00000022407 [Anopheles gambiae]
EYSKYRDTISPTQPDQVNWNDTISHLKQLFAETRSLFVRRFECFKIRQQQGQDISSLIAQINASCENADLSLTKEQLKCIILVIALNDEHHDLRQKALKMLEDSQKNGTNISLKKIEEELRAIQVVKESALSLVNPPIATNAIRTRCQFKRKANAWSTDASMRIMWQIRPLALRLHIQGRHLPQVQQK

SEQ ID NO: 152778 - protein, 232 aa, Heterodera glycines
  Coding regions on vcDNA: vcDNA=SeqID_79201; Strand=+; Position=1 -108,153-303,639-760,1665-1813,2181-2311,2601-2638
  Homolog annotation: Hit_ID=XP_394369.1; Match level="QueryCoverage =56%, HitCoverage=35%, E-value=6e-24, Identity=37%"; Hit description =similar to ENSANGP00000019163 [Apis mellifera]
MLCPSNALVGGGPSLFGENGTDEYSLNVHGYMTQNHSFIMSAAYSHPIGYYQLIDSNNAPTNQEQIRDEFQTSAIHRAAQQDANGKGRMSLLSSTTKYKVSIGDIQRHINPPECLNASLIGGILRKSANDFNAVLQHDFPAKDIGFFLNAQFLRYVGQSPMDSELVARRRTILNCSRIFIKEITSLLAADRSPICDRRPELMLDPSIQKQLTHFSMAIFMDFIVGSIGHLLG

SEQ ID NO: 152779 - protein, 338 aa, Heterodera glycines
  Coding regions on vcDNA: vcDNA=SeqID_79202; Strand=+; Position=1 -745,3942-4213
  Homolog annotation: Hit_ID=CAE64067.1; Match level="QueryCoverage =94%, HitCoverage=81%, E-value=4e-27, Identity=27%"; Hit description =Hypothetical protein CBG08669 [Caenorhabditis briggsae]
MSVRQKSVRKCRSANVGPQMSVRKCRSANVGPQMSVRKCRSAKVGPQMSVRKSRSANVGPQKSVRKCRSANVGPQKSVRKCRSAKVGPQMSVRKSRSANVGPQMSVRKSRSANVGPQKSVRKCRSAKVGPQMSVRKSRSANVGPQKSVRKCRSANVGPQMSVRKCRSANVGPQMSVRKCRSANVGPQMSVRKSRSANVGPQMSVRKSRSANVGPQMSVRKCRSANVGPQMSVRKCRSAKVGPQMSVRKWLDESGYLGKTGSGYFRVQKSRVRVQVFKPGTGGRESGRGTESGRESGRGTESGRESGRGTVSGRGTESGRESGRGPESGRGRKEEENEK

SEQ ID NO: 152780 - protein, 82 aa, Heterodera glycines; identical to SEQ ID NO: 137111
  Coding regions on vcDNA: vcDNA=SeqID_79203; Strand=-; Position=1 -88,213-373

SEQ ID NO: 152781 - protein, 35 aa, Heterodera glycines
  Coding regions on vcDNA: vcDNA=SeqID_79204; Strand=-; Position=1-3,72- 176
MVSIWAFIYEIDQKIKKDEQTDFHYVILILFFDLL

SEQ ID NO: 152782 - protein, 164 aa, Heterodera glycines
  Coding regions on vcDNA: vcDNA=SeqID_79205; Strand=-; Position=1 -69,136-361,419-618
MNYLLATILIQQFIILVCGANEKEIITLHEFMCKELTENDEANLYRNTKDWQHIKTIIHNEQIMDKFETLIEWQIRYSSIERWFNYCENLKTYINSKNVNGEALLMSISLKPKFTLPNRNGILPIAKAMANIVEAYKNIFMGNCEKIFRNCYKKIIKQEEILQK

SEQ ID NO: 152783 - protein, 388 aa, Heterodera glycines
  Coding regions on vcDNA: vcDNA=SeqID_79206; Strand=+; Position=1 -167,409-614,661-791,937-1149,1748-2194
  Homolog annotation: Hit_ID=CAE66724.1; Match level="QueryCoverage =87%, HitCoverage=85%, E-value=3e-69, Identity=27%"; Hit description =Hypothetical protein CBG12070 [Caenorhabditis briggsae]
LPKIVKALLDQIVAEGEELTFEVQVAGEVDQIRWLKNGQPLDKDGRVKMIKVDEQTYRMTIPSAALSDAGEFEVQAINDTGKAVSSAHAEVDQAPRIVQGLVPADIAEGDEQVFRVETSAPIRTVKWFKNGREIEAPPGARIRLKDVSPKKYELLIDDAQLDDGANYKVVLSNRAGECESSADLGVCKPSVFKLRSGLQDVTIDEGQPLELMAELDGEPAAVKWFSNGEEIKPDKRIKIATASNEAGQAETKCQVKVLTREPEPMAPKFVIPLRSIEGTPGERAEFTVKVRGVPTPELQWILNDAPIDFAREPRFKLEDMRDGNWAMTIHRKALISYLGYVPYTHTVHPLHPQFYRISQRPTLALCAVWLSIRSDAMSASPTSTQRGL

SEQ ID NO: 152784 - protein, 137 aa, Heterodera glycines
  Coding regions on vcDNA: vcDNA=SeqID_79207; Strand=+; Position=1 -32,1227-1608
  Homolog annotation: Hit_ID=XP_319741.1; Match level="QueryCoverage =91%, HitCoverage=28%, E-value=1e-11, Identity=30%"; Hit description =ENSANGP00000006515 [Anopheles gambiae]
MLWKEKMFNVNLDTTVKKLEKLFVKPQSIFIDRFECLIARKGKGEDFRSFVNRHKRLITDFKFSDLKEQQFYVLMLLTALKSHGDAMLRQRILSKLTADGDNITYDAVVEDCMKFMTTIAENKVIESSSSGSQRRKP

SEQ ID NO: 152785 - protein, 53 aa, Heterodera glycines
  Coding regions on vcDNA: vcDNA=SeqID_79208; Strand=+; Position=1 -36,594-719
MRGMKFLLAFLIIFDAGKYFEVIIEESEPNETISSQVKAMSELKMDDPEKSFT

SEQ ID NO: 152786 - protein, 31 aa, Heterodera glycines
  Coding regions on vcDNA: vcDNA=SeqID_79209; Strand=-; Position=1 -45,172-222
MLSNLGLDTQFQMEKFSPHIPFLETFCHLLL

SEQ ID NO: 152787 - protein, 247 aa, Heterodera glycines
  Coding regions on vcDNA: vcDNA=SeqID_79210; Strand=+; Position=1-744
  Homolog annotation: Hit_ID=AAO50779.1; Match level="QueryCoverage =34%, HitCoverage=5%, E-value=2e-10, Identity=38%"; Hit description =similar to Mus musculus (Mouse). Sex-determining region Y protein (Testis-determining factor) [Dictyosteliu
MSHTDLPPKAKAQRGLPQNGFQFDALKWAQVHQLIPPPTVLYPNPQILRTAVVVPINQQSCSSSSVNGVQLMPTNGEMIVTPCQQQQPQHQSQPEHQNHQQQQHQNQQQQPQHQIQQQHHQMHQNQRQRAIEGESRFTPRRFGPNRSHPYGGRTTASHRFIREQRETQLPINWPWNPLPRIQIPVEIRRVLLRRLAQEREHAFGLAGVMRQWNPPMALLLLSMEAFYSTLLAFVVNEGEPGPSLPQL

SEQ ID NO: 152788 - protein, 80 aa, Heterodera glycines
  Coding regions on vcDNA: vcDNA=SeqID_79211; Strand=+; Position=1 -117,177-302
MTFSSSVVLLLPVQLLLVVIGAVFIILSQCCGGGSKKKKPKAGAAVPTPQTSAVGGPPGAAEAPSSVSCARLGFCGWPAR

SEQ ID NO: 152789 - protein, 180 aa, Heterodera glycines
  Coding regions on vcDNA: vcDNA=SeqID_79212; Strand=+; Position=1-540
MVLVSEFCAQFLSCPTKSLRDRLNHPEDRVRVLQQLIGKKVQTTYKDRNGMRKCFFVGGMTERGAAFEPAYGRLRKPFNINVAAHFYARHRVKLHYPYVPCIIEGFIHGEDRYYPMELLEIVDDKKGGRLFGRLFTEIEEQEEEDTKSECSHSSNTSIYNVTVKDAHGMKALTKLPPLGV

SEQ ID NO: 152790 - protein, 233 aa, Heterodera glycines
  Coding regions on vcDNA: vcDNA=SeqID_79213; Strand=+; Position=1 -128,179-308,357-466,529-589,663-935
MDTFEEFVIVNEKSFTDILLTFGYNRGGISEIKFSDVTQFAALEFQLDYAKSLEIKHIGKTAREILPLAQIIRWQWDEKGSQQITDTQILTTEGSVRFHCLDYLGSIVVRILKKKDDSHTAENPFQSLNSPDDDFMVEIGDRKVALSASRLRCFSPVIDRMLSVEMREKQQRSVTLNELSIDMDQFLDFLLYISPNALSQPILPNRKIENKNKLQSANILLYDSNNLIYEIIV

SEQ ID NO: 152791 - protein, 55 aa, Heterodera glycines
  Coding regions on vcDNA: vcDNA=SeqID_79214; Strand=+; Position=1-170
DFVRLSVSLLLPGDRSDAQRGDEGEAATIGHFERIALTWTNSWILFCIFLQRRFR

SEQ ID NO: 152792 - protein, 381 aa, Heterodera glycines
  Coding regions on vcDNA: vcDNA=SeqID_79215; Strand=-; Position=1 -360,411-580,620-746,1079-1224,1268-1607
MASKIETKKQQVKLPHEGHLYIFDKMSVNGAIKFWVCEFKDSVNKCKGRLWTDLNNHFIRLSTPHTCPANASNVEAQQVKTTIKLRAITTLEPPSVIRSEALQNVPSPAAILVTKRAANDLIKRARHEINAPPAVPTNLNFEINQAYRTYTSTEGVEELFLLGDSGVYFENGKTPQRILLFGRDSFGRFADRMNECFGDETFSLAPAQFSQIYTILAKSRYCSDPVFALNVRMLTSVAFVPLCDIRNAVTALDMEFGNLVAFRPLIDWLLDNYVGRPRPNGTWSQPLFRPDQWNVYQRTLDGNARTNNNAKAEHHRLQGAFNCRHPSLWHFTDVLRREQKIADHKYNSAIAGLSPEKKRGKYLAADRRILNMVRNYIPLNA

SEQ ID NO: 152793 - protein, 147 aa, Heterodera glycines
  Coding regions on vcDNA: vcDNA=SeqID_79216; Strand=-; Position=1 -7,461-897
MCAFLLKRRPRTYVITIPTGGTLIQVYVQPKEKPTHQPIVQIQFDVKNLPRRKPVSADDEEDRSDDEMDDDEEDDMYSPKQQKEACKQPKRLEDGTLKNALDKDDMNNVPDALKINKGGGDVQQIRGTTKLKKYNVPDALKSNKGRR

SEQ ID NO: 152794 - protein, 24 aa, Heterodera glycines
  Coding regions on vcDNA: vcDNA=SeqID_79217; Strand=+; Position=1-97
FDNVLNAISNLDGNFENKQIISQI

SEQ ID NO: 152795 - protein, 58 aa, Heterodera glycines
  Coding regions on vcDNA: vcDNA=SeqID_79218; Strand=-; Position=1 -93,209-292
MPNPFLFVLFTCPLSVIWATRKSATRNTFEKKQGWSEDRKLTRSRSPDPNCCVALHPW

SEQ ID NO: 152796 - protein, 171 aa, Heterodera glycines; identical to SEQ ID NO: 148614
  Coding regions on vcDNA: vcDNA=SeqID_79219; Strand=-; Position=1-516

SEQ ID NO: 152797 - protein, 36 aa, Heterodera glycines; identical to SEQ ID NO: 132129
  Coding regions on vcDNA: vcDNA=SeqID_79220; Strand=+; Position=1-110

SEQ ID NO: 152798 - protein, 367 aa, Heterodera glycines
  Coding regions on vcDNA: vcDNA=SeqID_79221; Strand=+; Position=1 -174,438-560,619-958,1014-1480
MTKYQGNLKNVNVQNAKNRKDLDILYEYLYREYAGIPTVKPKFVFKNEIEIEGPIIYAEMFKKAEEKAKKDAPSWKANKINDDKHEIILDTKFDDQKTLIEDALFSEFVKGLATNWNKFFEMAKEYSNYLSRRKKQRNFYGYYDEQRMISYGLDEIDKMKEHLTQKYEAHLGIMYLMRETWQCEKIVDQLTKYKRKEYLDILFEYLFRLYVEAKNPKVSKQLPPLVKPIFIMGVTSQGYSYRLIEIIETLNTNSKLFWEKDEYATLKFELVNEEELNFENKEEKNLFHKNIQKGKQILKGPTDIEERIREEFEQKMKKMYENAKENAKEEKAKMEKAIEKAANIDEKGALKDEYNEKFGTFISSPFL

SEQ ID NO: 152799 - protein, 281 aa, Heterodera glycines
  Coding regions on vcDNA: vcDNA=SeqID_79222; Strand=+; Position=1 -62,145-279,354-569,656-842,892-1062
  Homolog annotation: Hit_ID=CAE64717.1; Match level="QueryCoverage =98%, HitCoverage=98%, E-value=6e-77, Identity=54%"; Hit description =Hypothetical protein CBG09503 [Caenorhabditis briggsae]
AKYKAFRLENKVAVITAATNGIGLAIAERLIGLAIAERLGHEGARLVVSSRDEDNVKRAIDRLVSSGLKRSDLAGHVSNSEDRSRLLKLTIQRFGSVHILVNNAGINPIFGDLLDVDESAWDKLFDVNVKAGFMIAKLFAPEIEQSGGGSIVFNSSIGAYRSPQGIAAYGITKTALLGLTRALAESLAPKGIRVNAIAPGIIKTKMSKALWEGIERSSAEAIGTLLWEGIERSSAEAIGTLMGRLGMPEECAALVAFLCSSDASYITGETVPVAGGAYSRL

SEQ ID NO: 152800 - protein, 152 aa, Heterodera glycines
  Coding regions on vcDNA: vcDNA=SeqID_79223; Strand=+; Position=1 -134,188-289,338-493
  Homolog annotation: Hit_ID=NP_509854.1; Match level="QueryCoverage =98%, HitCoverage=36%, E-value=6e-50, Identity=68%"; Hit description =phosphoribosyl pyrophosphate synthetase-associated protein (39.0 kD) (XL693) [Caenorhabditis elegans] emb
TSFLTAQVAKEKPPLTVVGDVGGKIAILVDDIIDDAQSFVAAAEVLKARGAYKIYVVATHVLKARGAYKIYVVATHGLMSLDAPSLLESSPIDEIIVTNTIIVTNTVPHEMQKLRCHKIKTVDISLLLSEAIRRIYNNESMGPLFRDLTIDD

SEQ ID NO: 152801 - protein, 160 aa, Heterodera glycines
  Coding regions on vcDNA: vcDNA=SeqID_79224; Strand=+; Position=1 -34,279-560,947-1113
MAKISLFLAKNDQSVHEGGADHATAPTPQCRPVHRCGGWPGAPDDRHGVGDGPPALFGHEQATSAQRSRQTLHVPRSSRRTGPHPLEGHHPLRHRCQELPLRGRHENEGPEDSLPPDCATGVRHAAHLGLEAQQPLLNGRGVRLAEATHRRRRKKDEESA

SEQ ID NO: 152802 - protein, 50 aa, Heterodera glycines
  Coding regions on vcDNA: vcDNA=SeqID_79225; Strand=-; Position=1 -56,125-203,244-261
MDILTPAKKRKDKWTKVKCLLTKMGILTAVKKRKDKWTKTDKWTKVCEQL

SEQ ID NO: 152803 - protein, 168 aa, Heterodera glycines
  Coding regions on vcDNA: vcDNA=SeqID_79226; Strand=-; Position=1-507
MEWAEMPAEWLLPSMLHVLSNRELSSVANGSEIEMDSKLREEAEKGAKQLAFVEHVPELCDYLPSLGRQQVATPPKKAIQDEHSVGIWHKPSHRRIANDGESGRRIAEEKFNEDEHRTVQLRKVRSGGRLNRPSIPFPGSEGKNGEIKRSERPKGRTTYSVRISVTYS

SEQ ID NO: 152804 - protein, 205 aa, Heterodera glycines
  Coding regions on vcDNA: vcDNA=SeqID_79227; Strand=+; Position=1 -132,255-739
MADDDLEDKYVALKAKVQDLEDRLANRVPNYLPPGVKFRNMMRANISADKKTNWRTLTSEIAELTKKLDGPMWARKMLNKTKMGINGSVTEFANKIRELVEQASPDPNYTDEARESESVHYFLNGLPTKLKRKLFVMEKPDSLIEAIAQAKKVIQVNEEIEKDEKGDEMKQQIAELTEQVNAISFQSKVNNERNGHENGREFVNP

SEQ ID NO: 152805 - protein, 339 aa, Heterodera glycines
  Coding regions on vcDNA: vcDNA=SeqID_79228; Strand=+; Position=1 -693,815-1010,1189-1319
MGHTMKRLTENLWTTERPSKVEYAWIGERCETTVNDFIEKGQGGILDFYLVTSFGYNFNPYNGWEEGQKWTFIWEIPEPSEAYWATHFPVGDFVAEVTENAIVLESEQSVFYFEKEKGDEREGIVGVPDEAYKMSNDVFILIHTPSPQKAREKRETKQKSEPQRKERPAKQEVFLKIRPDQNSKFENLDPASRPKSNWTRTTLGPKRNTTELIILSTPVPQSTSTVGSTTKSVYKAVGKKVKQLVATTTKAPFTTTKKSKIENTLKKATPKPKIVGLKSTTLKVLSTVRPSTKKVVKIPARMTPIPPTTQKIVEKLELPKEKGEKKSDSIKAEKKMKSY

SEQ ID NO: 152806 - protein, 76 aa, Heterodera glycines
  Coding regions on vcDNA: vcDNA=SeqID_79229; Strand=+; Position=1 -156,292-366
MEEFENSFEDESDEEVSVELFDENEIFDMERRKRTTVTTPDARWIKKVEKSKLQLAKAVLQINPNEGVKKYLIETI

SEQ ID NO: 152807 - protein, 74 aa, Heterodera glycines
  Coding regions on vcDNA: vcDNA=SeqID_79230; Strand=+; Position=1-225
MTEQHFGINCVDLELPMDISQFTVNVSATLFDLSCEEFLKKPDLDELPDYYLQVSKRWQLDACEMVPTVMRCKK

SEQ ID NO: 152808 - protein, 60 aa, Heterodera glycines
  Coding regions on vcDNA: vcDNA=SeqID_79231; Strand=-; Position=1 -34,106-254
MTINFWHWHKMQMELFFLRHSEYERLFNCTGLDIDSIPLERRQNVPESIAVCVLCTIYYV

SEQ ID NO: 152809 - protein, 61 aa, Heterodera glycines
  Coding regions on vcDNA: vcDNA=SeqID_79232; Strand=+; Position=1 -27,486-644
MGRSRLSDQMLIGLREVSAKLRSDIKQNGPCNIDLSKLISVLNGSSISMLLFGHPLEEANN

SEQ ID NO: 152810 - protein, 132 aa, Heterodera glycines
  Coding regions on vcDNA: vcDNA=SeqID_79233; Strand=+; Position=1 -306,630-675,1222-1268
MDPASPAAQSLSGSNSQQPPLKTHGVMRAGTIGSAAGTAFTQPQQQQQQHVQQLFQQQQPPSAFSAPNTPNQQQQNISQQQLTPAAAQLGTANSPCPLGIEEVCKLPRLSLNGVRFKRRRCKKVGGEEPAEE

SEQ ID NO: 152811 - protein, 222 aa, Heterodera glycines
  Coding regions on vcDNA: vcDNA=SeqID_79234; Strand=-; Position=1 -67,270-403,496-589,634-775,1009-1098,1143-1186,3277-3297
  Homolog annotation: Hit_ID=AAA93489.2; Match level="QueryCoverage =98%, HitCoverage=56%, E-value=8e-59, Identity=52%"; Hit description =Hypothetical protein F36D4.5a [Caenorhabditis elegans] ref|NP _741591.1| apoptosis-related protein PNAS-4 l
MPTEFFFQVLSYLSSSCSTCPVLATAFKRWLVRLFSNVYDMYKLNDIVFSSLGIGVFHSGIEVYDTEYAYAYGGHPFPFSGIFENTPRDAEELGENFNFRESIPLGETDFSAEDVNKESIPLGETDFSAEDVNKMIQNLGQEYRGDSYHLITKNCNHFSAILSKVLTGQELPPWINRLANISGSLPFVERWIPQEWLTPIAEWLTPIALQQSLDSRERGFTS

SEQ ID NO: 152812 - protein, 112 aa, Heterodera glycines
  Coding regions on vcDNA: vcDNA=SeqID_79235; Strand=-; Position=1 -34,80-301,350-528,575-699
MVDDFVKKTISVPPRNYPKNRSPSSDSSFPVSHPSTRSNSRNSRKTSPPTRKRRLKHNISQGKRTQRQTKEAHLSKQTMECAKAIGLDSDYLRKIEEQKKLREEIARKKNQH

SEQ ID NO: 152813 - protein, 91 aa, Heterodera glycines
  Coding regions on vcDNA: vcDNA=SeqID_79236; Strand=+; Position=1 -147,721-849
MKTCWRFFLIINEIVINSDQISNLMLLRWCQLREQAAPRVPPLCHNSLKAPNAICCRVIWTNTCGANLMEKTIAAYENIFEQIAQFYVVNA

SEQ ID NO: 152814 - protein, 102 aa, Heterodera glycines
  Coding regions on vcDNA: vcDNA=SeqID_79237; Strand=+; Position=1 -37,220-491
MISNYLINHIFFGRTSKGPTKRRRRLQTGSEHKQKCHIQLGFNFPKSFAGEQMGRAGQIAHRRNPRAQSLPHGRTSPRVGAVFAADPKLVLCAANGNAHLDI

SEQ ID NO: 152815 - protein, 375 aa, Heterodera glycines
  Coding regions on vcDNA: vcDNA=SeqID_79238; Strand=+; Position=1 -642,892-1377
  Homolog annotation: Hit_ID=BAA76676.1; Match level="QueryCoverage =76%, HitCoverage=97%, E-value=6e-13, Identity=27%"; Hit description =polyubiquitin [Bombyx mori]
MSHFGVSLLPIGIGLIIMLILLIPSSTDGMKITLRVEMGERWIVKQMKDNPFFTFEVEGTDSVATLKKKIKDKIKEYTGRSFSLALQTLRLNKFGLALEDTKTMQEYGIKDDQTIIVCTLGEFQIDVKYGKKRHSVNVKDTDTVATLKGRIENIKEFGNIPHEKQILIGDGVIVFKNSETMDECRIKKGDTVTVSWEKFEISVKYDEKEPINVEVKFGEKEWSVEVKATDYLSQLKEKIKDLTGISIERQKLHLNRRMLFGHTMMFNDIVKGDTIFLEDVFEISVKYQFSIPYSVFDFCKVEVNAGDTVKIVKEKIKAMIEENWERCGKLVEMELRKNDRFGEVLDNYNETIEKAGIKKEGDTIYVKCAFPPKSA

SEQ ID NO: 152816 - protein, 68 aa, Heterodera glycines
  Coding regions on vcDNA: vcDNA=SeqID_79239; Strand=+; Position=1 -79,143-270
MRSVRCSIVSFGAEVFAFKRLCATTEALPWTNSIWSFCLTNMSNRRPSNAVRVSRTQSSAWAFPNSAA

SEQ ID NO: 152817 - protein, 292 aa, Heterodera glycines
  Coding regions on vcDNA: vcDNA=SeqID_79240; Strand=-; Position=1 -306,416-462,497-868,935-1017
  Homolog annotation: Hit_ID=CAE74499.1; Match level="QueryCoverage =82%, HitCoverage=72%, E-value=6e-41, Identity=39%"; Hit description =Hypothetical protein CBG22250 [Caenorhabditis briggsae]
DRPQHRTSTLGEMAAAAAVGNASASAILVNIARALFVRALLMAHSLLCIWAAAETQGDNSVWAFALLAVCLVGEGFYAVVVRAGDDPKWFSPAVLLYLFATVPVPPLWLVHASMCPTAATCPPSVPRPPPLRRSTCPPSVPRPPPLRRSVCSPTRARTRKQLLGHSLFLALLLTRWLLPRAELSREELTQILLAYAAVVTDILEFVGLLNACAVCADPTLQTAVLGAWTLSLAQFALVLTASRARKMRIALATKIIQRMARKIRKQRMARKIRKRRGYCTFATVLLLGQFLA

SEQ ID NO: 152818 - protein, 30 aa, Heterodera glycines
  Coding regions on vcDNA: vcDNA=SeqID_79241; Strand=+; Position=1-242
ARGNIKGIFVFSDPENPKNPKLNSFCFYKF

SEQ ID NO: 152819 - protein, 260 aa, Heterodera glycines
  Coding regions on vcDNA: vcDNA=SeqID_79242; Strand=+; Position=1 -255,306-660,767-936
NFTQPNEFEDQIGHQLTCQSIATDLAHLQIAIPSTSNVFAAIEQHELSVVEAAEDVTLERISSLKSRLAKVDLDTAQTGPSSTQKVDLWALLKKKRTILARDESSEEEARASLREMALIDDELGDELKGNAEFEKLSRQWTSKKAELDRLMILNDQLKRICGRLDEGQGEEANAEELETELDALARSLATTALAHSDNGTSAAAFPLHRQFIRRVETIKKRIHRRMAEEQRQQRHALMHKIEALKMSPEGDLPVALEVAE

SEQ ID NO: 152820 - protein, 93 aa, Heterodera glycines
  Coding regions on vcDNA: vcDNA=SeqID_79243; Strand=+; Position=1-279
MCAFKALFEKCMEKAQSEKQIEGKETKKTVEIQNKMNLNPFKSVKQLELNALKTQILGAVPELFEAQTNARISVPDIDLQRMLDQILGDSIGP

SEQ ID NO: 152821 - protein, 316 aa, Heterodera glycines
  Coding regions on vcDNA: vcDNA=SeqID_79244; Strand=+; Position=1 -87,331-363,412-546,605-824,871-1076,1248-1330,1379-1492,1922-1991
  Homolog annotation: Hit_ID=CAE63823.1; Match level="QueryCoverage =93%, HitCoverage=47%, E-value=4e-19, Identity=30%"; Hit description =Hypothetical protein CBG08374 [Caenorhabditis briggsae]
MGEHPNDMSIEQILDKESEEKARRIAEKQIIQTLQKADNGTIQKLRLSDDLPNLLEREEAELKAELACMELNGTEKSSTTTDEPKPNSHSPYDDVVENHRFDIHFESNGPSVQPTTSSAAGATNRPPTDGKIRQIASFPHLKQSPFLSNGREEQLEFYDNVNSFCPFESNGRSPNNLNYNVKNGRQTDDRPTPPPVPEKPAFLRRTVSNTMVMNSSNDANNSSKIIGSIRTYIPDSEVEKRQSQIFDQLREQRERLEREAEEEARREQTQWEEQQRRAREAEESIRRIAQKARSSNGFVRRSWANGHKRNRLFGSM

SEQ ID NO: 152822 - protein, 151 aa, Heterodera glycines
  Coding regions on vcDNA: vcDNA=SeqID_79245; Strand=+; Position=1 -75,464-535,1856-1938,2818-3042
MTARRLASAVWRPSPDSVLNPSHPLNSTYWPGRSLTNTIIAYFDKNYTQPKFYKSFRLSGPQKQAVKDGKLKSVIKIVPKKNVATTSLSRTEQHGLKGKERSLLDAAKWGRRVLKGLNVVGVVSDCGKVILVCKEKGLSEAAGTTVGIVVE

SEQ ID NO: 152823 - protein, 21 aa, Heterodera glycines
  Coding regions on vcDNA: vcDNA=SeqID_79246; Strand=-; Position=1 -59,189-195
MSHPNAFRHSKCIEAYDQTES

SEQ ID NO: 152824 - protein, 119 aa, Heterodera glycines
  Coding regions on vcDNA: vcDNA=SeqID_79247; Strand=+; Position=1 -94,197-462
MIIFWMSMLVTVTSKFFGPNCLIINYKSDGSVNPPPFFYFEMKTINVKKYVEMQQYCISCEHLFSSEFLSVVALIWPLGGLFSQRMDFVWVGYFFIIKLFFNKSLSDLFYYEISVMKKE

SEQ ID NO: 152825 - protein, 304 aa, Heterodera glycines
  Coding regions on vcDNA: vcDNA=SeqID_79248; Strand=+; Position=1 -785,1552-1610,2623-2694
FTHRRRRTAAASDRGGRAQQSEDGGGERVTDEGRAAGGGRGQQPTTEAARRRRRRSHKQRPTGERPPTVDNNKKTAQRTGRLLVSQPSIDHHRPATGRNSGAGDSDDRKEAAEASGGGRGAPQLMRCWWWLCCWGCWLAIPSTIVIIITTTFTSTTTAADGDYSLVDHEQEQKQQQHHHQEEEGSNAFKSLFLLAVDKDHQQDKEFLLNDDDDNNQHHRVEEQLPLLFIVGSTVGTALHRLLLSIARTTPMGWPDWLQPHIDAFVLWVNGLLEYWHLGYLETNKNGLTSFCTDQRPRGVGLFGH

SEQ ID NO: 152826 - protein, 173 aa, Heterodera glycines
  Coding regions on vcDNA: vcDNA=SeqID_79249; Strand=+; Position=1 -111,459-867
MVTHLGKPLNFEIGDAAMTDGRPPVSAEQIKRAVRDAVDVLIQRHQRLPGSIWRAMFQRIGAKRTTPSGLDDGALLPADAEAARKEWRRRHRRRTDREDNELQQNAEDDDDKDGTIDQSRRGHFGTAVMVRDESSIVVDALSPSDKELAEVPLLLPSSSSSSSARHADRRFGD

SEQ ID NO: 152827 - protein, 195 aa, Heterodera glycines
  Coding regions on vcDNA: vcDNA=SeqID_79250; Strand=-; Position=1 -87,420-592,743-903,1963-2129
  Homolog annotation: Hit_ID=NP_740784.1; Match level="QueryCoverage =42%, HitCoverage=54%, E-value=5e-12, Identity=47%"; Hit description =diphosphoinositol polyphosphate phosphohydrolase; nudix (nucleotide diphosphate linked moiety X)-type mot
ESTEEAVLRELREEAGIRGKVLFCIGEFVDDQRFHHTTLFFLTVREVFTEWGENCENGRQRRWMGMDEARKSIKHNQRDMLERSIKIIEQTLGEQLEPSVSKCLSAVPVVSLRAAEDGIGIQQQQQKQLSPPSTAKSTAQVLVTYHHAFVVLNNFSSSTAAVSQSVSTDRSHRSSAICDSQKETAMEQNGTTIGG

SEQ ID NO: 152828 - protein, 48 aa, Heterodera glycines
  Coding regions on vcDNA: vcDNA=SeqID_79251; Strand=+; Position=1-145
LLKNLICQVPFRRCYGTLIQPTPFICERMQHDPKLKEKVERVQKEYEV

SEQ ID NO: 152829 - protein, 57 aa, Heterodera glycines
  Coding regions on vcDNA: vcDNA=SeqID_79252; Strand=-; Position=1 -60,114-149,255-328
LGKPFKASTTAKKFEGIVAMSASFPLRFGVLLDMLRVFEPLLPRFSKLRGLCKTRLP

SEQ ID NO: 152830 - protein, 213 aa, Heterodera glycines
  Coding regions on vcDNA: vcDNA=SeqID_79253; Strand=-; Position=1 -129,185-315,562-724,771-988
MIFTIAPSVALVAFLFFPNFFLYVCFANTHFLANHQSGAIDSVSDSPFQIRQPHSLPDLLGQLEWIRELTAIRTFIRDKQVRTIFASIHSTTETLKMDFLSRMFPNDELGNSQQSLSEEPNCAHLTGTTEERKANEVSTTKEFRSFVSEYQLARLSEEQLHHLGLFLAQKLTANDEKSRELALYYAHFYWRIRGDPLKSQQCLRLYLKRRPNC

SEQ ID NO: 152831 - protein, 212 aa, Heterodera glycines
  Coding regions on vcDNA: vcDNA=SeqID_79254; Strand=-; Position=1 -258,598-640,974-1311
  Homolog annotation: Hit_ID=XP_317693.1; Match level="QueryCoverage =78%, HitCoverage=21%, E-value=1e-09, Identity=31%"; Hit description =ENSANGP00000002326 [Anopheles gambiae]
PIILPSLIFDQQQHSAQNRSIHRRFTTSTTSFTTYPAQPPSYSIEPVGQAMPSLSYPIGPPQPPVPPSYPTVPQAPFAGTTSPTAFVHAGRAARHVVVERPCCLSLIINCPNNNCNCPPSSCFPYTHSGGCSATEPCPIPPYLAGTGGYPIGMPPKFPAIFPPMPNYPGIPMPNYYPTMPRNPGIIYPPVGATNYPIIPPLPYAVSPLPNYP

SEQ ID NO: 152832 - protein, 34 aa, Heterodera glycines
  Coding regions on vcDNA: vcDNA=SeqID_79255; Strand=+; Position=1 -49,1146-1201
MPLDSLCQQKALAALLVPLLLRKKLNGYFYRSTN

SEQ ID NO: 152833 - protein, 93 aa, Heterodera glycines
  Coding regions on vcDNA: vcDNA=SeqID_79256; Strand=+; Position=1 -88,161-221,292-424
MLIKKGSNTKLIRSLLHGDLISPFWLGTREHKILYNIQKTACLYDLYRLRHRNKSRRISAGLNRRPTIPKACGSTFADRHYRFWAIKVYSGEN

SEQ ID NO: 152834 - protein, 17 aa, Heterodera glycines
  Coding regions on vcDNA: vcDNA=SeqID_79257; Strand=+; Position=1-66
HKHLFDLFYHIHNLIKI

SEQ ID NO: 152835 - protein, 262 aa, Heterodera glycines
  Coding regions on vcDNA: vcDNA=SeqID_79258; Strand=-; Position=1 -157,235-429,537-645,703-1031
  Homolog annotation: Hit_ID=XP_312385.1; Match level="QueryCoverage =62%, HitCoverage=25%, E-value=6e-23, Identity=40%"; Hit description =ENSANGP00000012175 [Anopheles gambiae]
NENTQLNKEKCEENATASEDPLHIFDLLSITDTRIPELSARAGQPSPYLILQEYLKRCSTYGNTTIQLTTRRLRHQRHEFALSVGGNNSERVRVVSTNKREGKQKAAQAMLKKLHPNNSTWGSLLRLYGYEAQMKLKEARKCKDSVTKLQGISDEKWQEGKATGEFQPNTIILKKLQSEMLKLSEGIISQQKDTKIMPNCQQTIERLLEKEESGEPTAKLRRSDFHSELPILTEEQLRQLSSKLAIKYPNDEELVHIPSLKS

SEQ ID NO: 152836 - protein, 64 aa, Heterodera glycines
  Coding regions on vcDNA: vcDNA=SeqID_79259; Strand=-; Position=1 -60,177-310
TVEGDANILCKLSAPSVKVKTEVDLHNSQLNADQLYEYAKNCFKFKNICVLRFRKWSEARNFYK

SEQ ID NO: 152837 - protein, 154 aa, Heterodera glycines
  Coding regions on vcDNA: vcDNA=SeqID_79260; Strand=-; Position=1 -209,803-989,1051-1116
  Homolog annotation: Hit_ID=NP_495141.1; Match level="QueryCoverage =54%, HitCoverage=17%, E-value=4e-14, Identity=45%"; Hit description =cell-derived chemotaxin 2 (2G83) [Caenorhabditis elegans] gb|AAA68720.2| Hypothetical protein K05F1.5 [Ca
MAKFRLIVRWEGAERRRGQRANVCRIREFGSTAEANGRVSQQCQCQGGDNGRMGTVGQSMLIVNNGQLEGPIEGEVIGRVRLSASSNSQSYSGCANEGIFVVGTGKWTDYEVRIYNARFRESLALGKQHIEQGQHIGHRLDCAGEEVVQSVFME

SEQ ID NO: 152838 - protein, 118 aa, Heterodera glycines
  Coding regions on vcDNA: vcDNA=SeqID_79261; Strand=-; Position=1 -171,231-246,290-459
  Homolog annotation: Hit_ID=NP_507909.1; Match level="QueryCoverage =100%, HitCoverage=33%, E-value=3e-41, Identity=63%"; Hit description= heterogeneous nuclear ribonucleoproteins methyltransferase-like 2 (39.8 kD) (5U738) [Caenorhabditis eleg
EVDLYTVQVSDLAFETTFSLRVIRNDYVQALVTFFTVEFTKCHKRVGFSTAPDCKYTHWKQTVFYLYESLTVKKNEEIHGVFSVVPNVRNPRDLDFRIQISFHGDLCDLDEDNTYIMH

SEQ ID NO: 152839 - protein, 172 aa, Heterodera glycines
  Coding regions on vcDNA: vcDNA=SeqID_79262; Strand=+; Position=1 -118,224-352,563-663,848-1019
EIHKLRKEREAQAKERRTQRRRERIEQSTVWEQLTRTFTAGSGDDDSDEDNAAEGAAERWKMEPISLFQRVTTALSTKAVNMAAMLYLGIDLLLCIVFLAVQMVGAHWVQLSDIFRDCRLPIFLRVGFPIQSRDSYFQNFVGLGMPSLLFTYVPFSEQQMSCNRTDGDGPPK

SEQ ID NO: 152840 - protein, 77 aa, Heterodera glycines
  Coding regions on vcDNA: vcDNA=SeqID_79263; Strand=+; Position=1 -104,466-594
MPSEVNAAALVLFAMKLFFGLDGEEDKQQSRDGTNEATQCADDDSPSPVFSFDHWLLQLQLRMHCWQGTTVQKVLDN

SEQ ID NO: 152841 - protein, 320 aa, Heterodera glycines
  Coding regions on vcDNA: vcDNA=SeqID_79264; Strand=-; Position=1 -177,476-1259
  Homolog annotation: Hit_ID=AAG00552.1; Match level="QueryCoverage =81%, HitCoverage=84%, E-value=4e-19, Identity=32%"; Hit description =retinitis pigmentosa GTPase regulator [Mus musculus]
MDRDRIEKQKGNDRTELTGVHLVRHGNGNGKSDNAEQFSVVRTNGTCFTLKLNRPLEADLSSPGFLLRRLEVIDIDRGIGGICRFSLEKTQNEKGAAEKGEMFALDSQQCQWPRCWANLRLKRPMAEGEVAKVRVKARDGAGMTRRANEATVELEVIGAGANGAEGGGGEKRGRGRGGKEGRKKEHETEEAKVVEDKINKKEGRKEQNGNGRNGGEGRERGGREGGGTEEEGGRERERGRKGEGGTEEEGGREREIGREGERGRKGGEAEEEGGRERERGGGEGGERGGEVKEEGSGKRKIERKEEKLKEGTSLDEYRMP

SEQ ID NO: 152842 - protein, 108 aa, Heterodera glycines
  Coding regions on vcDNA: vcDNA=SeqID_79265; Strand=+; Position=1-663
  Homolog annotation: Hit_ID=XP_379696.1; Match level="QueryCoverage =88%, HitCoverage=85%, E-value=2e-09, Identity=37%"; Hit description =PREDICTED: hypothetical protein XP_379696 [Homo sapiens]
MLGQPSLEKANGRGRSGQSASEGEGRGGDDEEGERSDGGIGSDRGGGKWSGGRGRRKEGTRKRGKRGAEEGTRNRRGETKRKRKKRGRRKRKRRKRRRRDRRRGRKRK

SEQ ID NO: 152843 - protein, 98 aa, Heterodera glycines
  Coding regions on vcDNA: vcDNA=SeqID_79266; Strand=+; Position=1-297
VNGRVAGTLSPLETGQLGSEGSRVGIPTESRSRSIPNILEKRSGRIPGRDPDRIPINPEDFFSGSRGIIGICSNPIFFTFCAKFCSNVYLIFIIDQFD

SEQ ID NO: 152844 - protein, 209 aa, Heterodera glycines
  Coding regions on vcDNA: vcDNA=SeqID_79267; Strand=-; Position=1 -111,165-282,603-788,1634-1848
  Homolog annotation: Hit_ID=AAD48446.1; Match level="QueryCoverage =64%, HitCoverage=84%, E-value=2e-33, Identity=51%"; Hit description =nucleoside diphosphate kinase [Trypanosoma brucei]
MERTFVCIKPESVRRCLVGKIIERFEAHGFRLIAIKMIVSTRKQAADHYIGCSDQPFFPKVISYMTSGPVVAMIWEGVGVVKGIRKILGATPDKVPPPGTLRAEFRNNSDVGKYHDTVCHGSDSAEDAVREFAIWFDKKASVESRDQTGSGSRGISSGSRGIKFGIPTSGSVPSDFLNSSGLIGIGISSGSRIGIPPDLPWDPAGLKSR

SEQ ID NO: 152845 - protein, 155 aa, Heterodera glycines
  Coding regions on vcDNA: vcDNA=SeqID_79268; Strand=+; Position=1 -50,81-190,864-1171
MFRTFALLLAVVKVYGGRAKSLVNLSESVLNGINVNRLMQMGKRQFNWMETVKTLLKQNGLLSPDEFREALPLGAFLYDFDGMALRVVALEITNGIGKINGTKICKIKSSTSSTSSIDCSLDGIDMASLPDFKRPCEERWPELAPIYCYGKILEV

SEQ ID NO: 152846 - protein, 176 aa, Heterodera glycines
  Coding regions on vcDNA: vcDNA=SeqID_79269; Strand=+; Position=1 -102,309-594,1271-1412
RWIKEDTEDKKDPWKLLNLRTTQIVPVDLNALIYNSEKSASYNKTHSEFRKNFVAVFKSDGGTFNDYELDTKKVRKRTYYGSTVVPLFTGCLGDDKDAEKAAKRMFKGLMEIDKKHGIFNNYPFGVPTRMQKFAFDKAQQWLSANYKLYKSCQNFMWMKMAAQTGTPGAKGDFHAQ

SEQ ID NO: 152847 - protein, 61 aa, Heterodera glycines
  Coding regions on vcDNA: vcDNA=SeqID_79270; Strand=+; Position=1 -137,289-337
MKDVCPNSSPAFDGATNVPLLANTLNPATADGTGASSTMGCSMCQSPLPGFLRTAYLLVKY

SEQ ID NO: 152848 - protein, 115 aa, Heterodera glycines
  Coding regions on vcDNA: vcDNA=SeqID_79271; Strand=-; Position=1 -75,573-845
MSAIIDHCSVPCVYGLLPNKEGATYLEGWHAIWNAHLKGNQRLSGFVRKMIEEDEMWSQRIIDYQIAPADGIRGPHAARKGKYVRQDNNLNALLQDIGNRDPLEYLRACAYHLHF

SEQ ID NO: 152849 - protein, 118 aa, Heterodera glycines
  Coding regions on vcDNA: vcDNA=SeqID_79272; Strand=-; Position=1-357
MLLWHFIFSIIFFVYKIESAKIRPNFDEIFGDGLDKKESEQTVKIEQKEQNENLEFIHFLQPNGDEMGNDQIDQMDNSDDQKILKCDQSYKKNETDQQKSEIVQNLMQLKKSWGNGKI

SEQ ID NO: 152850 - protein, 235 aa, Heterodera glycines
  Coding regions on vcDNA: vcDNA=SeqID_79273; Strand=-; Position=1 -565,609-751
MNLWHLLFIIFFFIFAIKSGKIQPNFEEIFGQRWDKNESEEIVIIKIEQNDQKEQNETTGIDQIGGENGTDPNDQQKRQIILKFEAIKEKLKEKGKYKWKDQNKIERKIAKLLGIGRHKIYKWKKELNIIKKMGKSFYEEKKREFTERFDEFKELYGQGKQKEFAKELGISEATFLKWKKELMPNDHKKENKLKKLKHYFEIKEANPKVTDEIIAKKLGIGSATLTRWKREFATS

SEQ ID NO: 152851 - protein, 230 aa, Heterodera glycines
  Coding regions on vcDNA: vcDNA=SeqID_79274; Strand=-; Position=1 -119,175-330,381-520,564-664,954-1017
  Homolog annotation: Hit_ID=CAE67392.1; Match level="QueryCoverage =95%, HitCoverage=49%, E-value=1e-38, Identity=40%"; Hit description =Hypothetical protein CBG12877 [Caenorhabditis briggsae]
ETFSRMGEADQFPLILGRDCSGEVVEKGRAVKDLDVGDQVIAVVPVIAVVPPHCQGCHSEFALSFTNAVAPKPASLSHTESAALPYVACTAWAALVTTGRIDPNKAQHLRVLIHTGRIDPNKAQHLRVLIHGGAGGVGTMAIQMLRCWGVEKVVATCSAKKMQLVEELGAKAVDYRMQLVEELGAKAVDYRAKDAKQQLVAEGPFELILDCASTELAEWSDELLGIWRAV

SEQ ID NO: 152852 - protein, 131 aa, Heterodera glycines
  misc_feature (19)..(19): Xaa can be any naturally occurring amino acid
  Coding regions on vcDNA: vcDNA=SeqID_79275; Strand=-; Position=1 -191,242-392
  Homolog annotation: Hit_ID=NP_500284.2; Match level="QueryCoverage =84%, HitCoverage=2%, E-value=5e-33, Identity=63%"; Hit description =ubiquitin-associated domain and HECT domain containing protein (4D798) [Caenorhabditis elegans] gb|AAG2337
NSMVMQQIEQIKYLLPYIXRFWRALKAFDAEDKAKFLQFVTGTSKVPLQGFAHLEGMNGVQKFTIQKDTRSNSRLPSAHTCIQKDTRSNSRLPSAHTCFNQLDLPEYPDYETLHKMLLLASRECSEGFAFA

SEQ ID NO: 152853 - protein, 78 aa, Heterodera glycines
  Coding regions on vcDNA: vcDNA=SeqID_79276; Strand=-; Position=1 -147,194-281
MRAWAVNAFNAPLVLSNVPMPTIQNDNQVIIRVKVADFYLELELIANSQAASVNPIDVRMSEGYGNEVLSKIKCLTEF

SEQ ID NO: 152854 - protein, 209 aa, Heterodera glycines
  Coding regions on vcDNA: vcDNA=SeqID_79277; Strand=-; Position=1 -8,914-1197,1440-1624,1689-1841
  Homolog annotation: Hit_ID=NP_113997.1; Match level="QueryCoverage =35%, HitCoverage=7%, E-value=2e-10, Identity=46%"; Hit description =cyclic nucleotide-gated channel beta subunit 1 [Rattus norvegicus] emb|CAA04133.1| cyclic nucleotide-gated
MLRKNGKTREEEEKDENSIGEGGETEEKERKRKNSKQEGMEKEEEKDENSIGEGAETEEKERKRKNSKQEGGEKEEEKRMKLKRGRNSSKSTLFNFADPLRIGRGRFRVSSCLGLKLVGFVQNIHVSNPNPHSDKFLNFLIFLFLAANIFYSNLSVWSDNKLRSHFMVSGNTSEKIDNVFGIHIGIGIIGIILGEVNVIDVVIECAVMF

SEQ ID NO: 152855 - protein, 90 aa, Heterodera glycines
  Coding regions on vcDNA: vcDNA=SeqID_79278; Strand=+; Position=1 -43,107-225,312-422
MTFNFGKGGSFNAQSGGGVLVGGDKFGTNSTFGVDKKGLVADTDMHLLDNKTLHGGLGKEKNFIDDLADLIRQRKEEKQRQKEQRIAERI

SEQ ID NO: 152856 - protein, 136 aa, Heterodera glycines
  Coding regions on vcDNA: vcDNA=SeqID_79279; Strand=+; Position=1 -24,650-1036
MPSKEVIPGTDRLLRANNANVRPQLQGVDNAKDCLTPSTTGNNQPTREQPKLMDIDERIGMDDEDNDDGDRFGEAAEVLGGGDNANRVGGERVVGNRLRKRRSVSCEPTANSPAKMAPHQPADDQSAGCLLQVTEQ

SEQ ID NO: 152857 - protein, 150 aa, Heterodera glycines
  Coding regions on vcDNA: vcDNA=SeqID_79280; Strand=-; Position=1-453
MIVVVDVVVAVVCAFLLLAHCLPELLKADYFAFGAMETTAKLKYWVLQNEAQMEPYCERSAAAQQKLGYSTKDSEEMAAIPMASRANLKMAAIPMAFRAYLKMAAIPMAFRANLMIVHRIGRDLTLAECLVGGAAFARCIKRRVNELGRL

SEQ ID NO: 152858 - protein, 50 aa, Heterodera glycines
  Coding regions on vcDNA: vcDNA=SeqID_79281; Strand=+; Position=1 -121,466-497
MKRPMDDEAGEGPSAIEIQNVQMARSENDSRTAPKLFIRTGKHKKVATPS

SEQ ID NO: 152859 - protein, 169 aa, Heterodera glycines
  Coding regions on vcDNA: vcDNA=SeqID_79282; Strand=+; Position=1 -152,210-387,444-620
MLRSLLFAAVFASLLINCYEARTIRLANSFLCAKSGFTVEEGLTQHEANNIQVKGEEISNTQTEPVPILLVTANVEFDVVFHTNSKECKEQFKIKEDSKGCKKKGTLVGHNDFPKTPHCGESCTGYEVVCTVVKLASVEEQETGGIVGLKRSEFARMFGGAKCEWEAVI

SEQ ID NO: 152860 - protein, 161 aa, Heterodera glycines
  Coding regions on vcDNA: vcDNA=SeqID_79283; Strand=-; Position=1-483
  Homolog annotation: Hit_ID=E86336; Match level="QueryCoverage=88%, HitCoverage=37%, E-value=1e-23, Identity=43%"; Hit description =hypothetical protein F14O10.11 - Arabidopsis thaliana gb|AAF88160.1| Contains weak similarity to an unknown pr
METLQRQRKLDIYDKTQMKGEGGEQKWEEEEEEEEEEEESEYETDEEEEEEEGGNCTGEKESGKEMEELEESGKKEKADEGDKGNGEMEENGDEETEEEEKEEEEEGEEKAAEKKQQVQRENKVSFLELEEEENSSRGEEAEEELRMFTLFEKIGELVLRD

SEQ ID NO: 152861 - protein, 111 aa, Heterodera glycines
  Coding regions on vcDNA: vcDNA=SeqID_79284; Strand=-; Position=1 -185,576-681,728-771
MSSFPKAVNIKIEHNNSFSDHDYCYKESAVEEMDEENRSFFVDVENDDEYDDEYNARGRKRRWGKRTDKLRPDKVEYRVYWKGYPIEKSTWEPEDNLRLCQESIDRYEQRE

SEQ ID NO: 152862 - protein, 191 aa, Heterodera glycines
  Coding regions on vcDNA: vcDNA=SeqID_79285; Strand=-; Position=1-574
MFLCHLIIIIFFPYKIETAQNQPTFDEIFGNGWDTQYDSEEKLLDKNESKNEQNYQKENFEFNHYADHVIEENETDPFDQMNNWDKRNIMKSYQKNESNYKQKREIIQKFDAIKNKLKQKGKYKKKYQCKIEMKIGKHLGVSRYLIFKWKKEFLNDQQKTDFSDQQKRETVQKFDAIKNKLKEKGKYEWKN

SEQ ID NO: 152863 - protein, 354 aa, Heterodera glycines
  Coding regions on vcDNA: vcDNA=SeqID_79286; Strand=+; Position=1 -66,119-353,405-1168
  Homolog annotation: Hit_ID=EAL42101.1; Match level="QueryCoverage =72%, HitCoverage=98%, E-value=1e-25, Identity=33%"; Hit description =ENSANGP00000027443 [Anopheles gambiae str. PEST]
MRTQTIFSIAIVLMICEVNSFPAFSSLFSSAFGGSKKVENIGTTNDESHSRQKRQAETVVSDADTITLTISGENLTVTQETLADGTVVLRITGQNTNVETSNADDSAIETATEESATAAEDAANDESATEAANEESATAAEDAANDESATEAATEESATAAEDAANDESATEAATEESATAAEDAANDESATEAATEESATAAEDAANDESATEAATEESATAAEDAANDESATEAAIEVSSTSVAASPTTKATAPLKPPAKKPGNKSSSSSSCSSSESDEKKQGPKRRPTPPHKANKKKGNQKHKKGRNHQKKGHGHHKKGHGRPHRHQHKFARPDFGWFHAFPQYFRGLRFW

SEQ ID NO: 152864 - protein, 189 aa, Heterodera glycines
  Coding regions on vcDNA: vcDNA=SeqID_79287; Strand=-; Position=1 -79,2026-2516
  Homolog annotation: Hit_ID=EAA16748.1; Match level="QueryCoverage =89%, HitCoverage=49%, E-value=5e-23, Identity=34%"; Hit description =neurofilament protein H form H2 [Plasmodium yoelii yoelii]
MEKVIVQKLGWRENDRRENDPDPICEAKDPTQAENPTQAENPTKAENPTQAENPTKAENPALENPTQAENPALENPTQAENPALENPTQAENPALENPTQAENPTQAENPALENPTQAENPALENPTQAENPALENPTQAENPALENPTQAENPAQAENPALENPTQAENPTQAENPALENPTQAEKFE

SEQ ID NO: 152865 - protein, 43 aa, Heterodera glycines
  Coding regions on vcDNA: vcDNA=SeqID_79288; Strand=+; Position=1 -76,289-344
MPRKLDLVGNEKTYSSKTRLARKRPVQKIIDSAFLELSETRVL

SEQ ID NO: 152866 - protein, 27 aa, Heterodera glycines
  Coding regions on vcDNA: vcDNA=SeqID_79289; Strand=+; Position=1-81
MCYYAISFYFINVIVHFFIAISSATSP

SEQ ID NO: 152867 - protein, 189 aa, Heterodera glycines
  Coding regions on vcDNA: vcDNA=SeqID_79290; Strand=+; Position=1 -369,908-1108
MNQKLLNEERLNYFDNKRLINVNYYDKNRSINEIILNLAIDAGNERQKNESDFEEIICRQCFDKNMEEMLRKAEERAKEEEDKLLEDNPEEFEDEEIEEEEGERKFDVHKIVTNSKFDDAINWTDEAIFTEFVKGKATKLEKFFFLMKAFPKIIDYLNTSAFSFFKFGYCLAGPLIWQFSQNLVDCLIF

SEQ ID NO: 152868 - protein, 206 aa, Heterodera glycines
  Coding regions on vcDNA: vcDNA=SeqID_79291; Strand=+; Position=1 -145,421-896
MEAELGLVHLMKVNWDCNNVRKEQESECLKYRKYLHYLNNYLFRKYVEAKNPEMAAQLTTVKPVFLYGEKIMSLFIIVKELNFVTKCFWEKCENKLENVDLKNEKMELLNEKEIKEEKNGGNTPKRKVKKQKTKKIIVPTKIEKLQKEFEQKMEKMCENVKEKAKEEKAKLEKAMVKNENYKKEEAENMEKEYEHKFGTFNSSPFL

SEQ ID NO: 152869 - protein, 132 aa, Heterodera glycines
  Coding regions on vcDNA: vcDNA=SeqID_79292; Strand=-; Position=1 -335,391-454
MAIMLSFHPQIDKLNALTIQQSAKLSPILPPPSADEFHAVAVALTESANRLPTLLHNSTEENARGINEFTTNFARFHTTVSKMTAQANDTTGQEMAERLGDAKESALIMLESLRTAQTDPNNASLAQVFHWK

SEQ ID NO: 152870 - protein, 382 aa, Heterodera glycines
  Coding regions on vcDNA: vcDNA=SeqID_79293; Strand=-; Position=1 -214,260-375,1541-1669,1713-1853,1901-2038,2099-2509
  Homolog annotation: Hit_ID=NP_490886.2; Match level="QueryCoverage =88%, HitCoverage=12%, E-value=1e-47, Identity=36%"; Hit description =talin (279.1 kD) (1C213) [Caenorhabditis elegans] gb|AAK73909.2| Hypothetical protein Y71G12B.11a [Caenor
KSSNHPTESSQTKAISRGPLCATPSQQFGTDQSSDHSVRRLFSSSQLLVEGMEQEAQLSPAEQRNKLLNAARSVAQATSSMIDATRECQSRPGEVGPQVALRNAAEHLVQVTNQATGERQIQQTIQQLEKVSKETAASITQTVAAANSVSAYTARPHILAQQPLDSLVRECADVSRYVPPLIKRIKQHQGASEAGAQFRAKVGLIHDSQAVVGPATRLVDESRSSVSHVRDKHSAGLLLQNCQQLSINVAELRTVLNNVQQLDFGSQLDHSEELIRSLDAQLQQLSQRIRLGQPLLPPSSPPMDSPQQTTRTFRQQCRLLNSTIAQMVSATHSSESRQMGTAMLEMAQALSDFADSVEDVAATEANANGSGELAEGDERVDK

SEQ ID NO: 152871 - protein, 26 aa, Heterodera glycines
  Coding regions on vcDNA: vcDNA=SeqID_79294; Strand=+; Position=1 -72,942-950
MGANIVTADEFGNTALTIALATGRTN

SEQ ID NO: 152872 - protein, 30 aa, Heterodera glycines; identical to SEQ ID NO: 126607
  Coding regions on vcDNA: vcDNA=SeqID_79295; Strand=-; Position=1-91

SEQ ID NO: 152873 - protein, 68 aa, Heterodera glycines
  Coding regions on vcDNA: vcDNA=SeqID_79296; Strand=-; Position=1-207
MAFDFLPLLLLLLFYFQIDQTHSDGIIKCRGISIDQMQSFNYQSDQWTKPKEVKFSERPHFSVIFVKI

SEQ ID NO: 152874 - protein, 244 aa, Heterodera glycines
  Coding regions on vcDNA: vcDNA=SeqID_79297; Strand=-; Position=1 -104,669-936,997-1359
MTTSKASPRMILPVIKESRAPPAGSTKFGQTISECWKFVQDNKSNTIVENFQIDETEEQIDWDPDANSAFLDIGATVELVGAESDIDDGNRSSTFTATSTSSKRAKNTAKQQRKRANKRTKPKPSLEIGTPAGFLRDFRSRTRFFLVNGIVTAAGFLWDPRSGLPSQKSFNSCSRLRKIFYRALIKIINPPFKLAVQIDEGNPDSRIAPDEHGRYLISKVHAVYVHQNNRKAYFLSFHGMFFIY

SEQ ID NO: 152875 - protein, 89 aa, Heterodera glycines
  Coding regions on vcDNA: vcDNA=SeqID_79298; Strand=+; Position=1 -88,215-396
MKSGSVGEFEIEYEKAEITDAEGGGEGTRVMKDEYKPKGIKYSRKEWHQNYDEIGKKIGVGYVTIEKWKKQFGMGERINEKEKMEKMKM

SEQ ID NO: 152876 - protein, 266 aa, Heterodera glycines
  Coding regions on vcDNA: vcDNA=SeqID_79299; Strand=+; Position=1-801
  Homolog annotation: Hit_ID=CAE70527.1; Match level="QueryCoverage =89%, HitCoverage=88%, E-value=3e-10, Identity=23%"; Hit description =Hypothetical protein CBG17156 [Caenorhabditis briggsae]
MKQDELLANFLSSPLPPLPPRKNSSTNTRKSTSINDQLNDPSWIYDIKINYGQSSRNKTYQNRTKLTKHETNFHKQFGQNIFNSKDGSTESEKRSNQQTKKNPISIYGREGQEVSGNQSDQNTKKTSSDKQRNEKNKGISFAKNVVKYLSGHSSDTQKDQKPKNRKNEAGSTGKNTNQSNDVPSINNQRDQISQKATNDLYGQPSETPSYQKKANRMNGAGPSEKKSDQNDKSELNEGTPSENQIDKTKTNRLLKAKEILPFQQKE

SEQ ID NO: 152877 - protein, 126 aa, Heterodera glycines
  Coding regions on vcDNA: vcDNA=SeqID_79300; Strand=+; Position=1 -107,257-406,530-653
MSFFDNPIVLNGGKALFAFLMLFSNGLLVFVSFKANFGIVLISPSGIPLWLCFLLVSVPLFAVCCQYILFPVIALDRLIGALFPFKQMGKRYKRRFMLFALIASISFAIFMLAASINKSIIHFSEK

SEQ ID NO: 152878 - protein, 75 aa, Heterodera glycines
  Coding regions on vcDNA: vcDNA=SeqID_79301; Strand=+; Position=1-228
MSQPQEVQPMEAFDEVNTQQWHDLDNLKCRADEHCGADKAAAADPVPIQLRGQSDRTRAVPPGRGGVVEESKKRC

SEQ ID NO: 152879 - protein, 30 aa, Heterodera glycines; identical to SEQ ID NO: 141040
  Coding regions on vcDNA: vcDNA=SeqID_79302; Strand=-; Position=1 -75,147-164

SEQ ID NO: 152880 - protein, 52 aa, Heterodera glycines
  Coding regions on vcDNA: vcDNA=SeqID_79303; Strand=+; Position=1-157
AQADFALKLLREVSTDDRSCIVSPFSAAVTLSMVYAGAKEKTGEEMGQLLAN

SEQ ID NO: 152881 - protein, 170 aa, Heterodera glycines
  Coding regions on vcDNA: vcDNA=SeqID_79304; Strand=+; Position=1 -378,465-599
  Homolog annotation: Hit_ID=NP_495702.1; Match level="QueryCoverage =100%, HitCoverage=18%, E-value=2e-16, Identity=34%"; Hit description= UNCoordinated locomotion UNC-105, degenerin mec-4 family member (95.8 kD) (unc-105) [Caenorhabditis eleg
MTSLIADLGGLSGLWIGISVVSILEVVQLIWFCMQYIHKKKSVSTKEGTDKFQLFLLNYFVILRTPELLAMVRSARQRSSAGHTDKSPSGSSSSPPRARTESVGAYSLKSLHSVRSDLRPGIRITQERRPSHSTGSSTPYLAPEVELPCTCLYGARGQIVFMKPLCPFHG

SEQ ID NO: 152882 - protein, 103 aa, Heterodera glycines
  Coding regions on vcDNA: vcDNA=SeqID_79305; Strand=-; Position=1 -126,355-540
MLFLLLLFSSAPFALLFLPLDIFFTQIVPAKGGNGGGKGGCYGYCEKFNALEDDLEKMKQIKANAECFVDDMGKVIKGFEKNLDILRTSVTKLEEENESLTGD

SEQ ID NO: 152883 - protein, 122 aa, Heterodera glycines
  Coding regions on vcDNA: vcDNA=SeqID_79306; Strand=-; Position=1 -51,136-192,688-865,911-923,1272-1340
MKVYHPLVSPTLKSIEEEHHSLEHSEAHQQDTYLNKRIQDSRAELSFFVGANLVQRLATYETAGQVMTELLNSVVNMHQFIEKQVPVEMRGYGTRTGTPHFKKRMKEMDERFNEVKRLADRI

SEQ ID NO: 152884 - protein, 459 aa, Heterodera glycines
  Coding regions on vcDNA: vcDNA=SeqID_79307; Strand=-; Position=1-1380
  Homolog annotation: Hit_ID=XP_479365.1; Match level="QueryCoverage =30%, HitCoverage=10%, E-value=6e-12, Identity=31%"; Hit description =helicase-like protein [Oryza sativa (japonica cultivar-group)] dbj|BAD32013.1| helicase-like protein [Ory
MVWSNGLDRVMPYKNMTFGYDPNVPAEVILLPVHFPGHWALIVHDVQFGTHFADSLPTPYGRLDPQLTDKIKKIICDILPSTVLTGILNAENLTVQHDGNSCGYFVCLYAESWLMNNRTFVLPSLFINYEKKRILWHINELYGSDNVPYHPREGVPTPCPIVYRHTDEAQSTSKAAESMEVDDKNDIMIIEPHMSVNAVNAVLTQAQVAGENQADTLGLVSESCAPQEPIAQADDAIFVRPKTPPRRSARIGRRQSASISRSPSPAPKRRTSANTLSQVTPFTKRCHLIHKGWCCAAAAAKHYPEYSDSGKLGDKKCSHCGALLFPHENSSLCCRQGRVVLPKLNPHPKELEELIVCDKQPREGKEFVRNMSRYNNLLQFASVSAGNKPSPAGGPMAVILNGEFHRRISSMQAGTTQIPGFGQLYILDPVEAMEQRRKNPTFTGEKITNDEEFVQGHQL

SEQ ID NO: 152885 - protein, 40 aa, Heterodera glycines
  Coding regions on vcDNA: vcDNA=SeqID_79308; Strand=-; Position=1 -114,479-487
MPAAQQVIVPPLAQQQLLQCPPMPPCPVAIPVPMRLPRVF

SEQ ID NO: 152886 - protein, 49 aa, Heterodera glycines
  Coding regions on vcDNA: vcDNA=SeqID_79309; Strand=-; Position=1 -111,276-314
MSETDFVFKIIAIPISPWKIVLLFRTKNLLLKRVAPSEKCTLVVVAVIE

SEQ ID NO: 152887 - protein, 93 aa, Heterodera glycines
  Coding regions on vcDNA: vcDNA=SeqID_79310; Strand=+; Position=1 -63,498-716
MDLSAGDEQLKRNFSCKICFEPFSKDRRYPISLNCGHTFCARCVRQLSSFGTSIACGLCRRGTYSDFRQLGKNVTLLGFVLFYWKNSNLVAIG

SEQ ID NO: 152888 - protein, 67 aa, Heterodera glycines
  Coding regions on vcDNA: vcDNA=SeqID_79311; Strand=-; Position=1 -94,1256-1365
MHAFCARAIYHRACQSKAKQQRCCFERIKGIGLTIEHCERHFLDNVLDFVLRTGPSMFVYSERQTPA

SEQ ID NO: 152889 - protein, 92 aa, Heterodera glycines
  Coding regions on vcDNA: vcDNA=SeqID_79312; Strand=+; Position=1 -178,282-382
MKAAKKVGLKKKETKLASGQKKGRIAKGGGTSTTGAKKGDEEAATELLHSATLSEPIILASGEKQENLWRFAPKMTNFAILESSFQKIIMVQ

SEQ ID NO: 152890 - protein, 51 aa, Heterodera glycines
  Coding regions on vcDNA: vcDNA=SeqID_79313; Strand=+; Position=1 -91,423-487
MAATSKLQKSGRKRLRYDSEESSDDDGIGGAAPEMEENEEQGDAIQLGNNI

SEQ ID NO: 152891 - protein, 76 aa, Heterodera glycines
  Coding regions on vcDNA: vcDNA=SeqID_79314; Strand=-; Position=1-231
MLRPLPSPRNFLFGTVVVDNGQREEEETETPPSAILVVVCRDEETSDDDEADDDGFVATDRAATTSFIVAPIVDEA

SEQ ID NO: 152892 - protein, 297 aa, Heterodera glycines
  Coding regions on vcDNA: vcDNA=SeqID_79315; Strand=+; Position=1 -18,309-465,524-579,668-775,831-964,1560-1621,1673-1800,2834-3064
  Homolog annotation: Hit_ID=NP_502096.1; Match level="QueryCoverage =76%, HitCoverage=41%, E-value=3e-44, Identity=40%"; Hit description =carnitine palmitoyltransferase II (72.5 kD) (4L947) [Caenorhabditis elegans] emb|CAB03233.1| Hypothetical
MDDDHQKSLFRLPVPSLEHSCDRYLCSVGAVFGEHSDEFVDSKELVADFLDGTKGGGPALQAELKRYAQHNKHTSYISEPWFDMYLRSRIPCPINFNPFMMFAPDPEPIYNDQLIRATNLVISCGRFKKALDAELLKPEVFHMNPLKSDTEKFENICRKHFVVSRHGHFYTVKLFDQNGMLLEPKQIFASLSHICKSPPSSSASKTNFAPADECVGSLTTLKIIRVDLHNGGQWTCIPTEHLEGNWVLLDVFFDILLAQHSAPNRPHSLHIADSATNGDDNDAEHGTVLIVSQNGIF

SEQ ID NO: 152893 - protein, 24 aa, Heterodera glycines
  Coding regions on vcDNA: vcDNA=SeqID_79316; Strand=-; Position=1-74
ENYPCRFAQRRPMDVHPNGTFGGQ

SEQ ID NO: 152894 - protein, 80 aa, Heterodera glycines
  Coding regions on vcDNA: vcDNA=SeqID_79317; Strand=-; Position=1 -186,492-548
MQIIGIIPRVKINELVKQKEQLAMDDLRMVDQPELYNFDPIFQQIKEQKMEILKAFDFSFDTVGQFRRSLSIREHLQRPH

SEQ ID NO: 152895 - protein, 15 aa, Heterodera glycines
  Coding regions on vcDNA: vcDNA=SeqID_79318; Strand=+; Position=1-61
TFDHLYFDQIVNMVK

SEQ ID NO: 152896 - protein, 67 aa, Heterodera glycines
  Coding regions on vcDNA: vcDNA=SeqID_79319; Strand=+; Position=1-204
MAILFEPTPTEYNRRQCPTISRPKRVKLALNRVIKALHMAMAEPAGPKWSRNHSVPVRNVQRDNARR

SEQ ID NO: 152897 - protein, 119 aa, Heterodera glycines
  Coding regions on vcDNA: vcDNA=SeqID_79320; Strand=-; Position=1 -334,687-712
MEGEMEAKIHVYSTQPIDGDGFMAFARDFLNESKELLKIIENLSNPIQENVRKNLKNLASVAQQKSKQLRQSIAQQLEQLVANAANELANLQSQTGKFGDNTASEYLRIFRFTCFGKTL

SEQ ID NO: 152898 - protein, 24 aa, Heterodera glycines
  Coding regions on vcDNA: vcDNA=SeqID_79321; Strand=-; Position=1 -13,130-191
MRFLVEKSKQKGKILVLFLCKRII

SEQ ID NO: 152899 - protein, 105 aa, Heterodera glycines
  Coding regions on vcDNA: vcDNA=SeqID_79322; Strand=-; Position=1 -148,439-609
LNFLFFSKVWAEGGPSAIEIYWTPEQEARPVKHYFVQRMDKGRWINVSKSIPFTGQSKYCHNFLPLSLVHTIEYSFRVITVFVDGQEEASETFTGRLTMNAVSFN

SEQ ID NO: 152900 - protein, 176 aa, Heterodera glycines
  Coding regions on vcDNA: vcDNA=SeqID_79323; Strand=+; Position=1-531
MVTKEGVTLWCTRINKPQFVPFDVVYDLPGHCFFRVKNKARVFNVPYGDLPSGTCAKSKPTDHQQQQQQDLKRKAKVALDLVEAGLMADAMQDGTRWKKAKTAINVLGNLLLAESLDSTNSNSTDAPTQANEAADIKEEEENVQGEEENKEDIGDIDKTLDDFFNSLNASTSNVPI

SEQ ID NO: 152901 - protein, 272 aa, Heterodera glycines
  Coding regions on vcDNA: vcDNA=SeqID_79324; Strand=+; Position=1-819
  Homolog annotation: Hit_ID=AAL79776.1; Match level="QueryCoverage =50%, HitCoverage=72%, E-value=1e-13, Identity=36%"; Hit description =proline-rich protein [Saccharum hybrid cultivar CP65-357]
MWESGFALPAPSQYYGDLPVLPDNADEIEEMDTAQRRIASRRKLKKDEAEDDDDDDALHHKKYRIYQRSPPRLPSPPRAKPKPPPRQPTTKREQQKPKKLELKPPKIEPKFEPDSRPSTSKVAPRSKKEPEFQLDPRPSTSRQAGHLPPPAPKIVTKHEPTKRPVPYRIPKREPKIVEETPQRQQQPLPAAVVEEMPPVPPPRRGTKRRHPVNGENDGEVRIRKRVRQARRVRVQYSPEPGPSTSAQSDEQQQHRELFAIPSNQLESGPPYH

SEQ ID NO: 152902 - protein, 387 aa, Heterodera glycines
  Coding regions on vcDNA: vcDNA=SeqID_79325; Strand=+; Position=1-1164
  Homolog annotation: Hit_ID=NP_502797.1; Match level="QueryCoverage =91%, HitCoverage=98%, E-value=1e-52, Identity=34%"; Hit description =HASI (4P602) [Caenorhabditis elegans] emb|CAB16520.1| Hypothetical protein Y57G11C.19 [Caenorhabditis ele
MDGSSKENSTEHNHQDGTENQEGISPEKVELINSTLDKLYNDPSSPAAFAGVTALWKEARKKLKNLRKKDVQHYLEGHRTYTLMRPRRVRFPRAKTVAAGFMTDVQVDLADFQALSRHNRGHRYLLVAVDVLSKRLFVVPLKNKRAEEMLEAFRQLIDQMPMVPHRIFSDKGTEFKNRLLKEFFDEQEIEKHEPVHSSVKASVAERAIRNVKQRLYRYFAEKETLNWVDAVQKIVNGINSAPTRVHEMRPIDVDFSNAQKVWKRLYGHPALQKRTPRFRKDEFVRMSREKGQFEKRYLPNYGDEILEIDDVLKAVRPIRYKLRDEHGEKFKGSFYEQELARVRKDADTSYRIEKVYRKRKRADGSTEMLVKFIGYPNREWINESQLV

SEQ ID NO: 152903 - protein, 42 aa, Heterodera glycines
  Coding regions on vcDNA: vcDNA=SeqID_79326; Strand=-; Position=1-131
KMRLLLILPNLLPMLALMIAMGIIGSVVFGMDPNIKEPLLGY

SEQ ID NO: 152904 - protein, 102 aa, Heterodera glycines
  Coding regions on vcDNA: vcDNA=SeqID_79327; Strand=-; Position=1-309
MRLLLILPNLLPMLALMIAMGIIGSVVFGMDPNIKEPLLEKVQNADQDQQLKIDHINQPKMEVIVDDGTTEDADMAKALKLRETLVLAQNDDKMGMQRERRK

SEQ ID NO: 152905 - protein, 142 aa, Heterodera glycines
  Coding regions on vcDNA: vcDNA=SeqID_79328; Strand=+; Position=1 -238,403-424,745-914
  Homolog annotation: Hit_ID=NP_506146.1; Match level="QueryCoverage =80%, HitCoverage=43%, E-value=2e-28, Identity=53%"; Hit description =putative protein, with 2 coiled coil-4 domains (5N52) [Caenorhabditis elegans] emb|CAB02877.1| Hypothetic
CNPMIIVIAFLIIWSPQGFLPTRHVSVGECGCGGCPPPPSGGGSSNSASSCDSPRPPPPPPCCGCRSSCGCGGGGCENGGGGCGGGGGGGYGANGGGGCGGSIKLTIGCEGPKAPPPPPPCCGCGCGCGCGGCPPPPSGGGS

SEQ ID NO: 152906 - protein, 118 aa, Heterodera glycines
  Coding regions on vcDNA: vcDNA=SeqID_79329; Strand=+; Position=1 -18,65-403
MLFPIALWNLTHRLEIGLSRSNNSLEAWHNIWGALLEPNPLFSKFVKRMLKEFERWQHIVADFHNAPANGIRGKGLKRKSIYLQQDNNLRQLFAEFQQRAGQDPLQYLRAISYHLAQI

SEQ ID NO: 152907 - protein, 117 aa, Heterodera glycines
  Coding regions on vcDNA: vcDNA=SeqID_79330; Strand=+; Position=1-354
MEEQTETKKGKATKEEPIDRSDPAVERKKHDEHRIRWATQRKAAVDELRQRIKLRKKQWSAADIEKEMKETEKDDEEHNSECPTSIQQMEKKFWPTAIEDTAQISWHPGDATESKRN

SEQ ID NO: 152908 - protein, 79 aa, Heterodera glycines
  Coding regions on vcDNA: vcDNA=SeqID_79331; Strand=-; Position=1-336
RPEISNLRILLQDWNSKFFTGQDPVGLILQILHLKSAGSCAGLRILGNFKKFCINKKVFQSIKKYSNIFLNQKMMKMKN

SEQ ID NO: 152909 - protein, 227 aa, Heterodera glycines
  Coding regions on vcDNA: vcDNA=SeqID_79332; Strand=+; Position=1 -193,250-468,590-673,756-941
MSSNNALTEMMRREKKKLLGNVDVQDPLAFVIPATLREKRGEDIVLYDSRNVRQGEKDVVLIFGNSGHFAPMWHVHLDGTFKCAPAMWEQCFVIGASVHQRMCISMWCLLPGKQRRYYEEALKHRLTGTINSYVANHSWEDEIVRAPHFPIPLWNMHSQATSALAQRPLSPHHPALSDFICGVNESIDRQVDAARSARHFIHKRHKRYILPDAVIMRILADASYNSN

SEQ ID NO: 152910 - protein, 262 aa, Heterodera glycines
  Coding regions on vcDNA: vcDNA=SeqID_79333; Strand=+; Position=1 -290,399-897
MKHTKKMLLVPESEYLALINLLKGGAGGTDSLQAEKAAIDASIQKNLNDNKTGADVKMKRHSWLYKQRHQLKDMIENKPQKVIVENATGTAPQNIAPIQTHNGASFGEETDTSAPETDLRLSKKRQQKFLELKTSPEHYDKLQEMIERNPEKYGVDKSSGEILTNFKKPVIRSNYIDSLMYLTGQRADVPKGHRFFVQKGGSDPEMAKFFHSQRGEGDSNRSKRKKFVLVKAKAIKTVGLSRMEQPNNTKRKFFKPLLWAKL

SEQ ID NO: 152911 - protein, 79 aa, Heterodera glycines
  Coding regions on vcDNA: vcDNA=SeqID_79334; Strand=-; Position=1 -113,860-986
MGYAVPLFGFYYRLINLSKSQMRKRLKITIDKNTLLSKCTRCECPMVRGTDGTDRISFQYGRPNSLTAHVLFKFVGPQI

SEQ ID NO: 152912 - protein, 28 aa, Heterodera glycines
  Coding regions on vcDNA: vcDNA=SeqID_79335; Strand=+; Position=1 -83,255-258
MALYCRPFFVEVHSFNSKKSGVKCSVQR

SEQ ID NO: 152913 - protein, 154 aa, Heterodera glycines
  Coding regions on vcDNA: vcDNA=SeqID_79336; Strand=+; Position=1 -90,963-1338
WIPFLSANSCAQQIVDAVLKEKVIAFMPWCILPLNMQRVARDFINFRYEEPDYPMADDAQPKTTTTAVDHQIQNGATANTKLAVGEMPISNGQTVEERVAEKQAENGGANSFRRKPSPLLRLQKRQMREHFEFAGFIWWLIIVPAMALTFVIQF

SEQ ID NO: 152914 - protein, 48 aa, Heterodera glycines
  Coding regions on vcDNA: vcDNA=SeqID_79337; Strand=-; Position=1 -129,481-498
MPKINKFVERQEEEQNLLRAGRNIEEVTAPKMYARHLGDLGGTMFRFG

SEQ ID NO: 152915 - protein, 262 aa, Heterodera glycines
  Coding regions on vcDNA: vcDNA=SeqID_79338; Strand=+; Position=1-789
  Homolog annotation: Hit_ID=XP_319741.1; Match level="QueryCoverage =80%, HitCoverage=48%, E-value=7e-21, Identity=30%"; Hit description =ENSANGP00000006515 [Anopheles gambiae]
MGDAAIQRLTDILQQLLAAQQQNAPPAQNASQLPTLPDVKCFDASQHRGCEIEDWLKRFKFALDCAAPNFQDELKVKLLMTKLCGPTFSEYCKSVLPREVTDFDFVETSEKLKALFSRPQSVWIDRYECLRSVKDDDEDFGTFINRQKKLLRDFNFKKLNEEQFNCMVLLISLKSPKDATLRSRILAKLAADGDTVKYDTVVDDLKIYMSTIAEAKALEQPHVSKHLLAAKLKGQKKRKNSYHSSNASSVSTGTRSSNRSQR

SEQ ID NO: 152916 - protein, 148 aa, Heterodera glycines
  Coding regions on vcDNA: vcDNA=SeqID_79339; Strand=+; Position=1-447
MDRLGLSDSIRNGLKDKFRIETAKANGEIQNKKKFFRKNRRGKKQNFFAVGANVIASLGDEPWRAGRVISQKRGLYNVQFSDGTTGEFPAKSVQPYMPDEDENLNFLDGFGLKRSSSGGTVRKHQIGSDGRRDQLEDDLRASDCEQEA

SEQ ID NO: 152917 - protein, 113 aa, Heterodera glycines
  Coding regions on vcDNA: vcDNA=SeqID_79340; Strand=+; Position=1 -80,1387-1498,1553-1701
MKNKWQWDKEKMKCLRNEGDVFAFDNFLIICYPSIMATGVLDNDHSVDTVDLSNEMFNIDNIDNNPIAEECQNRAKKLGNSMAKLTWHGISIKLNRQSAGISTAILDTSFCEK

SEQ ID NO: 152918 - protein, 124 aa, Heterodera glycines
  Coding regions on vcDNA: vcDNA=SeqID_79341; Strand=+; Position=1 -130,460-701
MPIHISDVNQVITIRLLTDKMKNDNSTNNTIALKLWHTNQGKEDIEMLSIHFFLANNSVEVVIGTETHFCDYEFSNEIFEMNLQIWIKQYGYKILFKNKRLGKREYYPAKWWEGLKFKDHNKLT

SEQ ID NO: 152919 - protein, 235 aa, Heterodera glycines
  Coding regions on vcDNA: vcDNA=SeqID_79342; Strand=+; Position=1 -129,397-973
MPPDAFDDGSIRTAPTPRVQQMEELEREIAGSIVPELIVPQVIKNESEQKLVKGTTNSKAKNEIRIEPIGTKGRTNAKAKPTEIPAEEAEEGREDEQRQQQAEEEPEQHEPASSSAVPPSPPQRQRPTTPEAKRTARPSTEMATTEEQRETPKGKIDKERPTTQGTTPAEVSRTFILITNSTNKANSPSPSIKRTKATTTAPKVKPNNPDGDEPMLMEFDNGNSNILAESAVNGN

SEQ ID NO: 152920 - protein, 63 aa, Heterodera glycines
  Coding regions on vcDNA: vcDNA=SeqID_79343; Strand=-; Position=1-480
SSVQLHFPFSLPSLSFPFTHCSRSRHSPPECCCCRCQIPLALARPRRGYSASLSVPLSLPSSV

SEQ ID NO: 152921 - protein, 61 aa, Heterodera glycines
  Coding regions on vcDNA: vcDNA=SeqID_79344; Strand=+; Position=1 -90,2017-2109
MDGFEEKNRREEMVKKEDKKKKKQLLVPFILFNIMASINDLDYVRDYDYVYDLDFDEVEKC

SEQ ID NO: 152922 - protein, 160 aa, Heterodera glycines
  Coding regions on vcDNA: vcDNA=SeqID_79345; Strand=-; Position=1 -270,486-698
MLLFASSGQRSAPLLAKFDALFLQSLRLILDASPTIGCHVNGLFLRWQIDTANGKRKWRKELDAEAEEGAKWEEEKPWDVLDLPIIGKLEIWINDQTSRKLLQKCLISAVNNLIKTVEIPFNATKQFAFRVRVYGDEYFDNKYTASLKMCSIKTFKALNL

SEQ ID NO: 152923 - protein, 146 aa, Heterodera glycines
  Coding regions on vcDNA: vcDNA=SeqID_79346; Strand=-; Position=1-438
  Homolog annotation: Hit_ID=DAA03716.1; Match level="QueryCoverage =98%, HitCoverage=51%, E-value=2e-20, Identity=48%"; Hit description =TPA: HDC02932 [Drosophila melanogaster]
MNKRNEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGMEWNGME

SEQ ID NO: 152924 - protein, 169 aa, Heterodera glycines
  Coding regions on vcDNA: vcDNA=SeqID_79347; Strand=+; Position=1 -102,158-433,482-613
  Homolog annotation: Hit_ID=AAL78214.1; Match level="QueryCoverage =81%, HitCoverage=72%, E-value=2e-17, Identity=36%"; Hit description =putative esophageal gland cell protein Hgg-20 [Heterodera glycines]
WSAVFLLLVDCATILFWFFLDNAKKRRRPHKKEIFICGDCWLLVFDFLPPSQLGLEIALVSRRFDCIVDEHFKTRKWTLGEMRISHKIGENGTKQMQIVNSDGKPLPIPQNPLPNKVIGFRGITNDYIDLNVIAFLRRFRRILATCAISLYISTENVRILECALLNIWP

SEQ ID NO: 152925 - protein, 51 aa, Heterodera glycines
  Coding regions on vcDNA: vcDNA=SeqID_79348; Strand=-; Position=1-154
MSVCPLCDSPVPFGLAMLAPCHHVGHANCITNFVRHNGFCWVSNCAMPVLE

SEQ ID NO: 152926 - protein, 143 aa, Heterodera glycines
  Coding regions on vcDNA: vcDNA=SeqID_79349; Strand=+; Position=1-430
MPMISAYCLLPNADDCILIFHRRSARPSAPTLRLFVFVLLQFVVRPLVIHSMLFPPFVLLLAPIPLAFSIWPIVLAEPVFALDHLSLQNRATDEKHSSASTSPSLLSSVALTKCQSDYLSALIHRCMIRGVPTAMEGRICFAD

SEQ ID NO: 152927 - protein, 203 aa, Heterodera glycines
  Coding regions on vcDNA: vcDNA=SeqID_79350; Strand=-; Position=1 -55,99-193,241-491,636-771,915-989
  Homolog annotation: Hit_ID=CAE60221.1; Match level="QueryCoverage =75%, HitCoverage=13%, E-value=3e-39, Identity=51%"; Hit description =Hypothetical protein CBG03790 [Caenorhabditis briggsae]
MNRKITACGFLYVAPINLDFSQPSHEKKRWQRRWFTLYDDGELSYGLDSNSDTVPQLKMDMNKCIRVCEADAITNHAHSILIAFKNDRMDGLGDGLLKKVNWPSEIESVAKTDEHRQHPVVCYVKADSTDEIRWWQNLLQFYAKQNAIHLTPTRHLQPDEYFIEDDFPPDAQQKECTIQGFFVKYSQKHGYPQCLTALVSNGF

SEQ ID NO: 152928 - protein, 391 aa, Heterodera glycines
  Coding regions on vcDNA: vcDNA=SeqID_79351; Strand=+; Position=1-1173
  Homolog annotation: Hit_ID=E86336; Match level="QueryCoverage=42%, HitCoverage=43%, E-value=2e-13, Identity=33%"; Hit description =hypothetical protein F14O10.11 - Arabidopsis thaliana gb|AAF88160.1| Contains weak similarity to an unknown pr
MKNSHFVNCFWLVLMVYIAKTNGQNAEATTEVNSEQNGTANFDNGNGNLKENDNGTSTQKPSLRRKPLMEEAEGGVADEEIERLEEEEKQMEKDKAELQEEKEEEGGEEEKQRKDEEDEEEKQQENDEESEAQGADDAEQSMKAKLFKEKELAEEMELSLADSEEEAKRAKKQGKKHHGKGGGGHRHKHRNGRDGPTAFILPSFFLQRLFSRGAFGPSGAPFDGSSFPMILPIIINNNIRGGPPEEEHQLMSSRANHHNGPMFQAAHHFTAPFPPDFFAQRQSPLGTPIGGQRPSHQNANANFPPTSFGSLRAQQSQGVPQMHNQQNNAFGPSASDPFPPFLHSMQQQQQPIFPFGSSSFDGGRGPSSTETQQENQFQQKGQTKFSEASDS

SEQ ID NO: 152929 - protein, 260 aa, Heterodera glycines
  Coding regions on vcDNA: vcDNA=SeqID_79352; Strand=+; Position=1 -164,213-246,289-329,395-421,462-494,557-591,633-844
  Homolog annotation: Hit_ID=CAE68847.1; Match level="QueryCoverage =91%, HitCoverage=51%, E-value=1e-61, Identity=61%"; Hit description =Hypothetical protein CBG14809 [Caenorhabditis briggsae]
INSPNSANIHNEFGICGWILTILSYVLIILTLPISACMSIKVVQEYERAVIFRLGRLLPGGAKGPGGRLLPGGAKGPGIFFIVPCIDSYRKIFFIVPCIDSYRKVDLVDLRVLSFEVPPQEILSKDSRVLSFEVPPQEILSKDSVTVAVDAVVVTVAVDAVVYFRISNATISVTNVEDASRSTKLLAQYFRISNATISVTNVEDASRSTKLLAQTTLRNILGTKTLAEMLSDREAISLQMQVRSNNNNNNSSVIVIVKNI

SEQ ID NO: 152930 - protein, 113 aa, Heterodera glycines
  Coding regions on vcDNA: vcDNA=SeqID_79353; Strand=-; Position=1 -105,195-374,479-535
  Homolog annotation: Hit_ID=CAE62796.1; Match level="QueryCoverage =90%, HitCoverage=63%, E-value=3e-21, Identity=49%"; Hit description =Hypothetical protein CBG06970 [Caenorhabditis briggsae]
MAMKKRLTRIKSEWKVSGADVVTVEKRLGCDLEEKLKEMCEPSESVEDSVLLVLDGEMYYDVEFDDDKWARVLLRRGDLIAVPKGTYYRTTLTPQNFVKLQRFNKQQNPKPIA

SEQ ID NO: 152931 - protein, 395 aa, Heterodera glycines
  Coding regions on vcDNA: vcDNA=SeqID_79354; Strand=-; Position=1 -219,410-667,1499-1536,1769-2199,2465-2602,2751-2851
  Homolog annotation: Hit_ID=NP_956189.1; Match level="QueryCoverage =20%, HitCoverage=5%, E-value=1e-10, Identity=46%"; Hit description =Unknown (protein for MGC:63502) [Danio rerio] gb|AAH58868.1| Unknown (protein for MGC:63502) [Danio rerio]
MDTLWAPPQQPTLEMHSMCHNTSNNNNNGTVFADYYGNCDSHSYGSSYRNQPQQQQHELTVLSPANDSYETMALSPPMKLARPGPIGRLVDTQCLGAPQLKETRRQIRKAQPMAFGTIAMEMGGEAMAQQTQRQMSLMNNSGNICEQSPSECQLVVLRQEVMLRPENGMVVVITFARCLFSIQKTNGKSLPVEVSHSFVRLDCVGIMKICAYGAAANSKNNSSSKSKSSANSNSVPNCSRNAATAANGRHRRRTKGRTTNEEKAKGGGDEETMPMREEQQKRTEQRRCQNDVHIVAQAQLPEGRVLRTQTEAIRCVQQLGCPDVLKMSLLEASSSGGQQLFIIGRNFNPKNLRVLFREYNNDGLLGWSAEAKLDQRLVHQAFHPFKYNLVLNFAK

SEQ ID NO: 152932 - protein, 168 aa, Heterodera glycines
  Coding regions on vcDNA: vcDNA=SeqID_79355; Strand=-; Position=1 -126,231-401,445-547,644-750
SASGVTSMVSSCNSRRELVPQSPLIKVKADGSPQSNQLPTAEQKLAEHRAQLDRKLDVVSCHRMAVEMVSDQQQKSREYLKEKLHFENHNLATMRIKLDIDQLLDSLERKCHSPQSDEEKGAAKEGKSELTIAEVQKDFFPFIYAKAEQLLVDRRMANSFTRKLSDKK

SEQ ID NO: 152933 - protein, 183 aa, Heterodera glycines
  Coding regions on vcDNA: vcDNA=SeqID_79356; Strand=-; Position=1 -254,609-906
  Homolog annotation: Hit_ID=NP_056281.1; Match level="QueryCoverage =98%, HitCoverage=11%, E-value=3e-21, Identity=36%"; Hit description =protein tyrosine phosphatase, non-receptor type 23 [Homo sapiens] gb|AAK28025.1| protein tyrosine phospha
MRKQRCKLVETFRADLDADDITAKALAERELDPRKLFEQEMHKHDAQRELIEQNLRAQDNILRALTDANADFADFRRQILDANEKRALHALTLVTAYQVFTDIVQKSGQAADFYTQLHKLLAALERGIVNIEAANAEFAREEQRKRQAEEERHRRETEAREARRRQEEAAREAARAVNEFRFG

SEQ ID NO: 152934 - protein, 229 aa, Heterodera glycines
  Coding regions on vcDNA: vcDNA=SeqID_79357; Strand=+; Position=1 -134,1377-1568,1625-1852,2290-2424
DRLDLLSRLNQKAVEGQPRIEAVEAAGKQLDEATAQTDAHQRLQKYEDQLERGELDNRAKTLAELGELLGTERHGPHEQLGRHFGTVTDRFWRVEAMARAQSDNLRDAVEAFEQWQHADEALAERMAALSDAIAQLSAADVDGAEQLGAELNSVERREWAKLDELANQIVQMPNVEQTDHLTRKMRSNESQLARIRRDLAAKLESGEKTSGLLRKFRENAQKIETDLAE

SEQ ID NO: 152935 - protein, 208 aa, Heterodera glycines
  Coding regions on vcDNA: vcDNA=SeqID_79358; Strand=-; Position=1 -304,588-704,762-964
MTHVFFDPESVDWSSFITPQHGRGQKQYFVGSKYQRGFGFLGNVARFLTPIARNIASSAGHEGLAAGQRVLSDIAQGRDLGDAVREHSRQGLTNLTDKLQQYNQFCDLNKTFLYLSTSIERKEKSNWIPITKDSEADQHVGVESYDSGIYYAFRAYMMNELGFSEDVKKGLCEASCYYVDDVDQDDYTNSGFKNRASRFADSAKCETM

SEQ ID NO: 152936 - protein, 127 aa, Heterodera glycines
  Coding regions on vcDNA: vcDNA=SeqID_79359; Strand=+; Position=1-489
RRKHMMNSHEIEIFLSKHPTTRKYFIGVFASDKMPKLKDRHFPYCFVANTDRAGTIGEHWVACFVNSPTEIEYFDSLGDYPNEDLSSYLNLFERILINDRIVQHQFSDACGQFCIYFLTQRCSGILY

SEQ ID NO: 152937 - protein, 90 aa, Heterodera glycines
  Coding regions on vcDNA: vcDNA=SeqID_79360; Strand=-; Position=1 -86,143-252,1032-1108
  Homolog annotation: Hit_ID=XP_418512.1; Match level="QueryCoverage =72%, HitCoverage=9%, E-value=1e-10, Identity=49%"; Hit description =PREDICTED: similar to hypothetical protein [Gallus gallus]
MLNRRSAMCALTLGENIFVCGGYDGNHALDSVESFDIRKNQWFVRPPMLTKRCAAATAVLKGQIYEQFELYGNLLPVAKQMGKGSANANP

SEQ ID NO: 152938 - protein, 237 aa, Heterodera glycines
  Coding regions on vcDNA: vcDNA=SeqID_79361; Strand=-; Position=1 -281,339-386,431-480,529-646,694-911
  Homolog annotation: Hit_ID=CAE73692.1; Match level="QueryCoverage =97%, HitCoverage=39%, E-value=4e-34, Identity=34%"; Hit description =Hypothetical protein CBG21203 [Caenorhabditis briggsae]
KQNMTSMLDISIAFEDQEDSDVNLVDCSRELAISAHGNFNELRLSGKMCDIKIETEGIKFKAHKVILAATVPYFMKMFGSEMVEAHSDSVQMNTIDAEIMGLILDFIYTGRIKFTSRNMERLLKAADYLQLSVLSNRCSEILKAHITEENVFSIRKFAVLYNAQQAVLDTESFIQRFFESVSKSEEFLQLDFQTLVQTLDWDNLHVGSEECVFEALARWLDFDPMNRHTFAPRSHVH

SEQ ID NO: 152939 - protein, 328 aa, Heterodera glycines
  Coding regions on vcDNA: vcDNA=SeqID_79362; Strand=+; Position=1 -690,827-1123
MKQQLDSTDAKSTCAFDELMAGVRRRNGESIDDLADRVSSLVRRAYPGLGEHSYDDYSIRHLIRSLKNPDLALTKLDMIFDEFVAMAARAEITQKSAKAAEQKNTNFRQNFDQRRQINFRPPNQPEHFSRRTNENERQNTSFGVVKCYNCGQQGHISRNCHLPRRDQSNFAPQQYNSSARGANRTPIANDYRNPPQSFPNRTQQSRNFLRQNFLVEQPDDSPAVSNSNVLSKRLKPDRQIARVIDINGKEVKCYGVVTLPVKRQERTVQVRLHVAQTSFGYDLLFGTNSLSELGFKIFDELSKTMVDFKQNVNTQNSVHVIFKTTLMR

SEQ ID NO: 152940 - protein, 432 aa, Heterodera glycines
  Coding regions on vcDNA: vcDNA=SeqID_79363; Strand=+; Position=1 -174,449-784,835-1623
  Homolog annotation: Hit_ID=NP_498959.1; Match level="QueryCoverage =85%, HitCoverage=17%, E-value=1e-34, Identity=31%"; Hit description =zn-finger, CCHC type and RNA-directed DNA polymerase  and Integrase, catalytic domain containing protein
MESESVKKTPFVPEFGLHEFTVLPFCLCNAVATFNDLMNKLFVGMINDFLFIYIDDILDAILYFPDFAAAIEDPKRRFVILTDASKHGVSAVLCQNDEMKRLRPILFCLASMQQIRERLLPDRARSFGHSLWHRKFTQFITGIPTRVITDHKALVPMFGTKKRRATQELIPGKSNVVADLLSRYGINSDSENDQQLEENPKETILVGKIVEGEKSQKDGSFLELGGRSDWVEEVKNSEMKTVYEFLEKKTCPHSQREFQSLIDKIHHFTIVDRLLYFCDPKTSSQLLFVPEKFRKELIASRHEGKCAGHLSGKKIHRQLSEHYFWPNMLGDCVRFCLSCRICAHARKSRANEPPLQTVNTVEPMELVCLDILSIGPSESGNRYLLVMIDHFSKYLVAVPIPDKNSETVARAFVKNFVLVLGCPGRLHSDKGG

SEQ ID NO: 152941 - protein, 129 aa, Heterodera glycines
  Coding regions on vcDNA: vcDNA=SeqID_79364; Strand=+; Position=1 -53,268-604
MNRIRSIEAIKSVKIQPKNNEWLLMEEIGKQLEQSLGNLMNVKLFNALFDQTWPNLAFFCTKVAQNIETEYGTFFPSWAFACDVMVRFKLEQEKTIKNNKNKTPKRGKGQIQKENKKEVIQWTEEGGQR

SEQ ID NO: 152942 - protein, 107 aa, Heterodera glycines
  Coding regions on vcDNA: vcDNA=SeqID_79365; Strand=-; Position=1-321
MDATQLQQVLDAVFARFAGNAAPANTASSSLAHATLASSLDNRITKFHYDSECGNTFDRWFNRFGVLIEEDGKELPEQTKVRLLLGKLGDDEYNKYRDSISPSQPDQ

SEQ ID NO: 152943 - protein, 68 aa, Heterodera glycines
  Coding regions on vcDNA: vcDNA=SeqID_79366; Strand=-; Position=1 -12,364-558
MKEKAIPSILKCSRLPPPPKPPGLRGGGLTQTSKKKYLSDDTLSSDSDVHASTGTRRILSSEDEKEEE

SEQ ID NO: 152944 - protein, 232 aa, Heterodera glycines
  Coding regions on vcDNA: vcDNA=SeqID_79367; Strand=-; Position=1 -207,656-852,892-991,1709-1903
MARTKRKPKFARYGKVDGRRRFGRYKRKYNKLLGPALQGVQNLLVTAYHECAHAYLIKYGQNNIDILDRVTIRAQGGNLGETFWHYVEGFYTDEELVAQIVQFMAGRAVELLMFENAQGHEEDVESARNVAIQVTEMAPTDEAITNLLQQATDAPTQVLMNNARRLKRITDQGVRSLVAKAYDNFQLCLSNLRLVFSDSFDNCMKAREDQWSDEHLLKPTGMCIDMLRATHH

SEQ ID NO: 152945 - protein, 174 aa, Heterodera glycines
  Coding regions on vcDNA: vcDNA=SeqID_79368; Strand=+; Position=1 -139,187-337,401-515,581-700
  Homolog annotation: Hit_ID=CAE74145.1; Match level="QueryCoverage =76%, HitCoverage=55%, E-value=2e-11, Identity=27%"; Hit description =Hypothetical protein CBG21816 [Caenorhabditis briggsae]
FDLSFAAKNNDGKILGVLLNAPFKLENIHESYRDIGRMPNKKEFGEEIRNGPFPSQNANRIHAILTFVNSHIALLPPEEDIKLVELQAMAVGPGHARTGLGSGMLRALIQTASAKGYSHLFTCATAIASQTGLKKFGFDEIKTVPFNSFLEDGVPIFSGVHDNGVGAKLVALHI

SEQ ID NO: 152946 - protein, 71 aa, Heterodera glycines
  Coding regions on vcDNA: vcDNA=SeqID_79369; Strand=-; Position=1-363
LWRNMILKIAMAVVFLVIVQFVPPPFSKFFYVFKSHKNTFYGVFGVADHESGAHLDQFLIPDPNSNKKSKI

SEQ ID NO: 152947 - protein, 108 aa, Heterodera glycines
  Coding regions on vcDNA: vcDNA=SeqID_79370; Strand=-; Position=1 -271,450-505
MNFFIFFNNFILIIITILLISVNVHGNNDKNGDNSTQYKANDNIKSYIDDLGDEFWNTLPTITDLPKLDGVEFVGNHIKYTDESKNDSNETLYSDRTILTFIKLYHEN

SEQ ID NO: 152948 - protein, 29 aa, Heterodera glycines
  Coding regions on vcDNA: vcDNA=SeqID_79371; Strand=+; Position=1-87
MGKIHYCKRPDNSTKSCKARGSDLRVHFK

SEQ ID NO: 152949 - protein, 61 aa, Heterodera glycines
  Coding regions on vcDNA: vcDNA=SeqID_79372; Strand=+; Position=1 -97,138-225
MAGVGQAVTLSNLCQSQFEYIQIQRQTDDPSRDYETNQLFETPFRMVLEVEKGFSEVRGWH

SEQ ID NO: 152950 - protein, 244 aa, Heterodera glycines
  Coding regions on vcDNA: vcDNA=SeqID_79373; Strand=-; Position=1 -119,181-318,593-763,876-995,1041-1130,1182-1278
  Homolog annotation: Hit_ID=NP_499260.1; Match level="QueryCoverage =70%, HitCoverage=13%, E-value=2e-34, Identity=35%"; Hit description =clathrin heavy (3L297) [Caenorhabditis elegans] emb|CAA83003.1| Hypothetical protein T20G5.1 [Caenorhabdi
YKDPFKAFERHFTLSNQPIVNYRSDFQGKFHFLVGISAKEQQVIGSIQLYNNESKKSQLFEGHTACFTQFKAENNSKPISLFCYAPSKSGLLYLFTKLGYVHLFDIETGTKVCNTRISDKAVLLSTELKEADEVLCIDGSGKVISVGLDKSAIIPFILKHHKNTELALKFASRYNLDTDGVTSDSNNNDQPVAIQAHHQCQSVQQVLQRNSSSSISNGANSGISNGTAPMPLFESTPRNVLVFE

SEQ ID NO: 152951 - protein, 27 aa, Heterodera glycines
  Coding regions on vcDNA: vcDNA=SeqID_79374; Strand=+; Position=1-82
PINEKFFIVSLTSFEPFSDREEYNDTF

SEQ ID NO: 152952 - protein, 244 aa, Heterodera glycines; identical to SEQ ID NO: 150998
  Coding regions on vcDNA: vcDNA=SeqID_79375; Strand=+; Position=1 -256,302-780
  Homolog annotation: Hit_ID=NP_502799.1; Match level="QueryCoverage =85%, HitCoverage=33%, E-value=7e-10, Identity=26%"; Hit description =putative nuclear protein, with 2 coiled coil-4 domains (4P607) [Caenorhabditis elegans] emb|CAB16521.1| H

SEQ ID NO: 152953 - protein, 211 aa, Heterodera glycines
  Coding regions on vcDNA: vcDNA=SeqID_79376; Strand=+; Position=1 -208,556-702,770-1050
MNQPDVQHARPALVNAILNRHTETAIFLVKFPPTFRRQQFDFPTFFFIQLEKGADPHQTMIGQLNGLNMNVTLLWAAVVFVNLELCRALISHGANIEMGTDSGHSPLLCACFNGNLEIATFLVENGANVNLADTDGMTPLIATTFLLRLTSPTILSDLNINSSNSGTLCLDVFAEENDFVGPNATTASTGQALANGCTHREKMANQSDCFV

SEQ ID NO: 152954 - protein, 40 aa, Heterodera glycines
  Coding regions on vcDNA: vcDNA=SeqID_79377; Strand=+; Position=1 -51,463-534
MSQYFVNEKLKRSVDQMVHNFRYFYYYFQFNISIDRSYRW

SEQ ID NO: 152955 - protein, 89 aa, Heterodera glycines
  Coding regions on vcDNA: vcDNA=SeqID_79378; Strand=+; Position=1 -137,205-337
MALKRTKSDQLYHFDTQKMEYINLISTISILIFSFSLFGPNFYTPSDATEEEQLAMKCRQRCGIRNLNFVVNDDDDATARVKIINLITN

SEQ ID NO: 152956 - protein, 155 aa, Heterodera glycines
  Coding regions on vcDNA: vcDNA=SeqID_79379; Strand=+; Position=1 -264,321-521
MEKAPQNDTIDVVVHEVGTEHSSKDKNNINKSPLKKNAHHSIEGSRKMANKTVFLAKAVSYVSALLMKNGETDVSEKEMDRVHQRLLDMRCSSYSGYDTHNLWRAWINVRNTHPNTYQEAMEGKFHILKNAPNYGGPPNRAWDILRRKEEAKTRL

SEQ ID NO: 152957 - protein, 72 aa, Heterodera glycines
  Coding regions on vcDNA: vcDNA=SeqID_79380; Strand=+; Position=1 -71,477-624
MAMAQQLWGLRGVKRFRDAVNASSRSQGIIIWNRLPCSARQFITVPPKYCLPMLGTMLFFGIYRALVWWKCN

SEQ ID NO: 152958 - protein, 69 aa, Heterodera glycines
  Coding regions on vcDNA: vcDNA=SeqID_79381; Strand=+; Position=1 -123,769-855
MVRAEVTPTPHRSLYCTFTCPINDNHQFIRSIFLHILPTFLVSELRKKEHANTEQAVGARASEGLRAPG

SEQ ID NO: 152959 - protein, 38 aa, Heterodera glycines
  misc_feature (13)..(13): Xaa can be any naturally occurring amino acid
  Coding regions on vcDNA: vcDNA=SeqID_79382; Strand=-; Position=1-121
KGGRDPFVLQNFXKIKNHDNLLSGVLKVANHESDMYFY

SEQ ID NO: 152960 - protein, 159 aa, Heterodera glycines
  Coding regions on vcDNA: vcDNA=SeqID_79383; Strand=+; Position=1 -121,465-662,1412-1570
MRRANSTPKKRRNPSKNRANSADHPPALSRNLSARKQYFDDTVDFLNNQSSSKGRKSDVNGTLWEEFEAGRVTQLPLKEYHSSIPDYFERERAKTARKKTVEKSFTDSALKKNRSQKRKSLKNHLEQERTNDYREMAPNWQSAGYRDSYGSDSYYRTSY

SEQ ID NO: 152961 - protein, 182 aa, Heterodera glycines
  Coding regions on vcDNA: vcDNA=SeqID_79384; Strand=+; Position=1 -236,762-928,1593-1738
MPHFVPQRSAVRSTTIHVPSSSTSSTGERKITGDGGNGTASARLELIQQLQFRRQHSSPAVVEEDYERSVQFEDCVSMRSVSAWSAFDDIDTELEPKHEFQVKTNKLNDHHNRHHDNQNVSKTVHQLMGNLFKTVSALPEWHSYPKEEKGTSGGRSWEYLLGFHGGIFVPQFLPTLTTTTPK

SEQ ID NO: 152962 - protein, 53 aa, Heterodera glycines
  Coding regions on vcDNA: vcDNA=SeqID_79385; Strand=+; Position=1-164
TNGFGTALKHLQNGICTIEGPKFVDALHAHAENDPRGDHHGTPTTLATSTNYC

SEQ ID NO: 152963 - protein, 149 aa, Heterodera glycines
  Coding regions on vcDNA: vcDNA=SeqID_79386; Strand=+; Position=1 -57,160-325,374-483,1180-1294
  Homolog annotation: Hit_ID=CAE63358.1; Match level="QueryCoverage =77%, HitCoverage=71%, E-value=5e-18, Identity=39%"; Hit description =Hypothetical protein CBG07766 [Caenorhabditis briggsae]
MATVFCRDRFAVPREHLSTYIRDSWKPAVERLNGPVVFVSGRDGTELAEENGQHGDILQLDFEDSYRNLTLKMMGIYRFFTENTPVQQIVVINDDTIVNATALDQLLRAQVGSSFVISRAAAAEVLRHVCAFPGFAIHLDDILMGLLTN

SEQ ID NO: 152964 - protein, 78 aa, Heterodera glycines
  Coding regions on vcDNA: vcDNA=SeqID_79387; Strand=-; Position=1 -59,121-298
MFPMFIEWIAFKNMTSKPNVERCCTLGEMVGGGWASIVGQCCLICIVISVSFYLIVWARLKLDISRSGQSESKHFKII

SEQ ID NO: 152965 - protein, 134 aa, Heterodera glycines
  Coding regions on vcDNA: vcDNA=SeqID_79388; Strand=-; Position=1 -297,478-585
MSRLDLEEKNRALSHELREFGQRHHALQVRSDFEQQAAAREITVLRKAVGDVHDIQDQNDSLLHQNDSLLQTNEKLNKEIVMLKKWLRVFFWLLAVLLPFLWLVPGHLVCLKHRTRARNKRKQFLQSLLSHLIF

SEQ ID NO: 152966 - protein, 238 aa, Heterodera glycines
  Coding regions on vcDNA: vcDNA=SeqID_79389; Strand=-; Position=1 -253,488-657,722-1012
MAELKSRLENATDCTSIDALFHNLSVSAASAGEAQPPHVGTRPCCFIVDAVEQASPEMVVDRAGQCHQFERQFLPCTGSIPLFMGVRIGRDQLDELFLSHGSDIRLCLNTLQFNTLKTHTSDRIQANRTTTGTTTTTNANFAFVSGVSIDQKVSSSHAVPSPLNTAVTVSLFDTLSAIFTLDFHADKFVTKSGTACAVVCVPSCFHRFRHVVQPWHRPSVARSLAYAPGTVWPNVLRR

SEQ ID NO: 152967 - protein, 690 aa, Heterodera glycines
  Coding regions on vcDNA: vcDNA=SeqID_79390; Strand=+; Position=1-2073
  Homolog annotation: Hit_ID=CAE61412.1; Match level="QueryCoverage =19%, HitCoverage=16%, E-value=3e-09, Identity=27%"; Hit description =Hypothetical protein CBG05276 [Caenorhabditis briggsae]
MTSGSIGALGESGWAMAQNHNDDEMVAVRVVNKNVFNGKTSGSVRFEDVDKVLGEIVRLEEGINRVLRHVNRKANRALSNISLLSGEVNTGFRTLTTQIETCAERVDTVAQVNHADRQRRDSSLDSNRSDDIPAQDNQAENEDGLDDGHNINDQTLQWDETPFQRVNMLTDGPPIPLEVYRDDCVITYDRWAKRFREHMEAYGRKLDEKEKLARLVIYLDGIPKRLIEKMEDAKKTTIGMALTNLRAELDSPQSKSLSRQALLACRQSDGESVKDFLNRFREVEIMMSAQSSGMPFLQNERVIHAVEQESMQNPSTPSGRFQTLTPTRQDRFSSNNYEPNRRRNQTPGPQQRFRQKFDNRNQQSQYRNQRPPNDRRWNNRPVCNYCKKVGHVANACRTRLADFQNNQRPQSFNQRAKSDRWSTTPFASGANAVHQDQTLSLLHEIARTMNKLTVNTDQPGRRDDVNTIATSTEQCHVKKVHIKDKSDISKSEPLQVSSWEKATLGPKIHPFIFIVAIFCTCGPVFSNTAMIPQGPMLCQTETQPTLWKLPEIPECPIPKVTVGHVPISQIRELYIPNAIEHNTKAWACRKIIKRARKFTSLSGVPITEALSSVMLDVSVDECKQMIEHRSCIFGILTEIDGLWGTSNPIDLTPRFWFIGSFSWYEVNSKNCFAFETVISSHFFNNQSICI

SEQ ID NO: 152968 - protein, 866 aa, Heterodera glycines
  misc_feature (847)..(847): Xaa can be any naturally occurring amino acid
  Coding regions on vcDNA: vcDNA=SeqID_79391; Strand=+; Position=1 -572,807-1285,1565-2330,2957-3643,4874-4976
  Homolog annotation: Hit_ID=NP_500013.1; Match level="QueryCoverage =98%, HitCoverage=60%, E-value=0.0, Identity=40%"; Hit description =predicted CDS, polyprotein family member (4B673) [Caenorhabditis elegans] gb|AAC02594.1| Hypothetical prote
AKASYLTWNEVVSEVNTLHPYMATVRAFVNNKPVCSLMDTGASVTLAPISLAQDLNCLYPTNERVISASGHLIDVRAKALMHIEVANCKIYTEVKLVNDDGAAKRNYKLIIGCDAMKKMPPVTFDIANAKLHILNGSTDIGAERDWLFSDVKVVCNVSTDLLPGHCKVIEGKLLSFCDLNQVLVHDLDSCIDFSKSSATGDNLTKLRKLCDEFSDIFSKSQYDLGSCLVGEHDIVTKTEEPVASKPRRTPFRFREEVKSHLDKWIKAGVMVKSDTPWVSNLVLVQKKDGGLRPCIDFRKLNEVTIPDHYPLPRLEMILEKIGKCHWYSSLDLSSGYLQIRLTDRASRKCFVINEHGYTPSLGKVEIIKELPAPTSVKEVRRIIGMASFFRKHILGFSTLVEPLTRLTRKEVPFVWEAEQQDVFNKIKSILCDKPVLRFPDYQKPFHIFTDASNVGQGGALMQKDNDKAPFHAVAYCSRTLSTAERKWPTVQIELGSIIFALRQFRPFIYMGNVELHTDHKPLAYLLQKADAHPNLARWLIELQNYNIKIVHVAGKQNSLADALSRAAHENLSEEEVKNLSELKDVAEFPACLVLHLSHAWSSMSYLKFGGCTELITDNATAFTSEFFREFCAMLYISKRYAIPHWSQNASTERTFRTFHNILSKYISKDQPDFDEHLEAATFCYNTAVHQSTGETPFFLMYGRDPIFCVDQILDPRTADPVAFTDLTEFKYRLIISLRMAWAATAEEIRESQMRAKAQYDKQNRVLDIQVGDRVLLKNYISKVGTSKKFHLPWRGIFRVVNIDGVKVTITSCNAPQANPRVVHINQLKKSFETTIPMRLLKDKSCCXKEVPSSKTMTLSSWYESKS

SEQ ID NO: 152969 - protein, 320 aa, Heterodera glycines
  Coding regions on vcDNA: vcDNA=SeqID_79392; Strand=+; Position=1 -817,1492-1637
  Homolog annotation: Hit_ID=ZP_00225060.1; Match level="QueryCoverage =47%, HitCoverage=92%, E-value=8e-16, Identity=40%"; Hit description =COG3236: Uncharacterized protein conserved in bacteria [Burkholderia cepacia R1808]
MENHLIPGIPFLLDGQIAIKFFTLRYFTSNHHPAPFEMDFDDWGVRHMHSSEQGYFALRAVEFGDRQQFEHVLNLASARDVKNRGKRVRGYSYGHWQTVKREHMLRVVLEKFRQNEPLCEALLRTGFVRLVEASTDRYWAAGLLITDEAIRSSNNWTGRNELGWVLMHVRDQLRPLPQQVHLIHKHYVVCQAAAPDYVVALAAEPHVQPYAVRINNETVNAARQLQIGDTLVIGSVEWREGFEQLGAEGMNDRPCWVHQARFNWQATASAVYTVLRSHPQQPRPVMEDYTTNAADHRLSTTFQSQFASTSGGYLIRWKYY

SEQ ID NO: 152970 - protein, 187 aa, Heterodera glycines
  Coding regions on vcDNA: vcDNA=SeqID_79393; Strand=-; Position=1 -50,110-200,248-351,396-448,629-699,746-859,1280-1360
  Homolog annotation: Hit_ID=CAA62379.1; Match level="QueryCoverage =67%, HitCoverage=31%, E-value=2e-23, Identity=46%"; Hit description =SIX3 protein [Mus musculus]
MWNDAHYQQAEQMWGKSPLGPVDKYRVRKKHPLPPANPEKHCFNDNTRKILMENYLTDAYPSPAKEQQLAQETGLTEMQGDGIISELINAWQFVNESKQVGNWFVNRQQRDKKKQQKVPDHPERIGEEIKAQKRIMADAKKIFDAASARLEQLEQQQQAQNRSSTKMPPADELEKEYEFVELKEMDE

SEQ ID NO: 152971 - protein, 199 aa, Heterodera glycines
  Coding regions on vcDNA: vcDNA=SeqID_79394; Strand=+; Position=1 -319,371-651
  Homolog annotation: Hit_ID=NP_500013.1; Match level="QueryCoverage =73%, HitCoverage=9%, E-value=5e-14, Identity=35%"; Hit description =predicted CDS, polyprotein family member (4B673) [Caenorhabditis elegans] gb|AAC02594.1| Hypothetical prot
MGNVELHTDHKPLAYLLQKADAHPNLARWLIELQNYNIKIVHVAGKQNSLADALSRAAHENLSEEEVKNLSELKDVAEFPACLVLSSESRLVLDESINALTLRSDDASAFIEFLKSGEIPDGLSDLEKEKFAATASKMLIDSELLVHQESELRPRIFVPVSLRALVFDSFHSSPLGGGHMNLTKTLKNAEIFLARCMQI

SEQ ID NO: 152972 - protein, 612 aa, Heterodera glycines
  Coding regions on vcDNA: vcDNA=SeqID_79395; Strand=-; Position=1 -210,417-908,1168-1492,1541-1699,1832-2484
  Homolog annotation: Hit_ID=NP_498952.1; Match level="QueryCoverage =86%, HitCoverage=34%, E-value=5e-93, Identity=35%"; Hit description =low density lipoprotein-receptor, class A (3J922) [Caenorhabditis elegans] gb|AAK67236.1| Hypothetical pr
MMGIFHCAEVISPNFSAMLQGVHGQAHMCKAFYSLRSAFRCGQQTMRERCAKETETAKKMDEHLTEMQWTLESLGREEGCPAEEPSNLEELLSRRVLPAGRPPVGAAPLLTLRGPTAPQARPLPTADALTPKDNQCDEQQQQLFNECVQPLTAFQPVSIDWPIPRGLAWHFPPPPPQHPLAVIKQPKLIDQACQAFRNFSECRLRAQCFPLWARGMSAMFDFACGPRGSALYSEECVVAFSHGAPKDACPSARTLLSCAVPELSERCGEKAVQFVHEYVAVFAKAVDPNCALMGGRREEERDNGGQRDKGEMREKVEMRENAGQSDKEEQNIEVGMESGRKGPIAALNCSDEQKQLVRHCAAPLEALHAQLGELFEGGLQNVLKNLNGLAPLFAQGCMLGAEFRQCLSLLSSSSAADNESNRCVVSSCLVAAGAGICDQPDATQAIDTHLGCVFKQVSRKDEAAKHCLSVQVSDPEFGKCLRTTLVPIKQFSLASLRQALPQFVDCVHEIVQRTCGPIPLNVLHVLASKDNICPVNGPKATEQSVGGGKRAEENGNGKSLVKGRENGISGTPCANDMHSGDEVGSWRNLMIEYIAILQYFQVPLIGHNWPMI

SEQ ID NO: 152973 - protein, 124 aa, Heterodera glycines
  Coding regions on vcDNA: vcDNA=SeqID_79396; Strand=+; Position=1 -105,415-476,735-939
MDSYEVERTTTSPVELRHHFHIPSALTANGGDKSEEIEEIDRQPFPPYPDASAQPISSATNNQHHDCVPSTSTDIASTAFFAEIPLHQEMRKSDNEATLNEVEIEANEQHKKANKVVLYITALI

SEQ ID NO: 152974 - protein, 144 aa, Heterodera glycines
  Coding regions on vcDNA: vcDNA=SeqID_79397; Strand=-; Position=1-576
  Homolog annotation: Hit_ID=NP_497989.1; Match level="QueryCoverage =100%, HitCoverage=17%, E-value=2e-47, Identity=62%"; Hit description= rho GTPase activating protein 12 (3F891) [Caenorhabditis elegans] emb|CAA86318.1| Hypothetical protein C
PSMESLRERGIYKPEPVFGSTLADICTREKAFVPKFICEVTRLIEQKGLESDGLYRVNGNLSAVQRIRCQIDQDSYDSLYHEEDIHVLTGALKLFLRELSEPTFPVSMHKDFMSAMRETGIKRLRIIDDLLIRLPHINRETLRV

SEQ ID NO: 152975 - protein, 227 aa, Heterodera glycines
  Coding regions on vcDNA: vcDNA=SeqID_79398; Strand=+; Position=1 -233,1057-1150,1235-1489,1544-1644
MQIHNLAIIFGPSLFCSEERPNHQRKASQDKGKSGRRKSSDKRSQNEDQVQTEPTQNLAYRMIVYGQIVEFILNETDSLAYEFGERACEFVLHVQPATRRPSACSVQHNRPFAIAFLMPSQPTAKNVEAFQQAAAELLMPIIACNKRYVHSILRQAMLMLSERDQQNVQSYYSTSGNAQQIVIVSNKLKSVVQKTNAWFERVSDQLCESDGSADECFCECAGPEEFR

SEQ ID NO: 152976 - protein, 140 aa, Heterodera glycines
  Coding regions on vcDNA: vcDNA=SeqID_79399; Strand=+; Position=1 -360,408-470
MSDNNTHCQLFGISREANATSQWINGEKCEHCTVVDLGNQKMRAHEYSGRLLAQLHGKRNFPSDSAVAAFVVSVITDLNQLLVLAHYVTPEAVFKHLSLSISDQLILLNGLAEFNVTKYSQMNKKKFDRQKCIPYKKMKF

SEQ ID NO: 152977 - protein, 243 aa, Heterodera glycines
  Coding regions on vcDNA: vcDNA=SeqID_79400; Strand=-; Position=1 -168,215-402,453-690,1261-1291
  Homolog annotation: Hit_ID=CAE71127.1; Match level="QueryCoverage =93%, HitCoverage=73%, E-value=3e-31, Identity=34%"; Hit description =Hypothetical protein CBG17981 [Caenorhabditis briggsae]
FNLFLQNFGYIAYILSVVALLQHVNDLISLDECAVADLGCGTGMLLLGSTLLGAKFAVGVDCCQNALSVAKNNFAVGVDCCQNALSVAKNNIDKFEFEGSTTTNLVLADVTKFVPFIGKFDVVLTNPPFGTKNNQGTDVAFVLAGLRMLRPGGKTDVAFVLAGLRMLRPGGKLFSLHKSTTRNFLTKMAKNWDTVNGMECVAELKWNLEPTYKFHKKTNVDINVILCSFEKRYKIKREKQSKE

SEQ ID NO: 152978 - protein, 51 aa, Heterodera glycines
  Coding regions on vcDNA: vcDNA=SeqID_79401; Strand=+; Position=1 -54,1419-1520
MKGPSLRIYYDFVNNLDGAHHTDRLSLNLYLFSFSVVSPANFYSGWIIACQ

SEQ ID NO: 152979 - protein, 47 aa, Heterodera glycines
  Coding regions on vcDNA: vcDNA=SeqID_79402; Strand=+; Position=1-144
LKMVLTRKKSENLKNMSNSGVEARQKRKEWRREHAKKAGSTPKNDEN

SEQ ID NO: 152980 - protein, 106 aa, Heterodera glycines
  Coding regions on vcDNA: vcDNA=SeqID_79403; Strand=-; Position=1-322
AVSEVLRRLPDFWRFATWGPDIVVPTFGDPDILGPDFWGSRHLESRLLGIPRFGDRTTFGELTLREHNIREPDFWGSRHLESRLLGIPRFGVPTFGYTEIWGPNDI

SEQ ID NO: 152981 - protein, 58 aa, Heterodera glycines
  Coding regions on vcDNA: vcDNA=SeqID_79404; Strand=+; Position=1 -72,315-419
MYSTGSQTLPGLGFLKIQYPVPDPDAIPGLKSWTRLFRTPSIPGPGFCPNTRTRVTLL

SEQ ID NO: 152982 - protein, 150 aa, Heterodera glycines
  Coding regions on vcDNA: vcDNA=SeqID_79405; Strand=-; Position=1-451
YVDHSVIAFLRSNHQIFDKRGTDLYLWIPSSHSTNGQPIWDVFAREIWPIFSANIYQLGLSRGDNFDHLLRRISPTILTDLNKLNSIKSFGRLPAAFGDDFDVPNATISSGQALSKWLHSPRKDGQPKRLRFRRNLNAQADLDWVNNFKE

SEQ ID NO: 152983 - protein, 63 aa, Heterodera glycines
  Coding regions on vcDNA: vcDNA=SeqID_79406; Strand=+; Position=1-191
MAHTKFFCLLRSLTWMCWTWITAQTWSKNCATAGMQIMHIVCFALATRAPPAAPAITTWSAAR

SEQ ID NO: 152984 - protein, 235 aa, Heterodera glycines
  misc_feature (217)..(217): Xaa can be any naturally occurring amino acid
  misc_feature (232)..(232): Xaa can be any naturally occurring amino acid
  Coding regions on vcDNA: vcDNA=SeqID_79407; Strand=-; Position=1 -64,137-258,322-397,662-739,800-892,1346-1447,1500-1544
  Homolog annotation: Hit_ID=CAE57918.1; Match level="QueryCoverage =91%, HitCoverage=36%, E-value=3e-64, Identity=60%"; Hit description =Hypothetical protein CBG00970 [Caenorhabditis briggsae]
PNYLRAGTHVHLQSENGILGVGPYPYPGEEDGPYPYPGEEDPDWINAGKESITFLPGASTFGSDESFGMIRGGHIDLTLLGHIDLTLLGALQVSKYGDLANWMIPGKMVKGMGGAMDLVGAPGSRVVITMEHCAKGGKPKHCAKGGKPKILDNCTLPLTGKNVVRRIITEMAVFDVHPTDGLSLVEVYETFSVEDVVRATGCQFKISENLKPMLQAXLITISENLKPMLQAXLIT

SEQ ID NO: 152985 - protein, 44 aa, Heterodera glycines
  Coding regions on vcDNA: vcDNA=SeqID_79408; Strand=-; Position=1 -24,235-345
MRGRETMRLTETSPRWARMRRTPENYALLQQGYINTALKKAKKH

SEQ ID NO: 152986 - protein, 116 aa, Heterodera glycines
  Coding regions on vcDNA: vcDNA=SeqID_79409; Strand=+; Position=1 -283,900-967
MAANTRTLLQVVTMLQAQKSAGLMAANNEVLDALNHATWELRSALDALKEQIIAQNKGSDAQEMDEDENLPQINYENQPHPLDELSHGHLPTLFYESFMLLKMSYRNPLYKNFRQP

SEQ ID NO: 152987 - protein, 128 aa, Heterodera glycines
  Coding regions on vcDNA: vcDNA=SeqID_79410; Strand=-; Position=1 -226,277-366,734-805
TICQTQLTAAGAASAGIVPLNTSQWISHILDQQQGDNTDYEQQQREATQLLVGRRLSSMRSMWEERISEESEQKEYEEQVNAALFARRQFLFPKWRSVDPLTASLVASHKTPEMIPVVNNLSKKLIFA

SEQ ID NO: 152988 - protein, 141 aa, Heterodera glycines
  Coding regions on vcDNA: vcDNA=SeqID_79411; Strand=-; Position=1-424
MLFLLFIFVFLIINNSTDKTLSVNLCKKCRPTFAEIFGEEWQNEIIIGGDENENETDQNANFHQNDQNESTDQNDQLDVQQKIEIIHKFHAIREGIKKKGKYSAKIWNKIEQKIAKKLGISRQKIYKLKRELKLNKNKRNS

SEQ ID NO: 152989 - protein, 245 aa, Heterodera glycines
  Coding regions on vcDNA: vcDNA=SeqID_79412; Strand=-; Position=1 -580,628-785
MLFLIFIFVFLIINNSTDKTLSVNLRKKCRPTFAEIFGEEWQNEIRIGGDENENETDQNANFHQNDQNESTDQTDQLDVQQKIEIIHKFHAIREGIKKKGKYSAKIWNKFELKIAKKLGISRQKIYKWKKEIGLNIKNDQNYYEMKKKEFIARIDEIKRTSENGKQKQFAKELGIHKETFIKWKKEFGIEMGKNGIRYSNEEKMRKMNVYYKMKRENPSLSDKEIAGILKIGFATLKKWKKENNS

SEQ ID NO: 152990 - protein, 290 aa, Heterodera glycines
  Coding regions on vcDNA: vcDNA=SeqID_79413; Strand=-; Position=1 -229,565-712,759-1002,1134-1385
  Homolog annotation: Hit_ID=XP_428380.1; Match level="QueryCoverage =97%, HitCoverage=20%, E-value=2e-38, Identity=29%"; Hit description =PREDICTED: similar to WD repeat membrane protein, partial [Gallus gallus]
MGKHQKAIRSAVWNREGTVFVLASEDTAITMNNAEGETLNTFTCNGEIAELKLTTFRSFSGEREEDFVRGRRAISGDQGFIVCLSAERSAESISQELFSIQEYKTNLASITVNEPLGKMFSIGDNLLKGRDLVDLGEISDLVNVDSDDSGLVEVACSEDGSMTAVSARSGAVCVYLTKLPMLAAASSTHIAVLASLTEISIYQDGEIQPSQNLNIKIEPSLIAVGAKHIAIVLNSKAWFYEIKRNGTSFMYEHDYMTTIVKMKLNRDFVMAQLDNRVHLHKVNTILINRF

SEQ ID NO: 152991 - protein, 67 aa, Heterodera glycines
  Coding regions on vcDNA: vcDNA=SeqID_79414; Strand=+; Position=1 -148,192-247
MKKSEFIERFDEFKELYGQGKQKEFAKELGICEETFLKWKKELAPKYHKTLIKPSNYDKLKKDEAIF

SEQ ID NO: 152992 - protein, 134 aa, Heterodera glycines
  Coding regions on vcDNA: vcDNA=SeqID_79415; Strand=+; Position=1 -256,311-459
MERKIVKLLGANLQLIQKWKNELNLNKNKIKKRIYEEKKRKFIERFDEFKELYGQGKQKEFVKELGISEATFWKWKKELAPNYHKKHHTNDDKVKKMKQYFEIKEANPKVSDAIIAEKLAIGFSTMRKWKKECS

SEQ ID NO: 152993 - protein, 208 aa, Heterodera glycines
  Coding regions on vcDNA: vcDNA=SeqID_79416; Strand=+; Position=1 -598,646-674
MNLWLLIFIIFCIYKIESSKILPDFDEIFGNRWDKNETEEKAIKIEQNENTQSAEVGQMDEEMENDQKNVKINHKINDEATDQQKREIVKKFDAIREKLREKRKFDWKIRNKIETKIAKLLGTNINSIWKWKNELNLNKNKIKKRIYKEKKRKFIERFDEFKGLYAQGKQKEFAKELGISKETFRKWKKELVPKYHKSQKNPKNDEKL

SEQ ID NO: 152994 - protein, 162 aa, Heterodera glycines
  Coding regions on vcDNA: vcDNA=SeqID_79417; Strand=-; Position=1-489
MNLWHLILFIISFIFVIESGKIRPNFDEIFGDGWEKKESKEKLMIKIEHNEQNEQSQNAAIDQKRNDQKSSKINHNINDEATDLQKREIIEKFEAIKKRLREKRKYERKHLSKIETKIAKLLGTNRKLIQKWKKELLPNYFKSQILLYFPFKTMTMNALGLL

SEQ ID NO: 152995 - protein, 105 aa, Heterodera glycines
  Coding regions on vcDNA: vcDNA=SeqID_79418; Strand=-; Position=1-316
MNKTEWNSEWKLQKIFREKHNYLKTIKEIDEILDTIKDINLEVKRRLKALKPNSPSESDQENESIDEEQENDDEEAGEEEDEDEKEYDSDQEDESQEMHSREQTH

SEQ ID NO: 152996 - protein, 64 aa, Heterodera glycines
  Coding regions on vcDNA: vcDNA=SeqID_79419; Strand=-; Position=1 -109,163-248
  Homolog annotation: Hit_ID=NP_496110.1; Match level="QueryCoverage =100%, HitCoverage=12%, E-value=2e-12, Identity=53%"; Hit description= cytochrome P450 family member (2K78) [Caenorhabditis elegans] emb|CAA88606.1| Hypothetical protein T10B9
FDTSANTLSLVCHALALHAEVQEKVQEEIDSVCFDEDPTYEQLSQLKYTEAVVKETLRLLPIAT

SEQ ID NO: 152997 - protein, 143 aa, Heterodera glycines; identical to SEQ ID NO: 132463
  Coding regions on vcDNA: vcDNA=SeqID_79420; Strand=-; Position=1 -405,963-989

SEQ ID NO: 152998 - protein, 88 aa, Heterodera glycines; identical to SEQ ID NO: 124691
  Coding regions on vcDNA: vcDNA=SeqID_79421; Strand=+; Position=1 -96,135-305

SEQ ID NO: 152999 - protein, 182 aa, Heterodera glycines
  misc_feature (179)..(179): Xaa can be any naturally occurring amino acid
  Coding regions on vcDNA: vcDNA=SeqID_79422; Strand=-; Position=1 -97,154-253,739-902,998-1034,1481-1582
  Homolog annotation: Hit_ID=XP_316502.1; Match level="QueryCoverage =96%, HitCoverage=18%, E-value=4e-41, Identity=46%"; Hit description =ENSANGP00000013449 [Anopheles gambiae]
WPMIALKKLNRTSEVDIKRLCSLEHANVIKTLGICTKEHFPGICTKEHFPCIVMEYCEKGSLFEHLRRNPNISKQSMFINCSVQIAEGMCYLHSLKIVHRDLKSPNILIDKNNTVKICDFGSLYSWDQSSVVMSVCSVVMSVCGTSQWMSPEMLTNKPCNERVDVWSYGVVLWELLTGXVTD

SEQ ID NO: 153000 - protein, 129 aa, Heterodera glycines
  Coding regions on vcDNA: vcDNA=SeqID_79423; Strand=-; Position=1-390
MAVTGNAPSLVTGTNSSSGNNSNSNNNNNTEIDSNNTTVIHNSNHNTTSEDGDWVKSPPPPPSVEEATVVDSAAGLNCSPSLSTISLSSASPASVTYLGDSGDDNTTVRRVPNSFDRRRTNSVDLRTDI

SEQ ID NO: 153001 - protein, 143 aa, Heterodera glycines
  Coding regions on vcDNA: vcDNA=SeqID_79424; Strand=+; Position=1 -297,541-675
MAYPPPQYIPLYPLSGAPNYVMARPLADGNFMAPIQAPMARDATTQQQRLGPPHTTPTAPPAAAQSAAPAHSVPPPLNPPAHSAAPPLNPPSTGAGPDMEATENPGPIGLVEKPTLGNGNEPAVAAVLPESDSNAASSLASST

SEQ ID NO: 153002 - protein, 121 aa, Heterodera glycines
  Coding regions on vcDNA: vcDNA=SeqID_79425; Strand=-; Position=1 -50,128-204,249-438,528-575
  Homolog annotation: Hit_ID=NP_506387.1; Match level="QueryCoverage =97%, HitCoverage=23%, E-value=1e-14, Identity=36%"; Hit description =i-43 protein (5O161) [Caenorhabditis elegans] emb|CAB03152.1| Hypothetical protein F58G11.6 [Caenorhabdit
DCESNISAQHDFDYRYVTSTNTKEVVLVVEGGEFLIGASFNKKNCTAKDYFLHLPTINSLLFNAYNAYKLHYGYFSYRFRAESNEFKEILDRFFTPFLHLYRVNKIPLVDLFNGVDFLSIG

SEQ ID NO: 153003 - protein, 108 aa, Heterodera glycines
  Coding regions on vcDNA: vcDNA=SeqID_79426; Strand=+; Position=1 -150,905-1081
MVPNSRRCPSICCPLLLPTLSPTHRLAPPITTARPPTITRTLWTRPSRLAGADSDLLPNDPTSLESISLTAEKLSRKLSKAQALLKDWTIILSSSSKEVREQENALFD

SEQ ID NO: 153004 - protein, 47 aa, Heterodera glycines
  Coding regions on vcDNA: vcDNA=SeqID_79427; Strand=-; Position=1-141
GGGWKDGKSTKERTEAVIGWPFCALWPQIVGQVGQSNHCRGKQREFE

SEQ ID NO: 153005 - protein, 136 aa, Heterodera glycines
  Coding regions on vcDNA: vcDNA=SeqID_79428; Strand=-; Position=1 -174,504-718,765-786
DVEQADIAQRVTMFSSVAEEFLGMKAAELLAKEKEPESLAKHLDDLIAVKIIAKVNIKMMRHKLQNGLDVIAILFFLREFTMRQDCTLTIFRNEHREICSWLYPSGGSSTLLITIQLTLLEKLGPYAFVTFDLHQG

SEQ ID NO: 153006 - protein, 94 aa, Heterodera glycines
  Coding regions on vcDNA: vcDNA=SeqID_79429; Strand=+; Position=1 -76,177-385
MISRKQNNKWTNCLGKFLNENKIERVIFSHFYMFSLFPSALFLLLHHIDIYSTDQIEDKKNSHKELDTEIRTLFNETKVRILILWVSLKYKTIN

SEQ ID NO: 153007 - protein, 67 aa, Heterodera glycines
  Coding regions on vcDNA: vcDNA=SeqID_79430; Strand=-; Position=1 -178,228-282
  Homolog annotation: Hit_ID=NP_491624.1; Match level="QueryCoverage =83%, HitCoverage=20%, E-value=2e-13, Identity=57%"; Hit description =ribophorin II (31.1 kD) (1G118) [Caenorhabditis elegans] gb|AAB42275.1| Hypothetical protein M01A10.3 [Ca
MSPKSSHVNYDLLPEISHTFRSPEPRPSVLVSDMFSVLCASPLIILFLLWLRIGINFGKFKFSLSAL

SEQ ID NO: 153008 - protein, 65 aa, Heterodera glycines
  Coding regions on vcDNA: vcDNA=SeqID_79431; Strand=+; Position=1 -45,115-237,337-366
MTTNCCANAIILRPAEGVASYVGEQYMDVCRPGRGGYCSPVVFLNADGTFRGVITFKEGPTPINN

SEQ ID NO: 153009 - protein, 66 aa, Heterodera glycines
  Coding regions on vcDNA: vcDNA=SeqID_79432; Strand=-; Position=1-201
TFRTPDQKPQSSSSLFFDLARCTEDHSTQHVDAYQQIFVTVVMLFQLVKYAQIALPIGMEAARYRL

SEQ ID NO: 153010 - protein, 42 aa, Heterodera glycines
  Coding regions on vcDNA: vcDNA=SeqID_79433; Strand=+; Position=1 -50,549-627
MSRCLRMLGSGVYEMIKKRESNWGDQSKKCVILSDQKLPEWE

SEQ ID NO: 153011 - protein, 100 aa, Heterodera glycines
  Coding regions on vcDNA: vcDNA=SeqID_79434; Strand=+; Position=1 -138,1348-1512
  Homolog annotation: Hit_ID=NP_491379.2; Match level="QueryCoverage =91%, HitCoverage=11%, E-value=2e-33, Identity=58%"; Hit description =guanylyl cyclase (144.9 kD) (1F75) [Caenorhabditis elegans] gb|AAO61423.1| Hypothetical protein T01A4.1c
MIILIYRENETSNLVDNLLKRMEQYATNLEGLVEERTQEYLGEKKKVVTLLNDLYLAFDGVVDNFQVYKVETIGDAYMVVSGLPERTTDHASQIAQVPKI

SEQ ID NO: 153012 - protein, 73 aa, Heterodera glycines
  Coding regions on vcDNA: vcDNA=SeqID_79435; Strand=+; Position=1-220
FYDTFNNLLYLMEYKTNCCLLNKRSHQKTFFPNSLLRPFSLCRFAEQFDLELKVRVQFRIDVAHQLQQTHNDL

SEQ ID NO: 153013 - protein, 402 aa, Heterodera glycines
  misc_feature (225)..(225): Xaa can be any naturally occurring amino acid
  Coding regions on vcDNA: vcDNA=SeqID_79436; Strand=-; Position=1 -138,185-279,469-560,620-712,791-951,1080-1155,1205-1390,1653-1882
  Homolog annotation: Hit_ID=NP_505689.1; Match level="QueryCoverage =92%, HitCoverage=43%, E-value=2e-81, Identity=44%"; Hit description =solute carrier family 21 member (5K962) [Caenorhabditis elegans] emb|CAA16312.1| Hypothetical protein Y32
RRVRFQVTGILPIRSLKTFQGFYIFMPKYLELQFGIPQYEVNRLMAIIGVIIGVATFAVGVMVGSLVMRVAKLQGRKAAAWVAMTGAIAACFSLLNSLVGCTSTMTALGDSLVANANSTSSCAVGCHCELAPVANANSTSSCAVGCHCELAPLYPVCDPNGAVYYSYYSPCHAGCQLGESAFSILETQKTPLFESCLCSPTERVSREFCREENCRSKMYNFCHFXSFSQIIGGMGVVPGVLIMLRSVPPKHRSISLGFNGFLVSSVPPKHRSISLGFNGFLVSLLATLPSPIAWGTIIDNFCLFWTQKCGEKGACALYATDGLRFWLHFAYGGLRIVSLITDLFVIYHAVGLKLTDSDSQNANDERETAKATKKRQRAKREAEGRQRTTNWRGNRQRHFWRK

SEQ ID NO: 153014 - protein, 42 aa, Heterodera glycines
  Coding regions on vcDNA: vcDNA=SeqID_79437; Strand=+; Position=1 -87,286-327
MSEGVLTGPIDFAGLQNDLKMAYNITCLLNFSCITKKVYLVL

SEQ ID NO: 153015 - protein, 800 aa, Heterodera glycines
  Coding regions on vcDNA: vcDNA=SeqID_79438; Strand=+; Position=1 -215,590-2775
  Homolog annotation: Hit_ID=AAO52302.1; Match level="QueryCoverage =80%, HitCoverage=62%, E-value=2e-27, Identity=22%"; Hit description =similar to Homo sapiens (Human). Dentin sialophosphoprotein precursor [Contains: Dentin phosphoprotein (De
MAIGHNELVRVAKNRKLYNHFDEVQIGNNHDEFGKYIVFLPNWFNVYQFIFADDNGMPFGREFKSAIKQMKKCLDEIVEEQESPTHRGIKTICILPRKVDRRYDYKNWANKIDQLRNGQNIFKCKKWTKRQEVDKLNKIFKAIFEGKAIPEIICDQITLRKGYKRNKNGKTNNAEATKNGSDAESEKSDSDTVHMTPKVATTATVPKSLPPRSGPSPKAMIGFQSSPKMPRKLNASAIPSHSSNDNYYGMLGPLKSTPKSSAKLNTNAKPSQYRNINGTVDDYYYGGNKEDSETDMEEADPRNKRTPPKKHRKQEKLSDSRRLAQFQSIKGYGIHDGSNNGGNSIPTKSGSSSTPIHKSSGNNSPKKSHSPNQHSLSNSLKYSSPKKAAYSTVNLPVNPPHKNNTNYNSLTSEQRGRNLHNANNGGHHSHKNEGYGSPAGSTNMNSLSKSRSANNSPKEAAYSNPTSNIHMNTSHKSPKSEQKGRNLHNPNNSGHSNHNNEGYISPAMKKNVNLIPKFFFDNNSQEKADNSNPAANVPVNLKSKSLSANNSPKKAAYSNPAANIPVNLKSKSLSANNSPKKAAYSNPAANIPVNLKSKSLSANNSPKKAAYSNPAANIPVNLKSKSLSANNSPKKAAYSNPAANIPVNLKSKSLSANNSPKKAAYSNPAANIPVNLKSKSLSANNSPKKAAYSNPAANIPVNSMSKSLSANNSPKKMAYSNPAENIPVNSMSKSLSANNSPKKMAYSNPAENIPVNLKSKSLSANNSPKKMAYSNPAENIPVNLKSKSLSANNSPKKAAY

SEQ ID NO: 153016 - protein, 248 aa, Heterodera glycines
  Coding regions on vcDNA: vcDNA=SeqID_79439; Strand=-; Position=1 -106,150-469,566-702,748-931
  Homolog annotation: Hit_ID=XP_393177.1; Match level="QueryCoverage =51%, HitCoverage=17%, E-value=2e-14, Identity=35%"; Hit description =similar to ENSANGP00000002068 [Apis mellifera]
MGHLNLDEVLQFGGSKEVVIWDTTCIQQKVRHSMRELHAGKIEVSNCYTKPAELTGEPCGTSGRQRIVTTVNEKEPMILSEEDPEEFSSADDSESDMEFTPRTTTDDHGTAEYLGRRRKKFLKQRNIKQRVIALLRKFKPDEVMAEEEEGPHTSGSIVQPTELELQEIFEELENISDSGPEIEDDKLSIVSNPRPKIRPFFGSKSDIMPPIIDLQTEEGLFLSDELSADSEASECRPIASLLETLFRL

SEQ ID NO: 153017 - protein, 247 aa, Heterodera glycines
  Coding regions on vcDNA: vcDNA=SeqID_79440; Strand=-; Position=1 -240,300-470,1230-1343,1388-1606
MQSVLIFSKIRRLLTASLATLRGNAPFTAAFLLRLFAYANSDAVGKREKSETSDPNTEKSKAILGKKQQLVDTNDVRSEVAALTLLKAPFVLKTKHKNIQTPEEQSSDDTLVFMRILKSLTFFNVQLLRRLQMLDEKIHYNSYAYDFWKNPDVDALGTRNKLTKGEQWYLINDFNKMLTEISSGLDYIAQSKDSLCKVAKEVADEFDVKFREAFKMKRRKEKEDKEKEGVKEEEAGTQPTAQEKPKE

SEQ ID NO: 153018 - protein, 413 aa, Heterodera glycines
  Coding regions on vcDNA: vcDNA=SeqID_79441; Strand=-; Position=1 -304,361-514,572-642,1235-1289,1337-1475,1526-1706,1862-2043,2087-2242
  Homolog annotation: Hit_ID=CAE64358.1; Match level="QueryCoverage =99%, HitCoverage=29%, E-value=7e-36, Identity=36%"; Hit description =Hypothetical protein CBG09045 [Caenorhabditis briggsae]
YQLFSDSLEGQMLVDFTRVPKANVSETKETTVQKETVKKEKDAGVKKKAGKPGAGGGKGGSQLSKKDQILKESREKKNKEQIESDRQKIEYATGIKANVREAIFALDDLLRRLELDESKALCMYQKMLRYNEIFSERLENFENIDNKRIAALELVESIKVILTKYYDHLDSQQKDKSKNMSGGKVLYGIYTNEILNNPLNCQVLVTNPDCFEQILLSTSERCREFVSRIRYVILDEVHCINQKDTQGLSLGHIWEHIFLLIRCPFLALSATIGNIEELRDWLQEAEQLKPIDGAPARTVELECPKGVQFETDETKFFRGSSVTSNEIEDGTGEDAANDRASVASRASNNNSPVPSEISQQSKATWNDVVQFFNPFSVYKLEKLRMFGIPADQRLTARQVLELYQMMSDVDKTV

SEQ ID NO: 153019 - protein, 213 aa, Heterodera glycines
  Coding regions on vcDNA: vcDNA=SeqID_79442; Strand=+; Position=1 -195,242-368,417-614,684-805
  Homolog annotation: Hit_ID=NP_505879.1; Match level="QueryCoverage =93%, HitCoverage=98%, E-value=1e-81, Identity=72%"; Hit description =emp24/gp25L/p24 family (23.7 kD) (5L804) [Caenorhabditis elegans] emb|CAA98480.1| Hypothetical protein F4
MLSRTWIVAICFYIFFGTILPFSEAIRFYVASNDKKCLKEEIHKNIVLTGEYELSDSVGHTTTVHVTDTRGHTLYKRENFPEARGKFAFTADEYDIFEICFQMHGPTHQQKLNREVHLVLKHGVEAKNYEDLAKAEKLKPLEVELRRLEDLSDSIVQDFAYMRQREEEMRDTNESTNSRVLYLSIFSMLCLLGLATWQVIYLRSYFKSKKLID

SEQ ID NO: 153020 - protein, 507 aa, Heterodera glycines
  misc_feature (19)..(19): Xaa can be any naturally occurring amino acid
  Coding regions on vcDNA: vcDNA=SeqID_79443; Strand=-; Position=1 -90,1377-1503,1549-1849,1891-2084,2133-2399,2445-2525,2570-2773
  Homolog annotation: Hit_ID=NP_498283.1; Match level="QueryCoverage =97%, HitCoverage=23%, E-value=3e-49, Identity=29%"; Hit description =DEAD/DEAH box helicase and helicase, C-terminal (194.0 kD) (3H3) [Caenorhabditis elegans] gb|AAA62291.2|
RRSSTSRGFSFSALAKSSXFLASTPCFSTNISEFADVEIFLISLDSLLLELCAHRYHKWVLGGQTIVLCEQIKQFLGGLEELNAKFKLVTFTELTQIKQFLGGLEELNAKFKLVTFTELTPLFKSDTFLAFLHPFILCWITKSKWAENLEFFTSPLDEKWNDYLHQLTPSFMLLSLENAPDIIKEPINFADRFISLAFSLINEAFSLINEAIPVVLFNGFTINFISVNAYRLSTVPLNIEGFSQKIREKWPETRGRKLLSMRKLVYIFSCQNITDSCQNITDFWAVVLRDELKEAEKNKEKLDEFQKFCNAVLLSALICEELGVKRRYLDTEEDYNKGPSPSVNSFRRGLLERAQKLLSGAVEKQILFSLDDIWDGRMVFTCFKKIMEKQILFSLDDIWDGRMVFTCFKKIMSGEKILPLRRQEKFAQLHKSVGLTVSGEKILPLRRQEKFAQLHKSVGLTVAIPTDLEDKLLDPISQISNSKVQLVNIFYKVENELLRQFIPDFLE

SEQ ID NO: 153021 - protein, 344 aa, Heterodera glycines
  Coding regions on vcDNA: vcDNA=SeqID_79444; Strand=-; Position=1 -149,261-381,484-899,952-1300
  Homolog annotation: Hit_ID=CAE75221.1; Match level="QueryCoverage =59%, HitCoverage=26%, E-value=3e-22, Identity=31%"; Hit description =Hypothetical protein CBG23170 [Caenorhabditis briggsae]
MNLNGPPMVSEQRFSEQFRKIATPLNDFAYEISAISKILLDLQRDLTLRRCEDAWKRLETHNRQVESIVNQSLKQFWRREIERIQNQQLAVAQQLKPFATQMASLISVIDIRRSSDSVLPSPMEQICMQITKMEPDSESRVAAIEKEETLRREAKLEEEIAQTEEREALKARKALREVRPATPKMRTSNQRVKETNRDRGADALIREGTHSCLSSPCPSTKRHQPQVNRHVHRNSESKVYEPLQMDNIVNSVIATLCEKEELPRQNTIQKQTKTSENTIPSEREDNIKREMETEITAEKETNSQNVESVNAVVTAQMTRGRDPELLQAREKLLEAIREKVKRIE

SEQ ID NO: 153022 - protein, 61 aa, Heterodera glycines
  Coding regions on vcDNA: vcDNA=SeqID_79445; Strand=-; Position=1-204
QFLSSYGLELIQKVKFDCNFNIDFPSEFALSVCQPLGLSTLSFADNSSSHGIFLNCDPNSR

SEQ ID NO: 153023 - protein, 44 aa, Heterodera glycines
  Coding regions on vcDNA: vcDNA=SeqID_79446; Strand=-; Position=1 -93,702-743
MDQQRCTRAAVVGQRTLSSAHSDEHTPTAQPSSIVLNAFDMNPN

SEQ ID NO: 153024 - protein, 287 aa, Heterodera glycines
  misc_feature (6)..(6): Xaa can be any naturally occurring amino acid
  misc_feature (22)..(22): Xaa can be any naturally occurring amino acid
  Coding regions on vcDNA: vcDNA=SeqID_79447; Strand=-; Position=1 -216,428-467,519-599,1026-1165,1225-1266,1647-1742,2024-2068,2121-2184
  Homolog annotation: Hit_ID=CAE59349.1; Match level="QueryCoverage =94%, HitCoverage=29%, E-value=6e-59, Identity=45%"; Hit description =Hypothetical protein CBG02698 [Caenorhabditis briggsae]
VGLIFXFKNINKFLFIFVELKXKINFEIFIFLILKAVNTNNWLNTREVLKYYVYPNRTIDNEDLYPPTYYKNSTLGPWRFCWSDPVTDFHCTSVEFNHVTDFHCTSVEFNHEEDTSDVTTSVELSVRRAVPFMLCGCALDVLGLLCNTLCLLRSNPYQSLFVTALANIFAGLVDFNCIILYMASGLVDFNCIILYMASVSKEVGNKLYKASELDNSLFDYTYGFSFILLKISFLCTELAALLIVIVYMSKRDERTYNAHRMRSMLVYMSKRDERTYNAHRMRSMLRT

SEQ ID NO: 153025 - protein, 592 aa, Heterodera glycines
  Coding regions on vcDNA: vcDNA=SeqID_79448; Strand=-; Position=1 -227,276-1827
MRSIKDQNEMIKFDESVHIIQNEKVLLSTTERRSLKKRITEALNRGSSLWYRLDEGYIGNLNGLNLMVTPDRPFLGIKRTQGSALGPMLLAGEFFYPLGGVFFDHYRDEFNDFGDFFAGFMKEKEEKAGNGIESAGERGANDSSGLINRNVSGTGKRIEILSQNLGLIITEKDGGLKLNYESKLGSQNEEGKAVIKVKGRGTIKGSIFLLVLYLWGSMLMSNGGWAMGPEKERPVCESDENSEFDFSEEMQQWQRELVGHVVDNVRANNTQNSERACQLELEAGPSTSTAHSTPAGQQIICLNTQNSGSEKGFGGTVIGVETVAPKENGTVDQRVGLVKIRGENDSGSAKAVKRSHTDLQPKAKAQTGLPQNGFRFDALKWAQVHQLIPPPTVLYPNPQILRTAVVVLFNQQSCSSSSVNGVQLMPTNGEMIVTPCQQQQPQHQSQPQHQNHQQQPQHQIQQQHHQMHQNQRQRAIEGESRFTPRRFGPNRSHPYGGRTTASHPFIREQQETQLPINWPWNPLPRIQIPVELRRVLLRRLAQEREHAFGLAGVMRQWNPPMALLLLSMEAFYSTLLAFVVNEGEPGPSLPQL

SEQ ID NO: 153026 - protein, 39 aa, Heterodera glycines
  Coding regions on vcDNA: vcDNA=SeqID_79449; Strand=-; Position=1-117
KRNIFWKLDVWEDDSRRRRRFVQNPWGKRHKLAATMQQK

SEQ ID NO: 153027 - protein, 380 aa, Heterodera glycines
  Coding regions on vcDNA: vcDNA=SeqID_79450; Strand=-; Position=1 -216,317-628,729-891,1045-1202,1397-1448,1498-1697
  Homolog annotation: Hit_ID=EAL41690.1; Match level="QueryCoverage =95%, HitCoverage=95%, E-value=1e-114, Identity=54%"; Hit description= ENSANGP00000025604 [Anopheles gambiae str. PEST]
TNSNRSNFEMQFISTQQINQFYAEKVQMRRHKIQKVINSIGEIVKEVLKSVEQTEPRFICTLQNSNGNYDGLLVHSPYEFEVILYLNQMGVFNFVDDGSIPGCAVLKLSDGRKRSMSLWVEFITASGYLSARKIRARFQSLVAQTVEKAPFNDKCQVVQDSSDVKLIIYGKYFVQITCAFRCSGIWPRSASHWPSQHVQWPSIEMAKEIRQEGFDLLSKDLCASSPSTSMMEGDAWLMSTVQAEDKLLQAHTNREKVFSILKTLRDRHLDFSGSATTKQLVKVLVLYECEKHYANHEWNDFCLGDRIIGILLQMFCLGDRIIGILLQMVNCLQCRRCPHFFLPQMDLLKNRSPKSLDESARAVWALVRQLMLNGKALEQL

SEQ ID NO: 153028 - protein, 240 aa, Heterodera glycines
  Coding regions on vcDNA: vcDNA=SeqID_79451; Strand=+; Position=1 -11,402-834,889-1167
MNRRYIDHSVLAFLRSNKQIWDRSGIKLDLVVPLYMTDVKLIWDVFTREIWSLFATNIRHLSFHNADALDNWRRRTSPTFLTDLDELVSFTSYGLLPDGIADDGPNATAGQALSKWLHTPSKNGQPKRLYRYNLLGPQNLEWVNNFKETFISATTSVSYNIQFYLRVEPMPIEPFELVNEVTNEKLTLTKDGTGEFNWLLERCPIIGETAAAVQKQQQKKDENSDANLNKVFFRLYDDIG

SEQ ID NO: 153029 - protein, 291 aa, Heterodera glycines
  Coding regions on vcDNA: vcDNA=SeqID_79452; Strand=-; Position=1 -824,1293-1344
DKKQKAIKESSSSSSSTSIEIEHIGLSNRQFGCQNSSQGCSTSRDPVIYQAETSRADKSADSRRRPTNQSDSRYKENPGKILTEKHRYSSRHTVGMRENKPLVIRSDSQDTVANRQGQQVRQSSRRNNVRIRENERIPTRQGSEDTVANRTNAGHQSVQSSYRHSVGNMGKQVYEKRSDSSDTVTTPANVRAGTKSNRRDKILKQLNEEGFDSEYESRPTVGIRQNNTVDNHANFGERSQSSDNRHPIGNELNEQSEVLAEIQRLAIRSGISDTDEPSNEFDVDSFSFSFG

SEQ ID NO: 153030 - protein, 59 aa, Heterodera glycines
  Coding regions on vcDNA: vcDNA=SeqID_79453; Strand=-; Position=1 -10,198-262,445-549
MKESEATENERNGIFYGNSKFLSHKVSIKLALERALLCVTIMDAFILYKFDKSRISYFS

SEQ ID NO: 153031 - protein, 60 aa, Heterodera glycines
  Coding regions on vcDNA: vcDNA=SeqID_79454; Strand=-; Position=1 -153,447-476
MQKGGGGSSNNLEDILSSVFGFTSSTKASNRSLADMVKENDALLMDPLSVQRFFGKIHKK

SEQ ID NO: 153032 - protein, 102 aa, Heterodera glycines
  Coding regions on vcDNA: vcDNA=SeqID_79455; Strand=-; Position=1-309
MLQPDPYSRPSIQDLCEQIEHLALALDVRLDEPVLTFTAAPTTTTTTTSSSSNNGRSKVGESAAAKTARQKPPQQRHDQPRQKQHQKQQGTKKDVANNTGIY

SEQ ID NO: 153033 - protein, 119 aa, Heterodera glycines
  Coding regions on vcDNA: vcDNA=SeqID_79456; Strand=+; Position=1 -64,526-605,653-865
MELDGVFMERHGYREPNDEDDVLLNGQPQANCNGKCPKGWPSANGGLMKNGDNYSMNFSLRKLRLFGRPQQQPIASVDNELQHQRHTHEKEETDQEQLDDQITACTDQQNRQHLASNGA

SEQ ID NO: 153034 - protein, 67 aa, Heterodera glycines
  Coding regions on vcDNA: vcDNA=SeqID_79457; Strand=+; Position=1 -157,240-286
MADTTTGEQFKMLNDFMSLIVDNCFYFVFSIRIQKYTICFEMDRIMVQKIKDVFSTPLLPGRQQQKK

SEQ ID NO: 153035 - protein, 112 aa, Heterodera glycines
  Coding regions on vcDNA: vcDNA=SeqID_79458; Strand=+; Position=1 -152,315-498
MGNVQTSSIANQLLPFESYIVEIPELKYVARSSKTEKHLFNLATSVTYFLSLGATRFMKVARVEHFSKGPLVVKVFVIIDQQVAVEPYRDQLLQISRRLIKHPNFAPVNRVF

SEQ ID NO: 153036 - protein, 130 aa, Heterodera glycines
  Coding regions on vcDNA: vcDNA=SeqID_79459; Strand=-; Position=1-393
MDFLDLPGPRFFWIFVQKSPDPGLGFVKNVKQIFQDPNLTFSWPIKKHNNLAILFANDDDDDDDGVSQQHKKRMMVQPIITFVITTARLLLSSPYKFVLSNLRRRLHLFDNHHTSNQIIIFLNYKFIILP

SEQ ID NO: 153037 - protein, 67 aa, Heterodera glycines
  Coding regions on vcDNA: vcDNA=SeqID_79460; Strand=-; Position=1 -136,190-257
  Homolog annotation: Hit_ID=CAE63760.1; Match level="QueryCoverage =79%, HitCoverage=13%, E-value=2e-09, Identity=52%"; Hit description =Hypothetical protein CBG08295 [Caenorhabditis briggsae]
MGYDYMKVRRRNIRAATNTLLLIISIYLISNLLSLFLSVFAFLNPGFLQKNYPHQYRSVQEIYNKQI

SEQ ID NO: 153038 - protein, 19 aa, Heterodera glycines
  Coding regions on vcDNA: vcDNA=SeqID_79461; Strand=-; Position=1 -25,206-240
MQFLSIEYVQRHASYRQRE

SEQ ID NO: 153039 - protein, 61 aa, Heterodera glycines
  Coding regions on vcDNA: vcDNA=SeqID_79462; Strand=+; Position=1 -73,228-340
MISIFIVVEEEEEEEHFFGGAAPGENLKKKGTKQWEETKKKRRTGIEKSKDGKEKAEQIGD

SEQ ID NO: 153040 - protein, 30 aa, Heterodera glycines
  Coding regions on vcDNA: vcDNA=SeqID_79463; Strand=+; Position=1-90
MSTIPPLKNTNVPNGMITMSKIEEVGKPFP

SEQ ID NO: 153041 - protein, 106 aa, Heterodera glycines
  Coding regions on vcDNA: vcDNA=SeqID_79464; Strand=-; Position=1-319
LEKVDFFVFGAVPPSRCAQIYGESESFRNSFRIACTLILRWIFAPHNCLSTPNGHLKKSIFFVFGAVPPNRCAQIYGETESFGNSFPIACTLIMRWIFAPHNCLST

SEQ ID NO: 153042 - protein, 108 aa, Heterodera glycines
  Coding regions on vcDNA: vcDNA=SeqID_79465; Strand=+; Position=1 -297,746-775
MSSFSHHHHQQQLQQHRGSALSLGHAIAAPSSAELIVLDSPPPAPPKTPTTTVMMFDSTDHGGGGGGGQRQQQQQQFDVVASGCCTASSASSSFIIGSMNKYYIISVM

SEQ ID NO: 153043 - protein, 89 aa, Heterodera glycines
  Coding regions on vcDNA: vcDNA=SeqID_79466; Strand=+; Position=1-269
MQPTNMSNVSAASAAVSTTSASLKTAYSAIIDVLELDDVLIDEISAAPTSFGGGTDGATRTALATPAGGGTCTTSADEQSSSSGTKQAH

SEQ ID NO: 153044 - protein, 620 aa, Heterodera glycines
  Coding regions on vcDNA: vcDNA=SeqID_79467; Strand=-; Position=1-1863
  Homolog annotation: Hit_ID=NP_491240.1; Match level="QueryCoverage =98%, HitCoverage=46%, E-value=1e-141, Identity=41%"; Hit description= zn-finger, CCHC type and RNA-directed DNA polymerase  and Integrase, catalytic domain containing protein
MDQLAAGIPGVVGYMDDFIIASSTVNEHFSTIFKFFKRIQEFGFRIQMDKCKFLVKEIKFLGQIVSSDGIRPDQNRTRALQEMPAPTDITTLRSFLGAINYYGKYIKNIHQIRAPLDELLKQGVEWQWNEKHREAFDQAKAILLSDLALTHYDPHLPIIVTADASNKGIGATISHRFPDGKEKVFQHAARTLSKTEQNYSQIEKEGLGLIFAIQKFHQYIFGRKFILRTDHRPLLGIFGSKNGIPIFSASRLQRWALILLNYDFSLEFVRTDNTGQADALSRLISEQRNSAASEDMVIAQLCAETESEVEHLLNVQLEHLPVTVDEIQTAQQDDELIREVIKFTQNKWPNHGINPEIKPFFSGRHKLSIVSGCLVFNGRSVIPPSLRHRVLKALHLAHPGIVRMKNLARTLVYWPSIDSDIEEIVRKCRQCQEAAKQPQKQPLQPWPTTTQVFQRVHIDLAGPCSDGNTYLVIVDSFSRWPEVFMLRHTSSQHVIEQLQWLFDRFGLPKTLVSDNGPQFSSSHFKDFCDSNGICHLFSPPYHAQSNGAAEKFVDFFKRQLKKCSGDKNWLKQSLLSYRSIPIAVLNNRSPAELFLGRPLRTKLSLMKPERPSPFFRGPYQ

SEQ ID NO: 153045 - protein, 270 aa, Heterodera glycines
  Coding regions on vcDNA: vcDNA=SeqID_79468; Strand=-; Position=1 -101,151-283,346-924
  Homolog annotation: Hit_ID=AAB62657.1; Match level="QueryCoverage =81%, HitCoverage=20%, E-value=2e-12, Identity=21%"; Hit description =ORF 73, contains large complex repeat CR 73 [Human herpesvirus 8]
MAINQQFAEAANAAEHLQKRNEALEESLKSAEKRAFDLEEENGKVKQANKSMGYELEQSQALVVELKTSVETKLAELKKMDSVQQRVETELSDALNKLAQSQNKEKYLEQDLKEAQLQLERVKAELGEAQKEITAKKNECTEKAAEIDELLGVVAELNKDKIGEKIKEREEGRRKSQQKTKTDEKQQDMDHSGSSAASSPGQNASLLEVVEMISNHKLSTTEPLLLRTLTMVPDLAGARDGQTWAMGWKYREQKRKQREENCSTFWSWPN

SEQ ID NO: 153046 - protein, 44 aa, Heterodera glycines
  Coding regions on vcDNA: vcDNA=SeqID_79469; Strand=-; Position=1-134
MVGGVFCALCVLVVVLMHFFVSKLVATLALLFSVSHFSDAFAFK

SEQ ID NO: 153047 - protein, 197 aa, Heterodera glycines
  Coding regions on vcDNA: vcDNA=SeqID_79470; Strand=-; Position=1 -49,345-559,1270-1362,1719-1955
MHSSEFGSDVDNRTGPAVVAVGTGPGWQKHQIVVNGAKENARLTTTGAVAAVPSEDSSNNDDNGGGFVVVNCSSGVAAPPVGDAPQQRRRRNSNSVLRTSQSADRLSRTARRASRPRNTTVAAASGGAAASAGGGHRRHTQSVASFVNAAYAAAAQAANNNTNGTSAGGGGSSGNNNANANNNRDSISTTTASTDCE

SEQ ID NO: 153048 - protein, 784 aa, Heterodera glycines
  Coding regions on vcDNA: vcDNA=SeqID_79471; Strand=+; Position=1 -172,916-1004,1091-3181
  Homolog annotation: Hit_ID=XP_307468.1; Match level="QueryCoverage =79%, HitCoverage=72%, E-value=4e-63, Identity=28%"; Hit description =ENSANGP00000016246 [Anopheles gambiae]
MKIRISEQTNIGNSSNDVSGFDQRLKKIEQMLGTMLQFERAVLDVGQLEKRIEHIENAAGLQVDEHKSSTFRPSTFIASKKPIDPKRRPFNSQREQPITTDHGTTGNIQQLLDAIGQLVTAQQQQQINKPNPNNNVPIPVLPDISVFEPTDEKGRITEWIERFSFAVDFSAPNATDAVKVKALMNKLSETAFSEYSKSCLPGKVTDFDFNQSVERLQKLFAKPQSIFIDRYECLMATKTEGEDFRQFVNIHKRLLNDFKFTSLKEEQFKVLMLLTALKSPKDATLRQRILSKLGADGDNVRWRCGWTNHSHWECKHKSAKCQKCSQNGHLEGQCDKVQEWRRRNKLPIPKRKIGNLRIGTSMKVNSASLFKTDVAVDGKDIKFVLDSGAEIIVIDELSHEVIGSPRLRKCTESGCMFDGTQVKFIGKGVANFKFRNICIKGEYYVAKRGSLNLLSVQMMDAFGLLNELKAKINAPVNLCRVGEETRGFTKTPKAPLNSTVKGHIDHPKALFPDIFKNELGRCIKFKAHLTLKADAAPVYRKARPVPYNAQEAIDGELKRWEKMGVIGKVEYTEWAAPNDESRKIWSISTHHGNYEVKRLPFCVKSAPAIFQSVMDQILAEFEFATAYLDDVIIVSKSVKEHTDHLKKVLEKFQEWGFRIKLEKCSFFREEIKYLGQIIDRNGRRPDPEKISAISEMPAPTNVPSLRSYLGMVNHYQQFVKNMRFVRKPLDDLLKHDSEWKWSEKCKQAFDKIKEILSSDLLLTHYDPTKEIVVAADASELGIGA

SEQ ID NO: 153049 - protein, 33 aa, Heterodera glycines
  Coding regions on vcDNA: vcDNA=SeqID_79472; Strand=+; Position=1 -40,87-148
  Homolog annotation: Hit_ID=CAE63591.1; Match level="QueryCoverage =100%, HitCoverage=17%, E-value=8e-10, Identity=90%"; Hit description= Hypothetical protein CBG08082 [Caenorhabditis briggsae]
NNDAKLTLDEFKEGAKADPSIVHALSLYEGLAT

SEQ ID NO: 153050 - protein, 294 aa, Heterodera glycines
  Coding regions on vcDNA: vcDNA=SeqID_79473; Strand=+; Position=1 -240,431-504,883-1043,1454-1571,1621-1730,1842-1957,2290-2355
  Homolog annotation: Hit_ID=CAE63476.1; Match level="QueryCoverage =95%, HitCoverage=41%, E-value=3e-76, Identity=49%"; Hit description =Hypothetical protein CBG07943 [Caenorhabditis briggsae]
MASSTHYYKMDPSRDNPDLTEERRKAKFDPEKLGNFFWQGQLKRRRQICDYVQAQGTELAPAQPVPFMTRMEKLEDVARLSVGMRKHAENVIDVGSPQEQFYFNSLICGYDGSPFHLHFIMALPAMINNCDEEQAAEWLPKLFNCEIIATYVQTEMGHGTNLKALETTATYDASRQEFVFNSPTITSTKWWPGNLGKTANFAVVMAQLYTNGKCYGAHPFWVQLRDIETHKPLPGITVGDIGPKFGIGSNDNGFLRFNNYRIPRMHMLMKHAKVLPSGEYLPPMHSKVGYTSMM

SEQ ID NO: 153051 - protein, 211 aa, Heterodera glycines
  Coding regions on vcDNA: vcDNA=SeqID_79474; Strand=+; Position=1 -39,235-420,1726-2136
  Homolog annotation: Hit_ID=AAH22856.1; Match level="QueryCoverage =80%, HitCoverage=68%, E-value=5e-29, Identity=33%"; Hit description =FLJ21827 protein [Homo sapiens] gb|AAH11647.1| FLJ21827 protein [Homo sapiens] gb|AAH12802.1| FLJ21827 pro
MGTNEGQEQQQKRKEADDALPHFPISAELKALFGQIEDYVAERVEIVPCWKPFQIDYIPAVGEVDPFIKVPRPDQDRWVQNVKELRRTKAPTRVVYGKPMPSIESLMQEWPAELEQKLKEMKVQIDAKSSFYKFIQLLINANLDADLEDFVDLCLGLVDIPLHKSRLESLHVLFSLYAEFRASQHFRNMAMDRDEAGGANSANIDQFVMPD

SEQ ID NO: 153052 - protein, 136 aa, Heterodera glycines
  Coding regions on vcDNA: vcDNA=SeqID_79475; Strand=+; Position=1-411
  Homolog annotation: Hit_ID=NP_741887.1; Match level="QueryCoverage =95%, HitCoverage=60%, E-value=2e-22, Identity=40%"; Hit description =putative cytoplasmic protein of eukaryotic origin (XK990Co) [Caenorhabditis elegans] emb|CAD44127.1| Hypo
DRWVQNVKELRRTKAPTRVVYGKPMPSIESLMQEWPAELEQKLKEMKVQIDAKSSFYKFIQLLINANLDADLEDFVDLCLGLVDIPLHKSRLESLHVLFSLYAEFRASQHFRNMAMDRDEAGGANSANIDQFVMPD

SEQ ID NO: 153053 - protein, 529 aa, Heterodera glycines
  Coding regions on vcDNA: vcDNA=SeqID_79476; Strand=-; Position=1 -246,479-749,1380-1520,1614-1772,1846-1962,2157-2810
  Homolog annotation: Hit_ID=AAO19577.2; Match level="QueryCoverage =35%, HitCoverage=61%, E-value=7e-19, Identity=33%"; Hit description =chorismate mutase [Heterodera glycines]
MINNRLMVAHELALYRFAHQIPVDDPEREATVLKHVGNQANAAGIDAEFAVNFLLAQMEANKMIQVHKCMAKGNLEKRPTSVRGYIDRWNSDHSFESKYVPDFEKEIQPKFSYATNALILALIPLVDAGHQMHNDQNCVEHVEDVLESMEHLRASELEPNGKEAMEKAVKAILDSQTTKEQTKKESPRRRENAKNFEHKKSAQNRNVRKGKKQSEESWEDDIEKVTKKSPRKIEEVSDTSIMITRGEKSRGTNGKDKITHENKKTGKESDTKVKSPKKSPRRIEVSDRSVLIKMEDLISDEKEHLTSRERNETDAYSKTQVKKSPFKNKVTTENEPQNKSKSQAEEQKRSAVAAIDKSFDVRFDSEEENPRKASSTETIRNPSLISRDASIPMNSRNLSAVEHENERKDSLVVHRNRRINDNERAKSIGSEENLQNLGLSRDDKSTADEANDQSMNGSWSVEKTNNQRNRHVQQNGESRQNSNISLHSPSRLLTGISTEHGEEHRQESEEKAMESTRKSRFLMPNASGE

SEQ ID NO: 153054 - protein, 26 aa, Heterodera glycines
  Coding regions on vcDNA: vcDNA=SeqID_79477; Strand=+; Position=1 -75,239-244
MITLRPRISKGSGMRDHPWNESGDLN

SEQ ID NO: 153055 - protein, 351 aa, Heterodera glycines
  Coding regions on vcDNA: vcDNA=SeqID_79478; Strand=-; Position=1 -415,485-589,630-860,905-1110,1152-1250
MSSTQYLIFFLLLCCLKNISGIGFDEFAKNAGAINLADQYLKKEIKTKGELLEKLAQIGVEISLRTLERHLSKIKSKRKSEDSQVNNEEDMENAEISQCFSKFDNKFLFIIGHGDEYRKYQKTNENANTVYAYCIKCEIQIIRTMTRVTKNFMFNPLNEDQRQELCETWFYTFNEDHIDYSEPFEFVSSEYGPGEVTEILGDGNCGWRSISLALTGTVSNHSEIRKDVIEYLEETVYQHSFSNHHDNEWWLLFDSIENIRKHIENAIAPAIGAHEIEKWMNNLDLAAVTKMFRINIIVCERIQERIFRWQVYSPDLETSLSNLQQKESTASIFLYFHDGHYELIRKPQKIN

SEQ ID NO: 153056 - protein, 204 aa, Heterodera glycines
  Coding regions on vcDNA: vcDNA=SeqID_79479; Strand=-; Position=1 -156,643-737,837-1027,1159-1256,1339-1411
VHLTDSGGGFKKVQFSPLAQFHANNGSNETVVNPYRIEFRLMARDGGNCEDGYNLNAGQLKISVLFASNQTAVRFTRFSLEENDFGGRAMQNDFLRSNGLSFLADYADLWLLGLDMLPMAHQTEEQREQLKMELFISRSSKCLIEAWFVQPSHSLEPSDPNLQFAFSLCKPNPTEEEYERLFPKNVDKYVFPTGGSCAGLSNQM

SEQ ID NO: 153057 - protein, 107 aa, Heterodera glycines
  Coding regions on vcDNA: vcDNA=SeqID_79480; Strand=+; Position=1 -161,574-693,894-936
MIASLKQGRVTDENAVNSDSQFIKKFKFYPILSLFFYPSSQFPPSRAIRRNSILVFPCDIENCFGIFLWILSNISEKDGENGKRMRMNQQFNKSAFTLFGGANRCRR

SEQ ID NO: 153058 - protein, 58 aa, Heterodera glycines
  Coding regions on vcDNA: vcDNA=SeqID_79481; Strand=-; Position=1 -109,326-393
MGRSKWETPCNCKAVHIRHDGQEQLHQSVKFDPIKHNARNILLFVSLSYWQLIQFCTN

SEQ ID NO: 153059 - protein, 148 aa, Heterodera glycines
  Coding regions on vcDNA: vcDNA=SeqID_79482; Strand=-; Position=1-447
DQVFPRVPSPDVEVVVDGAAIVDEEEQQHVEEEEEQQQHVEEDQHQQHQQLTHCVPATQHQQQPSPMLSAAVQQAISTLQMRMPPLPVFPPFAMPLVLPPLQFTFQPYLQHRQQQQQQHQFASPALQIVPLDDAPAPQPLCDVLQTVA

SEQ ID NO: 153060 - protein, 186 aa, Heterodera glycines
  Coding regions on vcDNA: vcDNA=SeqID_79483; Strand=-; Position=1 -331,1094-1324
FAGDKDFVMMTIKNKFPRTIILEGLKAEKDSGIEWNVEQLIKGLEEIITMREEAMRCTKITRAIGGQHENWDSDKDNSIGQKAIGKIIGTETITENIIKEKKEILKIIKEEGLVKVQTVFGTIICGEMISSGPKLCPLTAMIIENEDKEPEKYWDLEMIGVKDNPVEKDDDVALKMFQDSVYRKDG

SEQ ID NO: 153061 - protein, 29 aa, Heterodera glycines
  Coding regions on vcDNA: vcDNA=SeqID_79484; Strand=-; Position=1 -56,218-251
MTEKYLYLIVAQKIESFKNFFENLCVNKN

SEQ ID NO: 153062 - protein, 258 aa, Heterodera glycines
  Coding regions on vcDNA: vcDNA=SeqID_79485; Strand=-; Position=1 -90,683-943,1347-1434,1801-2136
MIVPLLITFVQILITVAPLLITVVPLLITVAAVSAPDRFNATNAGQQPRPRTTSSAIGGGGGTADELQQEAEDNESVLLNGAESPTPGGGTLGYAILAEDSKTPAPFYEMMSESELNAELAKYGHGPMGKRAAIRLLNRIYEATHPVISSDTPIPRKVRRALATDDVGGDKNGAAERQRERRTKQKIGQMLRLANKNAETETTGNYAKQNDDGGGDGFANNAKENGAGQMAAATISKQQQRHGQQQQRGAMDATATTD

SEQ ID NO: 153063 - protein, 263 aa, Heterodera glycines
  Coding regions on vcDNA: vcDNA=SeqID_79486; Strand=+; Position=1 -81,147-857
MMFIFFISFFIIGFHQFLITFSIANPLDEDQRLIAVMKGDPKMRLSEYSTQKYEAYLGIVYLMRKNWKCDKIADEFEEYERKECQKYRKYLDILHKYLFMGYAGIPTVKPKFVFKHKFEIEGPLIFVVNCLTEISKFYFTKETGQNFRYKLNEFFNGFLEPKLLNEKRLNYEPKLPMNETILQLAIDTANERQTNESLDGIIQQNCGEQFDENLEEMFKKAVEQAKKDNPKKANQINNEKKQKRILCSKLDDQSIWVTLLTFN

SEQ ID NO: 153064 - protein, 261 aa, Heterodera glycines
  Coding regions on vcDNA: vcDNA=SeqID_79487; Strand=+; Position=1 -274,329-840
  Homolog annotation: Hit_ID=NP_702308.1; Match level="QueryCoverage =86%, HitCoverage=3%, E-value=4e-09, Identity=25%"; Hit description =hypothetical protein PF14_0419 [Plasmodium falciparum 3D7] gb|AAN37032.1| hypothetical protein [Plasmodium
MAEEYSNALFRAKKKGNINWDDKKMISFGLFEKEEMKKYLKKKYEAQLGVVYLMRKYWKCDKIEEKFKEKCKTNRKHLHILYNYLFHLYVEGKSGEFVNKFSAVKPMFFYYSGDNQKELISVVETLSKTSQCFWGIHKLSISNSHEMALKNEDDLIDEKNWEEQKNVVEKIDGPKNVQNKQQKILNLPKENEKNLWKEFEQKMEEMSKNAKANVKKERANLNDKAAELLKKGKYDSENEKVDLLYDEYNAKFETFKSSPFY

SEQ ID NO: 153065 - protein, 130 aa, Heterodera glycines
  Coding regions on vcDNA: vcDNA=SeqID_79488; Strand=+; Position=1 -88,132-219,263-307,353-409,453-512,554-610
IKSQSQNTSQGKALQKSPPGLTFVDPKELTLSQYKRTEFPAAERPKGFSQYSSQPDEKKKQPKPWSKAALGMRDSFDECDDSAFVGIDQKEQDEVQFQYECKSWSKRSRGQRDSFDEGDDSAFYGPSTSK

SEQ ID NO: 153066 - protein, 54 aa, Heterodera glycines
  Coding regions on vcDNA: vcDNA=SeqID_79489; Strand=-; Position=1 -58,387-493
MTISTYAWNSCHKKVFFRGGYIAIAPAPFGQFQRMRYRRTHRMNPIFILLIIIF

SEQ ID NO: 153067 - protein, 40 aa, Heterodera glycines
  Coding regions on vcDNA: vcDNA=SeqID_79490; Strand=-; Position=1-120
MSQYVFNIGDLWFNSSIIWYSLFLATFSLLGFVTIVVCVM

SEQ ID NO: 153068 - protein, 51 aa, Heterodera glycines
  Coding regions on vcDNA: vcDNA=SeqID_79491; Strand=-; Position=1 -24,84-215
MTTELVDKFYDLYKNAGLVPTEIAINGILALVALVGVCLNSCLIYVTIKSK

SEQ ID NO: 153069 - protein, 26 aa, Heterodera glycines
  Coding regions on vcDNA: vcDNA=SeqID_79492; Strand=-; Position=1 -36,533-577
MTFSLLAYSFFNAHKEHLDLSNDSKD

SEQ ID NO: 153070 - protein, 86 aa, Heterodera glycines
  Coding regions on vcDNA: vcDNA=SeqID_79493; Strand=-; Position=1 -69,395-586
MLTPHELDERLGWAPFAMLGQKKNLYLCKFFGFVFSPLPAMISERIKQHCVDLNTFMSSFGDWTLRTEVQAMEEMEIIRNKNLERA

SEQ ID NO: 153071 - protein, 253 aa, Heterodera glycines
  Coding regions on vcDNA: vcDNA=SeqID_79494; Strand=-; Position=1 -141,255-335,878-990,1041-1114,1163-1235,1428-1565
  Homolog annotation: Hit_ID=AAF21097.1; Match level="QueryCoverage =99%, HitCoverage=85%, E-value=2e-52, Identity=47%"; Hit description =thioredoxin peroxidase [Dirofilaria immitis]
VSWAILFSHPADFTPVCTTELARAAQLTAEFARRHVKVIALSCDSSESHRNWTEDIAAYGNSKGNGSEKISSAADFPFPIIADQQRLLAIKFGMIDPLNSDLSGVPLTVRAVFIVDPKKRLRLSLLYPASTGRAVFIVDPKKRLRLSLLYPASTGRNFDEILRVLDSLQLSDKFMVATPENFDEILRVLDSLQLSDKFMVATPEGWKPGSACMVEPRVTDAKAKEMFAGVGGGVRPVELPSGKRYLREVNDPS

SEQ ID NO: 153072 - protein, 147 aa, Heterodera glycines
  Coding regions on vcDNA: vcDNA=SeqID_79495; Strand=-; Position=1-442
MKQTKEKERTMSDEEDEDEASFSEEDEEMDGPSKQSKGKEIDDETMAEIEKWLKDLDVEKLMRESSTSKGTTQYSTPMKRKRGGKKVVTTDEDEEEEHGLNSGEMDFSQSSSEEEKSTKRGKRILKGKGKAKDEEQSSAGNEKPKAK

SEQ ID NO: 153073 - protein, 253 aa, Heterodera glycines
  Coding regions on vcDNA: vcDNA=SeqID_79496; Strand=-; Position=1-759
MRRIIVDVLFTMIFLLISGLGTLNAVNPAELAADEHAETHSPTTLGEKHQQQMDIPPLLKVPKVEPIETAPAQQSREWGGEEQWEQKERIPKVEVPKVEPSDTAPAQPKRKVPKMEPFDTAPAQQLREGRGEGQWEQQKEQSLGLAEVPLTAKRQRTPSARYHRPEFELSSEEEPDNSSDEDWKDAEEEESDELASLSKSSASYGLGEDIGEGEEEENEAMESKKKRMAQTKGKQTAPIEVPSKTDSSFDSEQ

SEQ ID NO: 153074 - protein, 245 aa, Heterodera glycines
  misc_feature (25)..(25): Xaa can be any naturally occurring amino acid
  misc_feature (35)..(35): Xaa can be any naturally occurring amino acid
  misc_feature (45)..(45): Xaa can be any naturally occurring amino acid
  misc_feature (55)..(55): Xaa can be any naturally occurring amino acid
  misc_feature (65)..(65): Xaa can be any naturally occurring amino acid
  misc_feature (75)..(75): Xaa can be any naturally occurring amino acid
  misc_feature (85)..(85): Xaa can be any naturally occurring amino acid
  misc_feature (95)..(95): Xaa can be any naturally occurring amino acid
  misc_feature (105)..(105): Xaa can be any naturally occurring amino acid
  misc_feature (115)..(115): Xaa can be any naturally occurring amino acid
  misc_feature (125)..(125): Xaa can be any naturally occurring amino acid
  misc_feature (135)..(135): Xaa can be any naturally occurring amino acid
  misc_feature (145)..(145): Xaa can be any naturally occurring amino acid
  misc_feature (155)..(155): Xaa can be any naturally occurring amino acid
  misc_feature (165)..(165): Xaa can be any naturally occurring amino acid
  misc_feature (175)..(175): Xaa can be any naturally occurring amino acid
  misc_feature (185)..(185): Xaa can be any naturally occurring amino acid
  misc_feature (195)..(195): Xaa can be any naturally occurring amino acid
  misc_feature (205)..(205): Xaa can be any naturally occurring amino acid
  misc_feature (215)..(215): Xaa can be any naturally occurring amino acid
  misc_feature (235)..(235): Xaa can be any naturally occurring amino acid
  Coding regions on vcDNA: vcDNA=SeqID_79497; Strand=-; Position=1 -694,1628-1679
  Homolog annotation: Hit_ID=I57441; Match level="QueryCoverage=99%, HitCoverage=78%, E-value=1e-33, Identity=38%"; Hit description =involucrin - orangutan sp|P14708|INVO_PONPY Involucrin gb|AAA36935.1| involucrin
PQGQLATKDTRIGQLRHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHQQGQLANXGHEQGQLANXGQGQGQLANXGQGKGQLANXGHLQGQLPTKGGGQLAYIEXKVKKIKKYHQ

SEQ ID NO: 153075 - protein, 33 aa, Heterodera glycines
  Coding regions on vcDNA: vcDNA=SeqID_79498; Strand=+; Position=1 -28,218-291
MARVFASRIGLFASKIVMDREGGMRTDPQTACS

SEQ ID NO: 153076 - protein, 80 aa, Heterodera glycines
  Coding regions on vcDNA: vcDNA=SeqID_79499; Strand=+; Position=1-243
MSLGKASTKPKDEGLGKNFNTTKNRNRCGRTPVTNGRRRTTSARGSSLAAYMPLRSTWAPLSSKVVKKKRHPSRAAKSAT

SEQ ID NO: 153077 - protein, 84 aa, Heterodera glycines
  Coding regions on vcDNA: vcDNA=SeqID_79500; Strand=+; Position=1 -152,192-294
MTVLKINLMISLPFVLAFELIPERHVRCGFTLIVKHAPDGLADFFGYSTRVKLLAFALIPERHDRRGFAWELSSIYKVLFHKNY

SEQ ID NO: 153078 - protein, 163 aa, Heterodera glycines
  Coding regions on vcDNA: vcDNA=SeqID_79501; Strand=-; Position=1 -26,70-454,793-873
MNLELHPRSFHSQEKNTDLHLFRTLVLTSPFKCHNFKKQTNKGSADSVHRVGRRTRAFAQRVLSEGHRPVVRLHHRLCVPYTVTNAGGDRAGQAGQSVAQVGDEEAHWQGGAEPRGTRRDGRPGGTLPQAGTVPGQLLSRLLPAQFFTVFDFLLFCVYRRPTR

SEQ ID NO: 153079 - protein, 140 aa, Heterodera glycines
  Coding regions on vcDNA: vcDNA=SeqID_79502; Strand=-; Position=1 -191,337-446,719-837
  Homolog annotation: Hit_ID=NP_494579.1; Match level="QueryCoverage =97%, HitCoverage=42%, E-value=2e-65, Identity=82%"; Hit description =neurotransmitter-gated ion-channel subunit family member (2D859) [Caenorhabditis elegans] gb|AAG24222.1|
DYDMDIYLIMGWRDPRLVNNFGKPVLVKEEDILEKIWRPDPFFDAKEAEFHEVTFLNFLMRIYSDGLILYETRIKLKPACNLVLCKYPHDKQTCELQIKSFAYAAETVRFEWFTNRLDAIDKNPDVRLPELYIDQYEPAK

SEQ ID NO: 153080 - protein, 127 aa, Heterodera glycines
  Coding regions on vcDNA: vcDNA=SeqID_79503; Strand=-; Position=1 -59,889-1213
MFLFLKISDRSSALIALMARIGVPSLKKVISSSFWLLAQFKMAHFLLTLCLTFALLAHCVSAKRRPGLRTWDFEAKPGMDNSVGKAKEEQDEDEEKERKADDGVGDKAVTEQIPPSKISSTTRQAKI

SEQ ID NO: 153081 - protein, 22 aa, Heterodera glycines
  Coding regions on vcDNA: vcDNA=SeqID_79504; Strand=+; Position=1-76
RAIIYANYAIWRYEQFCLTLGL

SEQ ID NO: 153082 - protein, 63 aa, Heterodera glycines
  Coding regions on vcDNA: vcDNA=SeqID_79505; Strand=-; Position=1-341
SALKKVVSLKPQKKAEFSKFFISIFFYSSKFSLIFSRLIEPVKSFRMISRLFDSVNNFKSYID

SEQ ID NO: 153083 - protein, 256 aa, Heterodera glycines
  Coding regions on vcDNA: vcDNA=SeqID_79506; Strand=+; Position=1 -124,168-311,355-446,484-589,635-762
  Homolog annotation: Hit_ID=NP_505864.1; Match level="QueryCoverage =98%, HitCoverage=39%, E-value=2e-37, Identity=36%"; Hit description =UDP-GlcNAc:a-6-D-mannosideb1,2-N-acetylglucosaminyltransferase II (56.2 kD) (5L765) [Caenorhabditis elega
RNLTNSIFSSLKFLNKHQEVFNLANFGQLNHQSVDFVLIVQVHNRIDYLNYLVGSLSVHNRIDYLNYLVGSLSRAKGIERVLLIFSYDKHSEPINKLIRSIDFCRVTQIFFPYNIQLFVTQIFFPYNIQLFPNSFPGLGPKDCPEGTKKLRREGLECANLRREGLECANAAYPDTHGNFRLPRFTQIKHHWWWKANYAFDEIMPKYGLENKTLLANYAFDEIMPKYGLENKTLLFLEEDHIVAPGLLLSLKLMTKS

SEQ ID NO: 153084 - protein, 113 aa, Heterodera glycines
  Coding regions on vcDNA: vcDNA=SeqID_79507; Strand=-; Position=1 -68,488-761
MTNLIEMTLNFEWKKLLHEQNNGPNFCKVWLIGISSNVNSAQMNPLLAQFDATIRKDFLKFNPLENAEENGGKNKSNKKFKMPKMEEISAKFDEFKLAFKSILVNKWEMFEAM

SEQ ID NO: 153085 - protein, 232 aa, Heterodera glycines
  Coding regions on vcDNA: vcDNA=SeqID_79508; Strand=-; Position=1-3,62- 163,255-461,881-1094,1461-1631
MLENYLAEKTFKGFAEYEEKMKNSLIKIRKIFDDWSEGHAKLLVSGSFLLGTHTIRSDIDLLCIVPGKVIKKVHIFGYDTTICQHMEHACSDGTNWSLYCELCSNEFVTDLVKFPHAPILLIKFIFDQVPYDVTFVIIPERKMLPAKIDDKTMDELMAKFKKPTENNTKMLRVLSGYHATFYIFNLILDGQNKQEMLQMDDGEGERQKIHQKFNKNAKNFRMLLLVMKLWAK

SEQ ID NO: 153086 - protein, 116 aa, Heterodera glycines
  Coding regions on vcDNA: vcDNA=SeqID_79509; Strand=-; Position=1-349
YNNVDVVCDLPWQFHQILWKILNLNNEANLMLAEAANEIVIENFENEFKNVKAQIHLQNFAMALLTNGATISGKWEQNESKKRQKLLEEITGMRCGHIRFDNLKLRWQKMEAQIQL

SEQ ID NO: 153087 - protein, 34 aa, Heterodera glycines
  Coding regions on vcDNA: vcDNA=SeqID_79510; Strand=-; Position=1 -89,261-276
MSKINQWSADCTFKGHTHGQRISLHKHFEKHLNE

SEQ ID NO: 153088 - protein, 263 aa, Heterodera glycines
  Coding regions on vcDNA: vcDNA=SeqID_79511; Strand=+; Position=1 -32,2427-2933,2960-3171
  Homolog annotation: Hit_ID=XP_315603.1; Match level="QueryCoverage =99%, HitCoverage=34%, E-value=3e-36, Identity=37%"; Hit description =ENSANGP00000017599 [Anopheles gambiae]
VSRINYYYYFLCLATRAVYLEATLDLTSESFINVLRRFISRRGKPDIIWSDNATTFKLAQKTLELLSAPGPDQEVQNFLTQNRIQWRFIAQISPWAGGFYERLVKLVKDCFKRTLGRRILSFDQLNTFVAEVEATLNYRPITAVSDAVDGPVPLRPINLLNQRFRSIGKQQQTQLIQRNTSRIQALREANDVFSRIQALREANDVFWAKWHSEYLTLLRERAQWDHKGPRLQHFGEPKEGMVVLISQDLVPRNQWPMGRIVET

SEQ ID NO: 153089 - protein, 443 aa, Heterodera glycines
  Coding regions on vcDNA: vcDNA=SeqID_79512; Strand=-; Position=1 -103,144-187,244-313,364-558,729-782,841-1064,1113-1219,1267 -1470,1529-1626
  Homolog annotation: Hit_ID=CAE60575.1; Match level="QueryCoverage =91%, HitCoverage=90%, E-value=5e-85, Identity=45%"; Hit description =Hypothetical protein CBG04204 [Caenorhabditis briggsae]
PAPTPSPQRKVSAAAGTNGGQTQTNCLICADKATGKHYGSISCDGCKGFTGKHYGSISCDGCKGFFRRTIRKKHNYLFRRTIRKKHNYLCRFSKNCVVDKNQRNACRRCRFDQRNACRRCRFDKCLSNGMRPEAVQLERDRIAATRRNGKIGTKTGKTQQRQRQQQKHQRWRVPLATKSKDSQRTATTGDVTDSMHQQLILLVQWMHQQLILLVQWAKHLPEFRRLPLRSQIALLRHFSAQHLILCAAFRSLVRVAASDAVWLANDRCVPRDAPKIPDINRVVARILDHLTSPMRRLRLERVVARILDHLTSPMRRLRLEECEFVALKAVAFFDPMAKGIDESAAKGIDESAVGAVEGMRHHILAALEHQVQRRSECRAAPLRLGNLLLLLPPLVAIARDLVEEAQLAKLFGANVDELMVELLLPEDAETRSYSRLRTSVTST

SEQ ID NO: 153090 - protein, 65 aa, Heterodera glycines
  Coding regions on vcDNA: vcDNA=SeqID_79513; Strand=-; Position=1 -134,193-258
NGMNRTAVPEENGKMEHTFERMGNIQWGVGELEWEAWMRQLDGAGYQTGHKSRLPILLEPMTKKK

SEQ ID NO: 153091 - protein, 19 aa, Heterodera glycines
  Coding regions on vcDNA: vcDNA=SeqID_79514; Strand=+; Position=1-58
NYYRHYMIFTKPYKIKKRL

SEQ ID NO: 153092 - protein, 96 aa, Heterodera glycines
  Coding regions on vcDNA: vcDNA=SeqID_79515; Strand=-; Position=1 -151,933-1070
  Homolog annotation: Hit_ID=NP_506013.2; Match level="QueryCoverage =97%, HitCoverage=21%, E-value=5e-24, Identity=47%"; Hit description =ADDucin, spectrin assembly factor, adducin head domain related (add -2) [Caenorhabditis elegans]
MPLVPIADLNGTKKYTAEEVECRNKLAALYRLIDHFRWSQSIYNHITVIFGINQAGYVLHSAIHAARHDVNCVLHLHTASAAAVSAMKCGLLPIIQ

SEQ ID NO: 153093 - protein, 128 aa, Heterodera glycines
  Coding regions on vcDNA: vcDNA=SeqID_79516; Strand=-; Position=1 -8,316-460,510-595,760-907
MIRSLRGSANFLMALICICELVHQNGNTFFLVVVISGTNFVSVLTADLIMAPSIFAINCGLMAMLCSAVDRLLSVISPLKHMDILLQFKYVYLFSYLLICIIYAAYSLNYVLANAFENAGKYGAIKFK

SEQ ID NO: 153094 - protein, 49 aa, Heterodera glycines
  Coding regions on vcDNA: vcDNA=SeqID_79517; Strand=+; Position=1 -93,405-461
MREGSRMECGTNLEKKLYEKLKSGEMPIAQSRNAFESVKSNLALAFLGL

SEQ ID NO: 153095 - protein, 338 aa, Heterodera glycines
  Coding regions on vcDNA: vcDNA=SeqID_79518; Strand=+; Position=1-1017
MLDGGSQISLISAKFFSQIMDKVSQKDVISRFENRIIAINGKEVKCFGVVALPIRRGTLETKILMFVAQSAFGYDLLFGTNALKQLGFKMIDEVSNNIVDFSPASMLENSPMIVFKTFVVDGQNLDKTPRNFGGKRKNTSESKNGTGTKKGNKGRRQQKQPETEKSSVRNAGERRPLFTKTFVPQLKPKEIPIKNSENFGEIEANKQRVSSVQMKVAVPNDKAKCVWRRKNLGQFQLGTTENLGRGKVSPKMASSANGRLDLCDRRPDSWSQSSFHRGDTDVKFGQRIFCRGGKRRKEPDRGMFKDGCWHRLNSPTTYRMPNEHKRQGTPFSWRVGMC

SEQ ID NO: 153096 - protein, 430 aa, Heterodera glycines
  Coding regions on vcDNA: vcDNA=SeqID_79519; Strand=+; Position=1-1293
MQTDRSPSEVDENEIRRRLLQVMMRQNGNAELTRHGEQDIGRRENGRPISDETQRPPIPRIAQPYADSLQMPNEFRENDRSLHPGLVFDGMMAQAIRSLDGFSYTMTLNTIPTLDGSKGSDSVNAFFKQFDIATEEWPEAKRLRALRSKCYGKAERAFNSAVAENRHDYQLIRRAIIRQLDDTDAKQLTAFDQLMKGVWLRPNEGIDQLGERVSRLVRCAYPGLSEQLYDEYSAMHFIRALPNSELAMTLEMTRKPGATFDEFIAQAARAEAVQNAARNSWRRSQNNGFSSTYWPRHGTSQNQRMHVTCYNCGRVGHISRNCASEPMQRMYHQNDEPPKRENLFIGAVNLEHRSEIEQFFGKTTNLSEKGRFLEESPAVGKILATKVSVFGRKLDAMLDGGSQISLISAKFFSQIMDKVSKKDVISRYES

SEQ ID NO: 153097 - protein, 150 aa, Heterodera glycines
  Coding regions on vcDNA: vcDNA=SeqID_79520; Strand=+; Position=1 -441,793-804
MLDVVNNNIVHFTPASKPENSPLIVFKTFVSHDKIRYDRKDVIKSQIVVDGQNLDKTPRNFGGKRKDESGPKNGTKTKKHNKKHRQQKHTTVEKTTIQNATENLGERKKQRQRKENGEIAWAIKRVWRRKSLDQFQLGTTENLDRGKSLV

SEQ ID NO: 153098 - protein, 194 aa, Heterodera glycines
  Coding regions on vcDNA: vcDNA=SeqID_79521; Strand=+; Position=1-583
MTERNFEQIRSRTNSSIVHEGNVQFANENNGIEMDENEIRRLLLQVKMRQDGNAELARHGEQDIGHRENGRPIFNEVQQPLIPRTQPNPHSLIQSGHQIHQRQNCSQNIATINHRPNGFEDNERPVPNPGLIFDGMMAQAIRSLDGFSYTMTLNTIPNLDGSRGSDSVNAFFKQFDIATEEWPEQKRVRALRSK

SEQ ID NO: 153099 - protein, 51 aa, Heterodera glycines
  Coding regions on vcDNA: vcDNA=SeqID_79522; Strand=-; Position=1 -58,108-205
MAAVPQANVEDDGPAADDFADENAAPPHNLLPWNAGQAVLLEAEGGGFIPL

SEQ ID NO: 153100 - protein, 20 aa, Heterodera glycines
  Coding regions on vcDNA: vcDNA=SeqID_79523; Strand=-; Position=1 -43,798-817
MSDTLQQNMAEKMQDKNLLA

SEQ ID NO: 153101 - protein, 182 aa, Heterodera glycines
  Coding regions on vcDNA: vcDNA=SeqID_79524; Strand=-; Position=1 -217,588-751,953-1120
  Homolog annotation: Hit_ID=AAR85527.1; Match level="QueryCoverage =100%, HitCoverage=100%, E-value=3e-54, Identity=57%"; Hit description=14-3-3b protein [Meloidogyne incognita]
MSDNKEELVQRAKLAEQAERYDDMAQSMKKVGERKLRNFYNFLVRILKVTELGAELSNEERNLLSVAYKNVVAVVEKSQQSYQEAFDIAKDKMQPTHPIRLGLALNFSVFYYEILNSPDKACQLAKQAFDDAIAELDTLNEDSYKDSTLIMQLLRDNLTLWTSDTAGDEQEAGGEAGEAGGN

SEQ ID NO: 153102 - protein, 68 aa, Heterodera glycines
  Coding regions on vcDNA: vcDNA=SeqID_79525; Strand=+; Position=1-204
MKGRKEHRERGRLCKQEDARIPGESVEIGTQQKQALRAAEVVYAMLICGNEGENVQLGAVSHLTPVTS

SEQ ID NO: 153103 - protein, 56 aa, Heterodera glycines
  Coding regions on vcDNA: vcDNA=SeqID_79526; Strand=+; Position=1 -159,329-340
MLTLLLAICLSLGPFLAYLSIALFSHRFLIVDRSRNRPICTSPGCVRCNRNANFLI

SEQ ID NO: 153104 - protein, 18 aa, Heterodera glycines
  Coding regions on vcDNA: vcDNA=SeqID_79527; Strand=+; Position=1-55
NRQSVSREAEEQSDTAET

SEQ ID NO: 153105 - protein, 108 aa, Heterodera glycines
  Coding regions on vcDNA: vcDNA=SeqID_79528; Strand=+; Position=1-418
VGLSVGHSFVINQITTQNLSHCFASLPPLAHLRHQLKSPPPPGCKIVPLEKPSVKLNWRFSRGDKAAKDKNGRRRSRNRKREKRVKRRMGEGIGGLIDGQLLTNRQCN

SEQ ID NO: 153106 - protein, 265 aa, Heterodera glycines
  Coding regions on vcDNA: vcDNA=SeqID_79529; Strand=-; Position=1 -88,135-575,671-939
MLQILSQFTLFLLFFNLSEQNNSETKCQNDFFQMAQKLRASAPPIAYEKGANCETKNGLSAFEQMQWFEMNVFGILCCQNDNGNGILDEEKAEKISKIKKKFCREMENGKSIGLMMGNIGEPSLKLDEILEIEPKIYEKLCDFAAISKIEGTKKENMENHIGKVIEKIKAFFEAIKANAIAFSFDSSVGTAHSIAFKAYGRRKRRRNPRLGCVLLYLCSVISLVVGLLDLMELFPVASWAPGAAFGVAALCFLLMCCVCDLRPNE

SEQ ID NO: 153107 - protein, 73 aa, Heterodera glycines
  Coding regions on vcDNA: vcDNA=SeqID_79530; Strand=+; Position=1 -172,362-411
MPSPIRLFTLFSLFLFLLLLLPFLSFAALSPREKRQFSFTDGFSSGTILQPGGGGLLKAIGLNVSSRLWAQFY

SEQ ID NO: 153108 - protein, 130 aa, Heterodera glycines
  Coding regions on vcDNA: vcDNA=SeqID_79531; Strand=+; Position=1 -296,452-548
  Homolog annotation: Hit_ID=XP_313055.1; Match level="QueryCoverage =89%, HitCoverage=35%, E-value=4e-12, Identity=37%"; Hit description =ENSANGP00000011681 [Anopheles gambiae]
TNLEPNVPVKRAKEGEAVAKTHFARGHVKGGCPPGPPGEPGTPGPPGPPGDPAPCPKHMKSEAQSVDGKQLANRNKRGETVLNAAKEGTEVKRQIVRHGIGPPGPAGPPGEAGEDGEPGPCECYKDQKSQ

SEQ ID NO: 153109 - protein, 194 aa, Heterodera glycines
  Coding regions on vcDNA: vcDNA=SeqID_79532; Strand=+; Position=1 -67,502-613,976-1062,1274-1486,1543-1648
MANLLYIRMKANDCPLIAFIRSGCTTSFISESFARKANLLGNIDRSNCETIPIPGKVLGWANDVQIRIDELNLQFVHRLGVMADKHLPIRFSSSLRHVSLDDGILPEFPVDDSAMASDGQAVAKWLFTPHPDNVPNFLYCDVNLSMDQWWSTMEQFKAVWHFPMLLLRLLSAFWFTFSRLFRLTLLCHLIGSTK

SEQ ID NO: 153110 - protein, 46 aa, Heterodera glycines
  Coding regions on vcDNA: vcDNA=SeqID_79533; Strand=-; Position=1-183
KFSILMSLSVTRNHYFGDFVTKIVKNHYFGVLSLFFHYFDIFWKIP

SEQ ID NO: 153111 - protein, 262 aa, Heterodera glycines
  Coding regions on vcDNA: vcDNA=SeqID_79534; Strand=+; Position=1-789
  Homolog annotation: Hit_ID=EAL44122.1; Match level="QueryCoverage =100%, HitCoverage=75%, E-value=2e-36, Identity=31%"; Hit description= conserved hypothetical protein [Entamoeba histolytica HM-1:IMSS]
MQIDELIVLESDDEEKEKQGEEREMPEEESAMQGKVKEKQAEEKETQGEKEKQQEEKETQVEEKKMQLDEEEKQQEEKEKKQTEKDVEEIIMLDSNDDEEIEKEGEDKERQEEEKETQGEEKEKREEEKVTQGEEKEKREEEKVTQGEEKEKRAEEKEKQSEEEEKTDKMEKQQEEKEMQVEEVIMLDSNDDEAMKKQGEEKEKQLGDEDKTEEDKETQGDEKKKQLENDEKRDKEKETQLEDKQKPEEEKETQGEEKEKEK

SEQ ID NO: 153112 - protein, 104 aa, Heterodera glycines
  Coding regions on vcDNA: vcDNA=SeqID_79535; Strand=-; Position=1 -32,287-440,1667-1795
METTALNPRQSHSKNGKFIENCPDFVEFERILRENLVADEISEQILELANQKAKQWNELVEKVQQSLNTQLEQAERKYGALHKMYMELLVEAQKKLKEYAHEFN

SEQ ID NO: 153113 - protein, 117 aa, Heterodera glycines
  Coding regions on vcDNA: vcDNA=SeqID_79536; Strand=+; Position=1 -85,143-411
MPSTSMARCDFMSTPSTSKSAFAFGLDDVHMFDELRRRHIWTEEELQRQRRSNAFLRKQLKAQRDRSTSLERSSSACRQRRVLSDVTTNPQEDKRLSAANDLLITLDAGISFKAREA

SEQ ID NO: 153114 - protein, 186 aa, Heterodera glycines
  Coding regions on vcDNA: vcDNA=SeqID_79537; Strand=-; Position=1 -515,931-976
MTKPQQFTVVVPFLLLCAFFSIICEAVKDNDKNQNNQTASQSTNSAPPTVIYQNEPPVIHVEQQEFSKIVQETTGNAAASTNNKKGGKADGPLSLSSSVFKRPAPKKLAVFKPHETSSRPIINFSTSSSSTHFQRGETKFQMLDGVEKRLLLPPKWLDKMNDKVLTDHVIDQRRHPPFPPGKCMFL

SEQ ID NO: 153115 - protein, 103 aa, Heterodera glycines
  Coding regions on vcDNA: vcDNA=SeqID_79538; Strand=+; Position=1 -51,899-1159
MSTGVAVVRQSAFFNPQRKPWHSVDRISQRTQRFGHRAVFTEKGIYCGKALTRQHVHWPGINSQIERIVSQGEENQMPQKAPIHFGGLILQMAGRLTNELNDS

SEQ ID NO: 153116 - protein, 270 aa, Heterodera glycines
  Coding regions on vcDNA: vcDNA=SeqID_79539; Strand=-; Position=1 -103,170-448,514-656,1069-1234,1480-1601
  Homolog annotation: Hit_ID=CAE66724.1; Match level="QueryCoverage =75%, HitCoverage=4%, E-value=8e-39, Identity=36%"; Hit description =Hypothetical protein CBG12070 [Caenorhabditis briggsae]
RIAAEEQRNTTTRGLATTHSSTQMRSSTGATDQQLFLSRAPSTADSSSSSGDPIKRYHHQQQQQQQKDDSSTTPATAEHRSLAVFVAIQDYVPEPGQAPGEALLLEQGQIVEVLDNKNPANWLVRTKAKPPLTGWVPGSYFETPSKYYTQRKSTRELTADEQTLSEQQQTLLKRDAMLNGLQYYSDDSGKVGQTFLRLERDFEQHVAFLRELDNAQRIVAENGAVQKFLEEIIKYSLRVQQQQNAKVMQKALELIQSVPKRAQEMEFTKN

SEQ ID NO: 153117 - protein, 130 aa, Heterodera glycines
  Coding regions on vcDNA: vcDNA=SeqID_79540; Strand=+; Position=1 -49,495-701,1832-1968
MVGASNLGSSGTQNKGASNGYGKLEGIGNLAANGSSFVLSGYQTDRGAAQIVETVGKSIATNNTAAELRIKNQGTEVINGTMGTNTTNIRGNVNATGDQTYVQSVSSVSDQNRQQALFNSQNGQTADKIK

SEQ ID NO: 153118 - protein, 209 aa, Heterodera glycines
  Coding regions on vcDNA: vcDNA=SeqID_79541; Strand=-; Position=1 -118,1066-1272,1318-1523,1566-1664
MNKRTKMKTKIALIIFGTTICWLSVRVVFVPPFSYGGHFPQFNFVSSEYGPGEVETIIGDGNCGWRSISLALTGSEWNHTEIRRDVIEYLEESINQHTHLNHNENEWWLLFNSIENIRKHIEISVSPAAGAHETEKWMNNLDLASTSKLFQLNIIVCERIQERIFRWQVYTPDLETSLTNLSQKETTASVFLYYNDGHFELIKQPTKIN

SEQ ID NO: 153119 - protein, 163 aa, Heterodera glycines
  Coding regions on vcDNA: vcDNA=SeqID_79542; Strand=-; Position=1 -141,201-299,375-490,554-638,687-736
  Homolog annotation: Hit_ID=NP_002853.2; Match level="QueryCoverage =100%, HitCoverage=19%, E-value=2e-75, Identity=82%"; Hit description= brain glycogen phosphorylase [Homo sapiens] emb|CAC00661.1| PYGB [Homo sapiens] gb|AAH30795.1| Brain gly
MYDVHVKRIHEYKRQLLNALHVITLYNRIKADPAKKVVPRTVMFGGKAAPGYHMAKQIIKLITSVASVVNNDPIVGDKLKVVYLENYRVSMAEKIIPAADLSEQISTAGTEASGTGNMKFMLNGSLTIGTLDGANVEMAEEMGAENMFIFGMRVEDVQALQKK

SEQ ID NO: 153120 - protein, 134 aa, Heterodera glycines
  Coding regions on vcDNA: vcDNA=SeqID_79543; Strand=+; Position=1 -114,200-488
MEADQIGKSIGSDQSNIQLIRQNEKLTRENVQLKQRNQEQQQQIQALIGANRELIWAFNESRREHDELMQQLRVMAKLVNNGSSTRPAGVENTGETLQFEQQKTKSVRPKQIAKKNATTASAANSGGGGGGRQR

SEQ ID NO: 153121 - protein, 132 aa, Heterodera glycines
  Coding regions on vcDNA: vcDNA=SeqID_79544; Strand=+; Position=1-399
DWRSVISSVLRKQYVLQLFEALCPEFTGSNVVDLAVKNPSRADFIQKSLNFVFDAENELFGSSTSRDSYFMAIAEKIFTLREAKDRQNLEKSCQNGTTERIGDAVRRRTLADVLKPKHTKSRDEDILDGDEI

SEQ ID NO: 153122 - protein, 139 aa, Heterodera glycines
  Coding regions on vcDNA: vcDNA=SeqID_79545; Strand=-; Position=1 -116,171-230,287-328,382-423,474-525
  Homolog annotation: Hit_ID=AAO92290.1; Match level="QueryCoverage =85%, HitCoverage=100%, E-value=6e-48, Identity=86%"; Hit description= FMRFamide-related peptide precursor [Heterodera glycines]
MAQFPVANILLASLLLGFVILNSKTNAQFQYGGGMLAEGPQMEGLLPQMEGLLEDYGRVGDYPFESLAKRAPLDLAKRAPLDRSAMARFGKRAPLDRSALARFGKRAPLDRSALARFGKRAPFGKRAPLDRSAIARFGK

SEQ ID NO: 153123 - protein, 387 aa, Heterodera glycines
  Coding regions on vcDNA: vcDNA=SeqID_79546; Strand=-; Position=1 -443,741-954,988-1088,1145-1334,1418-1632
  Homolog annotation: Hit_ID=AAO51573.1; Match level="QueryCoverage =49%, HitCoverage=19%, E-value=2e-11, Identity=27%"; Hit description =similar to Dictyostelium discoideum (Slime mold). Adenylyl cyclase
MALLTPVKRPPPAAGQWQQQQQAQPSPQVLTRGQIAATQTDDATVAAATALVVAQHQQQEEQPPQATTTNSSTQPPQMTNSTTQPPKVDEPSMAQQQQQQPPQATTISTTQPPKVDEPSMAQQQQQQPPQATTISTTQPPKVEPSNERDPNVVNDQQQQQKHILPLPPQQNEQNEVKSTTGLTPAEAVRRSQISALVEPKQPQQQQQEINNGAGDEHGGYQFVTHHFPLFRSISVLSDNWYDWVEGNQTDKAGNQQQNVIVHQSVNSTINADEHGISDEASPVASLSTIDLGRVYTTVGTVMESLLVNFAHLWQYRLFRFAFVLLSIYFCLGFLEQCAVAMTAACVRWAWPPVHFMLGSSRGTLFYLTDWFAWMDDFLSSWVCDMAN

SEQ ID NO: 153124 - protein, 44 aa, Heterodera glycines
  Coding regions on vcDNA: vcDNA=SeqID_79547; Strand=-; Position=1 -45,351-440
MSVHYFRVVCSQFYSNCYVQLKIQLDRFMGSGQTPKKQGVFILN

SEQ ID NO: 153125 - protein, 187 aa, Heterodera glycines
  Coding regions on vcDNA: vcDNA=SeqID_79548; Strand=+; Position=1-564
  Homolog annotation: Hit_ID=CAD53080.1; Match level="QueryCoverage =94%, HitCoverage=90%, E-value=8e-13, Identity=25%"; Hit description =hypothetical protein [Trypanosoma brucei]
YLTHYSNSYNGRRHSKPESADHQEQPQDNREAQIVDDAKCADKPESADHQEQPQDNREAQIVDDAKCADKPESADHQEQPQGHREAKIGDDAKCADKPESADHQEQPQGHREAQIGDDAKCADKPESADHQEQPQDNREAQIVDDAKCADKPESADHQEQPQGHREAKIVDDAKCADKPESRQTINW

SEQ ID NO: 153126 - protein, 102 aa, Heterodera glycines
  misc_feature (15)..(15): Xaa can be any naturally occurring amino acid
  Coding regions on vcDNA: vcDNA=SeqID_79549; Strand=-; Position=1 -215,287-425
FFRVAFVFLSIYFCXGFLERCAVAMTAACVRWAWPPVHFMLGSSRGTLFYLTDWFAWMDDFLSSWVCDMANRYCHQYDVMCDCQCSFVSRTQRAALLGGRRF

SEQ ID NO: 153127 - protein, 47 aa, Heterodera glycines; identical to SEQ ID NO: 141196
  Coding regions on vcDNA: vcDNA=SeqID_79550; Strand=-; Position=1-457

SEQ ID NO: 153128 - protein, 137 aa, Heterodera glycines
  Coding regions on vcDNA: vcDNA=SeqID_79551; Strand=-; Position=1 -240,343-516
  Homolog annotation: Hit_ID=E86336; Match level="QueryCoverage=99%, HitCoverage=36%, E-value=1e-26, Identity=49%"; Hit description =hypothetical protein F14O10.11 - Arabidopsis thaliana gb|AAF88160.1| Contains weak similarity to an unknown pr
DIEKLRDSLNLSDQVLVCDKDEEVEEGEHEEDGEEAAMDKDNANEDEEEDGEEDGEDEEEKEEEDVEKEEEEEEEETEQQSTANDEEEAEEMIGEGEEDEEEEREGDEEEEETEQAAEKKEARKYPEEEEDEDEFYF

SEQ ID NO: 153129 - protein, 579 aa, Heterodera glycines
  Coding regions on vcDNA: vcDNA=SeqID_79552; Strand=+; Position=1 -433,512-1269,1470-1949,2206-2274
  Homolog annotation: Hit_ID=DAA04499.1; Match level="QueryCoverage =71%, HitCoverage=29%, E-value=1e-39, Identity=26%"; Hit description =TPA: pol polyprotein [Schistosoma mansoni]
MMKAKELKGRLEKYQVTLQSFELEIIYRPGKKNKVADFLSRYNIPGNEKDPEPKQEENSDEFDLQPKILSAKNINENLIAENDGILNENPKITLKTVIEAQTKVKELAKIFYILKTGKCPNDVLKWKRVVSDYCLINGAIYFIKEGHFGVEKTWHEIKERFYWVGMKEDVKMLIEACEKCQMRKIQPGQAKSAPSVPIEPSNGPFQRIHCDLMGPLKRTERGNLYIFLAIDSFSKWVMAKAIPDQKANTVSENFVEMVVHQHSTPEIVVTDQGRQFTSGIFNDLAKIYGFEHVTTTPYHQQSNGMAEGAMRIMANIISQMVNEKGNNWDEILPHAIFSYNVSIHSATKFSPFFIINLRQPKLPTDRLLKLPSPDELVSDISVYTRIQTEKAAKAWEISIDGRAKLRKVHQEKVKHFNGPAILPLRQSDKPLNWEKYVDDPNLEQEEIEGESCESDCEETQDNENTQSKNKMGLKVSKYGFESSDDENDWNIVAFVRENQNSEDDEGPEVIMDRNPEIEIMPIFTILEVLIEGSFTEVYTGWRDPVTISLISSIPENLKRKIWKLGMGQTLQLSEIQKKC

SEQ ID NO: 153130 - protein, 171 aa, Heterodera glycines
  Coding regions on vcDNA: vcDNA=SeqID_79553; Strand=-; Position=1 -87,1132-1363,1407-1601
MINYIKFINYQLQNVISNDVHEFLNFFSMIKVITIFMPRKRSLTTRQERKQKREANSRLRNTLTSSEAGASSSSNIDTRQEESETAVFCDLDHDNLNNTPAEPLTKLGTSPSSNIDTRQEESEVAVFCDLEQDNLTTTPMTKSRKLDQPFSASMAPFVQAQTGQGRIDSLS

SEQ ID NO: 153131 - protein, 64 aa, Heterodera glycines
  Coding regions on vcDNA: vcDNA=SeqID_79554; Strand=+; Position=1 -33,194-355
MNIIRYDVLQLLTFGSICANITFEGEKARMEWYLGRLSKNAQMILDNVEPSLCVRRTCKMILLH

SEQ ID NO: 153132 - protein, 125 aa, Heterodera glycines
  Coding regions on vcDNA: vcDNA=SeqID_79555; Strand=+; Position=1 -36,270-608
MDRGTGPDEDGALDVERIFDDERAEDESSDDDGGADAVARTVGGAHIGTEIGTAQQQQLLDVGAMLDEAAAAQIGGLGDNNGRADATAATVRHQKVAVIAAEKGHQNRRHPERTDAVGVDNEEEE

SEQ ID NO: 153133 - protein, 16 aa, Heterodera glycines
  Coding regions on vcDNA: vcDNA=SeqID_79556; Strand=+; Position=1 -40,341-351
MANLKKKLGKVWAASF

SEQ ID NO: 153134 - protein, 168 aa, Heterodera glycines
  Coding regions on vcDNA: vcDNA=SeqID_79557; Strand=-; Position=1 -286,442-590,956-1026
  Homolog annotation: Hit_ID=CAE66693.1; Match level="QueryCoverage =42%, HitCoverage=33%, E-value=1e-22, Identity=60%"; Hit description =Hypothetical protein CBG12033 [Caenorhabditis briggsae]
KQINKNDSVMLVSDRLHGQCCLFCDRQCFFSSGCRQKQQQQRFSRTKTVLEGKCIHSLSAAGSIGTKRTQNLPIYETSLLIESGLNIAPPCFPVADDDGLEVKIIRPIAQEKCALKSRPGDTVKQYYKLTDPEGKEIGSNFGEKPAMTGMCIGEKRRVTIPGKLGFGD

SEQ ID NO: 153135 - protein, 43 aa, Heterodera glycines
  Coding regions on vcDNA: vcDNA=SeqID_79558; Strand=-; Position=1 -57,525-599
MGMSEEILTYKDDICVFMGLMQMLIRLPRTGWMPKKRVLRKFM

SEQ ID NO: 153136 - protein, 121 aa, Heterodera glycines
  Coding regions on vcDNA: vcDNA=SeqID_79559; Strand=-; Position=1 -80,601-781,1131-1235
PSQFGKSIFLNELKKIRSSAWSVSKKTLTVVGVNSKFSRKKFTLAIQKFHGAHTSERISEILKALLESWNVKECYCFVTDSAANLVKELLNPPKKSLYIIVKKHSPPDSAHSHFGLHLGTR

SEQ ID NO: 153137 - protein, 128 aa, Heterodera glycines
  Coding regions on vcDNA: vcDNA=SeqID_79560; Strand=-; Position=1 -84,176-350,400-525
  Homolog annotation: Hit_ID=NP_495690.1; Match level="QueryCoverage =69%, HitCoverage=25%, E-value=7e-09, Identity=36%"; Hit description =putative prenylated protein (2I349) [Caenorhabditis elegans] pir||T24558 hypothetical protein T05H10.8 -
MDEKDVKAEEGQKDKRKGAKASLGGGEGLISAHSAVIFTANFLQSRVVINDIGGQLAKLYDALEVKKAEEFEQRMEELASAGDERRGRKIAELREAFREWETFLARLDVELERVAGPNIQTELGETGR

SEQ ID NO: 153138 - protein, 301 aa, Heterodera glycines
  misc_feature (299)..(299): Xaa can be any naturally occurring amino acid
  Coding regions on vcDNA: vcDNA=SeqID_79561; Strand=-; Position=1 -104,724-887,1411-1562,1896-2030,2091-2238,2715-2846,2940-3008
  Homolog annotation: Hit_ID=NP_741501.1; Match level="QueryCoverage =95%, HitCoverage=63%, E-value=5e-64, Identity=44%"; Hit description =glucocerebrosidase (4S421) [Caenorhabditis elegans] emb|CAD42642.1| Hypothetical protein F11E6.1c [Caenor
CQSVLLEYFCLFIISFCVFFVLFSCFPLFFPSTFLSFVCVCNRTFCDLQLGPIGWAKDNNAIVYISDPAKFRLHQQQVPIEVEYSDQNHEGIEIVVDASKEYQTVLGFGGAFTDAAGVNLNALSNTTRATLLRAYFDKDGIKYTVGRVVMGACDFSVREYSYCDTPDDFELKTFALPKEDTEWKIPIPNIQQAIEMSGDQLRLFSSPWSAPGWMKTNGRMVGAGQIKLVYISYLNLNFRFFEEYKSHNINFWGLTLTNEPLHGAAWNGLELDHATVKMRDYGQMKYGPVLKKYEVSKNXPQ

SEQ ID NO: 153139 - protein, 136 aa, Heterodera glycines
  Coding regions on vcDNA: vcDNA=SeqID_79562; Strand=+; Position=1 -126,396-635,1124-1168
MVASSEEEGADQTDTLSAFGDDEMLMTELLDEVPPFDLINQGIVDTIHLAIMARHGVLGGNIRTVDVRVVDGHGNCIYTPPPAAHVPQLLEQFIQDVNNVIGRASTGLMEARVVAAWAHYQLILIISSYFILQLID

SEQ ID NO: 153140 - protein, 46 aa, Heterodera glycines
  Coding regions on vcDNA: vcDNA=SeqID_79563; Strand=+; Position=1 -8,317-449
MHWKLAEFIGEGTRKVGTWTKLRQGPGPREKLVPRPTRIFSKRKIF

SEQ ID NO: 153141 - protein, 423 aa, Heterodera glycines
  Coding regions on vcDNA: vcDNA=SeqID_79564; Strand=+; Position=1 -187,387-571,648-835,1024-1302,1564-1635,1707-1835,1982-2068,2380-2524
  Homolog annotation: Hit_ID=BAC27372.1; Match level="QueryCoverage =83%, HitCoverage=50%, E-value=4e-61, Identity=36%"; Hit description =unnamed protein product [Mus musculus]
YSRCLITEEWRLNSLANDRFIEYCCEILRCEMPPKCLALIDAVKTEALKTLASVVFLEKDKKIQMIVDQLELRTYHGFLPSQIRSCIDSLKAGRVDGSGGGDCSIAFVTSLFSLVYHIAGFEYGGDALNRSSMTAVLLDVVKNFSLPEQNISFVTRSVRIIDNLTGMDITEFNARSGTDAVIKRLNHEVNKCKEHIQIRQSSQSPGPLLCNQQRSALVKSLLNFLKRAVGDVHLAGQMRRIMDTDLPTSLIHVFEHPQYYGPSLLNCAISLATNFIFQEPAQLTTLQNKGLTMAIIGLIFNEKFPISRELVCALPNVCSALCLNERGLNELKLFNEKKPLEKIFRITAHVLGTSFDELIRHHPSLRKDLMGTLAGICDDWLSFEQTCEKEGKQCAISWAVGKAVVEDESALLLPLGDFSTMMG

SEQ ID NO: 153142 - protein, 309 aa, Heterodera glycines
  Coding regions on vcDNA: vcDNA=SeqID_79565; Strand=+; Position=1 -102,243-1070
MRSYMLKYFATDPNACAFIYALFDAYKLIGTDRLVVSCNAEQQQATTSQIAEDTAKVRELLIDDDSSSSSNQHGGTMPAITTAAAGTVPMPQLMEMDNGAGTLYFGPPQHQHQPQQQPHRSVDFATTAANILRSNSAGSAGRGGLGVGIGVGAGGAINISILGGPTVMMRGASYSTNSGTLSASISDGIVGSAGGGSGGGGRIAERSTHSIAIRTLKQITELITYIGKAFCTVSLPRVRQRANILPQMDQATVRHHAQKVTKIVFTGLKRLLEMDMNTDNIVYASSASSSSLNTTTMNTIGLRQIWHFV

SEQ ID NO: 153143 - protein, 303 aa, Heterodera glycines
  Coding regions on vcDNA: vcDNA=SeqID_79566; Strand=+; Position=1 -168,620-637,739-805,884-1542
MPPLVGHREEDAFILLERVLCAMKVLIQGEMELLEFTEGKAEQSQEIPVSEIDPAKIEQLVEMGFSQSDAVDALMQYSSVHEAAEYIVSMLERVTVPPTVSRPPAAAAVQEHPAITVSSSATAAAPPPPATTVAAATTVAANLVAAATAAAVSAEPNGTGGSAGTASYDNALQHQQPQQVGDAASGGSTTTNATTPMEQEQPLQQRERDQQQQLQQLTASLADVHQRNQEAAEAVEQLLQALRGEGVHHRGEMSGTLPPPPAAAATAMEQDGKSFDELKPLKREEFQAIRIDFCEITNGRVIT

SEQ ID NO: 153144 - protein, 157 aa, Heterodera glycines
  Coding regions on vcDNA: vcDNA=SeqID_79567; Strand=+; Position=1 -49,295-587,841-969
  Homolog annotation: Hit_ID=NP_499991.1; Match level="QueryCoverage =100%, HitCoverage=73%, E-value=3e-31, Identity=43%"; Hit description= putative membrane protein of fungal and metazoan origin (4B548) [Caenorhabditis elegans] gb|AAK29831.1|
EMLIERDAEPKTAGQKVKRAVETTFYISFGLISCAVLGVMTYLVFKEFFAFNTPQGVYRDAVKRVKADERCREMFGKRIMTFGEESGRGRRRHILHNKYVKDGQERLSVMFHVKGDAGIGKTYAEIYKGEDGKWDYRFVLVESDGFPKKAIFLIDNR

SEQ ID NO: 153145 - protein, 275 aa, Heterodera glycines
  Coding regions on vcDNA: vcDNA=SeqID_79568; Strand=-; Position=1 -63,111-138,190-268,339-396,447-479,532-624,674-698,755-817,956 -999,1057-1119
  Homolog annotation: Hit_ID=CAE59725.1; Match level="QueryCoverage =100%, HitCoverage=100%, E-value=1e-64, Identity=51%"; Hit description=Hypothetical protein CBG03161 [Caenorhabditis briggsae]
MSEWERLSEKLRHPENPIVFFDIAAGGADIAAGGAPIGRITMELFGDVTPKTAENFRQPIGRITMELFGDVTPKTAENFRQLCTGELKKDGVPIGYKNKKDGVPIGYKNSQFHRVIKDFMVQGGDFVNDFMVQGGDFVNGDGTGMTGDGTGMTSIYGPKFADENFEVKHSEPGILSMANAGPDTNGANAGPDTNGCQFFITCNKCDFCQFFITCNKCDFLDAKHVVFGRVLDGLLTVRKIENVPTVQNNKPKIPVPTVQNNKPKIPIVIEQCGEL

SEQ ID NO: 153146 - protein, 665 aa, Heterodera glycines
  Coding regions on vcDNA: vcDNA=SeqID_79569; Strand=-; Position=1-1996
  Homolog annotation: Hit_ID=NP_494143.1; Match level="QueryCoverage =88%, HitCoverage=39%, E-value=1e-101, Identity=37%"; Hit description= predicted CDS, putative protein of ancient origin (2C264) [Caenorhabditis elegans] ref|NP_494141.1| puta
MASINDLDYVRDYDYVYDLDFVQVEECVEIIDQENEIEIRNYAVFEEHSYAKRPRFVDEGSSQASLSLDIAIAGPSRMSDSQFEERRSNEYLKRKRERERLRRANESQDQRIMRLEQMRNRNNSQRSEESVLERQLRLEQMRIRNSNIIANENVMEKQLRLEQKRIRQRAIRQGVINVYAAGSNENAHEHSLSPMNMRCDFCDALHFAEEKVHGRGNSFKDCCHYGKVFVPEIPEQDFPEELRDLFMKFDARHENFFENIRHLNSSVSFASMNPLRYRYPNRGPYCFRIYGQVYHRMNLALNPENGDEPAYGQIFIVDTEHAVRAMRHANVAIDPQLLRTAYEVIRNVNPFAEAYVMMKEEENDEAERARNENREPTEIKLLFETGRQLDRRLGYNVPRVNEVAAVYVPGADGEVPNAKIVVRERGKELKILNCTNSMVTPMTYPLFYPRGTLGWHPEMKHRNSNRRVTRLQYVCYTLAIREREFNPILYGGKLFQQYCVDEYVKIEGDRMNWIKSNQKKILADAYKNVDNMLMRRAQERGLPLGRKVILPPSVTNSPRYVEKHFQDAMAVVRRFGKPDMFLTMTCNPQWGEISDNLFHEQTSSDRPDLVVRVFNLKVKAIMNEISKKKIFGEVIAWMYPVENQGRGLPHIHLLLTLTEQDKLIN

SEQ ID NO: 153147 - protein, 66 aa, Heterodera glycines
  Coding regions on vcDNA: vcDNA=SeqID_79570; Strand=-; Position=1 -143,679-736
MRTIILKKCCWLTIGCDFISEVLNLSVGHSTFCSLSRNSLLQLWRPLLNPHKREAMKHARSHHWTF

SEQ ID NO: 153148 - protein, 26 aa, Heterodera glycines
  Coding regions on vcDNA: vcDNA=SeqID_79571; Strand=+; Position=1-80
KSTPLYPMVYSLYAFSHSQLGMFPCK

SEQ ID NO: 153149 - protein, 651 aa, Heterodera glycines
  Coding regions on vcDNA: vcDNA=SeqID_79572; Strand=+; Position=1 -238,280-316,1423-1858,2038-3280
  Homolog annotation: Hit_ID=AAO85457.1; Match level="QueryCoverage =33%, HitCoverage=100%, E-value=3e-13, Identity=27%"; Hit description= putative gland protein G19B10 [Heterodera glycines]
MTVIVFLLCLIEPICQLALADLQGSVSRMGVRENGNLTKKKVLHKENNIPALKNASLTSSKHEDDDLLSEALINLHKLNEQTQNGSWSENSDETLTTLYSLVEIETKLTKFDEKAAKTIQELNKNLMTNSENVMIGESQSLKELSEELSKTIDTMKNKEDKAAKVSIDGVNGTLVQILQKANVHKKSIRLQIYVQVMKLLNLIHERIEQSPEKDTIGKVIGKSTVANSVKTVMPSQLIKQNEVIPKKQKHALSNKQKQETQKHLVSLGDKFRRRRRSPLPIAIIRSLSLAFAILCITVIALEHHNPWAVVVIAFLALYSQQENTRNFPTQIADGISNIVNRICGTRHTEGGPCLNGHRNNYGHESHRNISQTDVPQAYSCGNYVQHDWHNLAPQANELCATVRNANPSASGNPARRSSNDNNGRAAAGSVRQRLITPDLTLEINYRAPANRNKNKNNSRPGVEPSRSRRPNRFATNSLASSGNNQQNERPPSRISEGSGEETDDNNSIRSSKCTACKFENSSSSENNSRPGRESSRSQWPNRVATNSMASSGNNQQNERPPSRISEGSGKEKDDNNSIRSKCTACKLENIRSSSSSSDMRNAKAAEKNDDSNDHDDDKGENDEDDDIKDSDDDDDDANDDDDECDNDVKNL

SEQ ID NO: 153150 - protein, 129 aa, Heterodera glycines
  Coding regions on vcDNA: vcDNA=SeqID_79573; Strand=+; Position=1 -349,1177-1217
MTPQYPRCNCLQANDAAHHGGLMTKMAVRKWPVRKRPYENGRTKTAVRKRPYENGPYENGRTKMAVRKRPYENGRTKTAVRKRPYENGRTKTAVRKRPYENGRTKTAVRKRPYENGQLVNLMFFHVLET

SEQ ID NO: 153151 - protein, 663 aa, Heterodera glycines
  Coding regions on vcDNA: vcDNA=SeqID_79574; Strand=-; Position=1 -1079,1146-1469,1515-1683,1729-1915,1968-2113,2160-2246
  Homolog annotation: Hit_ID=NP_491240.1; Match level="QueryCoverage =35%, HitCoverage=17%, E-value=5e-40, Identity=40%"; Hit description =zn-finger, CCHC type and RNA-directed DNA polymerase  and Integrase, catalytic domain containing protein
MDAKSKWPEVVRMRTTTALATIEALRIVFTAHGLPEQIVSDNGPQFSSKEFGDYCQSLGIIHTTIAPYNPKSNGAAERFVQTFKQGMNKLKKEGMRQEIALSQFLLKYRVTPHAATELAPSEILFGRRLRTLLDLVKQTAANDFEAAKMQKSSYTERMKRNFDRETNARKNFKVNQRVYARNYRDGSKWIQGQITRQIGTAMFLVRTARGIWKRHFDQLKENWTEEPSDNPSSESADNSDSEDEVPIEAMDDEQQLPPPEEQPQPEQPQQQANAEPRRSTRKRKKTQIFDSVTTKVKRIICAALKYNVIQVSGDHGRGFTKITISLAHALRPNSPSNNFVAAVFPAKDSRKNLKNFCGSLFLGGDLCFLWAVGHCGSAMTAFPSPVCDCRRDHLISSAKCQLRTVQELERQADQFQQLTHGGDKATAETRALTKGIVCASLLPSISFEQMLLAPFHVFQGLGNALIKERIGAKRKAFRKRDLTGNSIRKILVHADQMEALFETEWAKTIFQTMAHLGKIQIFTKAQPLSPGGLDGLETAVYQFKAFLDEQPMVRTLLSKKTKAHLLLHHFVPFARQHGFLGLLDEQGDEALHSVWRRLEQLWKTMPDSEQMRQQLEHHFVSNWLLDTGRLDELKLREEEQREQAEEDKTNEESDQDADVDIVD

SEQ ID NO: 153152 - protein, 29 aa, Heterodera glycines
  Coding regions on vcDNA: vcDNA=SeqID_79575; Strand=+; Position=1-107
VVCEKVTKGVGPRFDSQCMLLMYFYDFNE

SEQ ID NO: 153153 - protein, 63 aa, Heterodera glycines
  Coding regions on vcDNA: vcDNA=SeqID_79576; Strand=-; Position=1-189
MRLTTTAVVVSATRLRDRRPPPNKKTTTIKTMATVTSSITIIIVDRYSHNSVAMREALCCEVQ

SEQ ID NO: 153154 - protein, 20 aa, Heterodera glycines
  Coding regions on vcDNA: vcDNA=SeqID_79577; Strand=-; Position=1-61
IRSFRAPIAAPSPPTVFSLS

SEQ ID NO: 153155 - protein, 29 aa, Heterodera glycines
  Coding regions on vcDNA: vcDNA=SeqID_79578; Strand=+; Position=1-87
CILANMVVANVQPFVSVIKRTAIHDDHSL

SEQ ID NO: 153156 - protein, 115 aa, Heterodera glycines
  Coding regions on vcDNA: vcDNA=SeqID_79579; Strand=-; Position=1 -194,251-357
  Homolog annotation: Hit_ID=CAE65235.1; Match level="QueryCoverage =97%, HitCoverage=32%, E-value=1e-25, Identity=50%"; Hit description =Hypothetical protein CBG10118 [Caenorhabditis briggsae]
AEHTAASSLFLPMNFFAHSLMYSYYALNSLGFKLPRWFAMIVTTVQTTQMLFGVAITATVFKLKSFLCFRCQQSMGNLYLSFLCFRCQQSMGNLYLAIFLYSTFAVLFIKFFYDL

SEQ ID NO: 153157 - protein, 102 aa, Heterodera glycines
  Coding regions on vcDNA: vcDNA=SeqID_79580; Strand=-; Position=1 -74,121-261,526-619
MIIIILFIICPLNLPFASGQLSTKPVHLTNGQNGLTFVSYRAPEQRESNGTDEKAFGIEFRLPEIAGHCDDGSVTINPAVENIPRYLTFLLNNKKLDYIGEN

SEQ ID NO: 153158 - protein, 35 aa, Heterodera glycines
  Coding regions on vcDNA: vcDNA=SeqID_79581; Strand=+; Position=1 -12,128-223
MALAFFTQITIFLEAIKMLRFSIFCQKLHSRTRWN

SEQ ID NO: 153159 - protein, 213 aa, Heterodera glycines
  Coding regions on vcDNA: vcDNA=SeqID_79582; Strand=-; Position=1 -128,221-380,464-533,611-705,827-1015
MSEFAFGQLTFLRPFIILILFCVGVLSDTETNKQTENSAPLSRDNSAHLARVLQLRQNHEVITHRKRDEKRTNAKTNNGKAKRYKCFLVDDNDSEENLTQQKSYFAKFQERQRLPTDILGWEESPRRSAGAAGARYLYFSTKGTTPEPIIEYIDEDNLKEAEVGTTAPFEGTAEFSIGALAPQRTTMRAMAPPKQQKLNMQTAITATTPVVVK

SEQ ID NO: 153160 - protein, 330 aa, Heterodera glycines
  Coding regions on vcDNA: vcDNA=SeqID_79583; Strand=-; Position=1 -185,568-1006,1196-1463,1521-1621
MAPPIKKKQKHSSADHRLISSSAATIGGKQQQQTLGSVMSSSGKRQSLRVAIKKNCRTLRKIYIDYSVITFLRANQQIFDKGTNLDLYLYLFYARKAKNVQPIWNVIADEIWPIFAPTIRNLNFFDAHDLEELIRHTSPSILTDHNINSIDSGNLLPDVIADDGPNATAGQALSKWLNTPRKDRKPKQLSCRDASEPPNIKWINGFKKAFLRAITTTSANYIIRLEDFEPAENAPFELTNERTNEMLTLEKEEKDDEENEDDDYDIDYWLLKRCPIGKTIQWEDENLNNVSFRFIRLAEFRQLSPPKAGQKKATNRLKMKPGPSGQRKKK

SEQ ID NO: 153161 - protein, 58 aa, Heterodera glycines
  Coding regions on vcDNA: vcDNA=SeqID_79584; Strand=+; Position=1 -102,219-293
MPKWGDDDGTMDGPKFEQQFEQCQHLFEWRKLHLAIVVHSGDAKKRQKKDVELRGSEI

SEQ ID NO: 153162 - protein, 65 aa, Heterodera glycines
  Coding regions on vcDNA: vcDNA=SeqID_79585; Strand=-; Position=1 -102,576-671
MFNRALFCSMDRWYGLTLTPIRIVEDEAQQALDETDELATDDSSQGMNASNGTERDDDQSSDVPM

SEQ ID NO: 153163 - protein, 182 aa, Heterodera glycines
  Coding regions on vcDNA: vcDNA=SeqID_79586; Strand=-; Position=1 -279,712-981
  Homolog annotation: Hit_ID=CAE65006.1; Match level="QueryCoverage =80%, HitCoverage=53%, E-value=4e-43, Identity=53%"; Hit description =Hypothetical protein CBG09844 [Caenorhabditis briggsae]
MDAKFKKWGPPPGCSIVTMKCVINANWSLAFSRKKLPSLLRRLLPKGSMNVHEKVWNAFPYWKEELTNPDFMKDNFLIRMETMLLSDRGNTKNAFGLTKEALNECKKMVRIDIANDTEFLSAEDIQEDSIPSTFRSVCTGRGPLTGQWQTNCEPFMCAYKLVTVKFKWLGFQTVVESFIQKV

SEQ ID NO: 153164 - protein, 52 aa, Heterodera glycines
  Coding regions on vcDNA: vcDNA=SeqID_79587; Strand=+; Position=1 -112,1466-1512
MAFGGPKKFGKSETEIPRPKYFSEVGNLNSDSKNIGNRGVPVAGEDGVRDQM

SEQ ID NO: 153165 - protein, 37 aa, Heterodera glycines
  Coding regions on vcDNA: vcDNA=SeqID_79588; Strand=-; Position=1-114
NVIPTSSASEQMQRNLFEILSQNESFAFQQIAGQTHF

SEQ ID NO: 153166 - protein, 206 aa, Heterodera glycines
  Coding regions on vcDNA: vcDNA=SeqID_79589; Strand=+; Position=1 -125,350-537,845-891,1206-1415,1734-1784
  Homolog annotation: Hit_ID=EAL24801.1; Match level="QueryCoverage =69%, HitCoverage=42%, E-value=8e-21, Identity=32%"; Hit description =GA10823-PA [Drosophila pseudoobscura]
MHTTRIVMSSNLDKNLENIRRIDQFASKVIGYSTHAALFNFSTEQNKWLKTEVDGPLFIYERLDQPLYSLVVVNRQSPQNFVEPITDGLKLSYHPPYIFVHREDGYIHSLWVFGEDECKRAFDTLTKLSMAQKMISAGATTSSPKNNISNNNDNGAVAAFAAATPPTKIVAAAKPSTPPPSQQQQQQAIRKEQLVTVPSSLNIRFF

SEQ ID NO: 153167 - protein, 35 aa, Heterodera glycines
  Coding regions on vcDNA: vcDNA=SeqID_79590; Strand=-; Position=1 -97,137-219
FVTISTFFGKFFNKNAIKPKNTPLRIDKKNFKKHS

SEQ ID NO: 153168 - protein, 110 aa, Heterodera glycines
  Coding regions on vcDNA: vcDNA=SeqID_79591; Strand=+; Position=1 -46,188-239,286-520
  Homolog annotation: Hit_ID=CAE57456.1; Match level="QueryCoverage =76%, HitCoverage=25%, E-value=2e-31, Identity=71%"; Hit description =Hypothetical protein CBG00420 [Caenorhabditis briggsae]
MASGRKHMTMTVFSGVGVSIPLDNETGKHRSFGFVEFELPEDAAAAIDNMNDSEIYGKTIRVNFARPPKVNERSQRPIWADDEWLKQYGHGSGQGEPGECQKFIWASKLE

SEQ ID NO: 153169 - protein, 61 aa, Heterodera glycines
  Coding regions on vcDNA: vcDNA=SeqID_79592; Strand=-; Position=1 -66,274-393
MQTFFSQNHFAAEGIQMQKWRTVVSPYIFTAKMKTMNAVTKLTFSQIYYFTFLHKFNQKDK

SEQ ID NO: 153170 - protein, 200 aa, Heterodera glycines
  Coding regions on vcDNA: vcDNA=SeqID_79593; Strand=+; Position=1-603
MAELKAIISRLTAIEKLISTNNNNTLATEMTAQFSAIAERLGEIERKINNNGIVSAEEIERKRSLVLIGLPESEEEVPSLRAKDDAKTVEEVLDRLDVEVCPQMVYRMGRRIDEKRKGPRLVKVVLPASTFQRFALMQWGRRRTELKKRPGWERLLVRPSLTKEELEIEREQRQKKWMEFGKKKTGENITTRRGGNEKNF

SEQ ID NO: 153171 - protein, 453 aa, Heterodera glycines
  Coding regions on vcDNA: vcDNA=SeqID_79594; Strand=+; Position=1 -1114,1160-1407
  Homolog annotation: Hit_ID=AAC06263.1; Match level="QueryCoverage =92%, HitCoverage=58%, E-value=1e-55, Identity=33%"; Hit description =pol [Schistosoma mansoni]
MTAQIPEIWKKSIICPVPKIQNPVNPVDFRPISLLCSVSKILEENIAGKIKNFVEKNNLLPNCQHGFRKAHSVTTQLLEVVDDFSFALENKKSIDVIYFDLAKAFDTVPHNRLISKLKSIGINNSLLKWIQNYLENRKFFVKIGSDFSDEYPCLSGVPQGSILGPLLFLIYIYDLPKFCETENVKIKLFADDLKAYHVLSNISFSPLQNFINKFNRYCKLNGLKIASNKCLTLHLGHKNQKINYFIDDFPIPKNPGNEPVRDLGIYFTNDLKWAQHIEIISKKALRSAFAILKSIKTGDTKILVNLFNIYCRPILEFGSPIFNPYLKKDIEKLENVQKTFLRVIFRRNNYAADLPNYAELLNIYDQKSLESRKINLQNNESFSFSKNPVKNEFIIRTAYCSTNARYNSFFIRTSRLYRLLPKETRLLNPNEFAKLLERSDLNLLISLPPQLQK

SEQ ID NO: 153172 - protein, 141 aa, Heterodera glycines
  Coding regions on vcDNA: vcDNA=SeqID_79595; Strand=-; Position=1 -107,814-1132
MASNNKNSLLLFLLLIVALLLNYGFCHQQQDNDSSSWWTVFLLSVGCAIICAVLIKGQSEPAEQNANNDQNEGQGDGEIAGGGVNLDDIDMDFIDGEIDYQATWGHNPFEHGGGNLLQNLQEQNIDEQEEEKGEHLKGFGV

SEQ ID NO: 153173 - protein, 42 aa, Heterodera glycines
  Coding regions on vcDNA: vcDNA=SeqID_79596; Strand=+; Position=1 -76,214-266
MAVTEAELFCALPTTTPEQLHAFGNFLRQFSQHLHDEHGFTD

SEQ ID NO: 153174 - protein, 119 aa, Heterodera glycines
  Coding regions on vcDNA: vcDNA=SeqID_79597; Strand=-; Position=1 -121,519-757
MAMDGTPTFLSNLNYRQFTFLSNRGRIFGASALQKHSASQTLYVLSLDVLTFDKLYVLQRVGIVFAKREERKKRETDRRRTTAQSAGQWHRRGMKEGCAIKIFCDEIIMNGRKISVMAH

SEQ ID NO: 153175 - protein, 54 aa, Heterodera glycines
  Coding regions on vcDNA: vcDNA=SeqID_79598; Strand=+; Position=1 -85,175-254
MHAKFVQIVAIACQWPEATLTDLNILKLILKSICSQVRFVTQWMIEKKVDFYPC

SEQ ID NO: 153176 - protein, 121 aa, Heterodera glycines
  Coding regions on vcDNA: vcDNA=SeqID_79599; Strand=-; Position=1-366
  Homolog annotation: Hit_ID=XP_146481.3; Match level="QueryCoverage =85%, HitCoverage=13%, E-value=2e-13, Identity=43%"; Hit description =PREDICTED: similar to carboxylesterase 2; carboxylesterase ML3; acylcarnitine hydrolase M1 [Mus musculus]
MGRKSRGKKGKREGDEEKEEKGVEEEEEKREEEKEGEEEEAAKGVREAVKEDSEEREGGKEEKETEREEEEEGEGTKEKDGIGTERTEATAENQRGKIRGDIKQSVIRVIADQCQRANGRE

SEQ ID NO: 153177 - protein, 190 aa, Heterodera glycines
  Coding regions on vcDNA: vcDNA=SeqID_79600; Strand=+; Position=1 -390,624-806
MPRFELQNICALQSQHQLRHLPKSEANDGGKEAAEVPIIVYEESDNETEQHTHHHQQQQQKTVGQPPRTAVDRREAARIACWASPELSCEGLSLKVRETQPRGTTEGGEARPEVKERTEQSEGKAKAQFERRKDGGAAETADGEGQFGGRERDDAATTADDVIASEMETRGAQIANEQVSGGWKTDGESN

SEQ ID NO: 153178 - protein, 148 aa, Heterodera glycines
  Coding regions on vcDNA: vcDNA=SeqID_79601; Strand=+; Position=1 -178,221-327,391-453
  Homolog annotation: Hit_ID=NP_494780.1; Match level="QueryCoverage =86%, HitCoverage=35%, E-value=4e-29, Identity=54%"; Hit description =nucleotidase (2E711) [Caenorhabditis elegans] gb|AAA83579.1| Hypothetical protein ZK430.2 [Caenorhabditis
VQKALDALVEGKLISEIERVGGAGFKVLRCLEGATAYVFASRGCKKWDTAAPEALLLAAGGTLSDMSGRLINYGGTLSDMSGRLINYGPSVQLINSGGVLATAPGVDHQSFVAAIPQLVKESLPETESFVAAIPQLVKESLPETEIVG

SEQ ID NO: 153179 - protein, 96 aa, Heterodera glycines
  Coding regions on vcDNA: vcDNA=SeqID_79602; Strand=+; Position=1-291
MGEDLKRMTPIGRTPRLDTAPVQPPHRNALTTGDEIAGHRHVGTAVRDPVKGQLRMAKERDRTLHKRKGQFIGHRPNGRAALAEHFHQIQLATATL

SEQ ID NO: 153180 - protein, 65 aa, Heterodera glycines
  Coding regions on vcDNA: vcDNA=SeqID_79603; Strand=+; Position=1 -168,810-839
MIKELRDEVFGKIDELRDEMNQKFGQINTRLDRTDQRLDQMDKRLDRMDQRLDQFETRLINYKFL

SEQ ID NO: 153181 - protein, 312 aa, Heterodera glycines
  Coding regions on vcDNA: vcDNA=SeqID_79604; Strand=+; Position=1 -195,239-312,364-526,579-716,767-975,1031-1190
  Homolog annotation: Hit_ID=CAE64833.1; Match level="QueryCoverage =98%, HitCoverage=28%, E-value=6e-60, Identity=39%"; Hit description =Hypothetical protein CBG09629 [Caenorhabditis briggsae]
MKANYQVSELVKCDSFSELLNSLTKFTLECLSMSHFFTTNSIYYLISFWSKLAGSLGYARVDVELISLCIPKVCTAFIQSRIALCESVVRQGVEDPLDDMGSVKQLMELFTILSRKDYKQTVKELLVRFDESLGILFTQGISEEEQIIARKRLIWLITMMAAGINGKASSNSSELDDDLYDGEVAARVWKTMQLTNGRLERQHPSVMDIQLEFAYIYLMDEFRKAYISDQVMRDSQVYEKLAELGITDDSEVLRLYAQKIIVNLTYWGKDEKILSSTLSLLNDLTVGYANVRRLLKTKEIQELLRNHAVTCS

SEQ ID NO: 153182 - protein, 230 aa, Heterodera glycines
  Coding regions on vcDNA: vcDNA=SeqID_79605; Strand=+; Position=1-693
MKRTNASNITPPRAKRSMAPALDLDPNTVALAEQERQRTLVFIGLPESNAIRPSERVQEDREAATKILDHLEVEAQPTAVFRLGRYDPQRTTRPLKVVMPTTTHQHMALGGWKRERARLRSLQNLNRLFVRPALTKEQLKEEYEARFRKRQQNPAPVATAMQPRQTNVPTPVKENGPNQKEASDDISKPPEVFDQTILVCYEALKSLPPNDKIVHQIQSLEKQYPRLFNK

SEQ ID NO: 153183 - protein, 100 aa, Heterodera glycines
  Coding regions on vcDNA: vcDNA=SeqID_79606; Strand=+; Position=1 -67,1151-1386
MAFFNNGTLLCYSLRDYNNNSVETNTKSYKSKHDEQKLEIVQKFIAMKNEYKQKRKYSRKEWNQNYAEICKKIGVGYETIKKWKKQFGICRKINTEKQNG

SEQ ID NO: 153184 - protein, 53 aa, Heterodera glycines
  Coding regions on vcDNA: vcDNA=SeqID_79607; Strand=+; Position=1 -114,172-219
MFATPEFMDAEDSLMEMKSNQFKMDKNEFIAAEKLIDKDYYRDFGDIFDPDVK

SEQ ID NO: 153185 - protein, 236 aa, Heterodera glycines
  Coding regions on vcDNA: vcDNA=SeqID_79608; Strand=-; Position=1 -268,329-431,534-733,1236-1373
  Homolog annotation: Hit_ID=CAG00028.1; Match level="QueryCoverage =63%, HitCoverage=25%, E-value=5e-23, Identity=37%"; Hit description =unnamed protein product [Tetraodon nigroviridis]
FVQRRLKLFSKLGSADDSALVKQQFAQLPHRNAFVQCLFIRASCFMERNWDGDQLDSVRDCLAILLFCPSHKKAHSLLIKCLISLKQLPLANECFEHYCTLHHFDDEHTTELKQLLGDKKQEEGEKLWTPEYTTHHRDYVQRYTGHLNINTDIKESNWFGPDDQFIVAGSDCGSLFIWERNSQCIVNALKTQLKKATDANFPEDAEDRNITELYELMRQNRRARTPELVWEQLLNS

SEQ ID NO: 153186 - protein, 96 aa, Heterodera glycines
  Coding regions on vcDNA: vcDNA=SeqID_79609; Strand=-; Position=1 -60,119-302,360-403
MSIVAASVLVIVTQCCGCGKKDAAEQQMAPTGDQMQQGSVAKQGSQMGQSAAQGGASKMGQSAAQGSTMANSQMPGLSTYAGVAQSPTPIEVSAWA

SEQ ID NO: 153187 - protein, 93 aa, Heterodera glycines
  Coding regions on vcDNA: vcDNA=SeqID_79610; Strand=+; Position=1 -96,155-340
MTTPANAARARSAKAKLRDAKRRRAAVGRAGYTRKAQRGERCAICMTNVSAITRTTLGCTHPFHRRCLYRWIRYHTNCPVCRYNFTRTIPRRN

SEQ ID NO: 153188 - protein, 110 aa, Heterodera glycines
  Coding regions on vcDNA: vcDNA=SeqID_79611; Strand=-; Position=1 -247,405-490
MVVLLLVVVSAAASAAAALFAVTVTCLRSAVSSACGGQRVPVFVAFVLVMALLIPATPAIVVEIIVLSQKWPTISNPENTHKVGSPSYNTQIEEIEKINFNTNNFQYNTS

SEQ ID NO: 153189 - protein, 220 aa, Heterodera glycines
  Coding regions on vcDNA: vcDNA=SeqID_79612; Strand=+; Position=1 -172,246-318,545-960
  Homolog annotation: Hit_ID=CAE71225.1; Match level="QueryCoverage =78%, HitCoverage=29%, E-value=9e-37, Identity=44%"; Hit description =Hypothetical protein CBG18089 [Caenorhabditis briggsae]
MVANPPPPPPPPPIPSFSGDTTTAFLAATGAPVVAPPPPSTPPPPPPPENEHAGENKVGSAGSPPPPPPPVPVPPPKRCRPLVLKPRDLPTISEGWGIGSADKFRIIEQVGEGTYGQVYKASDGQTGRMVALKKVRLENEKEGFPITAVREIKILRQLDHPNIVKLLDIVTDRTGPASAEQSPQQQSPSIGGDLSAQRKRRSSTLTNSSTSGGQPAGGGG

SEQ ID NO: 153190 - protein, 125 aa, Heterodera glycines
  Coding regions on vcDNA: vcDNA=SeqID_79613; Strand=-; Position=1 -105,372-470,547-720
MPKSERKIGTDNNGHHQNKMDEIKQEDEEEEKEDNLDLLKAKILSDFNKLDNGKRKFTSGATLGYVTPNFCIFLFMIISMIFEKPIKLVASFRMIPSLLVNKEKSYGALNLAQNPIVSGLIPNLG

SEQ ID NO: 153191 - protein, 64 aa, Heterodera glycines
  Coding regions on vcDNA: vcDNA=SeqID_79614; Strand=-; Position=1 -118,287-363
MSPLRFIIAFLLVVLCAFSALITAQEERVDNEPAALRARRGMYGSPYGGGMGGGGPWGGNFGKK

SEQ ID NO: 153192 - protein, 117 aa, Heterodera glycines
  Coding regions on vcDNA: vcDNA=SeqID_79615; Strand=+; Position=1 -125,176-404
  Homolog annotation: Hit_ID=NP_495679.1; Match level="QueryCoverage =70%, HitCoverage=6%, E-value=2e-15, Identity=42%"; Hit description =ARID  protein and Zn-finger, C2H2 type (2I314) [Caenorhabditis elegans] emb|CAA86663.1| Hypothetical prote
MLKRKRYLPIDSYLEALTIPLERKQKRDQFYQNIRSFYKRKWGFDFKAPSANGQELDLFEMYEAVTFLGGWQKVTALNRWSEGGHFTQIFLLILTFLVDVRPTNNNLFYYKSIFCPE

SEQ ID NO: 153193 - protein, 88 aa, Heterodera glycines
  Coding regions on vcDNA: vcDNA=SeqID_79616; Strand=+; Position=1-268
  Homolog annotation: Hit_ID=NP_491707.1; Match level="QueryCoverage =76%, HitCoverage=3%, E-value=3e-09, Identity=52%"; Hit description=P- GlycoProtein related (pgp-2) [Caenorhabditis elegans] gb|AAB52482.2| P-glycoprotein related protein 2 [C
VFFAIAFCGQSVGQIRHYFGLCLSSLSLCLFYRFQLIPDVVKARLAGSLLFHLIEYPSLIDSLSDRGNDQAKRNWPFQLDLNIQKFAG

SEQ ID NO: 153194 - protein, 93 aa, Heterodera glycines
  Coding regions on vcDNA: vcDNA=SeqID_79617; Strand=-; Position=1 -164,686-803
MSIGIRYGTERLPISDIFGVGIPTSQNFWGLGMPSLIRTAGPPVPSFLKNCTAKKQTLISGDYLLINDQPKKIFYPKLILFIDIIWLGFIFKC

SEQ ID NO: 153195 - protein, 22 aa, Heterodera glycines
  Coding regions on vcDNA: vcDNA=SeqID_79618; Strand=-; Position=1-68
MARKDFRFPTFLGSEFRLPKIF

SEQ ID NO: 153196 - protein, 28 aa, Heterodera glycines
  Coding regions on vcDNA: vcDNA=SeqID_79619; Strand=-; Position=1-85
TTPNPNASALPAAAAMAAAAITAKIQAQ

SEQ ID NO: 153197 - protein, 190 aa, Heterodera glycines
  misc_feature (12)..(12): Xaa can be any naturally occurring amino acid
  misc_feature (17)..(17): Xaa can be any naturally occurring amino acid
  misc_feature (19)..(19): Xaa can be any naturally occurring amino acid
  Coding regions on vcDNA: vcDNA=SeqID_79620; Strand=-; Position=1 -83,1016-1188,1577-1708,1764-1867,2139-2172
  Homolog annotation: Hit_ID=XP_392063.1; Match level="QueryCoverage =85%, HitCoverage=22%, E-value=4e-37, Identity=49%"; Hit description =similar to ENSANGP00000016235 [Apis mellifera]
SFLNDQVYLVFXIFKIXFXIFSKFLKSPQLIGLGLRKLRTYEKEDLERAKRYAMDQSVKYVMLKQREAHQQQVMCDRTMSPTKTDALSIMSRVYIGSINFDIGEEHLRQVFAPYGPIKLINMCRDPSTGNHKGFAFVEYEVPEANHKGFAFVEYEVPEAAQLAQEHMNGKMMGGRTIKVVELPETGASAF

SEQ ID NO: 153198 - protein, 113 aa, Heterodera glycines
  Coding regions on vcDNA: vcDNA=SeqID_79621; Strand=+; Position=1 -58,485-721,1204-1250
  Homolog annotation: Hit_ID=AAO33477.1; Match level="QueryCoverage =77%, HitCoverage=37%, E-value=8e-19, Identity=53%"; Hit description =gland-specific protein g4g05 [Heterodera glycines]
MSGESKEKQPAQKNPKAETASTKLPLDYDLHRVAAKAAGNVYAWLPADKQPKKLADIKPAAPAAPLPPADYDVERVAAKAAESVYSWLPKELQPEMMTEDERVEFTAEVFQDI

SEQ ID NO: 153199 - protein, 51 aa, Heterodera glycines
  Coding regions on vcDNA: vcDNA=SeqID_79622; Strand=+; Position=1 -45,559-669
MKELIGSYFYGHPKNEKWAQEQHFFYVKCTYITRVRRSEALASFCGFLIGQ

SEQ ID NO: 153200 - protein, 51 aa, Heterodera glycines
  Coding regions on vcDNA: vcDNA=SeqID_79623; Strand=-; Position=1-188
INKRHYLANNFTKNHPMWQKSISKSVLLSTKRNRTARNFPASDPSVPGKFS

SEQ ID NO: 153201 - protein, 499 aa, Heterodera glycines
  Coding regions on vcDNA: vcDNA=SeqID_79624; Strand=-; Position=1 -135,232-380,635-1065,1203-1369,1728-1897,2006-2147,2203-2272,2515 -2750
  Homolog annotation: Hit_ID=CAG31044.1; Match level="QueryCoverage =58%, HitCoverage=58%, E-value=4e-12, Identity=25%"; Hit description =hypothetical protein [Gallus gallus]
MWQLVDLEEEERKRQKRERKERKRARKEAKRARKEAAEADEGTAETEKQLRKRLKKKSKKRKKDKQVSHESLTPPPTPAEETAKDTAGASRAAESRTAFVAAPNNAAPRRTAASSATSRSVADIRRDEDAVKRRSPSIRRPAPERIRRPYRPLPPRRVSPQPRMPVRRKRPLLPSKSQTMTHRRRVVRRSLLTPSPPPAARPRGDTLRPLCARSLSPPTPLPPARVTQIERAVSVSSAGPPPRRRHGAHVAVGPVAAEAAALPPRPVLLPPHARGVRPLPAERDRAVTAAERTALPAHVRDPKLISTLRRPYIPGAGRRSTYGLARTINGETTSGTTTATTTTILGLRGRGRLRGRGGRVNLRFFTQRPKADYLDNRGQIDKRKLLEIATENATKLAMEGKLPKGAELVDTIKIKSVEQLATLCKQVADEEAARPVPFTKWINPNFPLGVAGGAPPKRMHRAGGPVGDDDDYLLLQKVSSGSEEEGDEEERFQRKKTAF

SEQ ID NO: 153202 - protein, 180 aa, Heterodera glycines
  misc_feature (47)..(47): Xaa can be any naturally occurring amino acid
  misc_feature (141)..(141): Xaa can be any naturally occurring amino acid
  Coding regions on vcDNA: vcDNA=SeqID_79625; Strand=-; Position=1 -178,300-422,479-597,725-848
  Homolog annotation: Hit_ID=CAE62539.1; Match level="QueryCoverage =82%, HitCoverage=47%, E-value=8e-15, Identity=33%"; Hit description =Hypothetical protein CBG06648 [Caenorhabditis briggsae]
SSRFSRLLFSGHRTLLWLFGCSLYALYWAVFVKPTVYSSVYFGWFFXPFVGYRPDNQHEFAVQLHTFHDILVAFLCPGIYLIFALVLCASSYDFNTMQKKTFLQVFLVSLINTLTGSLYVYMQHNDLRQQWMLTLAEFAWXPPVIYLALNKTIRKDSCSLFMKVFQRHRISSVGVVAVSA

SEQ ID NO: 153203 - protein, 73 aa, Heterodera glycines
  Coding regions on vcDNA: vcDNA=SeqID_79626; Strand=-; Position=1-222
MSPRFGSTSDMTAEPMPSSARCNSLMAISNEEDADGESSMAPMWSNICWEKSKEWGDEGKVDANLSLFGHKFH

SEQ ID NO: 153204 - protein, 26 aa, Heterodera glycines
  Coding regions on vcDNA: vcDNA=SeqID_79627; Strand=+; Position=1 -68,423-435
MWQKKATTTLKPREKAKEKVRKRKKI

SEQ ID NO: 153205 - protein, 278 aa, Heterodera glycines
  Coding regions on vcDNA: vcDNA=SeqID_79628; Strand=-; Position=1 -237,500-649,707-802,851-1204
  Homolog annotation: Hit_ID=CAE65129.1; Match level="QueryCoverage =100%, HitCoverage=35%, E-value=8e-56, Identity=45%"; Hit description= Hypothetical protein CBG09994 [Caenorhabditis briggsae]
METKDQVAIHEAMEQQTISITKAGIKATLNARCSILAAANPIGGKYDRSQPLRNNIALSAPIMSRFDLFFVLLDTNDNPLSAEAERALKSAYLRLRINDDGNGTRVTVRQLESLVRLSEAYARLKCEAEVTEEHVKKAYELLSKTIVPISAPQISLDEEDDADFNVAPQPMADITNQTQQDEEQHQMDIDTTQFMGEKDTETEQLGRQRRTASDTAKSAGAPSVCALSVDGGSEGLKLSHDQYMRIANMLVVHMREEEERNGDEPEWPGTRQSQLAEW

SEQ ID NO: 153206 - protein, 183 aa, Heterodera glycines
  Coding regions on vcDNA: vcDNA=SeqID_79629; Strand=-; Position=1 -196,239-408,1871-2056
MMFLIRHFLPCHYNADEDDAEFEEGALVEYCRSKVVRPSAVLKQPPLVVRRPSSAVKGTQNLFQNEKPNSKEKTNSSRNNDQFGRKTFEGELRNGWFIDEKQKRQQNARRNTAIEEGQQPAKIVFGGNSTEKNRWRSNSSTGAGIAERSLLSSAGDIARGRQMAHVIDIEVEEEKGKETPQKE

SEQ ID NO: 153207 - protein, 100 aa, Heterodera glycines
  Coding regions on vcDNA: vcDNA=SeqID_79630; Strand=+; Position=1 -84,225-443
KNRVIIFTVIVELIFGVFPCFVSILYNQVLNLPIGAPNSGLKGEIAITCCAFDGAMCGILYMSVLLKRSHGSSTVANAVTTVPGASKNLQKAHENLPKIS

SEQ ID NO: 153208 - protein, 102 aa, Heterodera glycines
  Coding regions on vcDNA: vcDNA=SeqID_79631; Strand=-; Position=1-311
RPGCDRMSALCLPAMGRCARETDQRAEEPPEKYHMNVLARYRTAIPERDGGHSKTNDEESSQNGGMDNNDDDDQQRIMPMPTEEGAGREGGGAQSSRSTDIE

SEQ ID NO: 153209 - protein, 293 aa, Heterodera glycines
  Coding regions on vcDNA: vcDNA=SeqID_79632; Strand=+; Position=1-882
MQLKGIDLSFCTLRRYVSRLTIVSAHTNKNDASNSNASSHEMPKHELRFEKCFSKTLRKNVFIIGNESAWRKYVQTNENNEDIYISCSKCRYFREQEKNVNVKSIVASAVLRQGTQLVMLQSNHNANCKPEKLEKLEAEQVDREQRRENYKCESEGKIIWRKGLGKARESDLKTDIDPLDENSISSNYPSWVSVRRAYNRRRQQLQGTDSNNPFDVPERLQLTKLGSLKLLMGKTITETEWMIYRNREIGTLLFASKIQLEAARYCKIMVADATFELAPRGFRQIWLKHLNLG

SEQ ID NO: 153210 - protein, 69 aa, Heterodera glycines
  Coding regions on vcDNA: vcDNA=SeqID_79633; Strand=-; Position=1-210
MHPIKKFIFLYLILYQSVKIEQKPVHRRAILSVLAIGGIVALVLVPIVVGSAVVGYLISYSIHGVNGKC

SEQ ID NO: 153211 - protein, 45 aa, Heterodera glycines
  Coding regions on vcDNA: vcDNA=SeqID_79634; Strand=+; Position=1 -48,623-712
MALLNLCILSLSCSCSASTYNRKGCRNWQLFSTNFVHFSTGRITH

SEQ ID NO: 153212 - protein, 149 aa, Heterodera glycines
  Coding regions on vcDNA: vcDNA=SeqID_79635; Strand=-; Position=1 -219,352-471,597-707
  Homolog annotation: Hit_ID=EAA59759.1; Match level="QueryCoverage =93%, HitCoverage=9%, E-value=4e-13, Identity=35%"; Hit description =hypothetical protein AN3551.2 [Aspergillus nidulans FGSC A4] ref|XP _407688.1| hypothetical protein AN3551.2
MGDDDDNIDDNDGNMDDNDDDDLGIDMDAIIRELEMEEGKDGEDEGLGLDYDEDDLEGSDDDPAEKEDEPKPNIAAKKGKKKVLESEDDDEDDLEGSDDDPVEKEDEPKPKALIAAKKGKKKVSESEDDFEEDWDSGDDYWVLAWKKRQ

SEQ ID NO: 153213 - protein, 301 aa, Heterodera glycines
  Coding regions on vcDNA: vcDNA=SeqID_79636; Strand=+; Position=1-906
  Homolog annotation: Hit_ID=NP_500227.1; Match level="QueryCoverage =81%, HitCoverage=23%, E-value=1e-34, Identity=34%"; Hit description =predicted CDS, reverse transcriptase like family member (4D351) [Caenorhabditis elegans] gb|AAK68554.1| H
MKKQLHKLRNEQESKIISQGQNSVNKCIRNKLSKVNEIPTLIDSAGNMFSSNEQKCEILAEIFQKSFLENSVVNGSLTQSTQNKIKLSDIELNAGIIWNILRKLPRRNSTSPDNIPYILLKNCAEPITKILADIFRLALDSGQIPEIWRTSLVVPIFKKGEKTDPLNYRPVSLTSTVCRVFERILSSKILEFLNGIRFFDKEQFGFLKNRSTTTQILKTMDDIYNSLQKDQQIDIIYIDFVKAFDSVLIDLLLQKIKKIGIEGKFHNFLTIFLKNRSFKVKLAKNCQTVSEYFQECPREVS

SEQ ID NO: 153214 - protein, 113 aa, Heterodera glycines
  Coding regions on vcDNA: vcDNA=SeqID_79637; Strand=+; Position=1 -126,459-541,905-1037
  Homolog annotation: Hit_ID=XP_314159.1; Match level="QueryCoverage =98%, HitCoverage=23%, E-value=8e-18, Identity=39%"; Hit description =ENSANGP00000015833 [Anopheles gambiae]
MANKVYVKKGIRVKNAFKKKIEENYGGRMETVDFEDIEGTAEKINNFVEEATHEKISDLIAPDALDKESCLVLINALYFKGAWANKFNKKFTKKATFYVDANTKKEVAETNTF

SEQ ID NO: 153215 - protein, 61 aa, Heterodera glycines
  Coding regions on vcDNA: vcDNA=SeqID_79638; Strand=+; Position=1 -135,860-910
MMHGSFCANVTFKGNSTEIQWFQKEILLIAVQIMDHAKKYVENELEKTFPLIEIGLVESKN

SEQ ID NO: 153216 - protein, 88 aa, Heterodera glycines
  Coding regions on vcDNA: vcDNA=SeqID_79639; Strand=-; Position=1 -30,315-551
MATLWNWSSFVFRQKLSADGLSILIQAEKPIVGIDSSALVDVSVEAGYHNMDTVVVQNGKTILRGTAQCEVGIILQICRHKALPIISA

SEQ ID NO: 153217 - protein, 30 aa, Heterodera glycines; identical to SEQ ID NO: 152275
  Coding regions on vcDNA: vcDNA=SeqID_79640; Strand=+; Position=1 -27,422-487

SEQ ID NO: 153218 - protein, 88 aa, Heterodera glycines
  Coding regions on vcDNA: vcDNA=SeqID_79641; Strand=-; Position=1 -39,256-483
MEAIIKHVQYAAVKWQHKMYRNSKTMARRMGLIDGWIKEMGRMNGLTKCLIVLAFCFTPIIFWQFFSFFTVHGSDAHQTLQRYLSQEN

SEQ ID NO: 153219 - protein, 48 aa, Heterodera glycines
  Coding regions on vcDNA: vcDNA=SeqID_79642; Strand=-; Position=1 -105,158-199
MPKIHFMAIDQQRVDCAICLDQIPLETFVRPLPCNHIFHNQCIENWYF

SEQ ID NO: 153220 - protein, 176 aa, Heterodera glycines
  Coding regions on vcDNA: vcDNA=SeqID_79643; Strand=-; Position=1 -142,184-572
EYNCSDETEYNFVKNAWIEINQNDPALSQLLEALFATVISANKALEYDDANKISAQLNELKQSLAYAVFFMAKRGQIPLESPREEKEREPKEILIGLIDIYNECQLDADKVLKSCGECGKKGKEEKWQKGKEKYGKKERRFLEFVAHSLEMKWDANAFSAGGQQQQDDDDGNYMHF

SEQ ID NO: 153221 - protein, 103 aa, Heterodera glycines
  Coding regions on vcDNA: vcDNA=SeqID_79644; Strand=+; Position=1 -105,158-189,744-918
MPQIHFMAIDQQRVDCAICLDQIPLETFVRPLPCNHIFHNQCIENCQLLFYDPVLLQLLVNDMEQYNARENSEIKSEARFGFSGLDLAIKTAFNKFQLIKAKF

SEQ ID NO: 153222 - protein, 70 aa, Heterodera glycines
  Coding regions on vcDNA: vcDNA=SeqID_79645; Strand=-; Position=1 -110,303-405
MPDAEKILQQLEHHFVNNWLLDTGRIDELKRVCFFKRIFICHFTSLLLLKIRVPRDREFLPKPGPGLAGT

SEQ ID NO: 153223 - protein, 342 aa, Heterodera glycines
  Coding regions on vcDNA: vcDNA=SeqID_79646; Strand=+; Position=1-1029
  Homolog annotation: Hit_ID=YP_024435.1; Match level="QueryCoverage =36%, HitCoverage=76%, E-value=2e-13, Identity=35%"; Hit description =hypothetical protein KgORF4 [Staphylococcus phage K] gb|AAO47450.1| ORF4 [Staphylococcus phage K]
MNFDEHGQINVMSSEHAYFMLKAAHFGDMASFHHIRHAPTPAAAKRLGRHIMPFVEQQWHVVRFELMCRALRAKFAVEHLRSALRTTGYGQLVEASRDEYWAAGREMHDVGLTATANWLGQNALGGALMIIREEVRTHPPTPNNLVRHYVVAQASAEDYVIVAAAFDHEPFFVRVGNDMLQGLGLQRNLAVGDTLVLVGYYWRAAFEQVAQIGHPTLPGWLHQGQIVRQAEAQSVQNVVLVPSFVMPGVIRAINNGRHQGHRIVCSVNVLVHGRIHTLTKRNMNEGVIELLEEGQNVQLHVMEVPAGWWCARNYILPPNALLGTGMEWQSNGGEVFPLWLEL

SEQ ID NO: 153224 - protein, 125 aa, Heterodera glycines
  Coding regions on vcDNA: vcDNA=SeqID_79647; Strand=+; Position=1 -136,195-328,878-982
  Homolog annotation: Hit_ID=CAE71134.1; Match level="QueryCoverage =86%, HitCoverage=8%, E-value=2e-13, Identity=41%"; Hit description =Hypothetical protein CBG17988 [Caenorhabditis briggsae]
MAPDFDPSTIPKSLPITNNGPPLIAVLWTNDWDAQRRRVLIRETNEETILAMAQNEVNIQFRYGKEFEPKSMVIITWMDSSVTDEDDENELSDADVLFQLALIVGNNACFAHNIFSKLPKSVMAM

SEQ ID NO: 153225 - protein, 163 aa, Heterodera glycines
  Coding regions on vcDNA: vcDNA=SeqID_79648; Strand=-; Position=1 -78,811-897,1634-1742,1977-2002,2456-2635,2920-2931
MQNFFLYRYAKFGATCMHRKKVIWREVKCECEGGQCVTVRVQLLLQCNAFRKTVKILGLLPEALPDEFVFPVRSISVHTFEKMVQWMEHRDGKPEPIVERDPLTGTQKWQVFDEFDKSFFKVVDFALKNATFRPNFQIQIEFAELKMLLNASHFLDLNSLFIK

SEQ ID NO: 153226 - protein, 89 aa, Heterodera glycines
  Coding regions on vcDNA: vcDNA=SeqID_79649; Strand=+; Position=1 -37,89-321
MAKAKHARWAKKTAPQPDTDAEMPQRAVDIRGNGAGQRRTTIINSNTGDTAGNGRAVGGDDGNRCVIPFNACRRRPTNSTNAVNIHGTL

SEQ ID NO: 153227 - protein, 120 aa, Heterodera glycines
  Coding regions on vcDNA: vcDNA=SeqID_79650; Strand=-; Position=1 -23,108-235,390-601
MRNMMASVVIFYFKIKIKIRISLISLLTHAFIVIADTAPVQKTMIEQFIAEIGSSISGVNETEFARAAGLGQHSAEKRESDTIGDELPKVMKKGSSLEDQLEELGQDDEEEDEEEDEEES

SEQ ID NO: 153228 - protein, 28 aa, Heterodera glycines
  Coding regions on vcDNA: vcDNA=SeqID_79651; Strand=+; Position=1 -23,58-121
MHCFEGKNGLFRLDIFPIHFRVLINKIL

SEQ ID NO: 153229 - protein, 230 aa, Heterodera glycines
  Coding regions on vcDNA: vcDNA=SeqID_79652; Strand=-; Position=1 -300,892-1158,1658-1783
MVFSFATSYGGFQCSVLENADSDEVFPSSSDAVDGLSSAAQTVASLRDRVFSAISETYGQWSQTIGAYFQEDDLEEDDDTEDYEPPVLLKQPVRVGPQFQVTELPNQSMETQPLDELSEKLWCPSTDRCPNAFIDAYLTNFAQIKAVKKPCRNPSAPPTTPLADVRPANVPDDEDALLALMKVRQKWLILPCRTVGELVTFYYSWKKSERYDLWKAEKCRREQQVDARTT

SEQ ID NO: 153230 - protein, 19 aa, Heterodera glycines
  Coding regions on vcDNA: vcDNA=SeqID_79653; Strand=-; Position=1-58
MADADAQSDYEEEEEDDDE

SEQ ID NO: 153231 - protein, 148 aa, Heterodera glycines
  Coding regions on vcDNA: vcDNA=SeqID_79654; Strand=-; Position=1 -6,627-1067
MRDVAGLDFWLHELPLVEQNATRETEEEKEEEEQTWQSVFVPRRWQEDGKRTERWNESMNHSRLAMSALMAHGTFMAKPLPDQMVGMPMDDDGTEGADEEKGTSDNGKLLSGGGELRRVWTAFWLALSAIVLLAVAVMTHQLTLISFN

SEQ ID NO: 153232 - protein, 29 aa, Heterodera glycines
  Coding regions on vcDNA: vcDNA=SeqID_79655; Strand=-; Position=1 -33,79-135
MMLGRSDKSINTENDFRLIGVFNGIAIRI

SEQ ID NO: 153233 - protein, 41 aa, Heterodera glycines
  Coding regions on vcDNA: vcDNA=SeqID_79656; Strand=+; Position=1-125
MSATEFENHLTPNLSGLYAKIDALSAQVQRLGLAMATLPNG

SEQ ID NO: 153234 - protein, 23 aa, Heterodera glycines
  Coding regions on vcDNA: vcDNA=SeqID_79657; Strand=+; Position=1 -39,599-631
MTLVSGFVEAFEFTLCFLMIPKT

SEQ ID NO: 153235 - protein, 100 aa, Heterodera glycines
  Coding regions on vcDNA: vcDNA=SeqID_79658; Strand=+; Position=1 -285,464-481
MFKLGFGLISNLASTCTVLDSLCCAIYFTLAFVPPGWLKRNANATAIGGTTNAQLREPNQQQQNRTHRIPSFNNTVGPGTNQPNRYCNGMVPVVTNHFTL

SEQ ID NO: 153236 - protein, 146 aa, Heterodera glycines
  Coding regions on vcDNA: vcDNA=SeqID_79659; Strand=-; Position=1 -215,307-532
MPMFVIRISKSLTTKVGLSITRERIMVFSKFVINHFFSSKDWSSVFAKHPILLDNNSSNIFYYEISVKNKKGWVFFGFAFKQHIKLDWIIENIGTYAYENDGEIWINKQRKGINAEHSNGVGDTVGIGVNSPLADHFTKNELRLGW

SEQ ID NO: 153237 - protein, 99 aa, Heterodera glycines
  Coding regions on vcDNA: vcDNA=SeqID_79660; Strand=-; Position=1 -61,295-383,469-618
MSISNNSINDGDDLTPAENEEVNGDAISLDNDGQFDGKNSKLITDRQQLKEFREKIAKMEMELKMAKLELENVRSFAIKFGKRTKVKTAAGTDGRAEGI

SEQ ID NO: 153238 - protein, 111 aa, Heterodera glycines
  Coding regions on vcDNA: vcDNA=SeqID_79661; Strand=+; Position=1 -60,180-360,631-725
MSSRRPSPKASTSRARSEHERARSRSRHERRGMFEIVRQGMWSKIVVTLRSMLPSPPILERESVSNLAFKIEIKNGFDNLANEEYGAYTGSRTLAKPATGQSSDSADSTVG

SEQ ID NO: 153239 - protein, 132 aa, Heterodera glycines
  Coding regions on vcDNA: vcDNA=SeqID_79662; Strand=+; Position=1 -75,195-315,647-732,1052-1076,1130-1220
ILHISMSSRRPSPKASTSRARSEHERARSRSRHERRGMFEIVRQGMWSKIVVTLRSMLPSPPILEPNEEYGAYTGSRTLAKPATGQSSDSADSTFFFNACGGPNEEYGAYTGSRTLAKPATGQSSDSADSTV

SEQ ID NO: 153240 - protein, 147 aa, Heterodera glycines
  Coding regions on vcDNA: vcDNA=SeqID_79663; Strand=-; Position=1 -316,362-489
MKRSKRNSSNTKTKKPRISKNFDHHEGIKPCIKKIEEYTTNSKKFRLLRSKSKFVVENIEKCPNPTIELENCIKTSIDEAIADAKRKLGGADKAGVIISSEMLEQEAVFNQFIKVEQSLSTKNINLYGSPFIITVTVLNINDLRKNK

SEQ ID NO: 153241 - protein, 116 aa, Heterodera glycines
  Coding regions on vcDNA: vcDNA=SeqID_79664; Strand=+; Position=1-350
MSGEGSDFNPAFFTVEENAQYQTILERLRSFEAAVCSQFRKLESSLNGSERATKDQLSRLESSLQNLDENEEMDEFETKEKIFKLEEKLEETHNKFEVLTANVSENLKECFEKLIL

SEQ ID NO: 153242 - protein, 157 aa, Heterodera glycines
  Coding regions on vcDNA: vcDNA=SeqID_79665; Strand=+; Position=1-474
  Homolog annotation: Hit_ID=XP_307468.1; Match level="QueryCoverage =63%, HitCoverage=12%, E-value=5e-10, Identity=35%"; Hit description =ENSANGP00000016246 [Anopheles gambiae]
MANPTVQQLMDMVKQLLEAQQNAPQAGQQPSNVPSLPNVENFEFGEQSTDIEDWLQQFDFALDCAAPNLQDVLKVKLLMTKLSKEAFAEYKKSCMPKNVTDFDFAKTVEQLKSLFARPQSIWIDRYDCLRASKLEDKEFRAFVNRHKRLLRDFNSRS

SEQ ID NO: 153243 - protein, 34 aa, Heterodera glycines; identical to SEQ ID NO: 124987
  Coding regions on vcDNA: vcDNA=SeqID_79666; Strand=-; Position=1-102

SEQ ID NO: 153244 - protein, 89 aa, Heterodera glycines
  Coding regions on vcDNA: vcDNA=SeqID_79667; Strand=-; Position=1-606
RNKTSFPCLSTVCPNFYFAKIFCRAEFASVWSRQVVQRPGTSALMNACDQRVADAGTRATGRRSQSGQLIAVHRRGADLHKQQGISLVN

SEQ ID NO: 153245 - protein, 118 aa, Heterodera glycines
  Coding regions on vcDNA: vcDNA=SeqID_79668; Strand=+; Position=1 -13,156-499
MLNNAVLTLFTGKPGSATIEAMLIDFKLTETSLTTPLPGVQLHWIHFNHAVMLGKYNLAMSFVTCIIMLFTIVSFLYWWYALMLSVRMASNYGEFLGWATVSMALVFYILFFMAFVLL

SEQ ID NO: 153246 - protein, 60 aa, Heterodera glycines
  Coding regions on vcDNA: vcDNA=SeqID_79669; Strand=-; Position=1 -96,831-895,960-1214
  Homolog annotation: Hit_ID=NP_508656.1; Match level="QueryCoverage =85%, HitCoverage=86%, E-value=3e-11, Identity=49%"; Hit description =putative endoplasmic reticulum protein, with a transmembrane domain (XE407) [Caenorhabditis elegans] gb|A
MELGDMVLAILELICCFFVPPIAILLKSGECNQQVLISVVLCILLWIPAVIHAIWYCFIR

SEQ ID NO: 153247 - protein, 46 aa, Heterodera glycines
  Coding regions on vcDNA: vcDNA=SeqID_79670; Strand=+; Position=1 -66,192-266
MEIQHLNNIFSLFLIKMHILWRSKIRVFLELSTNLAPHFGLPDFGP

SEQ ID NO: 153248 - protein, 319 aa, Heterodera glycines
  Coding regions on vcDNA: vcDNA=SeqID_79671; Strand=+; Position=1 -454,638-1043,1433-1532
  Homolog annotation: Hit_ID=XP_320889.1; Match level="QueryCoverage =42%, HitCoverage=21%, E-value=4e-15, Identity=33%"; Hit description =ENSANGP00000012033 [Anopheles gambiae] ref|XP_313651.1| ENSANGP00000013044 [Anopheles gambiae] ref|XP_314
MEEDRAKNTDIKFERLVEECRSILSLRSAAAALEHPGHGWQANSILVKPQREKERQGRQRQFSNSRTQGISMKDGRTVNQQTAASHQSRVCLFHAKRVEEIIGTTSAKASVKVIGTTKVTTNYGKSATTVIESDILHDSAEAKSRPTTTTRWHNFELIGLFDCTVEFAGIKLELECFVAPTGALNLFGLPWIRAFELALQRPIATTLQIVQPEPAFMAMASSADLDIVTELDRLLAIEAIKQIDYSRWAAPIVAVKKKSGDVRVCIDFSTGLNDALELNRHPLPRQYEIICFALGLYQTCYEGANLQFVDDFAQCFDRN

SEQ ID NO: 153249 - protein, 58 aa, Heterodera glycines
  Coding regions on vcDNA: vcDNA=SeqID_79672; Strand=+; Position=1 -129,227-274
MAPRDDSSNNNNNGQPSIQFDQQVRQDPGLNAVFDFVREQGARQMAQHRLNERRAGNN

SEQ ID NO: 153250 - protein, 95 aa, Heterodera glycines; identical to SEQ ID NO: 125597
  Coding regions on vcDNA: vcDNA=SeqID_79673; Strand=-; Position=1-660

SEQ ID NO: 153251 - protein, 168 aa, Heterodera glycines
  Coding regions on vcDNA: vcDNA=SeqID_79674; Strand=+; Position=1 -24,303-344,401-466,822-1196
  Homolog annotation: Hit_ID=XP_227544.2; Match level="QueryCoverage =77%, HitCoverage=65%, E-value=8e-11, Identity=31%"; Hit description =similar to putative protein family member (XC187) [Rattus norvegicus]
MWVKYFSGKKILNTVLKSYFGKLFITFLKKVIEIKVILGIGTKGNFMYLLYLFNHFCTSFIKFVPLLITVLFLLITVVPLLITVVPLLISVVPLHITVVPLLITVVPLLITVITLLITVVPLLITVVPLLISVVPLHITVVPLLITVVPLLITVVTLLITVVLITVIF

SEQ ID NO: 153252 - protein, 224 aa, Heterodera glycines
  Coding regions on vcDNA: vcDNA=SeqID_79675; Strand=+; Position=1 -102,159-248,305-385,443-523,583-672,727-855,1140-1214,1461-1487
  Homolog annotation: Hit_ID=EAL47359.1; Match level="QueryCoverage =84%, HitCoverage=37%, E-value=4e-12, Identity=29%"; Hit description =hypothetical protein 106.t00024 [Entamoeba histolytica HM-1:IMSS]
MFPDDDGYESEDDEILLPPPPIPPQLGHPPPNVPAVRVQPMHVGQQRLPLRDLPQFEDHLQNVPAVRVQPMQQPLPLRDLPQIFHPPPNVPAIRVQPMQQPVPMRAVPQFLHPPPNAPEIGVGPIHDGQQPLPLRALPQFAQPPPNVPAVRVQPVQQPIPLRDVPLFGNPPPNVPVILARFCYFFSRSRMQAIQPRQRPRQLRDVPLFDHPLPNGQKLDAKPNL

SEQ ID NO: 153253 - protein, 26 aa, Heterodera glycines
  Coding regions on vcDNA: vcDNA=SeqID_79676; Strand=+; Position=1-80
PGVPSRSREIGFRDELPCQYNIYITS

SEQ ID NO: 153254 - protein, 327 aa, Heterodera glycines
  Coding regions on vcDNA: vcDNA=SeqID_79677; Strand=-; Position=1 -399,1124-1708
MTTNSCVFYQHDLQKQKPNELVAYVARAVCLYTDIFNRMTEEERQSLNETMAYEESLTGQKNIELVGQKLDAQVEKKVKSLIADQHIIEYPTDQRTVLNMPTLHEFLRLEQGESSAMGEKKGAIVALPGSLDEMAQTLIEAEQPWDDGTDQFQGFSLLQRRPTLEDMFSRSPLTPIIESSSELRLRSESENSDQMYSLEFHALPSPQWNDKIVIGDQKGDTMVISDQKMSQKADQKHSPSKLTDQEHSPSKLVLVNDQKLKQEAGHARRNSTGSIHRGQKKEKEADHPSSSRATSIDQRPALQYHPAADLYHQRAASATDKSDGQLW

SEQ ID NO: 153255 - protein, 39 aa, Heterodera glycines
  Coding regions on vcDNA: vcDNA=SeqID_79678; Strand=+; Position=1-119
MAKNGFVFESWPTQSHPFITHPAVAYCQLLSARATRRQQ

SEQ ID NO: 153256 - protein, 36 aa, Heterodera glycines
  Coding regions on vcDNA: vcDNA=SeqID_79679; Strand=-; Position=1 -39,597-668
MSAFQIVQSGEKPIYSFGAAMDDVALKSMFAFVGGD

SEQ ID NO: 153257 - protein, 569 aa, Heterodera glycines
  Coding regions on vcDNA: vcDNA=SeqID_79680; Strand=+; Position=1 -74,698-2276,2363-2419
  Homolog annotation: Hit_ID=NP_510671.1; Match level="QueryCoverage =90%, HitCoverage=50%, E-value=1e-79, Identity=35%"; Hit description =predicted CDS, endonuclease/exonuclease/phosphatase family and RNA -directed DNA polymerase (XR69) [Caenor
MNCSLSVAAVTPTRRGQVKRSEQHNINEKCCAFNSALLNALNECIPIKKLLKKDLAPKYPQHLLASIKEKAKLYRQCKIDPTKKALYDSITLHIKIQTKKIHNLIEHKAISKGKNSIFKYIQKHNVNPFEIPNLVFENKCYHESEEKSELFAILFANSFNNSEVVLNDLSLDNSYGNIQCFISDINFNIIETQTLLRKLPNKNGTSPDNISYKVLKNCHFSLATVITELFRLSLDSGSLPNIWKESIVFPLFKKGDKFNPENYRPISLTCSLCRVMERILSKNIYNFLLKNNKISESQFGFIRNRSTTNQLITVVEDWYEAIINGKKVDCIYIDFQKAFDSVPHNLLLYKLEKIGIRGKLLNWIKAFLMNRTFRVKIGDSLSSIKKVGSGVPQGSVLGPLLFLIYINDLPDVIPSGVNIKLYADDVKIYICYKARTETEIMHKALHNLFEWANKWQIKVSIQKTFVLYLGSKNPKETYKFDGNTINAVDTIRDLGVNIDNKLQFSDHINHITRNAYLRMRSLFRIIKSKSSKIWITLYKTYIRPLLEYAPEPSANSIPKSIRIPATANT

SEQ ID NO: 153258 - protein, 187 aa, Heterodera glycines
  Coding regions on vcDNA: vcDNA=SeqID_79681; Strand=+; Position=1-564
MPSLNKLTFYESEMVLVNVFCAQLLDCPVKSLRDRINHPEDRVNAMNGLMGKKVRTTYKDRNGMHKTFFVGGITERGAAFVPAYGNLRAPYNVNVAAYFYARHRIKLHFPYVPCVIERFSGRGEDRFYTMELLGIVDDENKGRLFGRMFMEIGEEADDDDNDEDVSTSFDSTLRFDMGRDECSQLWR

SEQ ID NO: 153259 - protein, 761 aa, Heterodera glycines
  Coding regions on vcDNA: vcDNA=SeqID_79682; Strand=-; Position=1 -227,272-672,720-1062,1107-1678,1726-1917,1966-2061,2114-2244,2295 -2618
  Homolog annotation: Hit_ID=NP_001004509.1; Match level="QueryCoverage= 99%, HitCoverage=51%, E-value=4e-84, Identity=29%"; Hit description =si:busm1-180o5.3 [Danio rerio] emb|CAD60788.1| novel protein similar to DNA polymerases [Danio rerio]
MPCALAQLVPSYGLDVEDKPFFPHLANRPENYGQHIYPTPDDYLANGMMPEKRRQFDHWFEQHREEPFQLDEALASYCTNDVEILMAALVAFRREFFDVSKRNEYVDGIDDRENHDGIDVLRECMTVAGACMKHFRLNHLPAEHLAIVPEKGYDNTQNQSKLALRFLFWYAEENNVQVQTAYSPDGEKKIANYTVDGWIEAEGCVIEVNGCVWHGCRKCFPSDNMMLPNGKTAGEQRERDAKRLQFLRTQVTRVDVFWECEIQRMLDRSREMRKKFAEYVDGGPLVIRDAFTGGRTGPLKLFHKAGADQKISYFDFTSLYPYINFTTRYPVGHPKVHVLNEDVNWTSPAHNTFPLALIKCWVIPPRKCTIPVLPVKVGERLCFPLCMKCAKDYPTGGVDDEYHCRHNDQQRGWVSTSTSIELNAALEEGYRVTKVFRVLEYEQSDDKLFRPYIAEFMAQKIQASGFDSSIKGDAEKEQQFVRECYEQFGISIDPSKMAVNKGKRSIAKLCLNNLWGRFSLRNFGLSQTLITDDPVAFREHLDNRSVDVTAIDELVLDHILHSYENKKEWVEEHDCSNIVISLWTTSAARLLLLKAMQKVARTPGCVLLYTDTDSLIFVHPKNACPLKTGPHLGQFTDEYPQHEIVEYCSGGAKQYGLKLRRLNAPAAAVLEYVLKVRGMTLNYDVINNQHLRYETFKQQVLDFAATGDYEPIIVTYPNFLRPSIREGGKVTSGPMQKCYRPYVGKGIVKSDFNVLNFGHTL

SEQ ID NO: 153260 - protein, 87 aa, Heterodera glycines
  Coding regions on vcDNA: vcDNA=SeqID_79683; Strand=-; Position=1 -38,85-310
MENQKEAKGTNRRPKGWPFFVKIIRRVAKLMPQPTKSPREKFGIPKFFDPLVQNWPSLWYAQLSEFWPTFSPNGIALVANPIEQRLD

SEQ ID NO: 153261 - protein, 146 aa, Heterodera glycines
  Coding regions on vcDNA: vcDNA=SeqID_79684; Strand=+; Position=1 -125,174-285,540-743
TSDLFLSPPFGFPLFPFISLNDSGDFIETNFGPQFKFDPAKVILNFPRQNYWDANVCDENLQIIGNKSLTVHHKGTTSVKQQQTKLDELIHLEKGTYAFYNYGYLCINGGIKGRNAKYSYGVGDTVGIGVNLATRKIIFTKNGLRL

SEQ ID NO: 153262 - protein, 34 aa, Heterodera glycines
  Coding regions on vcDNA: vcDNA=SeqID_79685; Strand=+; Position=1 -54,131-178
MNEKMDKFQLEIGKLNQNIIENKFKVNENRREIQ

SEQ ID NO: 153263 - protein, 89 aa, Heterodera glycines
  Coding regions on vcDNA: vcDNA=SeqID_79686; Strand=-; Position=1 -161,205-313
MADNFGWKVGKVFKRRNGNKQLAERCVGTDGTKGWHALMIEQKKNGLILESSFGKDLSVEIGPKFFVHGSDFLDINITKGTVLQQIKFN

SEQ ID NO: 153264 - protein, 43 aa, Heterodera glycines
  Coding regions on vcDNA: vcDNA=SeqID_79687; Strand=-; Position=1-131
KKCQTWEKWRSAGILLQILFIFVVFSFFNSFSAFEFGLHIFFN

SEQ ID NO: 153265 - protein, 46 aa, Heterodera glycines
  Coding regions on vcDNA: vcDNA=SeqID_79688; Strand=-; Position=1 -62,111-189
MNLICFSFFFVVLATNAIGEGLAEDKWKKCELNGNGMIRMGKKAKK

SEQ ID NO: 153266 - protein, 20 aa, Heterodera glycines
  Coding regions on vcDNA: vcDNA=SeqID_79689; Strand=+; Position=1-62
IRSAPNFAGILKGRELTYFK

SEQ ID NO: 153267 - protein, 378 aa, Heterodera glycines
  Coding regions on vcDNA: vcDNA=SeqID_79690; Strand=-; Position=1 -122,187-283,750-921,984-1106,1665-1764,2337-2429,2508-2603,2756 -2829,2945-3031,3367-3476
  Homolog annotation: Hit_ID=CAE64902.1; Match level="QueryCoverage =94%, HitCoverage=43%, E-value=3e-84, Identity=34%"; Hit description =Hypothetical protein CBG09719 [Caenorhabditis briggsae]
PLLIYPCLKSVNSPIIIIIIVIITQMCRALILSGSPDSFARYPKWAQTFENELSFEFKTRMPNALLLYTDDGNVQQNFFTISLLDGHIQVEFRLGEQQFEMPERRPVIQIGFVNAARVDDGKWHRFSFFQAWENVRVQLDEEKAFAWENVRVQLDEEKAFRVLSQRTFALGNIRTNSDVFVGGIPKQFQEIEKLSSPLRRHSQHFAGAIRSLVYRLFPQGVSNPQLMDSMGTRKTDKDYCQPTFTSLASSVYCQNDGYCQNDGRCYSANNGARCDCTDSDYEGRRCETKKPSTEVSFFGNEWLGYDLRKEPSTAAVWSLRQMFNITFRTNYSNALLLLAGDGRHVELFVEKGVILARSQLAGSEKRMIRVQDRALRRV

SEQ ID NO: 153268 - protein, 487 aa, Heterodera glycines
  Coding regions on vcDNA: vcDNA=SeqID_79691; Strand=-; Position=1 -15,73-1519
CGLSVMAEKQEAKRKNDQERYRRRTEQSVSPGRSPVPDGSADGNGEASASLRGTTTPSLSALQISTPASSIGSKKRGRPLKAGAKPILATQETVSSIDTPRTAVTQSDQGSPCKKRGKVTECDKPTFANEAIASTPVSTQSRGGRPVKQLGGHAGKGRGKTNESMTKSSEMDQSVENALSPAPSHIVSKKIDFSTVPINFATSRNFACKIWRWAAIGLYERDGETALGPRSGPRFIETCWNRPNEWLNDSFIVAYLAYIASISQRKTVVVDSLASRTDISRFSNVKNYTFGYDPNAVPEVVLMPLHFPNHWTLIVYDVAHGAYFLDSLHMSSLSDERMALIQSIIAEIVPGNASFAVEYVQQLTKQNDGNSCGYFVCLYAESWLMNNRTFVLPDLNINYEKKRILWHINELYGSDNVPYHPREGVPTPCPIVYRHTDEAQSTSKAAELMEVDEHDDIMIIEPQTSGQAVDAILTQAQVAGENQADML

SEQ ID NO: 153269 - protein, 129 aa, Heterodera glycines
  Coding regions on vcDNA: vcDNA=SeqID_79692; Strand=+; Position=1 -129,723-875,942-1047
  Homolog annotation: Hit_ID=CAE57242.1; Match level="QueryCoverage =91%, HitCoverage=8%, E-value=2e-26, Identity=43%"; Hit description =Hypothetical protein CBG00120 [Caenorhabditis briggsae]
MLFQEEAAAKQTKGEKGGKKKGKGGSFQTISMIYRDSLNNLMTPDFVQRYALLAAAEAAKDGKTNPKTASTNMLARLVKQGDLGPDQFKIGHTKVFFRAGVVAHIEDLRDARLSQLVTAFRRCADGIVP

SEQ ID NO: 153270 - protein, 42 aa, Heterodera glycines
  Coding regions on vcDNA: vcDNA=SeqID_79693; Strand=-; Position=1 -81,220-267
MTNDHLHRVPKMNSFIKKVPCVAKKFFPNWMTLTRSFSKRKR

SEQ ID NO: 153271 - protein, 434 aa, Heterodera glycines
  Coding regions on vcDNA: vcDNA=SeqID_79694; Strand=+; Position=1-1305
  Homolog annotation: Hit_ID=XP_479365.1; Match level="QueryCoverage =48%, HitCoverage=14%, E-value=2e-13, Identity=27%"; Hit description =helicase-like protein [Oryza sativa (japonica cultivar-group)] dbj|BAD32013.1| helicase-like protein [Ory
MALIQSIIAEIVPGNASFAVEYVQKLTKQNDGNSCGYFVCLYAESWLMNNRTFVLPDLNINYEKKRILWHINELYGSDIVPFHPREGVSTSFAVVSHHNGDVAQTSSKVIMPMEVDDSPVLPSSEDTAVLAQAPVIGENQADTHGVVADTIVQQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSTICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQTPEELRLCRMTL

SEQ ID NO: 153272 - protein, 56 aa, Heterodera glycines
  Coding regions on vcDNA: vcDNA=SeqID_79695; Strand=-; Position=1 -325,368-491,548-591
MRNEGRTTLRMKNLSKRGGRRKTDAFVTCEKLDYFSRIAFPAIYTLFNVVYWTYYM

SEQ ID NO: 153273 - protein, 33 aa, Heterodera glycines
  Coding regions on vcDNA: vcDNA=SeqID_79696; Strand=-; Position=1 -84,481-498
MSDQSAQCYEKKKQISAPKNLLDVEESERKFLT

SEQ ID NO: 153274 - protein, 51 aa, Heterodera glycines
  Coding regions on vcDNA: vcDNA=SeqID_79697; Strand=+; Position=1-155
LQICWLKLHMKYISKFFDSVRRFDKDGFRFAISRSTFGNWSRIFSAITCNH

SEQ ID NO: 153275 - protein, 222 aa, Heterodera glycines
  Coding regions on vcDNA: vcDNA=SeqID_79698; Strand=-; Position=1-671
PPTVPGQSDERRCTPSARCPSAPFLFRRIPSPFFGGSAAFISHGISNTSTTTSTAPPPFTTATTTTAAGGIDRNVSEAKSRGRGAATAAPITTKPSWANAATNQPTASGTNGHRWKQHNRKPTATGRLALLSVRMSFSFAQQSTPAPLSVSSVSSAALSPHLMVPFSCPSTSSPVDPSTPLQFISHHPQHQGVPPPPPYQMHPMAMSEAPVGPSKFSCSSRL

SEQ ID NO: 153276 - protein, 75 aa, Heterodera glycines
  Coding regions on vcDNA: vcDNA=SeqID_79699; Strand=+; Position=1 -177,471-521
MRCSDRSIWVLSVLLGVLVLGSQTAPIFLLNWVLIREPRPLNITRLGGPVAGVDDQGPLVRLELHLHRGRRNRRI

SEQ ID NO: 153277 - protein, 117 aa, Heterodera glycines
  Coding regions on vcDNA: vcDNA=SeqID_79700; Strand=+; Position=1 -262,573-662
LVDKDEQKARAAVQRELALLRRAVAQLNEGRRIKDIGDLRERMLDAQRPLPWRAMADAREVHEFRSVQQNFYSDRKEELLREMYQLQGKMGMFLLGRDRAFRSYYYMNTAFIILCPR

SEQ ID NO: 153278 - protein, 49 aa, Heterodera glycines
  Coding regions on vcDNA: vcDNA=SeqID_79701; Strand=-; Position=1 -36,91-204
MPFRAITSTKGEVCLFPETMSSRLCKKIGLTFGEKLSMSETSETNRVRH

SEQ ID NO: 153279 - protein, 49 aa, Heterodera glycines
  Coding regions on vcDNA: vcDNA=SeqID_79702; Strand=-; Position=1 -34,356-471
MGVWVRKEKGIAAPIGTAGPCRPLTNVTKSFLENSATKTAIKSKKFKKF

SEQ ID NO: 153280 - protein, 46 aa, Heterodera glycines
  Coding regions on vcDNA: vcDNA=SeqID_79703; Strand=-; Position=1-196
FPGGAYRHRLLPLPKKFFGKSAPQKSFLLIFKIWNRILQKKMIFAL

SEQ ID NO: 153281 - protein, 21 aa, Heterodera glycines
  Coding regions on vcDNA: vcDNA=SeqID_79704; Strand=+; Position=1 -60,649-654
MPMCQHFVPTKLAQFGEKVWF

SEQ ID NO: 153282 - protein, 71 aa, Heterodera glycines
  Coding regions on vcDNA: vcDNA=SeqID_79705; Strand=+; Position=1 -90,793-918
MLCDCMIQGVSYVGEFSYFSVDPIERPKKKPNLSGFYKEEIKTAAMRELCNLLHISSMEPMMEKLKKVRAF

SEQ ID NO: 153283 - protein, 136 aa, Heterodera glycines
  Coding regions on vcDNA: vcDNA=SeqID_79706; Strand=-; Position=1 -82,124-261,313-387,642-713,772-813
FLFSVAISFRRRLFRIYAFILPSESDQFGSSHPVLECDLNKTCGAKCCSQPLIFPGLISFESSTFSYFGITQQAPSYIWVTSSPDDESEKDQICATTLMQGRTLLHLIMHDKSIAESEDNNKNFCFSHDECCTYRR

SEQ ID NO: 153284 - protein, 158 aa, Heterodera glycines
  Coding regions on vcDNA: vcDNA=SeqID_79707; Strand=-; Position=1 -400,459-534
SLDNFQIAKSREISENQTEREFTTPQVTNGSTGEEKKRNERRKEADKAPDQRSKKGHDEEANANEVHSTTGAQPPTFTRRHDEEANANEGHSAAGAQTLPFTVSARLPIFTARTFTYEVDVAPAVAERFESAQVVDIYNSLPPPMDPRMKRENANGIS

SEQ ID NO: 153285 - protein, 94 aa, Heterodera glycines
  Coding regions on vcDNA: vcDNA=SeqID_79708; Strand=+; Position=1 -122,1186-1348
MFSVWGTGPQKRHKKVPPLREGFSDPGRSGERPEIGEAWPRGTSSTSNICWVFFCGYGYPTFADLTFADPTFADPTFAEPDICGLDTCGPDNCG

SEQ ID NO: 153286 - protein, 590 aa, Heterodera glycines
  misc_feature (149)..(149): Xaa can be any naturally occurring amino acid
  Coding regions on vcDNA: vcDNA=SeqID_79709; Strand=-; Position=1 -34,374-483,1401-2941,5414-5532
  Homolog annotation: Hit_ID=NP_508324.1; Match level="QueryCoverage =99%, HitCoverage=23%, E-value=1e-110, Identity=38%"; Hit description= predicted CDS, peptidase family A16 and RNA-directed DNA polymerase and Integrase, catalytic domain and
VEVPSVYFQNSRFVGDKDFVMMTIKNKFPRTIILEALKAEKDSAIEWNPEKLWNLEMIGIKDNPIEKDDEVALKMFKESVYRDGRYVVSWPWKSPIDELPTNFGLAYRRMIGIIEKLKKSKEFLKQYDEIFKEQLKEDIVEETEKRSQXTLLTLPHHCVVEEKKTRVVYDASAKIKGKKSLNDMLFRGPIYMPELPGLLMRSRLPRIALWGDIQRAFWTLELQENDRNYAKFLWEPISKDNLCVFRFKRVPFGVISSPFLLGATVRHHLENEPSDLAKEVKNNTFVDNVFVGCNNFEEAIEKYKNLKELFKKARMNIREFISNSEKVNKEIPKNDRLIKNPKVLGVNWEINTDKYIIKFPKIIDNENLSRRKVLKELNSVFDPCGWLAPCLLPAKLFFQSLWEEDRKWDDQISEEKQSEWKLITKSLKNMVIKCNRRIVPEKEKADLHVFVDASKDAYAACVYLKSNHIQTKLICSRSRLKPRKVQITIPRMELLGVLLGTRAIKYVEKELKIEIKEKILWCDSKPVLFWIKSKDDQPRFVENRLREIRELNPQMSDSVPTEENPADVGSRGCTPEELLSHPLWWEGPIF

SEQ ID NO: 153287 - protein, 127 aa, Heterodera glycines
  Coding regions on vcDNA: vcDNA=SeqID_79710; Strand=-; Position=1 -111,420-692
MCHRRATIRKLDRPVQEGRTGNGHHLFFLRASSRVLYAFLSATTPSGSYNIYFYLEEQTIEPFELVNEQTGEKLALQQVAHQTYNWLLKRRPEIFVGEAVPVQWEYEIVNRLNTVQIQLPNDEECLG

SEQ ID NO: 153288 - protein, 30 aa, Heterodera glycines; identical to SEQ ID NO: 126607
  Coding regions on vcDNA: vcDNA=SeqID_79711; Strand=-; Position=1-90

SEQ ID NO: 153289 - protein, 106 aa, Heterodera glycines
  Coding regions on vcDNA: vcDNA=SeqID_79712; Strand=+; Position=1 -51,111-380
  Homolog annotation: Hit_ID=NP_501090.1; Match level="QueryCoverage =91%, HitCoverage=11%, E-value=3e-11, Identity=36%"; Hit description =putative protein, with a coiled coil domain, of eukaryotic origin (81.0 kD) (4H798) [Caenorhabditis elega
MLMAMEKVHLVITTDGKEFVTRRHLVTECANECLASGGRIALTELAAQLSVDLDHIQTAVNQLLAMNRHYRMTEDENTVEDISTPAEFVVCAGELIHRSFFEHNFL

SEQ ID NO: 153290 - protein, 214 aa, Heterodera glycines
  Coding regions on vcDNA: vcDNA=SeqID_79713; Strand=+; Position=1 -140,464-968
MTTTTTTTTTTTSSTPTTPKGTTTENWSESLAAAVGGKTTLVLIIVGALIAIIVLLVVVVCCCCCKKRKRRRRHTSADDDNDKEDNKKRKRRHHTSADDKKEEDHYHIDQHNKKEGEQHGKEDNKSPIQSELKVSTISAVPSDYNTNKRLGATELDVEAEEVPKTKPVPKKSKSEGGTKRKLSNFFWSTGTTEKRPSAAEHGVEVPETIRDDED

SEQ ID NO: 153291 - protein, 142 aa, Heterodera glycines
  Coding regions on vcDNA: vcDNA=SeqID_79714; Strand=-; Position=1 -312,1179-1295
MARHIWPLLRNGLRTLVSLKRKQLALMRKHVSPTVLFDCPNLVEIITPILPERPTVDNTKYAADTSARDLYMWLHMPRPDGRPLVFKLTKWSKGWDQFVNDLCSTVAWLRRTEKDFQTADQQQQQQQQQMSPKHNGQSDGII

SEQ ID NO: 153292 - protein, 323 aa, Heterodera glycines
  Coding regions on vcDNA: vcDNA=SeqID_79715; Strand=-; Position=1-972
MARAARSNVTRSTDGVSPSSGQQPKHLLNDDERLIHYQQEFKRFKKLLEDEQERPAPVRLTQLPTDEASKGLLRDALSEAARTIQQQQQPQPKQPAPHQQQQQSSHSDSSTMRQPPRRRQRPAKRSPRTTSVSTDGAEASRFPSSSSAASLLTRTDNGGRGGAETTEREDSSNDDRPQNMAAVGPARKGQREEADVQLHPSTSTAAAAVLRDTEQRKRQAIDYALRNAGTLGIGDGQQVYRLMQGAYRPIKNSDLDALLTFHFAEPKPEKAPPGYKTFIGNARKDPRMVRMLFGNSGAESGKKKKKMGGGGCLLHRCYTFACI

SEQ ID NO: 153293 - protein, 161 aa, Heterodera glycines
  Coding regions on vcDNA: vcDNA=SeqID_79716; Strand=+; Position=1-483
MSKLGSDGNDEHGGVNLGGGDGGDDGQALPTEDDGLGGAHLPPLLFIDEEEEEESPESRAGDDVNRVGNGQIYTEKVKQEGEEESDDGNADMDSVSHDTYRSSSSSSTMSSSLFLLHDCHMRHHYHHDNNNCNSPPRKQAATELLKLPLIDYLCGLNNGCS

SEQ ID NO: 153294 - protein, 139 aa, Heterodera glycines
  Coding regions on vcDNA: vcDNA=SeqID_79717; Strand=-; Position=1-417
  Homolog annotation: Hit_ID=CAE56395.1; Match level="QueryCoverage =92%, HitCoverage=16%, E-value=8e-16, Identity=39%"; Hit description =Hypothetical protein CBG24082 [Caenorhabditis briggsae]
MRPNDVNFSNAQKVWKRLYGHPALQKRTPRFRNDQFVRMSREKGQFEKGYLPNYGDEILEIDEVLKAVRPILYKLRDEHGEKFKGSFYDQELARVRKDAETSYRIEKVYRKRKLSYGSTEMLVKFIGYPNREWINESQL

SEQ ID NO: 153295 - protein, 84 aa, Heterodera glycines
  Coding regions on vcDNA: vcDNA=SeqID_79718; Strand=-; Position=1 -62,197-389
MEEANEKKHVPEEYKHLLKFTYPDSVKKPEEYLGGGFVAMEMDAKNKKAKVNFYAAGHIHPTEQKFVEKEKFVEGSKFKYNVEL

SEQ ID NO: 153296 - protein, 86 aa, Heterodera glycines
  Coding regions on vcDNA: vcDNA=SeqID_79719; Strand=-; Position=1 -47,642-855
MAQNRKICHFFVARGRTFPAPYYTVHYNFGINLEKSVRFVMVDTVILCGRNRKMFKDEKTFTEEIKEKSEKHFEWLENELKLANEK

SEQ ID NO: 153297 - protein, 70 aa, Heterodera glycines
  Coding regions on vcDNA: vcDNA=SeqID_79720; Strand=-; Position=1 -51,936-1006,1431-1518
MRELQTRINATIVEVQKERFGSDAGGLILDYHCAEMFPKRCASYDESVVHELENSTAEQLEANVRTITNL

SEQ ID NO: 153298 - protein, 104 aa, Heterodera glycines
  misc_feature (7)..(7): Xaa can be any naturally occurring amino acid
  Coding regions on vcDNA: vcDNA=SeqID_79721; Strand=+; Position=1 -25,1210-1505
  Homolog annotation: Hit_ID=NP_949714.1; Match level="QueryCoverage =79%, HitCoverage=45%, E-value=2e-27, Identity=62%"; Hit description =maltose O-acetyltransferase [Rhodopseudomonas palustris CGA009] emb|CAE29819.1| maltose O-acetyltransfera
RKNFKSXTGRNIFLGDDVFLNYNCCVLDVCRVDIGDKSMVGPYAADHPRDRAVRDQGWEYGRPVRIGRGVWVGGGAVILPGVTVGDGAIIGWCVNKLAKKAMTD

SEQ ID NO: 153299 - protein, 34 aa, Heterodera glycines
  Coding regions on vcDNA: vcDNA=SeqID_79722; Strand=+; Position=1-103
EIGKQIHVGSAHRMALSAWPNDYWRRWTNLDLIS

SEQ ID NO: 153300 - protein, 82 aa, Heterodera glycines
  Coding regions on vcDNA: vcDNA=SeqID_79723; Strand=+; Position=1 -134,211-297
  Homolog annotation: Hit_ID=NP_505492.1; Match level="QueryCoverage =97%, HitCoverage=14%, E-value=3e-28, Identity=72%"; Hit description =putative nuclear protein (55.4 kD) (5K149) [Caenorhabditis elegans] emb|CAA94805.1| Hypothetical protein
RYRGDCLNQAICKCSCEADPSKPAKNVCTKSNCDCLRIKESCSKLCACKQICKLCACKQICKNKEPPKRAAKVNKPAQGCAF

SEQ ID NO: 153301 - protein, 219 aa, Heterodera glycines
  misc_feature (202)..(202): Xaa can be any naturally occurring amino acid
  Coding regions on vcDNA: vcDNA=SeqID_79724; Strand=+; Position=1 -96,296-425,948-1050,1429-1513,1957-2050,2460-2610
  Homolog annotation: Hit_ID=CAE72223.1; Match level="QueryCoverage =89%, HitCoverage=39%, E-value=1e-100, Identity=85%"; Hit description= Hypothetical protein CBG19334 [Caenorhabditis briggsae]
CKCGGDCANGASKFHVPKHVQNCFLEHKHESSGLIVTLIGDGYIYRGDFFHDSKNEPHVEEQLVAAIYDLISKYKVDLYEIVIFVSKSPCFHQDCEPKCEVVDECKCNKACAKLLGLLLSKVRKELSKVDVRMTVKFLYPHLNRGDLYTKQGILSMLQSGIKVEPLLLKDWSAVMDWAPHPEHKGEYLQVVYNYHLFLYLLXLHSFIIIQIGVFKNSIK

SEQ ID NO: 153302 - protein, 182 aa, Heterodera glycines
  Coding regions on vcDNA: vcDNA=SeqID_79725; Strand=-; Position=1 -37,767-1278
MSEKARQISKDLDEMDLDELRRQQFAIRSFTESVDDEETEWPLPPTNLMMRRGEEVQLGRDGREEEEEEEEEEEKEENAWRRRRRPSPAHSDECGTMRESSTADTIVEVVGEHRQAQNSRTRSYSAQSQLGQHLKMGPPNGPVNGRNAKICDESAGPRVGGPRIRTAQKFNGQFGGGRNWGG

SEQ ID NO: 153303 - protein, 260 aa, Heterodera glycines
  Coding regions on vcDNA: vcDNA=SeqID_79726; Strand=-; Position=1 -201,259-475,719-1083
  Homolog annotation: Hit_ID=XP_223980.2; Match level="QueryCoverage =70%, HitCoverage=12%, E-value=1e-13, Identity=34%"; Hit description =similar to RPGR-interacting protein [Rattus norvegicus]
MTSEGGAIVELYAGAERMESGDQVWRELKKKAPKTAELLEDAWAQIKKRWAKFNGMLNDEAKQYMEKVKYSGWHWFVRQVVGPFVRLPNDAKTNLTLSLFDAYPLMNTVMSKLMANRTFLDWAGEWYKNAEQQIQTMEKEKNATKEELNEDGIMAQMKEMFKQMNLGNLNDLMGGMGEEEEEEMREGEEQLEEEEEEEKEEEDEKAAEKEGEGEEEKEEGEGQCSKSNESNEEGGQCMAKEGEENAEKSETKMKEDRDEL

SEQ ID NO: 153304 - protein, 152 aa, Heterodera glycines
  Coding regions on vcDNA: vcDNA=SeqID_79727; Strand=+; Position=1-548
INGYASNKLSVRFVFASLGRRTNGPTTWRTNQCQPLYFTYLCINEYLTQINVLFPRFTFSMYCFASSFSIPLNFAHRFLICAHASSSSSAVLGAFFFSSRQTWSPLSMRSAPAYNSTMAPPSLVIALISLSNKSLGNRAGKDVSPKPVKTFV

SEQ ID NO: 153305 - protein, 155 aa, Heterodera glycines
  Coding regions on vcDNA: vcDNA=SeqID_79728; Strand=-; Position=1 -196,398-669
MEFVPFLLFIFLFLLAIPPIRCDEIPLDGPDPEVDEHIRKQFQSHADAFSAGIKDGWAEEIQKQMALLPKDLLLKLIKAMTSEGGAIAELYAGAERMESGDQVWRELKKKAPKTAELLEDAWAQIKKRWAKFNGMLNDEAKQYMEKVKRGNRTFI

SEQ ID NO: 153306 - protein, 170 aa, Heterodera glycines
  Coding regions on vcDNA: vcDNA=SeqID_79729; Strand=+; Position=1-783
QRIRVEQTQRQIRFRVVGKAYKWAHNLANKPMPTAVFHLFIYLTQINVLFPRFTFSMYCFASSFSIPLNFAHRFLICAHASSSSSAVLGAFFFSSRQTWSPLSMRSAPAYNSAMAPPSLVIALISLSNKSLGNRAGKNCFAKTRKDNSFNTSKMFREPISDKLCHIFGLN

SEQ ID NO: 153307 - protein, 222 aa, Heterodera glycines
  Coding regions on vcDNA: vcDNA=SeqID_79730; Strand=-; Position=1 -45,93-142,586-678,727-865,1221-1445,1586-1626
  Homolog annotation: Hit_ID=CAE66068.1; Match level="QueryCoverage =99%, HitCoverage=55%, E-value=1e-48, Identity=46%"; Hit description =Hypothetical protein CBG11282 [Caenorhabditis briggsae]
FIWAGCSDNIRFGNQFTRKFIDTFTRKFIDTAEKKRSDARSSLMNLHNNRVGRRLLATNMRKKCKCHGVSGSCVTKTCWKTVPTMEEFSCVTKTCWKTVPTMEEFAALLKQKYTNAKQVNKEKGLGMMKLPWGGCSLYAENGQKTISGKRQRMAIYHYSFLALLCRFSFDSFSQIECQQLCCGRGWETRHEIRQEPCRCKFVWCCDVKCDICRREVERRFCR

SEQ ID NO: 153308 - protein, 42 aa, Heterodera glycines
  Coding regions on vcDNA: vcDNA=SeqID_79731; Strand=-; Position=1-127
MAAQLASALSSPDYYNCQMQPGLTRRQRDICVRHPSAMRSIS

SEQ ID NO: 153309 - protein, 106 aa, Heterodera glycines
  Coding regions on vcDNA: vcDNA=SeqID_79732; Strand=-; Position=1 -224,315-408
MSFRDISPISSPLSNWSPLPLTFMFSVWAICCSLSVTSQLFDTGTFRYMPKHSFGSLYDGGRPHLPRSASTFFASHFDDRTANGLMDAMPDYLRTTGGATAPHLSG

SEQ ID NO: 153310 - protein, 37 aa, Heterodera glycines
  Coding regions on vcDNA: vcDNA=SeqID_79733; Strand=+; Position=1 -100,353-366
MPNASDLRILGNLNEVLTLMNGYTLASLRISSICDLI

SEQ ID NO: 153311 - protein, 46 aa, Heterodera glycines
  Coding regions on vcDNA: vcDNA=SeqID_79734; Strand=+; Position=1-138
MQRAMSNLAVAVATAAEPSLKARHLEAVRMFFDRIADESGCQPEQK

SEQ ID NO: 153312 - protein, 98 aa, Heterodera glycines
  Coding regions on vcDNA: vcDNA=SeqID_79735; Strand=+; Position=1 -96,350-551
DPISEVQLAALRVLMALTRHQWAYAHFCAITDFVNLLVDRSVNFDADAMQLKYALICRLVEAAPSALNDGQMEMLRDYCTKGPFWGAPVVEVATEEAA

SEQ ID NO: 153313 - protein, 74 aa, Heterodera glycines
  Coding regions on vcDNA: vcDNA=SeqID_79736; Strand=-; Position=1 -45,494-673
MRPPKRAPLKKKDSTYEFDPELCTARSDEELVETVRRLERQPKFGRSVFSSVAPDPGQKNKALQAQWREFNKVG

SEQ ID NO: 153314 - protein, 175 aa, Heterodera glycines
  misc_feature (8)..(8): Xaa can be any naturally occurring amino acid
  Coding regions on vcDNA: vcDNA=SeqID_79737; Strand=+; Position=1 -125,175-341,557-742
  Homolog annotation: Hit_ID=NP_504476.1; Match level="QueryCoverage =95%, HitCoverage=52%, E-value=1e-45, Identity=56%"; Hit description =type V secretory pathway protein (31.7 kD) (5G75) [Caenorhabditis elegans] gb|AAP57298.1| cell death-rela
QKLFFSFXGILKLLITGASESITDEAAMSKEPGFLYYTAGVHPHDAKDFDDGRTLDFLVHPHDAKDFDDGRTLDFLRSHLTTNSQCVAVGECGLDFNRNFSPRDQQLRVFEAQVQLACELGKPLFVHEREAHQEMVAILSRHSKSLPPTVIHCFTGTEMEAKQYMDMGLYIGLTG

SEQ ID NO: 153315 - protein, 105 aa, Heterodera glycines
  Coding regions on vcDNA: vcDNA=SeqID_79738; Strand=+; Position=1-318
  Homolog annotation: Hit_ID=CAE62639.1; Match level="QueryCoverage =55%, HitCoverage=31%, E-value=6e-11, Identity=43%"; Hit description =Hypothetical protein CBG06772 [Caenorhabditis briggsae]
MPKIIKVTKDFPVCQRKEFRTEPENSLDEIDYHQQNLTSFAPLRIAIKISDLYEANYRPTCPNGGQALQMQTRGVPMTLIGKKCADNFCPTGTKCVEKEVYAHCC

SEQ ID NO: 153316 - protein, 47 aa, Heterodera glycines
  Coding regions on vcDNA: vcDNA=SeqID_79739; Strand=+; Position=1-142
WTSPVVRGCACRQRISRVTQSFAPGLATHRLPRHVRPAIGAQCWRTW

SEQ ID NO: 153317 - protein, 63 aa, Heterodera glycines
  Coding regions on vcDNA: vcDNA=SeqID_79740; Strand=-; Position=1 -147,654-698
MKKYILFLKRALLKERISGAKDGMGKYGMKAFSDDGALVGFEMLELENMKFCDSEIQSFYRYL

SEQ ID NO: 153318 - protein, 92 aa, Heterodera glycines
  Coding regions on vcDNA: vcDNA=SeqID_79741; Strand=+; Position=1-276
MLRFRPKEFDHRHSSSRSVGLSTRPQHFGHPRKELIKQQNVREYHIDQLLLDQQHAVADHQPQQQPLAVMEQGESSAIKEIVAVGEDGAGKK

SEQ ID NO: 153319 - protein, 203 aa, Heterodera glycines
  misc_feature (25)..(25): Xaa can be any naturally occurring amino acid
  misc_feature (32)..(32): Xaa can be any naturally occurring amino acid
  Coding regions on vcDNA: vcDNA=SeqID_79742; Strand=-; Position=1 -287,369-560,609-682
  Homolog annotation: Hit_ID=AAN32886.1; Match level="QueryCoverage =85%, HitCoverage=97%, E-value=1e-64, Identity=73%"; Hit description =gland-specific protein G2D01 [Heterodera glycines]
APSSPTATISLIAAITANGCCCGWXSATACCXSSQLINVIFSHILLFDQFLSDAQNVADALKGQLIGCSNGGDRTLLAEIEASLATHSADEECALSLGFVRAMFAIAASASSHASNNSEWQTLSGQFGQKVTEIDSKCAEFGISIGQVPINGPKGVHVQNVPNSESVISMPGLAGSPKGVHVQNVPNSESVISMPGLAGSHTQ

SEQ ID NO: 153320 - protein, 159 aa, Heterodera glycines
  Coding regions on vcDNA: vcDNA=SeqID_79743; Strand=-; Position=1 -126,355-411,592-747,879-978,1227-1267
MVTQIFHIRSQHLEQLDGVKEGDQKEQELSEFMRSICNFLSTVFRSLNIIVIRLCEFTNPNVDILTVLHPIHEYYSRFYVADGQTNQISDTVKDTSKLLCIFLQRLVINQKYAGCAYTILIAAFLNGFCFLLDAQLSVSVSRKFPIGCRGLVQLHGHPS

SEQ ID NO: 153321 - protein, 294 aa, Heterodera glycines
  Coding regions on vcDNA: vcDNA=SeqID_79744; Strand=-; Position=1 -381,424-924
  Homolog annotation: Hit_ID=NP_001004509.1; Match level="QueryCoverage= 100%, HitCoverage=20%, E-value=9e-37, Identity=33%"; Hit description =si:busm1-180o5.3 [Danio rerio] emb|CAD60788.1| novel protein similar to DNA polymerases [Danio rerio]
MNIFKAMFLLTEQLSIVPEKGYERCDRASVMAIKYLEWRSKRDGIEIRHAGNGREVKIGNYKLDGFITNVGGRDKCIEVMGCYIHGCMNCYDPAAELIGGRSAQELNDETQERLTELRKTLDVEEVWGCQIEKELKKDEEMRDFFDDRGNEKGPIDPRMAYAGGRTGPMKLYAKSDEKKKISVYDIVSLYPSVNYGTAYPIGLPQIIIPKSDEIDVNWTRPEDLKYKGLYKVRVNPPKGLRIPVLQLKCDERLLFPLCWRCASKFKKETTRCNYKCPHDEAQRRHVATYTSVEL

SEQ ID NO: 153322 - protein, 452 aa, Heterodera glycines
  Coding regions on vcDNA: vcDNA=SeqID_79745; Strand=-; Position=1 -117,164-724,771-1035,1075-1393,1437-1533
  Homolog annotation: Hit_ID=NP_507780.1; Match level="QueryCoverage =80%, HitCoverage=28%, E-value=3e-34, Identity=28%"; Hit description =predicted CDS, DNA polymerase type B, organellar and viral family member (5T899) [Caenorhabditis elegans]
MNNIMRQRDAAIELLHNCGIDINEYSYGVEQLPNVQKYWDEIYPGKYRVVAFEKSADPRKSICVLWKAPMGREKVVPIFLENGHWDGLKNYVCFFNRGRKFCIDCECFFDKDVKHTFECRARCYYCNRVGGMPCEKESGVKIECPKCHRYFYNWECYNYHQGHQTCKLWKRCVICDKTYLFNTKKGHECGETYCQLCSVSHDPKRGCYIMPIEEKEEKDVYRIVVWDSETSQDSIYKGDQKEHVINYISVRVTCTECCDDKNRTNCKICGEERIKDWSEVEEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPYYYNKKENYGIRLEHLPPMEDYSPGSMNKDKFIKFEKWYNENKETPFYLDDELKKLLPKRHGDFIAVNY

SEQ ID NO: 153323 - protein, 249 aa, Heterodera glycines
  Coding regions on vcDNA: vcDNA=SeqID_79746; Strand=+; Position=1 -140,599-927,1185-1465
MGENRSSSISSINSNLIDPINSNLSDLSDYDDQPMLIPNEWAINMLMDNSPFVNPSQSLKQNQFSSNNENFPSSSSSLSLPSSSEAPNILYENANENKNELGFLNANWPVVQQKTADKNNDYEIQKEKRQKLEELQMGNGALDEQQIEAQRGLKLLLHNIWYIIMLSFAILQIQLAPIETTMLQVQQGAKFNFYYLNLALEKMNADKILENIGTELVQDKMIQNNKLFMDIIGEINVHAKKVFGQQLYE

SEQ ID NO: 153324 - protein, 163 aa, Heterodera glycines
  Coding regions on vcDNA: vcDNA=SeqID_79747; Strand=+; Position=1 -131,381-741
MSKQSLADLLNETTKNDLACLLLSHKESLNLEQIVKNISISKNDFGASVFFHNILIHIHQKHINQYKEPIYKIITFAHLYRLIFEYFDGIFNKINGPIIQQYIGLDYKIMKEFFEKSTKQLNGLIARGKSDKPFLFALKESEEAFISDYLLENCTHLIDEQNN

SEQ ID NO: 153325 - protein, 110 aa, Heterodera glycines
  Coding regions on vcDNA: vcDNA=SeqID_79748; Strand=+; Position=1 -210,467-589
MFSQIFVFILFLAMCKCQNVRVNNGNARVAQSQQMLGGNGQKFFVIQRDTNALDGSASQVQSSGMGGNLAQNMMQPQQQQFSQNFATPPQAQQTQQAVRTILCLIASSIV

SEQ ID NO: 153326 - protein, 84 aa, Heterodera glycines
  Coding regions on vcDNA: vcDNA=SeqID_79749; Strand=+; Position=1 -133,892-1013
MTTINHNQTVFDATYTDVAKRISDGGADGNTNHEHSDEAYRKAAPGPFTFQVHLWRNGNITFVYKQVLPGPTDLCIVNAAIFRF

SEQ ID NO: 153327 - protein, 36 aa, Heterodera glycines
  Coding regions on vcDNA: vcDNA=SeqID_79750; Strand=-; Position=1 -23,1309-1396
MPIPTAHRTYLILRKLITLLQDGPQAKVAIYMQYIC

SEQ ID NO: 153328 - protein, 94 aa, Heterodera glycines
  Coding regions on vcDNA: vcDNA=SeqID_79751; Strand=+; Position=1-285
MAVRKIKNDNARNRNVYTMAVRKIKNDNARNRNVYTMAVRKIKNDNARKRNVHTMAVSKSKNDNAGQCIVYTMAVRKIKRQHWAAYRPTPIPLW

SEQ ID NO: 153329 - protein, 548 aa, Heterodera glycines
  Coding regions on vcDNA: vcDNA=SeqID_79752; Strand=-; Position=1 -180,229-658,708-928,971-1373,1421-1563,1614-1796,1843-1929
  Homolog annotation: Hit_ID=AAV44035.1; Match level="QueryCoverage =43%, HitCoverage=14%, E-value=1e-29, Identity=35%"; Hit description =putative helicase [Oryza sativa (japonica cultivar-group)]
MESRVKLPPMMVQPSRCALIEEIFPAELLNNPLASWQQLSERAILCPLNRDTLQLNETIMDRLTTVERVYHAVTLPVVDKTGEADLENIAADANHENLCRMTPPGVPEHILRVRVGAVMMVTRNISLEEGLCNGTRVQVMELFDNIIRCRILTGTHVGNEHDLHAARFVFGGDPKAPHEGPIKCERIQYPLRPGSVMTINKSQGQTLARVGVLLDTSQCFAHGQLYVALSRVRDSDNIRVCTTRSDLRVKNVVIRELLDEEEEEMALAALPDDPSDPFPRHPPADSEPDDDKPIGMPNEAVFKTPTPSTRAQHPKTTPIELDNTVSKQHLDKLTVVKGDITKQQIWMIVNAANSDLVKGGGVDDAIHRACSPRQKELKQLLNIKILSNGGPIADGGVVDTPAFGDLANNVQYILHAVGPKVSAALNEHHRRSLAKCYTNALDHLASMHMDIANPQPRSIAFPSISTGAFNFPRVDAAHIAIRAILNWLADQPADAPAIDEVRLVAFSDDDFKLYKEIRERVKRQMNAGKRPTPKTSLQTPLRIPMVCI

SEQ ID NO: 153330 - protein, 482 aa, Heterodera glycines
  Coding regions on vcDNA: vcDNA=SeqID_79753; Strand=-; Position=1 -351,399-875,923-1201,1250-1591
  Homolog annotation: Hit_ID=NP_914485.1; Match level="QueryCoverage =93%, HitCoverage=26%, E-value=6e-26, Identity=26%"; Hit description =P0489A01.23 [Oryza sativa (japonica cultivar-group)]
MLWDCSFKVDELDVHGPSGHRIAVEQGFKDEEENLNAICEAAQAEEERRQRGEERVTQLTAYFAYNEANPPIGLSYANCYKKLRYDRAKKQWKLNVDAPVPKFCRLKTVSPSNRELLAIRLLLLVVLDPKGWESLRTVNGNVFPTFVEAAGARGLLTDEDLWMKTIDDAFRMKKSIRQRIRWLAVFFATANLASPCTILDKVLVTADKWLVHTSVERASAEEQKQYVLNAMEWFLLANGITPDSEPREDGTYESACEHIGLPRPQGLVLSKDIFMKLAFFRDDALNEHLHVDFLPDGQRRGAMRQDYLQKYISGPKPNEEQQQLIDAVQTALEHVQQVIDGQCPDFSPDIQRLFMVTGEGGAGKTFTYNKIIARAKSAGINFLPMASTGIAAELLYEGQTVHKRLCRLKQVDSSTSPNVDNESNFANMLRNIHGILIDEISMQHRDVLEFVDRLLRSVATQQFKDLSFAGKVAKFDHCFFNV

SEQ ID NO: 153331 - protein, 286 aa, Heterodera glycines
  Coding regions on vcDNA: vcDNA=SeqID_79754; Strand=-; Position=1 -167,480-487,553-745,1137-1299,1710-2039
MFFASDRYRIQSDSCDFLYAILSCLVKRVHQLAADVQLRCPIPCICFWAKLPNLSKAREKFRSFSLAFKAENQFEQLEKEACRVSVQMRHVETVFLSATKCGDGEQQNNQLTNIGTLLNYTHRELANSLDKIANVQQMLSKGGRHSLRSLLNLMNALFKINEINLPFDGSILDGTDQKLSERIVQLLSPADVQLVADLNSAEIGRLLAELLEKGDDSGGGGGGGNLGGIAEEDEDEAAEEEENEGNAKREEERERRELQEAIAKSEQSLGLAELRSGSLPVKHHLY

SEQ ID NO: 153332 - protein, 340 aa, Heterodera glycines
  Coding regions on vcDNA: vcDNA=SeqID_79755; Strand=-; Position=1 -888,1366-1500
MNDGGSNADANNNGNSNNNRNSFGTESSFSAGSSSTIAAVSVVGDQGLHYSVTGVLNQQSNNNVEKIGGIGTGTNRPQRRLSLVGNGGIAVKLPDYQRLPISSFGCTTDGHGREGRIYATAGFVGGTNNEGTLKKGSSKAAFLPSSYSSSNAVGGGNLIVGPAFNNGGPSIFGLRNGNGISTAASHICLNGIGISGGSSSSASVVADGKSTLSRRAQRLAQKAAHKLTIGSLSSELSSSASALYSLFTSSPAENGAGFAAMNGGKTVPSSGTFAGAANGVGGIYAETYLGHEQFYHDKAPFVSAHTSRGIDFLERFGQFAKERALIEEEYASKLKQESED

SEQ ID NO: 153333 - protein, 279 aa, Heterodera glycines
  Coding regions on vcDNA: vcDNA=SeqID_79756; Strand=-; Position=1 -108,162-389,444-593,851-997,1051-1257
  Homolog annotation: Hit_ID=AAP30770.1; Match level="QueryCoverage =92%, HitCoverage=99%, E-value=8e-77, Identity=59%"; Hit description =putative gland protein G17G01 [Heterodera glycines]
MRTIVYFKLLQIVLGLAFVWQLLSFHQFCGTFVCPKAFLHDISVGHCKRFTLIGKDSKTGEFGAVLDERKWHNQLFMSSTNGLPIKEQQQQFMDELAAKLPCPGRHCIPITTPSFFFWTEKNRNLLDNVVDFFSGQLLLALCSLLTIGIGFARMLRPAAEYECFDYCMALYSVFCWCCSAWASSCLLLYWTSYWSCMNFRADDTNVPLVTFVFDIVMVCSFVFEMFFNNSLVKKRPENASFAAANRKLRNDVATECANVAIHRQQQQQQKNGSAIIMQT

SEQ ID NO: 153334 - protein, 643 aa, Heterodera glycines
  Coding regions on vcDNA: vcDNA=SeqID_79757; Strand=+; Position=1-1932
MPMPVFHPQPQFYRGQMVPQSPIQNYAPFLNNQMPAMLPHQQNIQHAQMAINAARQQVNQQPFQNAQQQAVLHQAGLSGLEYAMILDRLPDIKGNEGSDLIRNFFKKYSQYTIDWPNKKRIESLEAKLSGRAERAYNAALASEPFAYENIKRSILQQLEETDCREMSAFNDLMNGVLRKSGENLDDLADRISSLVRRAYPGLTRNLADEYSIKHLIRSLNNPELALSLELHRRNGMSFDEFVALASRAETTQKAAKIQNGERSKPYYERNFQHTHQGERNSEMISKNFSPRPICYNCNEPGHISRNCNKAGAQSNRNAPAFFPRNQQQQQLHNSPATGANRIVQHSKNGVTPAVRSQNFLKQNCIRMEEEVKTDATDATVAGVKLEKEVIEYLRDELEKSETFCSGFEPNAMIGKMVTVELGVMGTQTRGMLDGGAQISLMGGKFFYDLITSGKLDLHKTGFKGVSARISDVNGKELECLGTTSLPVDRKGCRTTNVCFHITSAPFGFDLLIGTNALRSLGFCLYDIPNKEMINFEEVNHQKKNQISVIYQMTLKPHTMQFVTLSAGNEWNGKDVLITAANEKTFHKLEPIVGTVQDGKIMVSILNTSDKFVQIFENEIIAELTPALLMWETENSLASVIVSE

SEQ ID NO: 153335 - protein, 55 aa, Heterodera glycines
  Coding regions on vcDNA: vcDNA=SeqID_79758; Strand=-; Position=1 -155,484-496
MAETTSPSLAANIAEKQHHKSGGGGAGSSSSAAAHKCRLMVYHEVLNSADFNFIF

SEQ ID NO: 153336 - protein, 158 aa, Heterodera glycines
  Coding regions on vcDNA: vcDNA=SeqID_79759; Strand=-; Position=1 -85,505-600,1150-1353,1814-1903
  Homolog annotation: Hit_ID=CAE65258.1; Match level="QueryCoverage =96%, HitCoverage=16%, E-value=7e-10, Identity=31%"; Hit description =Hypothetical protein CBG10148 [Caenorhabditis briggsae]
DELMRESAENCLTNAYTNVTVNRGAPYEIYVWIDHAGSVLTWDFDITKGECEFVIYRTEKKIAVPLHSHQQQKHSSASFSATAAPPPNAATSSNAATAGGAGAAVSGGGSATVSSSMAATVMGPVERVAIIGEPTFRVGVELFLAQQPLSFGEGDSMQ

SEQ ID NO: 153337 - protein, 37 aa, Heterodera glycines
  Coding regions on vcDNA: vcDNA=SeqID_79760; Strand=-; Position=1 -92,415-436
MNKKYFYSVWESNRGKNQIKSLQNIFKKKNIVATGND

SEQ ID NO: 153338 - protein, 125 aa, Heterodera glycines
  Coding regions on vcDNA: vcDNA=SeqID_79761; Strand=+; Position=1 -195,618-800
MNLILLVLLLLHSKIDQTHSADHDNNFECRNVPTDQMKPFQYKSDRWEEKMEIKISGTKLHQGKELYIGFSTAENDNLPKNQCVVIKIYGDELNEKALYDNSIKFFHLLKENDPENEHIINLIDQ

SEQ ID NO: 153339 - protein, 84 aa, Heterodera glycines
  Coding regions on vcDNA: vcDNA=SeqID_79762; Strand=-; Position=1 -112,187-329
MGKGWKMPRNWGRVENFGKVPWFEAFRFDFITGDENPTSISTVGERKYHLLDSVKRDTLSQKGSGTLTSPKTRCWTCEKMWENQ

SEQ ID NO: 153340 - protein, 24 aa, Heterodera glycines
  Coding regions on vcDNA: vcDNA=SeqID_79763; Strand=+; Position=1-93
LTHRPLRRKNQLNCTWSPKLTRRV

SEQ ID NO: 153341 - protein, 95 aa, Heterodera glycines
  Coding regions on vcDNA: vcDNA=SeqID_79764; Strand=+; Position=1 -51,283-422,469-565
MGVSGSSLSAYVQVAVHRFTTDAAFAQAVKMITSLAFVPLEDITPALAALEDHLLDELEGVLDWFVINYVGRLRNNGTRTRHCFGPKNGACMSAQ

SEQ ID NO: 153342 - protein, 212 aa, Heterodera glycines
  Coding regions on vcDNA: vcDNA=SeqID_79765; Strand=-; Position=1 -199,248-324,920-1111,1166-1333
  Homolog annotation: Hit_ID=NP_491118.1; Match level="QueryCoverage =57%, HitCoverage=7%, E-value=3e-29, Identity=47%"; Hit description =zinc finger protein 294 (1D746) [Caenorhabditis elegans]
MFSSENAKRGAFAKKSLNGNELESEANEGDAEDIGKSLEEQSHQLALPRLFKALLSFEFANYSRLNESEVDPLLLSWDVLMRFFGDLDVLSRVRILSKVREIECTYRLEETTMTLTILLPENYPIKAPKVETGRSIVNRELHRKWLLQLGVFLNGQNGVMMDGILQWKRSIDQHLQGVEECTICMSTVSSTNYQLPKIRCRQCRKKFHGDCL

SEQ ID NO: 153343 - protein, 92 aa, Heterodera glycines
  Coding regions on vcDNA: vcDNA=SeqID_79766; Strand=-; Position=1 -70,115-209,257-370
  Homolog annotation: Hit_ID=CAE57921.1; Match level="QueryCoverage =73%, HitCoverage=13%, E-value=2e-14, Identity=51%"; Hit description =Hypothetical protein CBG00973 [Caenorhabditis briggsae]
MALFGTKNNAIGGEQRRITAGIIAIGDELLKGTTRDTNSQFLCKQLFEKGVWVKKVSILGDSITEVAKEVRNFCVEFDIVLAAFLCFSWNFD

SEQ ID NO: 153344 - protein, 146 aa, Heterodera glycines
  Coding regions on vcDNA: vcDNA=SeqID_79767; Strand=-; Position=1 -114,157-483
MDFFLLLSAMAALFLFFLYSMNALLCVRRLRKCHGKEKHNFFIASNRSSNESPLSDHLCQNVPSSLGERKNQLKNKNRSQWPNEWEEEKWRQIPIMKRDSGKRRERGGESVRRETRRVRAEKKGNTEFEMDLAIWRRTGKEQRQFF

SEQ ID NO: 153345 - protein, 33 aa, Heterodera glycines
  Coding regions on vcDNA: vcDNA=SeqID_79768; Strand=+; Position=1 -24,299-338,406-443
MIWLVLMKLMALGFPRNLCIEAYIVSDRNEVGN

SEQ ID NO: 153346 - protein, 86 aa, Heterodera glycines
  Coding regions on vcDNA: vcDNA=SeqID_79769; Strand=+; Position=1 -60,411-611
MKFYAYGRVRIDATAHSTGKPGGMNFNMATATPANFGIRNENNDAEQNIEALFRTQNVQEETPLAGPAFCPTTPYLFAMAGGNSEK

SEQ ID NO: 153347 - protein, 331 aa, Heterodera glycines
  Coding regions on vcDNA: vcDNA=SeqID_79770; Strand=+; Position=1 -21,426-684,866-1581
MEQGGFEAFQFIKVEFVAEEKARLFQVVSQLNSERRSIVHRAIASHFAVDEQYGAKLVKDGATDHQQFCEKINAMIGNLVDPTDAAKVAVAGDFLHQQVQCAYGSLADMNQISNLKAHISELRAQNLTQQAQIGAQQVQIDGLHAQVGNQQNRLQAQVVAQQNLIGGQHNQIGAQQNLIGGQHKQIGGLHVQVAAQQNMIGGLHAQVADQQNRIGGLHAQVADQQNLIGGQHNQIGDLQARNTALLAQVSDHLSLFDTPAQNSSLRKRKLVSDVEKLPSQTSSGPSKLAIGVSETTVGPSTSIVGASETTVEPSKSADDLSQTGESLPSKD

SEQ ID NO: 153348 - protein, 218 aa, Heterodera glycines
  Coding regions on vcDNA: vcDNA=SeqID_79771; Strand=-; Position=1 -22,619-686,1517-1711,2171-2389,2480-2570,4949-5007
  Homolog annotation: Hit_ID=CAE69958.1; Match level="QueryCoverage =98%, HitCoverage=34%, E-value=3e-41, Identity=44%"; Hit description =Hypothetical protein CBG16348 [Caenorhabditis briggsae]
KLGLSGTDPFAKLEKITEYRSTLLYSSFGKLNISVFITVTDLNDNAPQFSARRFAVQIAEELPEGTPIRLDFRATDADQPGSNSRIRYRIVRSSPALLLHIPDPLRPELFVAGRIDFEKMPNFTVFIEAEDQGTPKLRTFARLDVTVIDVDDLNPTFEAQMYKSSEHRGFSLAIEPSPIRAWDADRSFDEPIIYSLSGEIFLDGKRQEGGNGRSIPNW

SEQ ID NO: 153349 - protein, 40 aa, Heterodera glycines
  Coding regions on vcDNA: vcDNA=SeqID_79772; Strand=+; Position=1 -42,850-930
MSAQFGNECDYLTPAANTKRRRTRNREKDSTLALTTLTNK

SEQ ID NO: 153350 - protein, 50 aa, Heterodera glycines
  Coding regions on vcDNA: vcDNA=SeqID_79773; Strand=-; Position=1 -15,815-952
MSADQRRYELIDLHKLCKEEIPWRTFTALAKTDKNCNAFVAALQELVKEA

SEQ ID NO: 153351 - protein, 120 aa, Heterodera glycines
  Coding regions on vcDNA: vcDNA=SeqID_79774; Strand=+; Position=1 -147,824-1036
  Homolog annotation: Hit_ID=CAE65880.1; Match level="QueryCoverage =68%, HitCoverage=16%, E-value=2e-21, Identity=59%"; Hit description =Hypothetical protein CBG11030 [Caenorhabditis briggsae]
MRFLTVDELNRKCPREGLAMAPFAKNGNGSTTEEQRRWLNQPFDETCIRSFFLGLSAQLRRYEPWEEWFYTVMYTLISALALLGNGMVILAVIRKRGMRTARNVLIVNLALSNLMLALTT

SEQ ID NO: 153352 - protein, 327 aa, Heterodera glycines
  Coding regions on vcDNA: vcDNA=SeqID_79775; Strand=+; Position=1 -138,193-261,336-411,653-883,1140-1231,1297-1389,1440-1487,1541-1640
  Homolog annotation: Hit_ID=NP_741835.1; Match level="QueryCoverage =97%, HitCoverage=54%, E-value=4e-54, Identity=41%"; Hit description =somatostatin Receptor subtype 5 like (XI5) [Caenorhabditis elegans] gb|AAA80406.1| Hypothetical protein C
PSSPPPSFLQVMAIDRYYSVRSLNINSPSGRSGQCLRAVLISLLIWLFSFLFSFLLSFPLLVYYRVHVLYVIKEIAWAKETNADLIVLRSYGWRQCRLNSSSLIAVDDRMVQLGMAAMQGAMLYAVPLVVLSIFNVILCLEFLKNPYNEDETDAIPEDEHQTAETQYGKRRGQRNSTADLMLPRQVSIVTVGTSTRAAEKRRNRTTVLLIAMAGSYAVLWLPVLLIAMAGSYAVLWLPFTFVSILIDLDWLGVESGSPIVERESGSPIVERIDQTCKLLSITSICVNPFLYGFLSITSICVNPFLYGFLNTNFRHEFNEIFLYCFAC

SEQ ID NO: 153353 - protein, 468 aa, Heterodera glycines
  misc_feature (2)..(2): Xaa can be any naturally occurring amino acid
  Coding regions on vcDNA: vcDNA=SeqID_79776; Strand=-; Position=1 -166,826-1014,1085-1169,1281-1375,1430-1515,1657-1795,1855-1953,2061 -2210,2307-2431,2484-2658
  Homolog annotation: Hit_ID=CAE68659.1; Match level="QueryCoverage =98%, HitCoverage=98%, E-value=2e-96, Identity=41%"; Hit description =Hypothetical protein CBG14558 [Caenorhabditis briggsae]
RXSNEIKWDDCESIGTFEDRRNGQRMAPRRGEKPRQEICGPLKWLCFAVNFFIFLASVACLALGVYLFLTDPRPIDEFVDVLLNPAVLLTSAGLFSGTVALFGLFGALRDNVCLLKLFALFVFFALFVFLSYLVLVVFTCFLFLLFYSDASEGISAQFLLRYSIRRYHINRNIADFVDYMQEQLECCGSTSLECCGSTSFRDWNISEQFKCNSSNPYPERCGVPFSCCRRSVAGGANGGQNPLVPAIRSLQCWQNAQKKREQQLDSDIYVADIYVAGCLQPLRTLFDDHAFHIGFAVVSVVLPVCMAVFLSQCLARQIDYQRFLLRREERRIARAERRERRFREQQQNQSTGQLEKRRRNNQQKEKRKSRTKSSSPLRTAAKVAKRLSVNLENGTARRERARGITGGGEGRRRERARGITGGGEGRRRGAREKRRRPIRGTASPRKNVPRGTREETKAQRKTPPRNRR

SEQ ID NO: 153354 - protein, 150 aa, Heterodera glycines
  Coding regions on vcDNA: vcDNA=SeqID_79777; Strand=+; Position=1 -249,575-778
MGKAMANDQNGKGKQCANKRPPFGIRIGGIAFELLADVPISEGCAATTLKLNKCQKNDASDEIQLPFHLFLHIIHEIRDVSIDKTNVVPEGAEKAEKGDGAREETGGSEQHSRVEQNVDKLIDGTRVGQKEINAKRKASDGSELARTWGL

SEQ ID NO: 153355 - protein, 30 aa, Heterodera glycines
  Coding regions on vcDNA: vcDNA=SeqID_79778; Strand=-; Position=1-94
LISLHVFKLKQLINSVSQYGFCPNNLKNKP

SEQ ID NO: 153356 - protein, 32 aa, Heterodera glycines
  Coding regions on vcDNA: vcDNA=SeqID_79779; Strand=+; Position=1 -43,138-193
MAKQCDERVNTLTNAANFWGASIKKQNVSTYL

SEQ ID NO: 153357 - protein, 119 aa, Heterodera glycines
  Coding regions on vcDNA: vcDNA=SeqID_79780; Strand=+; Position=1 -74,993-1278
LRVPIIAMCNLQQKLSKIETLRLARNYIKALNQMAEKGAQMMSKVDYARILCEELSATTANQIATCLGVPPILLRAMPTQRQQQHQQEFDGTAQSQTANCTPTNFKTQSRKGCFSGTIV

SEQ ID NO: 153358 - protein, 35 aa, Heterodera glycines; identical to SEQ ID NO: 149064
  Coding regions on vcDNA: vcDNA=SeqID_79781; Strand=-; Position=1 -22,433-518

SEQ ID NO: 153359 - protein, 411 aa, Heterodera glycines
  Coding regions on vcDNA: vcDNA=SeqID_79782; Strand=+; Position=1 -111,153-318,360-889,1117-1176,1560-1928
  Homolog annotation: Hit_ID=CAE71770.1; Match level="QueryCoverage =65%, HitCoverage=21%, E-value=1e-39, Identity=39%"; Hit description =Hypothetical protein CBG18765 [Caenorhabditis briggsae]
MPRVGDRVMVEANYNPSMPFKWNARSIEKIQNVEYRQETTQQYQPHQNRQVQQPQNGTSSRWNDRPPRDEFPREPRRQPPMSIHRTPPRDAGQKRPLSRQRSPLPRKSPPRRQESTVSKREREVRDETETREKDRESTRARSPQSGKRDTASPPRRRQRIIPRYHCNVSKQTIPQYTLFFLFFSCNCQLSGELKYAELRKRYSSLYIPSDFIRCKFSWVDSVKLETPLQFSPHPIKFHVLHKDVDVLLDEGKQLPLENPPDADSRFVVKGIVERASLCASAACGHLRWMLSDEQYQQTVQKLQDQLASKLSAIDAQDFVSPRRENEKGLNLDSGDGEAAAAETGEKINQEERSGSGGIDQSPKQPAVGDQHQPEITNTISAAEVLSSKRFIKVVSSTSMCSGVAGGVEFLS

SEQ ID NO: 153360 - protein, 85 aa, Heterodera glycines
  Coding regions on vcDNA: vcDNA=SeqID_79783; Strand=-; Position=1 -64,209-402
MQLLYLSSFYSAVISRDLVQTSLLQTVHQGTANGHCGRHQWHLQTTVVQFVCRHSGRNRQSEQGQSKKGAICRVIRFSKFIEKYI

SEQ ID NO: 153361 - protein, 55 aa, Heterodera glycines
  Coding regions on vcDNA: vcDNA=SeqID_79784; Strand=-; Position=1 -163,446-450
MCETLRTINGGVPICKSNFQELDVACQSILRERRIQLADLACGAVVSNCQSKLAG

SEQ ID NO: 153362 - protein, 80 aa, Heterodera glycines
  Coding regions on vcDNA: vcDNA=SeqID_79785; Strand=-; Position=1 -130,490-602
MYVPIGPWERRFLKKIGKGCTVHKKYIVIFYCLVVSRAMLLPCADQHKRPAASMNATIFVPAADHWVDLKCFFFYFKSGT

SEQ ID NO: 153363 - protein, 212 aa, Heterodera glycines
  Coding regions on vcDNA: vcDNA=SeqID_79786; Strand=-; Position=1 -117,377-457,519-708,764-885,1087-1215
  Homolog annotation: Hit_ID=CAE65136.1; Match level="QueryCoverage =80%, HitCoverage=29%, E-value=4e-34, Identity=36%"; Hit description =Hypothetical protein CBG10002 [Caenorhabditis briggsae]
MASSISSVDIDSQSEMASNSRKTVDDVQSFEEFPVYSSKANYDRELSEAVAEHGRCALEANNALLQAQTTITELEQKVQEIRDRTLCSETSVHELTKDIRQLDVAKKNLTESIATLHHLQLLLNGVNLLTQWVTERRYNEITTELPAVLNVLLLFEDYQHIEHVKQLTDKSVLGGKLQDDFINWFINQQLAIYTVLYADSEDVAWLDRIEER

SEQ ID NO: 153364 - protein, 199 aa, Heterodera glycines
  Coding regions on vcDNA: vcDNA=SeqID_79787; Strand=-; Position=1 -297,496-627,677-847
MLKNRTQERDDLRDDIANFTAEKAKLERGVAKLEEDIGKLKRDRTKTDEDIIRLKRERTKADEEIGKLKKEQTKWEEEHARLKDQHAKLGEEKADLETAKNLSKNHLYNILTFVECFFFVQLADQQQQIEQLKEDKNQWTHDLTQYFDANSQQNEASMADEQGKMEAKELDEQNQYFYDQQVRYVFKRRGKKLKFEQFP

SEQ ID NO: 153365 - protein, 391 aa, Heterodera glycines
  Coding regions on vcDNA: vcDNA=SeqID_79788; Strand=+; Position=1 -99,450-548,634-732,795-1470,1658-1860
MEVPKGGNKALRRANLDSAQSIDGNIGNKRRRTRNEGNQQQNPQPPEFPPVILAAHHSQPQHQLLNQGHSTGAFPFVDPQQQQQLTPQPLGTPARVSVTYTKPFPMLEQQQPQRTQNLQQGDEAAIIERVRQRQLAELAAMEAARPIPDDLQYCAPYNAYGLTSIGWLLMGWREQMVIRSEKGAFTGERKLRQIGHPKIMSNLGCPVFGVNFARLYFALSSSSLIGVVTQSGPMGGDKAKFKGRKLILQFDKDASQLLTVKEWERDDGRPSELARAQARDRVHLQRLNVVQQKGAIATTNENTFIFTLTFGQFSTMTIISHAGNDGTGSANVQQQQSQQHQQGTSAALHAQVGQNEEEEDDEDLLLCIENGQELSGGDRHQPHQRTSTPVS

SEQ ID NO: 153366 - protein, 79 aa, Heterodera glycines
  Coding regions on vcDNA: vcDNA=SeqID_79789; Strand=+; Position=1-240
MMNELECRIGLSIMVKAQKQLNWKHKRVTCDPKSGKKPLAEDHGKRIIMEKTTGTKAAHLWSFLKEMSAGEKATPFKVK

SEQ ID NO: 153367 - protein, 386 aa, Heterodera glycines
  Coding regions on vcDNA: vcDNA=SeqID_79790; Strand=+; Position=1 -113,171-195,261-425,475-573,730-1488
MSFTFPGGARRPVIDINSENLMFVWNLPRWIDIGEIKRSLQPKYGRIKFVETFEAWREGRRMGQIILDFGTYSSLSAFTKALSNKEEFNYEGVEFMCFDSKIGQKPFFNFVRQQTGVDLLACEGVPPTFEYKRKGSSFEREQQNPNTISLRPRVRDRDSPRGTERSRYNRDDDDGNNGRPNGAAQAVPSLRGVGRGFGQIGSRFGNRELPPPSDESKRTAAFEKIGSRFGNRELPPPSDESKRTAAFEKIGSRFGNRELPPPSDESKRTAAFEKIGSRFGNRELPPPSDESKRTAADENESEQRNGRGDENRRVHSIVEQGNDKVEDEQTHRTDSPLGDFGSNPPSRNFARRISRPKPSFLGEKRSEGFFAAGKISGTRKRRAIRN

SEQ ID NO: 153368 - protein, 155 aa, Heterodera glycines
  Coding regions on vcDNA: vcDNA=SeqID_79791; Strand=+; Position=1 -254,334-417,480-611
PNEENDDEIGQENDDEVGQEQQQGKEEGEERDDGKGTPSADDDGEGANKSDGRTTDSSFTQYREKSRSREDSVSEDRDGHGGAGLDFGFDISKILEALQTVGEVVRFERLGKTSAAFTFDDAAEAANASVLVVDDLAAPNAYFQLMTAEEAYQYQ

SEQ ID NO: 153369 - protein, 62 aa, Heterodera glycines
  Coding regions on vcDNA: vcDNA=SeqID_79792; Strand=-; Position=1 -54,656-789
  Homolog annotation: Hit_ID=NP_495960.1; Match level="QueryCoverage =83%, HitCoverage=8%, E-value=3e-10, Identity=57%"; Hit description =RNA binding protein SYM-2 like (2J470) [Caenorhabditis elegans] pir||T25208 hypothetical protein ZK1067.6
MQKSNSPVLSFVRMFCRPGVHMIYNSAGHPSGEAFIQMDSEQAAANAAQEMHNKYMELGKKR

SEQ ID NO: 153370 - protein, 108 aa, Heterodera glycines
  Coding regions on vcDNA: vcDNA=SeqID_79793; Strand=-; Position=1 -37,1073-1167,1228-1407
  Homolog annotation: Hit_ID=XP_511052.1; Match level="QueryCoverage =99%, HitCoverage=10%, E-value=2e-28, Identity=60%"; Hit description =PREDICTED: similar to hypothetical protein FLJ21918 [Pan troglodytes]
KVGKGGGGKRDRVDSRCVVRARGLPWHVSDLDVAMFFAGLDIPPGGVAGGVALCLGPEGRRSGEALVRFARADQRDLALQRHRRHLHARYIEVYRASGDEFVKHAVGD

SEQ ID NO: 153371 - protein, 374 aa, Heterodera glycines
  Coding regions on vcDNA: vcDNA=SeqID_79794; Strand=-; Position=1 -85,180-272,357-555,613-648,702-746,791-922,1106-1193,1279-1315,1367 -1431,1493-1611,1786-1826
  Homolog annotation: Hit_ID=NP_501380.1; Match level="QueryCoverage =94%, HitCoverage=32%, E-value=1e-104, Identity=56%"; Hit description= osm-9 and Capsaicin receptor-Related (ocr-2) [Caenorhabditis elegans] gb|AAC04431.1| Osm-9 and capsaicin
LNSVNTRNGNEWNWTPTNGHRQNQKLYQLVDMHGGGELIKWMRYARKGGDYSIVDGYFETTIKQAMYNSGKGKLESVAELVKMRNKERNERLGAFSRKKGKGKSGPNILDDFNQNANQNQGDLKKALKLLDGGLKLLDGGRGGKGDAKYREIVWKIEERGDAKYREIVWKIEERGQMGENLVQMGENLVGCCLMQGGPIHTELAIRLLNEFPKLVNDVMLSEDYYGLSPLHQAIVNEDPSLCNYLLQHGADVNQRCFGACFGAFFCPDDQKGSRTDSLEHEYVELNGSRTDSLEHEYVELNLKTEYAGRMYFGEYPLAFAARMYFGEYPLAFAACTNQFDCYRLLRAKRADPNAQDTNGNDCLHMTVIHENMVR

SEQ ID NO: 153372 - protein, 269 aa, Heterodera glycines
  Coding regions on vcDNA: vcDNA=SeqID_79795; Strand=-; Position=1 -77,1465-1879,1929-2203,2259-2300
MGMSSVIMSKATVQTAAKERENGEEIFINLNAIAFLDSLRPLFAACPINLTIDSNNPAILKSVVDNIWPMLNVGAMLLSERILCGLRKSNSSILNSCPTLRVLCLYATDDFFTEFPADDSASASDEKALAKWLFTPHPNDVPKVLKCSIGRERFWKLKIVQFKTAFANASSHANFIVVICIPLCFVEPFELINRIGEELTLKITADGENVLLIRCPIERDASEWTKWEEEAIGWRISNQKNRIDVGIYDPADVGDGLLKPAPGPSVQQQ

SEQ ID NO: 153373 - protein, 38 aa, Heterodera glycines
  Coding regions on vcDNA: vcDNA=SeqID_79796; Strand=+; Position=1 -94,252-274
MKDWSDHVGPIIVCKIFVQTFVPDKMRLFIFGSGFFII

SEQ ID NO: 153374 - protein, 101 aa, Heterodera glycines
  Coding regions on vcDNA: vcDNA=SeqID_79797; Strand=+; Position=1-303
GELSRSERPFCARPSDCFSAQSPPPSAMFLTPLGNVKNELVVCPTDFGGDFVFGMELEPSNSDFCASTAAFAPSISMNGPFPPMQTQMIRMPMPSLSASIT

SEQ ID NO: 153375 - protein, 158 aa, Heterodera glycines
  misc_feature (3)..(3): Xaa can be any naturally occurring amino acid
  misc_feature (14)..(14): Xaa can be any naturally occurring amino acid
  Coding regions on vcDNA: vcDNA=SeqID_79798; Strand=+; Position=1 -158,206-250,292-481
  Homolog annotation: Hit_ID=CAE68346.1; Match level="QueryCoverage =89%, HitCoverage=43%, E-value=1e-24, Identity=49%"; Hit description =Hypothetical protein CBG14076 [Caenorhabditis briggsae]
IEXLVANSKPGTLXEGTNQLGRTYSPLLPLSMVERQKIVQLFHEGWKICDISKYLCVTHSCYLCVTHSCVSKILQRFRATGSVRPKDAKEGRQESFRATGSVRPKDAKEGRQESPLVAAIRDYRQRLGIMRQSEIREQLIRDGLCRRENAPSRSSINQ

SEQ ID NO: 153376 - protein, 346 aa, Heterodera glycines
  Coding regions on vcDNA: vcDNA=SeqID_79799; Strand=-; Position=1 -48,123-326,481-600,739-841,945-1024,1130-1206,1597-1832,1975-2147
  Homolog annotation: Hit_ID=EAL44122.1; Match level="QueryCoverage =52%, HitCoverage=48%, E-value=4e-15, Identity=26%"; Hit description =conserved hypothetical protein [Entamoeba histolytica HM-1:IMSS]
MLTPATAVGRCLELKNKGLQEKLKQQETNALLEKIEAENGKMKNEIEKMQAKMDEKEKQLEKKEEQLEKKEKQYMDKLEELQKNVLQVKCDSEEENNRKLKNEHKEMKEKQDKLEEKLGKKLDTQKAFQAEHEKKLMEQIETLQAKISKMEMEKQKQKVYNDQMEQLQNEQKKKTNALEKNQRKMALRNFRQNRWDANACHYNIKIITNNHNPYGWLTFGFAIKQQDKLEGAIANDLGTYAYLSGGDFTVNGEWKIQKEDYSFGSEDTVGCGINLATRQIFFTKNGWLLASYDLVDHSPFVDGLAELFPFLSLLCSGEEIEANFGPKFHYNLAKPKQWKSVMLSSN

SEQ ID NO: 153377 - protein, 168 aa, Heterodera glycines
  Coding regions on vcDNA: vcDNA=SeqID_79800; Strand=+; Position=1 -327,377-556
MNRSFICADRGAQWEGTRLHRFPRLRFAAGRFRVELSHHFRSPQTDGCQRHLGRLRAPWPTPSPNRTAGQNGRGRIHGQRAAGVPGTVGRFYGPPEEGGHATENPRSFGSQVHGTFSATTDLLCPLQRLHLGHRRQAGIPVPNLYGCRAQTVPFGRRVEKSRQQNGRF

SEQ ID NO: 153378 - protein, 191 aa, Heterodera glycines
  Coding regions on vcDNA: vcDNA=SeqID_79801; Strand=-; Position=1 -142,191-234,289-396,444-541,611-673,729-846
  Homolog annotation: Hit_ID=NP_497716.1; Match level="QueryCoverage =100%, HitCoverage=65%, E-value=2e-51, Identity=55%"; Hit description= ras suppressor protein 1 (30.5 kD) (3E563) [Caenorhabditis elegans] emb|CAA87096.1| Hypothetical protein
MNRLYKLPRGFGSFAKLELLDLTYNNLREQSLPGNFFFMPTLRALYLGDNDFESFPEDIGHLTNLQVLVLRENDLIDLPRQMGTLQKLKELHIQAKMGGNRLQVIPPELGQLDLIDPNDENAKTLRVENNPWIVPLKDALTRGAQGGDWQSGVESFWNYIRSDNYRRLYESHPVGVGSTPPKRNKEKKVSR

SEQ ID NO: 153379 - protein, 60 aa, Heterodera glycines
  Coding regions on vcDNA: vcDNA=SeqID_79802; Strand=+; Position=1-340
LIFIILLLNTLTVQTFSDLSMFLFQNRVLTCTSSFISLLLFCFEFIRTFCVLIIRQIYYA

SEQ ID NO: 153380 - protein, 196 aa, Heterodera glycines
  Coding regions on vcDNA: vcDNA=SeqID_79803; Strand=+; Position=1 -93,157-497,642-798
MSTEQLIEVMEELRPCYKWADYNLFNHNCMDFAMDFIRRISAVNLPSGKFFSWTQEIRQPLILLPIRKICETETFKRTVKSLKRKEEKEQGKGGGTEKERKRERKRTKKAKRKSEKQRKERDNAGEGGQQTKERTESAGESPAESAIENAQNISLRKKSSAAEQQQIHIEHRGALGLYITTIRILPMTEEMGQKDE

SEQ ID NO: 153381 - protein, 315 aa, Heterodera glycines
  Coding regions on vcDNA: vcDNA=SeqID_79804; Strand=+; Position=1-948
MVGQKKQLDNQTNSGRVISTFSVAEHGRHNNECGEAICYSDQTTTKQKSSSLMQQHYFETNGSKEITTKQRLQRLRRKSTSSRKNMSLSHRYTAPFSSSKGCAGFIVPPVFPKTCSLYDESFSGGVFVDHQEDRLLVEAVDRIRKRNFSCKEKEHDGCLQKQQTSADASQINGDFINENSDIDSGNSSITEGRQSPICSEFTQNFGRTEATQFKKAAENSDVASDANWKDTNQRDGFLRKNCRLLHFVKKKGSESLDNEHMQNDDRENDKLPAQRQWETDTTKRKSWRARLLRTLSVGSPSVGRVMKDKEKQRGN

SEQ ID NO: 153382 - protein, 259 aa, Heterodera glycines
  Coding regions on vcDNA: vcDNA=SeqID_79805; Strand=+; Position=1 -218,274-368,545-718,771-908,964-1051
  Homolog annotation: Hit_ID=CAE66050.1; Match level="QueryCoverage =88%, HitCoverage=22%, E-value=2e-71, Identity=58%"; Hit description =Hypothetical protein CBG11250 [Caenorhabditis briggsae]
LIVVNLTKIDIPSPSEKPTHFANFRERETREDQPSEMPLPEALHSQLLDEFMIRQIIDILPPRAEGYPWVQIYNIIDILPPRAEGYPWVQIYNSEKHGFSLTTLYRRMAEWDEEMSPVLLVVRDVNGHVFGAVSSGALKPCDHYYGTGDSSLLFRFTGEFPHTRELRTFTWTGENQFELRTFTWTGENQFFVNATRESLSFGAGGGHFGLWLDADLNHGRSQKCATFDNEPCATFDNEPLAGEEEDFVVQFVEVFGFCM

SEQ ID NO: 153383 - protein, 89 aa, Heterodera glycines
  Coding regions on vcDNA: vcDNA=SeqID_79806; Strand=+; Position=1-270
MGTIPIAVGIGMGTIPIAVGIRMGTITIAVGIRMGTIPIAVGIRMGTIPIAVGIRIGTIPIAVSIGMGTITIAVGIGMGTITGVLFAWY

SEQ ID NO: 153384 - protein, 79 aa, Heterodera glycines
  Coding regions on vcDNA: vcDNA=SeqID_79807; Strand=+; Position=1-333
ETGNFKFADPVAGLEFKIFYRTGSGRINPAILHLKSAGSCAGLRILGNFKKFCINKKVFQSIKKYSNIFLNQKMMKMKN

SEQ ID NO: 153385 - protein, 144 aa, Heterodera glycines
  Coding regions on vcDNA: vcDNA=SeqID_79808; Strand=+; Position=1 -28,334-389,1749-1868,1920-1992,2044-2153
  Homolog annotation: Hit_ID=NP_741479.1; Match level="QueryCoverage =100%, HitCoverage=21%, E-value=2e-28, Identity=46%"; Hit description= solute carrier family 9 regulator 2 (68.2 kD) (4J893) [Caenorhabditis elegans] emb|CAD36491.1| Hypotheti
ALYASSKCKQFEQFFALPPPPTKQITFLKQQFNLLSFSPIDEFGFNLHAERGKGHFVGAVDKGGIADDAGLETGQRAGLETGQRIVGVNGRLVSAQTPHKEIVKLIKEIVKLIKSDPLKTVLLVASEEADRFYAEKGLGEATDN

SEQ ID NO: 153386 - protein, 29 aa, Heterodera glycines
  Coding regions on vcDNA: vcDNA=SeqID_79809; Strand=-; Position=1 -65,786-810
MECQQRTFGRVQKGRIRKRRRNKVDTLTV

SEQ ID NO: 153387 - protein, 119 aa, Heterodera glycines
  Coding regions on vcDNA: vcDNA=SeqID_79810; Strand=-; Position=1 -95,427-691
MQGGEDDLYLCCPTGQGFTKLTKNCHFVLWRDRNFALAKIDQKTVAKMLLFAEEESAVTVSKCIGKTVERTERWPKAGSKQFVHAVRPFTFAFSFLKSFSALFQLRGICVEYFGCKIGI

SEQ ID NO: 153388 - protein, 256 aa, Heterodera glycines
  Coding regions on vcDNA: vcDNA=SeqID_79811; Strand=-; Position=1 -608,945-1104
MSKNAAQTFVEPRTGNYWHFLATVAKEGSLIEHQKSFGLMKRNGTSEKKIWLKCEKKQCPYRGLYLKEKMALFDRYEHIHNPLEDELKLARRKTGEIGTMKLHGPKLARRKTCGIGNCGKLAPPKKDLAETKGIRKIGTKSEGPKLASRKTDINLRNREKEEKPKIAESKCKGGEDDLYFVLSDLEQEFTKLAKNCQLVLWRDRNFALAKIDQKTVAKMLLFAEEESAVTVSKCIGKTVERTERWPKAGSKQFVHA

SEQ ID NO: 153389 - protein, 106 aa, Heterodera glycines
  Coding regions on vcDNA: vcDNA=SeqID_79812; Strand=-; Position=1-321
MSSIEMEVPKVNNRKKRRITWTFLMRVDNGEKFIEFCRQNGLNGQSLHNAVGGKCRRMCRRYWFESAEKCPYKIKLDIATGEVYERNQHNHTTPEGNGNGKGAQQP

SEQ ID NO: 153390 - protein, 443 aa, Heterodera glycines
  Coding regions on vcDNA: vcDNA=SeqID_79813; Strand=-; Position=1 -115,728-1024,1160-1287,1415-1507,1549-1638,1710-2015,2061-2191,2234 -2403
  Homolog annotation: Hit_ID=NP_502681.1; Match level="QueryCoverage =40%, HitCoverage=18%, E-value=3e-10, Identity=28%"; Hit description =GEX (Gut on EXterior) Interacting protein GEI-18, P-Rex1 (gei-18) [Caenorhabditis elegans] pir||T19533 hy
SIKESAELSAEDKKALTNGYAPLKQLSQTLISTIMAQKVRKYRSQEQLSLADRLLRINMHSLVKKSNRLKYRINRSIGLNTARYTEFDYLVQLLEEAERRLCKFLYCAQLYKKHIEQSVKRHEDTYKGKREHINEKNRICHAQDENVVKAFAVMFRHLDELCRRHLQTFDQEVITEGKKLSDEVEMRRAEFEALNNQIKAQLPRVIGSINTRVRELIQRVNKLDEAFLCRMDEWFARERPEKVRDCFSAALPFRAHLSASHRHTLAELNKIAAHLSSGSNPLQKSQSLCQIGKRLSLIFAEKSLHLSFRGTKSTHFSNEREAQNKQPKTHKRRPQTTKERDALTKICHAQKLTQQLRRVQSDWESASMVLRRGDAVVVKALRQDGFSLCDNAVSSGLVPVALLGPFDESFTAPFSPESPASGNEPHAIDLAVESAGHKQNNSD

SEQ ID NO: 153391 - protein, 180 aa, Heterodera glycines
  Coding regions on vcDNA: vcDNA=SeqID_79814; Strand=-; Position=1 -76,221-399,647-729,885-1089
MITRDRHFEKSLDLDFLKLILKSKKGKSRFFRVLPRPGFFSHLTWTLISWTKIQENPGPGKIQVAEKWPGPGPGFFETHFKNQKKVQEKSRLPKNGLDLDLDFLKLTLKIKKRFFRVLPGPGHGFFSHLTWTLISWTKIQENPGPGKIQVAEKWPGPGPGSRKNPGMDPGPGRSLIKIIF

SEQ ID NO: 153392 - protein, 46 aa, Heterodera glycines
  Coding regions on vcDNA: vcDNA=SeqID_79815; Strand=+; Position=1-141
AKRLLEEKEHELQTLNTELASERAVKNIFQSKYRLCWTRKIFRDSK

SEQ ID NO: 153393 - protein, 57 aa, Heterodera glycines
  Coding regions on vcDNA: vcDNA=SeqID_79816; Strand=-; Position=1 -99,270-344
MPIQCSMFVARAPFLPAIALPAKQIKLIFFKSIAPNSPLCYFQLTLRTFYLFLHGYS

SEQ ID NO: 153394 - protein, 77 aa, Heterodera glycines
  Coding regions on vcDNA: vcDNA=SeqID_79817; Strand=-; Position=1-619
CRVILRGRGEYGTQSKHLMKEGEVGGASPEGLLMPCPAQCPRQFPSLNCISIPFSCLSLSLCPFPPSIQWQILIKHK

SEQ ID NO: 153395 - protein, 25 aa, Heterodera glycines
  Coding regions on vcDNA: vcDNA=SeqID_79818; Strand=-; Position=1-75
MPEAIPEGDYERGKKIFKQRCLQCH

SEQ ID NO: 153396 - protein, 245 aa, Heterodera glycines
  Coding regions on vcDNA: vcDNA=SeqID_79819; Strand=+; Position=1 -11,71-343,404-857
  Homolog annotation: Hit_ID=AAL78214.1; Match level="QueryCoverage =57%, HitCoverage=74%, E-value=7e-10, Identity=28%"; Hit description =putative esophageal gland cell protein Hgg-20 [Heterodera glycines]
MNRRWICADVWMDILPSFNRPQLGLKMALLSDRFDVLVDKHFDGKSELPIWSYIIIFKDQEFGPKPMLFVVSKYVISLPDHPLPNKIRFKDLRIEYIDHSVLAFIRSNKQIWDRMGTKFELKVYSYETDQIWDVLAREIWPIFAPNIRHFGFHCGDHLDNLLRLVSPTLLTDCDQLNSIDSGYLSSSAIAVDGPNAISAWQALAKWLHTPTKNGQPKELRCDDFSKSINYFKEVTDHNFIKLLIN

SEQ ID NO: 153397 - protein, 34 aa, Heterodera glycines
  Coding regions on vcDNA: vcDNA=SeqID_79820; Strand=+; Position=1 -36,428-496
MKTEPKFGIKGIASRGHLGVSNDTNNVGPNKFGI

SEQ ID NO: 153398 - protein, 70 aa, Heterodera glycines
  Coding regions on vcDNA: vcDNA=SeqID_79821; Strand=+; Position=1 -92,241-291,378-447
MPRLFNLDASRKSYGADQKLIIFMVIKYSTNVFWVSRSLGRNDLIKLVFESRLFWGTVFLSQKCNLFGKY

SEQ ID NO: 153399 - protein, 67 aa, Heterodera glycines
  Coding regions on vcDNA: vcDNA=SeqID_79822; Strand=-; Position=1-225
AKNFFYFRKKIEIFSKKIPFDRARKTMFWKWSSFSRENSLKILKIQKPKNRFLGLARKILKIFEILK

SEQ ID NO: 153400 - protein, 257 aa, Heterodera glycines
  Coding regions on vcDNA: vcDNA=SeqID_79823; Strand=+; Position=1 -111,244-441,490-590,700-821,1675-1916
HISLCGKGDVMLELQHIISIAQCFPNLLSLNLWKCLKFENGLNPSQNSSHALSELLSKCAAIEYLSLCRATNIGTILFEPTLLPSKLAFLETDDTFDLQAMFKIANEQCRNIRCLSLQILKPTIPSLDFVHEDTLKRLVHLELDFHKTPQAPFFENFVKTSLGFLANLRILRLAKVTVFEFFVLSNCALPTVGFALPMFDRIEPADEQQQRKSGRRSAAKAHIEYQRQLSKIPHNVPPVHPFFAHARLWKRCRPTKL

SEQ ID NO: 153401 - protein, 57 aa, Heterodera glycines
  Coding regions on vcDNA: vcDNA=SeqID_79824; Strand=-; Position=1-172
QDLGYSAYNIDILAAFLSLSRLKNLRFLVIRHYGKVLQQISTQKCVKCSENCDETFV

SEQ ID NO: 153402 - protein, 1685 aa, Heterodera glycines
  Coding regions on vcDNA: vcDNA=SeqID_79825; Strand=-; Position=1 -1135,1223-5142
  Homolog annotation: Hit_ID=DAA04499.1; Match level="QueryCoverage =52%, HitCoverage=61%, E-value=1e-117, Identity=30%"; Hit description= TPA: pol polyprotein [Schistosoma mansoni]
MWLTVSFSWSTVSTEYCYLFMTKIMSQHGSTIMLSPLGSVNNCQFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREMLTLSFSQTIKSICDYMLETRRWAATALLSDPTTFARKLFQSGKLVAKVAGPELIKVWPCIELQAHDYEFAKIGNSADSEFECFDKIPIKFRVKDNKRMAFIDPRTMILSSDARLAPCSEYRKQLIFVRGSLYEVDQIDAQVKQVNANRIDGFSLNLSLAPTYARHSFLHLALVNVSDFIGQFYDANLARESELTFQIKSEDAIVTKTLSEQWEQVNFLIRFGLMIKDEYVGRGKTRRMTFGGNKTQKIVKSPAHLNMMDLNASVEFGNEIELSPVKLIEPAQTQAHKIAGKRKRPVKRTRFSFRAPKVLIGLLVIFLPNAFANPDVNNQISIQFTSPSMIYLLIIPFLIFITISVLLCSKRNSDLPMLPNLNAISPHHAVVQTLINSTPVRCLMDTGASLTVAPRSVADELNCRTFSSDLEAMSASGHVIRLKEYAQVNLNIAGYTVRSLIYFVDDSEFTVARDYSVIVGWDVFEKLPPIKFDHLNGKFFVGDNESKLCYRSILLLNDLRVSAEKNTLIPADSQILVDASIESSPNPKNSFCIDRPDISLIKKGLTVINSVSPAGQKQIKVAVVNPTMEPKWIWKGTHLAFANELLCDRNGFLKENSTKEILTLNSERKKMEIDPTFVVDFSRAMVKDKDLEKLKALIEEFSDVFSKFRYDLGLFTAAEHHITTTTEEPIASAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDKVYQMITMPFGLKNATAAFSRAMAIVLSGLEDTSLAYVDDVLIFTKSPNFSEHLTAVRKVLERFRLYNLKLSPKKCIFASNEMNFLGFVLTAEGFKPSLSRIEILKEMPVPLNVKEVKRVLGQAGFYRRHIENFAMVVEPLLKLTRQGNKFEWGREQQNAFDKIKELLTQAPSLIFPDYDKAFHIFTDASSTGQGGVLMQKDDVTGTFSAISYCSRTLSAAERKWPAVQVEMSAIIYALREFRPFIFMSDIELHTDHKPLAFLLKKSETNQQLARWLIELQNYQVKIVHVAGKANTLADALSRAAEDKPLSEIYNVDELEDIIEFPVCLALAAHSRVVADPFLHTLTIRHEDGNTYEVNLLEEQAADPEAAAYISFVRDGEFPADLDEKEKELFAVGTANYKLISGILYFEDKGSPPRIYVPISLRGLIFESFHSSLLGGGHLNYRKTIAKCKKYFWPKMYSDVLTWVKLCVTCQLRHNPTPAYREEMLIVPANTLFAKVGLDLAGPFPVTQKGNKHILNIVCWFTKYVISVPVPDTKAQTIAHAFLTNCYLKYGGCVELITDNASAFTSEFFKEFCSMLYIDKKYACPHWSQGNASTERTFRTFHNILAKYISKTQPDFDEFLDAANFCYNTSVHASTGETPFFLMFGRDPIFCVDQIIDPKVRDPIAISDRNEFKQKLVVAIRHAWHAAADEYAKAQRKMKEQYDRKARPQQITIGERVLIRNYDGR

SEQ ID NO: 153403 - protein, 163 aa, Heterodera glycines
  Coding regions on vcDNA: vcDNA=SeqID_79826; Strand=+; Position=1-516
  Homolog annotation: Hit_ID=CAE56861.1; Match level="QueryCoverage =86%, HitCoverage=9%, E-value=2e-15, Identity=29%"; Hit description =Hypothetical protein CBG24691 [Caenorhabditis briggsae]
MWLTVSFSWSTVSTEYCYLFMTKIMSQHGSTIMLSPLGSVNNCQFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREM

SEQ ID NO: 153404 - protein, 1855 aa, Heterodera glycines
  Coding regions on vcDNA: vcDNA=SeqID_79827; Strand=-; Position=1 -256,431-891,1124-5974
  Homolog annotation: Hit_ID=NP_508324.1; Match level="QueryCoverage =94%, HitCoverage=63%, E-value=1e-111, Identity=29%"; Hit description= predicted CDS, peptidase family A16 and RNA-directed DNA polymerase and Integrase, catalytic domain and
MIKSAVVRALSLYKLKDGQLEVSGFHIDSPVRLDAPQYELHVALENGKSEKIVAYRADWIVKSIRRAEWKTGNVEITDEEPDLLIETGIDTAKNFWDLQLIGIKDDPKENDDDTAMEIFEKKAKRLADGRYSSGWPWKEFPPDLPSNYNMAYRRLVNLLEKLRKTPELLDKYHESISREFNLGFFELGERREGFPEHFLPHHGVVTHKLRIVFDASAHPRGEKSLNECMFRGPVMIPDLKHLKEKASPLALEFAGNAFVDNLMTSCKDAGEVLKKYREGKALFAEAQMNLREFICNSMKAMEQIPEEDRLNKPGTKVLGIPWDIQKDELSIGFPPTNEAGKISKRIVLKTLASIFDPLGMVAPCLLQAKLFLQRLWDRTLGWDEILPADETAEWFAVIREWKTEPFKFPRRSVLQGEMVQLHAFVDASKDAYAAALFIRSQKGEETNVQLLYAKSRIKPRKAEVTIPRMELLAMLIGARMLKFAENQLRIPINEKFIWGDSKPVLSWIESKDSQPRFVENRLREIRRISENARFLHIRTHENPADVASRGCTPEELRSHHLWWNGPTWLREPMKSWPIDFEVTPKGAMNDGQESSELDNVVAVPATTSEDNPWIDPCRFSSWTKLRRTVVWFLRAINKMRKTRIFEISEGVPMSSEDYQYAEILLVKMAQKCWPMWKKQSQELVKTSRKDGLVRLSTRLAMSNASEDMVNPIILPENCPITRLIAQSVHESLAHSGVESTLTEFMGKYWTPRARLTIKKVIRACGRCRRIQCPAYKLPTMPPLPEDRVRRTAPFESIGIDYLGPTNTKINGKLQKAWIALFTCLSTRAIYLEPVLDLSAEAFLQVFRRFTSRRGTPKRIITDNGTQFVLAAKVVAALEAGKTPTCPLEEHLANEGIKWRFNPSLRPWSNGFLERQVAGVKAAFKRVLGRRILPYDQLRTFVAEVEATINQRPITYVDEGPNAVQPLRPVDFIMPKAILSLDVRRNQQSSDTEFENEPKNLQKQLQMRWEGTLATLDEFWTRWKKEYLLMLRNRLQWEHKGPRSCLADQPKIGEVVIIEEEKTPRNCWPLGRIVELQGSDNIVRSAKLKIPKANGERISWREISRPINRLYRLEVPKVDESEDQEEEEVPNGKIGLQGPIPKKDGKQAERPRDVQQGQIRNHGMVTRSMTKAASILGLMFMLVIWTTFVETRFVPNPPDIPKLHRGRQFPPCKMCKLECAERGIKVTVPRKVTKFEVCCGATSSCLVHRYTPDKLIYELPREQLIADYQCGATYWLRDGKVNIGEVECPPQDPCTLIDCWFCIERIANPDCRPDVSTGVYGLFTFTGIIALCRILSILRQVTSNLFWLIRWIIITPIKMVIQGIGKRLQRDDARVVQREPNKRKMTPNRAKKLSKMGMSLLALAASSLLIEHAAGSARVVSISAVAENCLRKANGSECRIESSTDVTLLPVGQPVRLILRDPEERVMGVVEMKLLSLSIVCIPKTERWLRSYTVRTTSVKSCPREGSCFGKFCQRVHEDYMKGYSAFVQELGSVQKGPGFTSCRESCSFWNCGCKLPTASCIFYRVHAVPESKIIYELISCPTWEYRINAKLKAESGGNFKGEMEMSLIPGITFKWKEVKLTPVAVSQAPVPILGHKFLSDGTSFSMVDQVNTNLLCQDREIASNFSGCTLSKEACPKCWVDEEAQRVDCQCRDSILEKEFNNPEKRLPLSLRNLNIRYKDGEIFSETHYTPIQVMVQFEGLRLGIEEDFTKCWAQTKTLKGCYKCQSGAQLKLRCWTEYGSALADVYCVDGTRFTVPCRSKAEDQNVILSFDQAEIDTNCTIECSGGKSKFRMKGHLIYVPIQQQIEMGVRISDT

SEQ ID NO: 153405 - protein, 103 aa, Heterodera glycines
  Coding regions on vcDNA: vcDNA=SeqID_79828; Strand=+; Position=1 -94,419-636
MRFWVNGVKVVPFEVRECKSSLYCLRSNCSAASTNEHYFVLGCTLTNNETINKEWLISDYIKPNSSTKDWKCHFEFGKRDQPMPFPLPEGAILPKTENTQPWQ

SEQ ID NO: 153406 - protein, 100 aa, Heterodera glycines
  Coding regions on vcDNA: vcDNA=SeqID_79829; Strand=-; Position=1 -123,172-351
MTPAEEQQMGNYHAQVARATEEFQQQMAQAVQAPFRGGFGIPSIGQTPQLRLPQLPCFRVDSSSGGDGAQSSQNAAAQNFSGNAAGGVDEENDASVSVEE

SEQ ID NO: 153407 - protein, 122 aa, Heterodera glycines
  Coding regions on vcDNA: vcDNA=SeqID_79830; Strand=+; Position=1-369
MTQCNELCSELLQNGSPNNYNSSNTTNCDNDADSANSLATGTKLVAAGRNFSNKKVPVSSPKCVPTTAENVIKRPPLFYDSKRRRVDKFYQKQSSLVEYFEQDSKQIQVQKWPKPVSLFYIG

SEQ ID NO: 153408 - protein, 65 aa, Heterodera glycines
  Coding regions on vcDNA: vcDNA=SeqID_79831; Strand=-; Position=1-196
MDSEPDKWEANALANVSVKLTIKESNVRRRDARADSVLHEVLEASDIAREGQCCAAQLRKLKPEK

SEQ ID NO: 153409 - protein, 263 aa, Heterodera glycines
  misc_feature (25)..(25): Xaa can be any naturally occurring amino acid
  Coding regions on vcDNA: vcDNA=SeqID_79832; Strand=+; Position=1 -273,714-833,1274-1452,1615-1794,1946-1995
  Homolog annotation: Hit_ID=NP_498611.1; Match level="QueryCoverage =92%, HitCoverage=55%, E-value=2e-50, Identity=46%"; Hit description =cation Diffusion Facilitator family member (50.3 kD) (cdf-2) [Caenorhabditis elegans] gb|AAK18959.2| Hypo
LPHVNSANCFSAYFFFVCFHLFLVXACVTVLHSSPSLAMSEASSTSCNTESARASRRLTLLSLIVNLTLTLAKALASHLSGSLSIMSSLVDSIVDITSGLVIWRTGRAIRTPDPYLYPVGRTRLEPAALIIVSVIMALASLQMILKSLNSIVYNDINPKVDWPTIAIMMATVIVKLILFLLCRRYSSTNSSLVLAQDHRNDCLSNSIALLCAWAQKFWLYLDPIGAIVVSVFVFQFFSDLVKPFPGGFIPLFRYIAVTWYNTG

SEQ ID NO: 153410 - protein, 141 aa, Heterodera glycines
  Coding regions on vcDNA: vcDNA=SeqID_79833; Strand=+; Position=1 -324,631-731
  Homolog annotation: Hit_ID=CAE69489.1; Match level="QueryCoverage =56%, HitCoverage=19%, E-value=1e-16, Identity=50%"; Hit description =Hypothetical protein CBG15694 [Caenorhabditis briggsae]
MPNSTVKNVALMNGTSPAPSADLPRFNHPTPSASFSFPKGSFFSSASASVESPMTATKNHRPTEPLATAFLGASSSSSNGTIEHAENGGNGHQPMTVILTVRMLMQGKEVGSIIGKRGDYVRQIREQSGAKVNISDGSCPE

SEQ ID NO: 153411 - protein, 50 aa, Heterodera glycines
  Coding regions on vcDNA: vcDNA=SeqID_79834; Strand=-; Position=1 -21,67-198
LIDHSPRGANKWRLTLRAFDWAVGRRAELGEEMPAGQSSKSWQNFFWSER

SEQ ID NO: 153412 - protein, 41 aa, Heterodera glycines
  Coding regions on vcDNA: vcDNA=SeqID_79835; Strand=-; Position=1-123
MKLFCPFVFLVLLSATAFAFSNLNKTPKTVHWEDACDECQL

SEQ ID NO: 153413 - protein, 99 aa, Heterodera glycines
  Coding regions on vcDNA: vcDNA=SeqID_79836; Strand=-; Position=1 -73,685-745,802-1020
AFSPATHSLTSQFILVKNGNLRKNFCSPLRPSYGRFTRRTSHGTVGLLLPVLRQTRGRVRPPGQCQRKRRRARGRRRARDVQILKKGGRKKRSKSDRID

SEQ ID NO: 153414 - protein, 63 aa, Heterodera glycines
  Coding regions on vcDNA: vcDNA=SeqID_79837; Strand=-; Position=1-189
CCTATNGNGHDAGDDGTAFQSLPDFAETVAFVHQFGPLFELSPFSFDDLAQALQQLHPPTEQK

SEQ ID NO: 153415 - protein, 32 aa, Heterodera glycines
  Coding regions on vcDNA: vcDNA=SeqID_79838; Strand=-; Position=1-97
MTSQAAEQELDECLKDKVVIFVILNQIFIRDK

SEQ ID NO: 153416 - protein, 30 aa, Heterodera glycines
  Coding regions on vcDNA: vcDNA=SeqID_79839; Strand=+; Position=1-92
MMNIRSNGKIRFAVSCSSNMNRSMEAHFFL

SEQ ID NO: 153417 - protein, 133 aa, Heterodera glycines
  Coding regions on vcDNA: vcDNA=SeqID_79840; Strand=+; Position=1 -257,705-849
MRIQSVARTGDPNLGRSLIQGPDHWLIHPFPRIRIPLFLSFSFVSWVRTSAPSLVAPEVCWHAAGCPSLPENEMEIRVEKEENGMSALADSPEVHYSCRLRIRAHRPRIAINTYHVNTTPLSTVLIIARVIVD

SEQ ID NO: 153418 - protein, 116 aa, Heterodera glycines
  Coding regions on vcDNA: vcDNA=SeqID_79841; Strand=+; Position=1 -197,427-512,960-1027
MPRIPWPRGLMWRYSLQYKALNFKQSFPFSITSVFNATLFTDCLYHRLLFGNGLGIGRQSAMLDEFDGFWRWALSGAAVVSIIWLGILTALMVAAFIRMKTIATARTVDRIPMPTF

SEQ ID NO: 153419 - protein, 118 aa, Heterodera glycines
  Coding regions on vcDNA: vcDNA=SeqID_79842; Strand=-; Position=1 -229,564-691
MPPYHRLAKSLSPSFKSVPFLRQRCSSFDRIGAVLPVKTARLYSRLYDALNGNAGNRRKASTPHPNIFDDAPFNPLAILGPQENVWSSPDPDPKVPSTSAAWEHNYVPISPDYAATLM

SEQ ID NO: 153420 - protein, 104 aa, Heterodera glycines
  misc_feature (88)..(88): Xaa can be any naturally occurring amino acid
  Coding regions on vcDNA: vcDNA=SeqID_79843; Strand=-; Position=1-398
  Homolog annotation: Hit_ID=CAE60185.1; Match level="QueryCoverage =75%, HitCoverage=37%, E-value=1e-14, Identity=55%"; Hit description =Hypothetical protein CBG03741 [Caenorhabditis briggsae]
EGYITNYSPFANTFSYVCHISSSFAYIQFADVDAVNTSTSLNDSLFLGRQIKVVPKRTNVPGLSSTNRPPRGMRGGRGSGRARVIVKXIYSERRSRGRPPRWQT

SEQ ID NO: 153421 - protein, 248 aa, Heterodera glycines
  Coding regions on vcDNA: vcDNA=SeqID_79844; Strand=-; Position=1 -193,1168-1424,1481-1777
MSSGSSGPEEGEIGAELFANEAFEEAEEPAGLVQFFQAESKRGRELIRSGGFEYAFEADSGLQEVTINSRDFAVQSLSQIWGHISQLRDIFSYLGVYLKFPPDDCADASDGQALAKWLFLPRPDAVPKVLKCSFEFDEEQWSTKINGLIAAFSTASSPVNFIIGIAYSSAIDAFNVPFNLTNELTGERLTLNTAKNKYRHYLLIRCPISRDENKWTNWEKEALELRFWDQWNIIEIAIVEEETGEWSA

SEQ ID NO: 153422 - protein, 109 aa, Heterodera glycines
  misc_feature (56)..(56): Xaa can be any naturally occurring amino acid
  misc_feature (75)..(75): Xaa can be any naturally occurring amino acid
  misc_feature (95)..(95): Xaa can be any naturally occurring amino acid
  Coding regions on vcDNA: vcDNA=SeqID_79845; Strand=-; Position=1-383
  Homolog annotation: Hit_ID=XP_453846.1; Match level="QueryCoverage =96%, HitCoverage=89%, E-value=8e-18, Identity=50%"; Hit description =unnamed protein product [Kluyveromyces lactis] emb|CAH00942.1| unnamed protein product [Kluyveromyces lac
NHGKFSPVFQPLSGKDKHADFASVARVHPRTSKGITGLLLLNFVRLSADTPSKKLXTEAMSQLFSRLESRSLSEXARQLAPRTKIGHAPPSSESXKSYQSVNPYGVRAG

SEQ ID NO: 153423 - protein, 551 aa, Heterodera glycines
  Coding regions on vcDNA: vcDNA=SeqID_79846; Strand=-; Position=1-1656
MPKYGHKIWTKMPKYGNMDINREIWKNMDIEILLFCLHLCRLFSHQVYRFLAMVIYPGVNTRSAHRKLLWNHFGPFKILDLTDSTASVIPIDKPNFEPIKVPIERLVKVPEGVPNISTLPRGKNPFKNQLNALISVVCLISREMENEPCGKSAAMEKIKDRETENETTNLGNSQKLEHLGRHLIGQLRTIANSVGGKVMETENSCGPLLWDTQCGGLGIEHRNCVQMTAADLDPVLERAGLGLKVIRKWKKIQNGDECGDFKVIGTPMKALLSNFLLKSNAVSSVAGGRKLTQLIVSAPVGFELITYSGAREDQVKIGNFPTENDIESAFTAWVERCAVTRDKLLKTGYTPIEVPMPNVVAELPESEKLGWNEVLKKASFVLGKVRATTIHRKPLFVEKPRVIVGDSSAKQLLKMWPKSQFIGTEEGTITEVIRAFYGAILSSKVKAVIVMIGRDSIRGEETIENVLERVGRLEQLLKRFSHAPVFWLRPPFIKEKMIEYEELIIRMKEHFGTAQGNVKFVKRQRRRDDQCWNCGAMAPVSIPTMCQTMAK

SEQ ID NO: 153424 - protein, 40 aa, Heterodera glycines
  Coding regions on vcDNA: vcDNA=SeqID_79847; Strand=-; Position=1-120
GTSKALLIIYNFYFPLHSIASTVVYLYSTPFQFHPHFSDV

SEQ ID NO: 153425 - protein, 445 aa, Heterodera glycines
  Coding regions on vcDNA: vcDNA=SeqID_79848; Strand=+; Position=1 -148,389-602,941-1045,1163-1366,1579-1752,2394-2603,2670-2822,2876 -2987
  Homolog annotation: Hit_ID=CAE72599.1; Match level="QueryCoverage =97%, HitCoverage=41%, E-value=3e-79, Identity=36%"; Hit description =Hypothetical protein CBG19789 [Caenorhabditis briggsae]
VPFFRLIFSHFPLRIRFSEVELFLQYIDYFLDADIARKCSIREWWSLGCPVPLLAMAWHFSTQSVNFLIPTLLLMVLLNSCSFKPPTRRRSDRLKEGVDKQSLASSKPAKPSKRAKTGLCKMLCVHEQLLQYFDLHEFECLHFPTYELPLKLPPRPWLDTGHCGPAYTYAQNVVRKLEPYPDMDPTEMMRLRVGDRHSRARPVFDALNLLGATPWIINKEMLCHMRRTLEMSYDGRHREYLRPLAVPVHPATFDVVQTEGRVGTRGADGGGVGRSDSISISSALFRCEQNSLHCWLVYRLTLAQHFANSVLYFPHNIDFRGRAYPISPQINHMGDDLNRGLLKFAAGPLGERGLEWLKLHCVNITGRKKRSSLRERLKFAEENLSLLTSVANDPFDLAFWWRDSEEPWQAFWWRDSEEPWQTLAACIELRDALSRDRPEDFVSHL

SEQ ID NO: 153426 - protein, 29 aa, Heterodera glycines
  Coding regions on vcDNA: vcDNA=SeqID_79849; Strand=-; Position=1 -40,794-843
MQNFLLNIIVNEDVFVKLLEMKKGASKIS

SEQ ID NO: 153427 - protein, 134 aa, Heterodera glycines
  Coding regions on vcDNA: vcDNA=SeqID_79850; Strand=-; Position=1 -294,354-461
MSHQPFANFEIVRLEAMIIGLEIDKDQLQRDVYHLKNRKTQIHNKKIELLQQKEQLIREISVLRETKATLVNETKDLREEILELRDMDGSKDDDPLCARNYACIPCGHRALCNRCAETVSIDGRCPFCREELIG

SEQ ID NO: 153428 - protein, 111 aa, Heterodera glycines
  Coding regions on vcDNA: vcDNA=SeqID_79851; Strand=+; Position=1-336
MKHTKKMLLVPESEYLALINLLKGGAGGTDSLQAEKAAIDASIQKNLNDNKTGADVKMKRHSWLYKQRHQLKDMIENKPQKVIVENATGTAPKTLPRIWAYRNQTSTSLKN

SEQ ID NO: 153429 - protein, 162 aa, Heterodera glycines
  Coding regions on vcDNA: vcDNA=SeqID_79852; Strand=+; Position=1 -324,622-786
  Homolog annotation: Hit_ID=NP_508504.2; Match level="QueryCoverage =97%, HitCoverage=5%, E-value=8e-44, Identity=56%"; Hit description =non-muscle myosin (nmy-1) [Caenorhabditis elegans] gb|AAA83339.2| Non-muscle myosin protein 1 [Caenorhabdi
MGMTEMNESVFGVRTKKGMFRTVGHMHKEQLTRLMQTLRNTFPHFVRCIVPNHEKKPRKIQSMLVSFSVLLHAQCRNMVRRETIFMALNNEWYIYQQICKGLNRTPDLVLEQLRCNGVLEGIRICRQGFPNRIPFQEFRHRYEILTPNLIPKGFMDGKEAAK

SEQ ID NO: 153430 - protein, 320 aa, Heterodera glycines
  Coding regions on vcDNA: vcDNA=SeqID_79853; Strand=+; Position=1 -303,476-616,942-1063,1453-1607,2093-2331,2480-2482
  Homolog annotation: Hit_ID=CAE58816.1; Match level="QueryCoverage =93%, HitCoverage=28%, E-value=6e-27, Identity=26%"; Hit description =Hypothetical protein CBG02025 [Caenorhabditis briggsae]
MSRLWHFLCALFASVFFTSSPLQTESEERADAEEMASDLKQKNVNMQEMLNDYWMRIEENEDTQTKLVEENKKLNETNKDLEEQLEQEEQARQKLQLDKKNDLYAQLQDAFAKLQAEKQSLEARIGLLSNQLQEEEDKNKQSVKYRHKDEVTRDICVYCRNRTFCARTYAPHFLKGIHSFRHLYRIQDCADDDAATIAALQKQARKLESQLEEVREDSENEKKQKLGLQSKVRQLEQELSGLLEQQDEQEAEHRQLLNANALLKQQLKEAQKKTDDDIVAQLEEQRKRSQKELAEAMQALADSEQAQKRAEQSKKKVQQE

SEQ ID NO: 153431 - protein, 54 aa, Heterodera glycines
  Coding regions on vcDNA: vcDNA=SeqID_79854; Strand=-; Position=1-162
MSVASRRCRLSPMMLSQPTVCVIFFGCCMMNWSTRLRKNCAPYLVGQTNDGGYT

SEQ ID NO: 153432 - protein, 133 aa, Heterodera glycines
  Coding regions on vcDNA: vcDNA=SeqID_79855; Strand=+; Position=1 -54,203-550
  Homolog annotation: Hit_ID=NP_492439.1; Match level="QueryCoverage =88%, HitCoverage=67%, E-value=7e-11, Identity=32%"; Hit description =putative protein, nematode specific (19.0 kD) (1J648) [Caenorhabditis elegans] emb|CAB63307.1| Hypothetic
MAGKLRQHSLSSVRKLQELLHDCNVQLATVRSQTQQIGTAADSAQLRRELDNNAKVGLPIATETLEENSKGTIWHFYRSANASRFGFVIMNCIKRQFVLCSQQLLISYHFRFRSSPNFTPDRQTKKCICICWH

SEQ ID NO: 153433 - protein, 262 aa, Heterodera glycines
  Coding regions on vcDNA: vcDNA=SeqID_79856; Strand=-; Position=1 -163,211-356,405-720,771-934
MSEFAGESDGRSRFSDAVYITGSQWKIEAKIRKITEGTDEKKYLGFYLWCDAKEGGPWNCVFSATFRIVSGKTEAENSIGKLCDYVINRPCVGCGFKNFITFAELMDPNNGFYNRKEDKLTLTIDVTVEYEKREKLILDQSKSNGTIEMEIEKVSEFAREIFLSERKSETMHIKGLQWKILAEIEKKNESTGNEKCLGFSLLCHAKEEDTNWNCKCTATFRIVSQKSGVTDIKREFSEERTFNSESKASGFPDFISFAVCHN

SEQ ID NO: 153434 - protein, 111 aa, Heterodera glycines
  Coding regions on vcDNA: vcDNA=SeqID_79857; Strand=-; Position=1 -73,124-233,316-466
MLSFIYTDDLSELNGDNAMAVLYAAKKFNIPGLVRPSVQIPISELRNIFLAYNQALIFELEDFACKCLRYICQNAAHLFGSDQFLQITRMCFAIFSRVIVCYSTMNLNLEN

SEQ ID NO: 153435 - protein, 48 aa, Heterodera glycines
  Coding regions on vcDNA: vcDNA=SeqID_79858; Strand=-; Position=1 -49,346-443
MTELERMQRMNLENENDNRQRSFSPDPTITEFTADQGNYSINWINNYS

SEQ ID NO: 153436 - protein, 73 aa, Heterodera glycines
  Coding regions on vcDNA: vcDNA=SeqID_79859; Strand=+; Position=1-222
MRRFVNSAKCQRFVNSTIRQLDDSSTQPKCDDSSTQPNVNDSSTQRFVNSTIRQPSQNVTIRQLNQYYLKNGT

SEQ ID NO: 153437 - protein, 96 aa, Heterodera glycines
  Coding regions on vcDNA: vcDNA=SeqID_79860; Strand=-; Position=1-360
MVIVCYSIIIWLPIVRTDWPIVRIGWSFVRPIPILSPSVVYCCCCCCCSSLPLRLHLFHQRLQVFVLVAVLVNLHVRVHEQTFEPFVHHYVAQQCV

SEQ ID NO: 153438 - protein, 189 aa, Heterodera glycines
  Coding regions on vcDNA: vcDNA=SeqID_79861; Strand=+; Position=1-569
  Homolog annotation: Hit_ID=XP_309989.1; Match level="QueryCoverage =91%, HitCoverage=64%, E-value=1e-24, Identity=36%"; Hit description =ENSANGP00000015194 [Anopheles gambiae] ref|XP_319667.1| ENSANGP00000022407 [Anopheles gambiae]
MDAQQLQQLLNALQQMVTNAAPQNATPANLSNANLASSIDARLSTFHYNPEVGTTFECWFKRYGKLIEDDGSTLPEASKVRLLLGKLGEEEYSKYRDTISPTQPDQVNWNDTISHLKQLFAETRSLFVRRYECFKIRQQPGQDVSSLIAQINASCENADLSLTKEQLKCIILVIALSDEHHDLRQKALK

SEQ ID NO: 153439 - protein, 41 aa, Heterodera glycines; identical to SEQ ID NO: 129319
  Coding regions on vcDNA: vcDNA=SeqID_79862; Strand=-; Position=1 -49,464-540

SEQ ID NO: 153440 - protein, 1063 aa, Heterodera glycines
  Coding regions on vcDNA: vcDNA=SeqID_79863; Strand=+; Position=1 -310,1136-1239,1372-2413,3698-5430
  Homolog annotation: Hit_ID=T13996; Match level="QueryCoverage=51%, HitCoverage=44%, E-value=7e-88, Identity=34%"; Hit description=pol protein - fruit fly (Drosophila melanogaster) ZAM retrovirus-like element (fragment) emb|CAA04050.1| RNase
MVCQTHVEGTIWSLPIWLPCPKLKHTPSDTPIKQPIRLFRPNPFEQKSKAWVCRKVKKSLIEYTNPWNDVIIKQLPSENLPVLLDECKQMVQEKSCSEGILIQKARTAPCSEYRNIPILINGSLVQVDQITGSVTPLKVSKLTYLIEFDDSKVKGVLSSDWKEVRDEMVKQITGDWSQLRDWFILIICALSACDILIRILALVLEKYFNNLSLLQTFFGLTTNNTNQSRPPPPPPPPSPSNTCSVQSPNFSNHHVVLELGETSEGNPTQWPPSITRFSLLPKFESNNSPRLLNAMFPLNSKSFVTTIPAHADTIPLIALIDSAASSSIAPIKLKDKFICQNLNSSEVSITTAVGIPIPVTGSVPFSLHMANMLCSAHVHFAPDYLDIWDICDIIIGTETLERFPPILFDFHNKFLTFGYGPPTLFQSKSQNISDCQSSPSKNLLIYQNKVHFHPHIPSQINSSISPCILSQTCENSQHFNVPPPSIIDSLNNRLTRDDLGWNPTLIEPINGISAIPISNPSQSPKTIFANMTIATANEVSEDPDLHFFYEDPDHALFSISPQSDEGIIPDPSFKIDFSKSSVSGPDLQNLKNLCEEFSDIFSKSQYDLGSSTAGAHEIVTSTQEPITCKPHRTPFKYRDELKKHIEQLLKSGVMVQSDTPWVSNIVLVQKKDGGLCPCIDFRKLNEITIPDHYLLPRLDTIMEKIGHCHFYSSLDLSSGYFQIPLTKEASRKCGLIIEEGVFQMTHLPFGLRNATSAFARTMAHVLSGLDGFVVAYVDDILVFTKPPSFSDHLSALQTIFERFQRFNLKLSPKKCTFAASSMNFLGHTVSSKGYSPSLSRIEVIKNIPTPQNLKQVKRIVGMASFYRRHIPNFSTIVEPLTSLTKKEKKFIWDKAQEDALTRIKELLSQNPILTFPDYSQPFHIFTDASVIGQGAALMQKKNDLFSAVAYASRTLSAPERRWPPVQIELGAIVYALRTFKPYIYMSEIELHTDHRPLAYLQAKAQQHAHLARWLIELQNFNIKIVHISGKKNALADALSRLSESDPPQIPSDSQELQDIIEFP

SEQ ID NO: 153441 - protein, 89 aa, Heterodera glycines
  Coding regions on vcDNA: vcDNA=SeqID_79864; Strand=+; Position=1 -49,84-304
MFLGKKGNNLFDEIKLEQKNWSHKIKQKRKQILKGQTDTERIREEFEQQMEKMCEIAEENAKEEKAKLEKAIENATNSEEKEVLGQRIQ

SEQ ID NO: 153442 - protein, 254 aa, Heterodera glycines
  Coding regions on vcDNA: vcDNA=SeqID_79865; Strand=+; Position=1 -87,129-803
MLINSVFMIPFFISIFQQFLITFSIANSSVEDNMLFAFLKGQKEIQFSEYSRQKYEAHLGIMHFMRMNWQCDKIAVKFEEYERTKCPKYRKYLDILHEYLYREYIGIPTVKPKFVFKKRIEINGPLIYAVNCLVEIWLFYFKYYWLNTNFRIFIFNRFELKLLNEKRLNYKQKLSINEMILELAIDTANEWQTNESLDGIIQQNCGEKFEEYLKEMFKKSEEKAKKDKQWKANEINNGKHLIIKHSKFDDQGTW

SEQ ID NO: 153443 - protein, 109 aa, Heterodera glycines
  Coding regions on vcDNA: vcDNA=SeqID_79866; Strand=+; Position=149 -215,278-540
  Homolog annotation: Hit_ID=BAD62285.1; Match level="QueryCoverage =72%, HitCoverage=65%, E-value=1e-12, Identity=51%"; Hit description =putative glycine rich protein [Oryza sativa (japonica cultivar -group)] dbj|BAD61562.1| putative glycine ri
MNFALITLPFVLIGVASVCLGSGLYGDDYGGYGHHDPHHDGHHDGGYGYGHEAPHYGGDYGYGLHDRHYGGYGYGYGGPHHDDGYGGYRYGYGHPGSHGYGHGFAGFAL

SEQ ID NO: 153444 - protein, 604 aa, Heterodera glycines
  misc_feature (181)..(181): Xaa can be any naturally occurring amino acid
  misc_feature (219)..(219): Xaa can be any naturally occurring amino acid
  misc_feature (232)..(232): Xaa can be any naturally occurring amino acid
  Coding regions on vcDNA: vcDNA=SeqID_79867; Strand=-; Position=1 -141,190-439,1658-1871,2324-2613,2769-2892,2939-3109,3161-3341,3402 -3735
  Homolog annotation: Hit_ID=NP_491290.2; Match level="QueryCoverage =95%, HitCoverage=84%, E-value=4e-96, Identity=24%"; Hit description =UNCoordinated locomotion UNC-89, PHarynx Muscle abnormal PHM-1, UNC -89 (unc-89) [Caenorhabditis elegans]
RRSETDGGGIAKEEEAKVEEEAEKPKAIEVEKPTIRQGMQDQSLPKGSPLVLDIQVGGTPTDVQWGSPLVLDIQVGGTPTDVQWFRDGRPLDEASGVIAEDLGDGHFRLTVPEFNDGDFGRYAVKVSNEAGDAESVANITEKGGPKAPSVMVSVVVRVMVTVATVVVTVEPFNYYSWGQNXKIITRAKTHRSNSDQYKGQSDQSKIHFSRAFNVLLSNXVIESNFKIMISEXILAPEEQKPEIVRGLVPVSVRPGEPTKFEVEVKGPVRSVKWYKNGREMEQPETEQDGNCYRLIIHSAGPDDEADYKVVLSNLGGEAQSEAPLKLIKSLRFVRPLEDVTVPKGHRAVLMAETDRSPALAVKWFKEGKEAETDRSPALAVKWFKEGKELVPGDKAQPKRVSDTKFRLEVPDTDADDTAQYSVVFDREDFDREDEPGVECSCALTVLLPEEMPAEPPRFERPLREQTIPEEDELVLEVETQGKPHTVRWYKNGQYKNGQQLSPSDRSRMEKLGPDRFRLVVPSALQDDTGDYACEIANDAGLARCEARQTVEPFSEFIRPLQDLSVVEGERAEFWCETNRRSVRLVHNAAYREDIIKMRLITDER

SEQ ID NO: 153445 - protein, 103 aa, Heterodera glycines
  Coding regions on vcDNA: vcDNA=SeqID_79868; Strand=-; Position=1 -49,153-186,1011-1133,1206-1311
MAPATGPSSVAAITWNVLVAPSREHICRFDLKIIPKFSMFSKAYFILVIFGSIIGGTFGTDNEDEQWEGFEFMNRGERISKFFKNLFFMRIASILCTKHKIDR

SEQ ID NO: 153446 - protein, 158 aa, Heterodera glycines
  Coding regions on vcDNA: vcDNA=SeqID_79869; Strand=-; Position=1 -235,634-875
MPPKSKPNRTHNIRQTAKIIRLLGCCQFGNQSWHKHSLPSHHVFGRNVTPICPCRFMFPSAKIGPLYWAGPFLSGLIHSPAEVKFELQIRKTMCKFFRGIFPISFFFMPFARHAIFSSKCVEKRGEEKWCLAPSSRGCKSCRYGTDDWMALTYLGMPF

SEQ ID NO: 153447 - protein, 126 aa, Heterodera glycines
  Coding regions on vcDNA: vcDNA=SeqID_79870; Strand=+; Position=1 -31,845-1159,1267-1301
MPKEDFTKSVVPTGVLTIEEVNSVYQHYSHQNLSDATGLFPLKFPTHRRNKNEGTIEMEIEKVSEFALEPVGSGRFSDAMDIGGFPWKIRAQIKTKNESNEKWLGFYLCYDGPKKEVFKYYLNHSN

SEQ ID NO: 153448 - protein, 264 aa, Heterodera glycines
  Coding regions on vcDNA: vcDNA=SeqID_79871; Strand=+; Position=1 -315,598-740,1191-1529
  Homolog annotation: Hit_ID=AAQ82908.1; Match level="QueryCoverage =60%, HitCoverage=13%, E-value=3e-11, Identity=27%"; Hit description =ubiquitin-specific protease 7 isoform [Homo sapiens]
STGVLTIEEVNSVYQHYSHQNLSDATGLFPLKFPTHRRNKNKGTIEMEIEKVSEFALEPVGSRRFSDAMDIGGFPWKIRAQIKTKNESNEKWLGFYLCNDGPKKENWSCKSSATLRIVSQKNGTEDLIGRIGDRIFNKEWNNYGFNYFISFAELLNPGKGFYDKDEDKVTLAIDVIVDEPKTEKIISDPNKSNGTLSMEIEKLSEFAREVIRSDRISETAVYIKGMPWKISAQIKTKSNEKCLGFFLLCDASKKGLVIKLLIEI

SEQ ID NO: 153449 - protein, 29 aa, Heterodera glycines
  Coding regions on vcDNA: vcDNA=SeqID_79872; Strand=+; Position=1 -63,324-350
MEQSRVTHFAVQNQMIEAILKIFDRNDGK

SEQ ID NO: 153450 - protein, 26 aa, Heterodera glycines
  Coding regions on vcDNA: vcDNA=SeqID_79873; Strand=-; Position=1 -42,617-655
MAKGHIIGNSSGCTWLFTSSFDLIGH

SEQ ID NO: 153451 - protein, 79 aa, Heterodera glycines
  Coding regions on vcDNA: vcDNA=SeqID_79874; Strand=+; Position=1 -115,1037-1161
MEKQQQSKSDDHQQSDQKQQQQKKAVAVVVPRIVRKENVLPRPSFPILPMFGQQPMEIDAESPKGIRPTGPGWMAYIYI

SEQ ID NO: 153452 - protein, 223 aa, Heterodera glycines
  Coding regions on vcDNA: vcDNA=SeqID_79875; Strand=-; Position=1-672
MKLLPLFFLIVILIIKIDQFGAEKKKLKQKSFDEIFGEKWEEKEEERRNELKKREIIAKFYKIKEKIKQKGRKYPRKEWKKIERKIAKKLGTNRNKIYKWIKEFGLQKRKSYKSKTDEEKRQIIQKFIEMTNEFKQKGKYSLKEWNKNYAEICKKIGVSKGTIIKWKKQFGISKKIITKEEKMEKIKIYWEIKKENPKMSERAIAKMMKIDRTNISKWKKLFG

SEQ ID NO: 153453 - protein, 118 aa, Heterodera glycines
  Coding regions on vcDNA: vcDNA=SeqID_79876; Strand=+; Position=1-359
LINSIDNVRSKLISDGVFKNTFNRNAKASNEFQQLINTLEHKFVEQIGQQNEEDGQENKRYSLVDKVTFWQNSVRVSEKAGTEVLDELEEMRAKFVQNADEFDQQEWIFNSKKGFWLI

SEQ ID NO: 153454 - protein, 45 aa, Heterodera glycines
  Coding regions on vcDNA: vcDNA=SeqID_79877; Strand=-; Position=1 -12,92-217
MGVWHMSICISGQVAKPFYLHYLSLRFNSLMEQKIFLYFLYHYFN

SEQ ID NO: 153455 - protein, 118 aa, Heterodera glycines; identical to SEQ ID NO: 125192
  Coding regions on vcDNA: vcDNA=SeqID_79878; Strand=-; Position=1 -157,543-742

SEQ ID NO: 153456 - protein, 298 aa, Heterodera glycines
  Coding regions on vcDNA: vcDNA=SeqID_79879; Strand=-; Position=1 -699,900-1043,1111-1164
  Homolog annotation: Hit_ID=CAE69590.1; Match level="QueryCoverage =92%, HitCoverage=13%, E-value=1e-36, Identity=33%"; Hit description =Hypothetical protein CBG15812 [Caenorhabditis briggsae]
MATGIALTLTDCVMWFIDENTGKFSDRFSDDQFSLFDAIHQPRPLVKNNVREIIDMANNRRLTVVEAEDANILRMRVGRFIDLNGRTEMSLHDAYQLKLVQKPQTLAEVIDSGSLDNDGRFIDGVKPRTLLEAICSGMLDPDVAHIKAGPGDELISIGEALKRGRLTPKGEIVLTLGEVGIHRGEKINLFMAHERGLLTSRVRHTIFDVKGVRNAADGSIMSFKEARDAGILQLQFDGLETRLNEASARGEINSGLAEILVAPCGLSNNGLPLSLVRAFLKYQVRTPRPSEIKFSLFG

SEQ ID NO: 153457 - protein, 53 aa, Heterodera glycines
  Coding regions on vcDNA: vcDNA=SeqID_79880; Strand=+; Position=1 -59,807-909
MVKPSVFRYLSLEFNSTLVQKLFTITAHGSRESRGFWGVMITDHGNHGVFGVS

SEQ ID NO: 153458 - protein, 73 aa, Heterodera glycines
  Coding regions on vcDNA: vcDNA=SeqID_79881; Strand=-; Position=1-222
MNCKNVGTDHWPNFVKSELQFSTQANEDGQLATRSEKSLKKTEKIDDIMVHESETKANSNCLGVMNYGRLSTH

SEQ ID NO: 153459 - protein, 67 aa, Heterodera glycines
  Coding regions on vcDNA: vcDNA=SeqID_79882; Strand=+; Position=1 -85,957-1075
MRANGPNGRRRPPSGTSMNSGTELFFPIVLNMFLKRNHYAEYGSFPKLYHGRVLNLFLFCVLRGILV

SEQ ID NO: 153460 - protein, 469 aa, Heterodera glycines
  Coding regions on vcDNA: vcDNA=SeqID_79883; Strand=-; Position=1-1417
  Homolog annotation: Hit_ID=NP_508294.1; Match level="QueryCoverage =92%, HitCoverage=37%, E-value=6e-61, Identity=35%"; Hit description =predicted CDS, endonuclease/exonuclease/phosphatase family and RNA -directed DNA polymerase (XC178) [Caeno
NKLENNNNTSIDSIPNIFLKNCKENLVYPLFHIFCFSMMTGQVPNIWKKSIIYPVPKIPNPINPVDFRPISLLCSISKILEEILPRKTNFVETNNVLPNCQHGFRRKHSVTTQLLEVIDDFSLALENKKSIDVIYFDLAKAFDTVPHERLVSKLKNIGINGTLLKWLQNYLQNRTFFVRVGSAFSDEFPCLSGVPQGSNLGPLLFLIYISDLPNFCKTENVEIKLFADDLKAYSILSKNTISPLHSFINKFLNYCELNGLKIAPNKCLVSHLGPKNPNECYLINNIPILKNEEGEPVRDLGIYFSNNLKWEKHIEFITKKAIRTSFALLKSLKTKSPKILINIFNVYCRSILEFGSPIFNPYMKKDIDALENVQKTFLRIVFRRNNNKDDIPGYNELLQLFKQESLLKRRIKIDLKLFHDIILEKIHIQHNDSFSTYSELKNDFIIKTGSTNVRYHSFFIRTSRLYRCL

SEQ ID NO: 153461 - protein, 236 aa, Heterodera glycines
  Coding regions on vcDNA: vcDNA=SeqID_79884; Strand=-; Position=1 -69,156-797
MVYGHITLGFIWTKAKWKKQANRTSNCPIKIIMATDIKNILNRLSSIETLLSNNNNNTLASQMAEQFNAIAERLSEIERKINSNNNANDSAEEKERKRSLVLIGLPEAVAEKPSERAKEDAETVAEVLDALDVEVCPQMVYRMGRRIDEKRKGPRLVKVVLPATTFQRFALAQWGRNRTELKQRVGWQRLLVRPSLTKEELAAERETREQRRMNYEESKKNEMVTTRRGGKMEKNF

SEQ ID NO: 153462 - protein, 222 aa, Heterodera glycines
  Coding regions on vcDNA: vcDNA=SeqID_79885; Strand=+; Position=1-666
MALLSDRFDVLVDAHFDGKSEFTIWRTIRIVKDEGPKAKLSVWTDGNVSIDGKRVEFPLPDHSLPNKICFKNLQIQSVLTFVYAKAFLSFFSYIDHSVIKFLRSKKPIWDRRGTNLEVLVDAFDTDVQPIWDVFVSQIWPIFATNIRHLCIPNGAHLDNLRRLISPTFLTDLDQLISIDSGALLRDGIADDGPNATAGQALAKWLHTPTKNGQPKQLRFLAY

SEQ ID NO: 153463 - protein, 172 aa, Heterodera glycines
  Coding regions on vcDNA: vcDNA=SeqID_79886; Strand=-; Position=1 -151,194-443,1128-1245
MEQPNQEIKTKRNKEKLEHEGSLYVLHKLSDDELRKYWRCEFFGANDKCKGRLHTDINGNVLKIIGSHTCDMSAAQVECQRRITQLKRRAVETCEAPATIRAQVLQNTATPVLAAFPTKAATKKVNVCKFLCQSRKQALTRKRTPREDGHAKTEFQSCNRIRKLNFILFIYR

SEQ ID NO: 153464 - protein, 51 aa, Heterodera glycines
  Coding regions on vcDNA: vcDNA=SeqID_79887; Strand=+; Position=1-153
MQRQQKQHIFGAMPAQQQQQQMDEGGNAECGEYDEDLQEIPAPVQEQQMNM

SEQ ID NO: 153465 - protein, 31 aa, Heterodera glycines
  Coding regions on vcDNA: vcDNA=SeqID_79888; Strand=-; Position=1-94
FRNWQTGKGVLGPVGKVLLIRDLFAHFPSMM

SEQ ID NO: 153466 - protein, 42 aa, Heterodera glycines
  Coding regions on vcDNA: vcDNA=SeqID_79889; Strand=-; Position=1 -35,1097-1190
MAGQRVADEQQGGFGVANHESDIYFCQIRIPNPYSSYFRTIK

SEQ ID NO: 153467 - protein, 120 aa, Heterodera glycines
  Coding regions on vcDNA: vcDNA=SeqID_79890; Strand=+; Position=1 -71,269-442,1332-1447
  Homolog annotation: Hit_ID=XP_397245.1; Match level="QueryCoverage =82%, HitCoverage=26%, E-value=3e-12, Identity=33%"; Hit description =similar to red-1 [Apis mellifera]
LGLRFPYGDEKLIQKIAKAYDICGIPSFILVDENFSLLTRNGRSVCLSDPHGYPWRRKALYELTEHTVHRLSEMPSLILFTEGSAEDIEFSCQILSPCAESVFTQQNESPQIAASLPAKL

SEQ ID NO: 153468 - protein, 285 aa, Heterodera glycines
  misc_feature (5)..(5): Xaa can be any naturally occurring amino acid
  misc_feature (281)..(281): Xaa can be any naturally occurring amino acid
  Coding regions on vcDNA: vcDNA=SeqID_79891; Strand=+; Position=1 -123,175-414,475-552,675-718,774-831,984-1086,1166-1285
  Homolog annotation: Hit_ID=CAE63323.1; Match level="QueryCoverage =94%, HitCoverage=40%, E-value=2e-55, Identity=42%"; Hit description =Hypothetical protein CBG07714 [Caenorhabditis briggsae]
ERQIXKRAIHRRLIYSDANSIPPDQPHFPITGFCPAECTQKFPIDGIYIFASFPIDGIYIFASQLHSHLTGRKLHSSVIRGGSKVTEINRDDHYSPHWQHIRSLRPFVHVRRGDVISTTCVYETRGMKHWTWGGYGIEDEMCVGGYGIEDEMCVNYVHYYPASEVNFDKSAVSNASLHAFFARLRGVKNKQMNIHRGVKNKQMNIHEKYSAVKWMAKFAALRELYAVASLNVACLQHSGDLFPVKIIRPPHKLESRAEARVRHGIVDKRRDGDECLALNDXLLSL

SEQ ID NO: 153469 - protein, 134 aa, Heterodera glycines
  Coding regions on vcDNA: vcDNA=SeqID_79892; Strand=+; Position=1 -80,137-242,928-1001,1053-1197
GSSSPSAGGCSPPLAIALYVCSMFLILILFYVAFRCARGRNNEYILANNGPVRLARAIAPRADADGPEMPDERQLWLEMFESGDYELLSWFGRDRAKQIMEDLRKFAEETGRECTHVKMLLDKINRGMINGKKE

SEQ ID NO: 153470 - protein, 21 aa, Heterodera glycines
  Coding regions on vcDNA: vcDNA=SeqID_79893; Strand=-; Position=1-62
FDVVVIRCVIPLGMMSKSPYS

SEQ ID NO: 153471 - protein, 52 aa, Heterodera glycines
  Coding regions on vcDNA: vcDNA=SeqID_79894; Strand=+; Position=1 -45,141-254
MSGSEPMSNEILNKSKILGLDDVKIYIRYKALINFYNITQAWIAWVGFTIIK

SEQ ID NO: 153472 - protein, 236 aa, Heterodera glycines
  Coding regions on vcDNA: vcDNA=SeqID_79895; Strand=-; Position=1-713
  Homolog annotation: Hit_ID=NP_500227.1; Match level="QueryCoverage =94%, HitCoverage=21%, E-value=2e-51, Identity=46%"; Hit description =predicted CDS, reverse transcriptase like family member (4D351) [Caenorhabditis elegans] gb|AAK68554.1| H
KKLPNKNGTSPDNISYKILKICHSSLSTVITDLFRISLDIGSLPDIWKESIVFPLFKKGDKNNPENYRPISLTCSLCRVMERILSKNIYNFLLKNKKISEFQFGFVRNRSTTSQLITVVEDWYEAIINGKNVDCIYIDFQKAFDSVPHELFLYKLEKIGIRGKLLMWIKDFLSNRTFRVKIGDDLSSSKKVGSGVPQGSVLGPLLFLIYINDLPDALPSGVKIKLYADDKLYICYK

SEQ ID NO: 153473 - protein, 23 aa, Heterodera glycines
  Coding regions on vcDNA: vcDNA=SeqID_79896; Strand=+; Position=1 -47,610-634
MMRATRVRFAFLSVVRVWSFPKN

SEQ ID NO: 153474 - protein, 159 aa, Heterodera glycines
  Coding regions on vcDNA: vcDNA=SeqID_79897; Strand=+; Position=1 -291,340-528
MSINLRDKKSLMENILPAVDISHTINGITVSSERIAVARTIPFDIVGKCKECKATECETEWCISKEGVTIWCTRFKISPRFVPFDVIYELPGYTFFKIRNKSRVFNVDHGSRSDACTQTPTPLYHLPPPPPPPKLPKRKQEQQQADAPAFFSALSAAVV

SEQ ID NO: 153475 - protein, 498 aa, Heterodera glycines
  Coding regions on vcDNA: vcDNA=SeqID_79898; Strand=+; Position=1 -74,130-600,676-883,929-1489,1535-1603,1846-1959
MTSKRNGTLQKGGPSTKKWDFRAIGNNFTEEMENYKLIDERSTICEKFGFTKNITEFRINSDVRRPDEAMRDAIDTMIKAAFKTTEERMKRKVRMFGMAITGAGLASPVWVPYRAYPQNNADVIMQEINKLGQSGDGDENKKTLLLSEPIMMKITCVTLPSGEGPRNVHKFDFGFKEHQRIRISNVDKFCLFYALVASKLYLEVHRNIFNRFMNSIVRQREAAYGLLRNCGIDINEYSYGVEHLSRVQNYLDEIYPGKYRVVAFEKSADPRKSIRVLWKGPMGRENVVPIFLENGHWDGLKNYVCFFNRGRKFCIDCECFYDKDIYHTFDCRARCYYCNKVGGVPCQKESGVKIECPKCCRYFYNLECYNYHQEHQTCKLWRLCVICDKTYRFNPKKDHECGETYCQLCSVSHDPKRGCYIMPIEEKEEKSVYRIVVWDSETSQDSIYKGDQKEHVINYISVILCLTTSAVPGRTRYRLSMDSKFMNSKCETRRNIQC

SEQ ID NO: 153476 - protein, 444 aa, Heterodera glycines
  Coding regions on vcDNA: vcDNA=SeqID_79899; Strand=+; Position=1-1337
SRRREEQQIPADIQQEEPFQPAPQPSIPIHPQLNRKRKAQYALNDVQESKKSLIGLEELRPPSLQQEASLRFKQKRTNKSRVTLPQHSNSLSLAKLHNPPRDLLAEAASAPLPDDDADDFELSQNHGSASQVQPPPPAPPLPSKAKKRKSNKVDEDIERKRIRIGSRKRDLLAEAASAPLPVDDGGDDFEPPQKPGTSAQVHPLPPGPPLPSKTKKRKSNKVEEDTERKRTRIGSRKRLSSPTVPKNQPKRQKNSGTERQSEEQRRQFADDQLLFSIPNSQLTNEQKRRRLQFVFNRNPVKYGVREDTILNNAGNPVTDSSVTQALEYIIERRAGRVPRFRQPPGTKLIRDRINRDLILRTWTAPPVPPRGAKRKLPQTDQEEELNQKSQKIRGTVQPRGRAQEGLMLPFPTRGVKRKTTAPPEATIEIPPKTQRLRPQKWKNQ

SEQ ID NO: 153477 - protein, 205 aa, Heterodera glycines
  Coding regions on vcDNA: vcDNA=SeqID_79900; Strand=+; Position=1-618
MKIGAPKKKIATKNHLKKYLEKNGRKKKMNRKREKLLKNSHKIKAKIKQKERKYSAKEWNKIELKIGKKLGTNRNKIYKWIKELGLYKCHNKSKTDVQKIEIVQKFNAMKNEYKQKGRKYSRKEWHQNYAEIGKKIGVNYGTIQKWKKQFGMNGKRITEKEKMEKMKMYWQMKGENPKMSDEKISKILKISQWTIFNWKKQFEKN

SEQ ID NO: 153478 - protein, 716 aa, Heterodera glycines
  Coding regions on vcDNA: vcDNA=SeqID_79901; Strand=+; Position=1-2149
  Homolog annotation: Hit_ID=XP_318550.1; Match level="QueryCoverage =99%, HitCoverage=71%, E-value=1e-178, Identity=44%"; Hit description= ENSANGP00000020240 [Anopheles gambiae]
MNRDSGAQATVISFKTWIKLGQPKLSPTDIETRNCNDIAFSTEGKFHCTVSCFDRPSKTLIAYVSSDLKHDLFGLPWIEEFELIPREILFPKSTKGKPNASINANVVKAPNPAIGITDESSLTAVLQKDFEEVFKNGLGHCAIKAHLILKPDARPIFCKARPVPHGAIEAVDTELDRLLQIGAVKPVEFSHWAAPILAVKKKNGKTRVCIDFSTGLNDSIELNRHPLPRPDVIYAALNGAAFFSNLDLRDAYLQMELDEKSKHLCTINTHRGLFQCQRLPFGVKSAPSIFQHLMDQICAGIPGVFSYLDDCLIASKTLEDHVNALHTLFQRIKDFGLRIQLEKCKFLQKELLFLGHIVSSNGIRPDPARSEAIQKMPAPHDKTTLRSFLGALNYYGRFVKPMREIRAPLDQLLRKDESWSWGDDQQSAFEQAKAIMVSELLLTHYDPTLPIVVAADASKDGIGATISHIFPDKKEKVIEHASTVLTNAQQNYSQIEKEALALVFAVQKFHRMLFGRKFTLLTDHKPLLAIFGSKKGIPIYAASRLQRWALIMANYDFEIRYINTASFGQADVLSRLIANYPRPEEDILIANICTETECYISTILQTKTEQLPVTADEIAEATPKDEILKKILAFTKSNWPKKSSDPDIAPYFPKRENILEIEGCLLFQNRVIVPQSFRNRMLKSLHMAHPGIVRMKALARQHVYWPGMDSEIERIV

SEQ ID NO: 153479 - protein, 120 aa, Heterodera glycines
  Coding regions on vcDNA: vcDNA=SeqID_79902; Strand=+; Position=1-529
MALTREPLTIDFNCKSRQEAIDFNCSLGVQACTDCIPDHSSGLVNCNCRSHNLEKLLESPERRLPLNIKNYQLRNTGRKVIALTGFSPVQLNLQIEGLQMALELHQSLCTILPLNISGCY

SEQ ID NO: 153480 - protein, 178 aa, Heterodera glycines
  Coding regions on vcDNA: vcDNA=SeqID_79903; Strand=-; Position=1 -88,902-1096,1344-1400,1717-1911
LKKAYESDVMYGTMQDFHLHESSDEIYGTNDDVTHERELRLAFNSPGMENLNDQFLLLTKVALPLALKALKDAGGIIGKDGPTKEQEAALKQYLTSFLRWNVEQSSKARSNQTEAESANADEEEGEESSEMLKPQISKHLEEFIELEREGWVNSALQSLSLSEQVHYIKQAEELDNRM

SEQ ID NO: 153481 - protein, 155 aa, Heterodera glycines
  Coding regions on vcDNA: vcDNA=SeqID_79904; Strand=+; Position=1 -159,457-567,679-734,1018-1159
  Homolog annotation: Hit_ID=CAE66607.1; Match level="QueryCoverage =93%, HitCoverage=19%, E-value=4e-59, Identity=72%"; Hit description =Hypothetical protein CBG11932 [Caenorhabditis briggsae]
MPFTFSLNFLSAFAGGAPFGAMSVADLGSLTRLEDKIRLLQEDLESERELRNRIEANRKREAELQKLRKLLEESQLEAEDALNVLRKKHNDACLDYNEQIEGLQKKNAKIDRERQRLQHEVIELTATIDQVQKEKHAAEKAAERFEAQAIDLANK

SEQ ID NO: 153482 - protein, 120 aa, Heterodera glycines
  Coding regions on vcDNA: vcDNA=SeqID_79905; Strand=+; Position=1 -157,362-481,642-727
  Homolog annotation: Hit_ID=AAF72796.1; Match level="QueryCoverage =43%, HitCoverage=5%, E-value=1e-21, Identity=96%"; Hit description =paramyosin [Anisakis simplex] sp|Q9NJA9|MYSP_ANISI Paramyosin (Allergen Ani s 2)
EAEHKLSLANTEISQWKSKFDAEVALHHEEVEDLRKKMMQKQAEYEEQIEIVHAAKDFAAGEGQVALAVRGRSAHCGPGEGAEHHRHTGEGQAMLTMVRIEGLTRLIYARNKPGVNLATN

SEQ ID NO: 153483 - protein, 506 aa, Heterodera glycines
  Coding regions on vcDNA: vcDNA=SeqID_79906; Strand=+; Position=1-1521
MDSQKSPKVNGKNLMGTEIKDFLGKFDGIVAQLRAIVFQGTEEVMETDNIDFALTWDMQCGGLGPEHRNCVQLTTADLDPVLERAGFGLKVAESRLKPQNAKFGLKVVGTPLKALLATFLLKTNAISSSAAGRKLAQSVIGAPVGFELITFIGSREDQIKSGRIPVEEDLEAILEKWTECCAVTRTKLAKCGFGAINVPIPRSIEDLPEGEGKPWTELLGKAGFVLEKVKATSVLRKHQFVTSPRIIIGDSSAKQLEDLWPTSQFIGATQGSVGDVIRAFDAVALSSKVKVGVIIIGRDALIRNETADNVMEKIGRLIQLCAQFQHVQFFWLPPPFIRDQQIEHDMLIDRMKDHFALIRGNIRYVSTTPSGRSLLEIWRYGNGYNTEHVSAEGTMKEKGLYMLKAWLMTQVNDFPGDRELGIEKKRAESEEKGRGKTEGKNVRTGESDRQPSHRPIRSPFRHTGHAFHRSNRTPTHHPYANPVDRHQPQPFRMPNQQGPSRRQFQR

SEQ ID NO: 153484 - protein, 426 aa, Heterodera glycines
  Coding regions on vcDNA: vcDNA=SeqID_79907; Strand=-; Position=1 -149,633-807,862-1114,1195-1298,1509-2105
MPTLLKGPFLKEFPNGRVELVPWEQFSMGQYLHVLVASLRKYAALYKQKQISKKMTKNFPSLHRCYVIIQNVAEHSGSAEEDTERITSIVYSVVSSDGFRQRCNQIKVQKLDLLKNSAVATNAAGQPIVVASGHLPLRIERLPRRGTGSSASRSATTVTTARGEGQQQQTTTMTTGADKQWGEGKTADGATGEEYDWSNAMGSSRPALIRVRFRNREAAIAFCQLFRERQIFLRQKRQQQPKGQDDEGIVRQHGTGIDCGDRETDAGNEEEKEEGDGQQTDSYSDLSDLDVFSSCDEDTNGGHEKTPPVTREETATKEHGKKEGGETKTETEESVGEEGQQQKTESKAKATEEGDTNNNTKASNSGMKRKKMQSSASQRHRHGHCSERRQKHKQHLLDSLICGAFAHRDLTPPELALGYALRQHCR

SEQ ID NO: 153485 - protein, 22 aa, Heterodera glycines
  Coding regions on vcDNA: vcDNA=SeqID_79908; Strand=+; Position=1 -20,699-747
MSNSKDNLFRKNCHFSYFSTKR

SEQ ID NO: 153486 - protein, 97 aa, Heterodera glycines
  Coding regions on vcDNA: vcDNA=SeqID_79909; Strand=-; Position=1-294
MNLNKQEEYSTEEWKQNYAKICKKIGICYGTICRWKKQFGIRCKITEDEKMEKMKIYWQIKKENPKMSDKEIGKTLKISRSSIFNSKNQLEKERTEE

SEQ ID NO: 153487 - protein, 89 aa, Heterodera glycines
  Coding regions on vcDNA: vcDNA=SeqID_79910; Strand=-; Position=1-270
MQIGYVISRKGMMYDVHFQDGYTGRYHATIWRSIHRPSMKDLDLWTPNRKWKRSPRELQWQTLNAEEEWTCRTDVSRKRMDVSDEKDPF

SEQ ID NO: 153488 - protein, 451 aa, Heterodera glycines
  Coding regions on vcDNA: vcDNA=SeqID_79911; Strand=+; Position=1 -495,588-1445
  Homolog annotation: Hit_ID=XP_318550.1; Match level="QueryCoverage =91%, HitCoverage=44%, E-value=3e-76, Identity=36%"; Hit description =ENSANGP00000020240 [Anopheles gambiae]
MILANYDFEIRYVNTTSFGQADVLSRLIANYPRPEEDILIANICADTDCFINSVFENRIDQIPVTTTEISSAMANDQPLQMVLQFLRNGWPTKVTESEISPYFPKRDKIFEVDNCLLYEDRVIVPTSLRSRILKALHIAHPGIVRMKALARRHVYWPGMDSAIEKRVHIDFAGPCSDGHQYLILIDSFSKCPEVYRMNTISAYATIFVLRSIIFRLGIPEEIVSDNGTQFRSAEFATFCKEFGIKHIFTPPFHPQSNGQVERFVDTFKRSMKKMSKSEKDWIEKMLFSYRTTPHVALNGFSPDQLFFGRKLRTKLTLIHPKGEKAENFDQKSFKKGQSKYTDKMAQNFDRKHGSKLINFLPNDHVLLINYRNNKTEWLQGKIVERLHKSPTYRVYVPVLRRVVHRHANQLRRRHLLEDEAEKEAPQVEQPPPVVEPPRQPQQIQPANSPLK

SEQ ID NO: 153489 - protein, 105 aa, Heterodera glycines
  Coding regions on vcDNA: vcDNA=SeqID_79912; Strand=-; Position=1-316
MNKTEWNSEWKLQKIFREKHNYLKTIKEIDEILDTIKDINLEVKRRLKALKPNSPSESDQENESIDEEQENDDEEAGEEEDEDEKEYDSDQEDESQEMHSSDQTH

SEQ ID NO: 153490 - protein, 693 aa, Heterodera glycines
  Coding regions on vcDNA: vcDNA=SeqID_79913; Strand=-; Position=1 -98,220-1591,3139-3750
  Homolog annotation: Hit_ID=NP_508324.1; Match level="QueryCoverage =59%, HitCoverage=16%, E-value=1e-45, Identity=25%"; Hit description =predicted CDS, peptidase family A16 and RNA-directed DNA polymerase and Integrase, catalytic domain and Z
MCRPDSLGINACNYNDNFICYFIKPPNYSNTHTLILFKIIFACDEVTNLVAGTNDCAVTQEGKIECSYDQTTQLSITPEHLTCLKLDNTKTNTTMETLQITIETLTIICTEKSDYFTRGYELSSTSQKRCSGAGKCTGQTCQSVKMSDRNPEVNDHANNQPGYSYCVPSCGGWHCQCFLATDGCLFYRTYAESVGDEIFEVVNCPSWTIQATIKLSINPELTYSVDLKPGILTHIGDESNSSISVTLTSTSIPPTPLFGSTFIIVREELKAAIVANENLLKNILRCKNKEEAQSFSCTFPPEACQCHGGDSVVHCECEKSPLTEIFARQENLLPIKTQGSYVYFDSQIKAKIQQTTSLQMQVTLKGHKVKAIYDKNICNIVTISLEGCYSCTSGANWTLSCKTNFGTALANVECPSQKVQVNCDKEGKEQQIQLAYNKQIITENCGVICPDGKSEITLKANLEYISQQDTKIIPANNTNEKPIIGTSLDQLKRAEKIAQSKQLKKAIKTVKSTVRANQTDDIIQSEKAIEKLNDIREKTPECPNFHDSVDPETDGSFFQKLKSWEVDHKEIWDQAIRHAKKLEQKRIDSVETQTNNILEATTKAVKGEEFNRTLIEKLVRLIQSTGYSTKAGQDQALISLRKIENNLKHQRRYLTAQERTTHYLKKTFGLPTEQKLKSNNDSDTTTQSTSSNL

SEQ ID NO: 153491 - protein, 338 aa, Heterodera glycines
  Coding regions on vcDNA: vcDNA=SeqID_79914; Strand=-; Position=1-1017
MNRLFQNSLTIISLLTLISLCSSYSYECPKEPKIWKTRYTTLCIENGFTIRQNKITKEFCYKQLVCKDKHIIKRRPPYCGEKCKCPEGFKFCSFASYNKIKNESVEKINYQSIISFFKPNICAPNKTENCPIMKRKLFNSIVLYDNSIHIVKTLNLLFSQIDSINNFRCFGEGNLTIGTPIYCREHDCFKNNSFKQKYGTKFCFYEPYEKIYLVKSDEELIQIKAWGTIEKIFYLPNNLNQSFIENRRNKREENSSINEEATIECLKGGIIIKAINDIQELQISIENYTIIKKNPQKEEIIYLPPKLTSFEYKPIIKFISNPDKTNEKQITCQSSPVS

SEQ ID NO: 153492 - protein, 81 aa, Heterodera glycines
  Coding regions on vcDNA: vcDNA=SeqID_79915; Strand=+; Position=1-257
CSPFVKSVITDKRRTLILSSSQFLHLIYPFFLIARCNWTTHEHKTTFIFFIPCDDIVKFSPVNSLIISNGKTEPIEEDGGK

SEQ ID NO: 153493 - protein, 742 aa, Heterodera glycines
  Coding regions on vcDNA: vcDNA=SeqID_79916; Strand=+; Position=1-2228
  Homolog annotation: Hit_ID=NP_498959.1; Match level="QueryCoverage =98%, HitCoverage=32%, E-value=2e-86, Identity=30%"; Hit description =zn-finger, CCHC type and RNA-directed DNA polymerase  and Integrase, catalytic domain containing protein
MEEEVRAGATVGGVMLEKKVIEFLKDECSKGQTESEPMEEKPIMGKMVTVELVILETPTTGMLDGGAQISLIGGKFFYELVTSGKLNTMKSGFKRVSTRISDVNGKELECFGVITLPVFRKGCSTTNICFHITSAPFGYDLLIGTNALRSLGFCLFDIPNKEMINFEEIHPKKEKSVGILYQTTLKPLSMKLVTLSVGNEWNDKEVIVTSSNEKSLHRFEPTVGKITAGKITVPIVNSSIEFVQVDEKEIIVELFPTNLFAKADDSLGSPLLVNNLKLTPKMNEIKCQSMEILECLKSQAKDMSDQEFLPLGRLISEFDNIFAIREEELTQTDMVEHRIDTENAKPIKAKHRPVPYAYREKVATMIKDYLGRGLIRPSFSPWASPIVIVPKRDGTLRFCVDYRGLNSVTVKDAFPLPNIDSTLLALGGKKFFSVIDFMSGYWQIRMDPESVEKTAFVTEFGLHEFNVLPFGLCNAVATFQRFMTRLFEGMINDSVFVYIDDVLIASESWSEHLKHLREVFKRIDEAGLKLKISKCRFAVKEIPFLGHILTREGVKMDMDKVKPVIELPTPTSKKELHSLLGFLTYYRKYIFGFGSLAAPLFRLLKKDVKFEIKEVELGAIKALKKSILDHAMLYFPDFKAAVDDQKRQFVMLTDASKIGLAAILCQPDENGNLRPIYFASRQCNRHEARYCPTELEALAIRFGTKKYAQFITMIPTRVITDHRALVSMFKSKNETGNSRVDK

SEQ ID NO: 153494 - protein, 64 aa, Heterodera glycines
  Coding regions on vcDNA: vcDNA=SeqID_79917; Strand=+; Position=1 -24,458-628
MRNPAEKELFISEIVEKYLKEEIGEDKSDGSSSSSSSSESAETSRETEEDEQIWGGKARTDQSQ

SEQ ID NO: 153495 - protein, 78 aa, Heterodera glycines
  Coding regions on vcDNA: vcDNA=SeqID_79918; Strand=+; Position=1 -155,996-1077
MAPPNPSLHRVHPLSPPAVPPHHGRQQSLLNPQKGHMPTFSAVPNDQKEQPNAPGRPGNPGPPGKRWRAVARTGEMWR

SEQ ID NO: 153496 - protein, 80 aa, Heterodera glycines
  Coding regions on vcDNA: vcDNA=SeqID_79919; Strand=+; Position=1 -15,409-636
MSKDSKRRHDRDSSDYVEESKRRCDEARKRQIDREDRARRRSREKREQVEKEYEYYLQIACSESKKESQKNGGQQHNVGF

SEQ ID NO: 153497 - protein, 589 aa, Heterodera glycines
  Coding regions on vcDNA: vcDNA=SeqID_79920; Strand=+; Position=1-1767
  Homolog annotation: Hit_ID=T19209; Match level="QueryCoverage=47%, HitCoverage=31%, E-value=3e-11, Identity=24%"; Hit description =probable protein kinase E02H4.3 - Caenorhabditis elegans
MATTRKISSESNSKNKLFAEKGSVNRTTKSSNKKQQPIVLIPKRRKHKNYISKRKGNKTSAALRQCVSDPCIYKSFDHWHELWKEPPDGCDGPCRKTSIRQRKKLSMPSQDQLFSNRIQQLDAAAAKLLAVANASIDEEEKKMMTVSASEQLDVMGVVSSTAMKTGQLDRNPTRNGAREEAEFVSEINAGNSRRNSKKLNIQPSLDITTPSTSKQLEKQQTKAPVRKISGRRRRIEELSRIKEELRNAKLPSFDDISRRHSRLQKKEDIENAQAKSTVDAVSAAFQSTQQDANAKKRSVGAFPASLLDNNREKQKHKKATVMGKPPASPSMLARHELNRLAEYSGQSAGQSAAKSPGINNNNNNINSVISPCSPSLNNCSYMRLRNAPPTSAVRPPSKLPLVAVSIDQDFDNPMFGFDTDIRVPQEHQAETSTTETFDLLASAVDTDANDQCSAESCNSNTHNSAHQQRAKNITPLEFQATIELNNSPQNIADAEDEEREDEHYGTPADETTEARVPVLRVSRHGVGRTEQSDLDGRHQMPCHPPVPPPPYPGRPKPVNPATASLIASLQLPPSVCAKVTKSLPVWISG

SEQ ID NO: 153498 - protein, 64 aa, Heterodera glycines
  Coding regions on vcDNA: vcDNA=SeqID_79921; Strand=-; Position=1 -103,320-411
MILLLKPLIVQPMFGIIRFLFVPLASIGVCLKRRDPNALFAQRRLISVVGTQTDEHISARKWRD

SEQ ID NO: 153499 - protein, 340 aa, Heterodera glycines
  Coding regions on vcDNA: vcDNA=SeqID_79922; Strand=-; Position=1 -17,605-1027,1092-1639
  Homolog annotation: Hit_ID=NP_504664.1; Match level="QueryCoverage =97%, HitCoverage=87%, E-value=5e-46, Identity=34%"; Hit description =predicted CDS, reverse transcriptase family member (5H34) [Caenorhabditis elegans] pir||A89075 protein K0
ISWRFDFRPISLLCSISKILEENITQKITNFVETNNVLPNCQHGFRRKHSVTTQLLEVIDDFSLALENKKSIDVIYFDLAKAFDTVPHERLVSKLKNVGINGTLLKWLQNYLQNRTFFVRVGSAFSDEFPCLSGVPQGSNLGPLLFDDLKAYSILSKNTISDDLKAYSILSKNTISHSILSLINFGIIVNKWPKIAPNKCLVSHLGPKNPNECYLINNIPILKNEAVRDLGIYFSNDLKWEKHIGFITKKAIRISFALLKSLKTKSPKILINIFNVYCRSILEFGSPIFNPYMKKDIDALENVQKTFLRIVFRRNNNKDDIPGYNELLQLFKQESLLKRR

SEQ ID NO: 153500 - protein, 24 aa, Heterodera glycines
  Coding regions on vcDNA: vcDNA=SeqID_79923; Strand=+; Position=1-76
ITGVSIIAVLFLVFLMPSQNLVRF

SEQ ID NO: 153501 - protein, 29 aa, Heterodera glycines
  Coding regions on vcDNA: vcDNA=SeqID_79924; Strand=+; Position=1-87
LYFLFLFSISLLLVFSYLFFIETKALSKI

SEQ ID NO: 153502 - protein, 141 aa, Heterodera glycines
  Coding regions on vcDNA: vcDNA=SeqID_79925; Strand=+; Position=1 -194,251-372,523-571,628-689
  Homolog annotation: Hit_ID=XP_326403.1; Match level="QueryCoverage =90%, HitCoverage=12%, E-value=7e-14, Identity=31%"; Hit description =predicted protein [Neurospora crassa] gb|EAA33019.1| predicted protein [Neurospora crassa]
KYGNPKQANEIDWVIPARFCTDRYDSKKIRHRIEVQLGEESKEERLEAGESQTKWPNAYVIPSKDGHKVRIIDAPGIGDTKGVNEDKINFDKTLNFISTLPELHANIVFVFTNARGSNYDMGKTAEVLEKLLAPIERAHNV

SEQ ID NO: 153503 - protein, 220 aa, Heterodera glycines
  Coding regions on vcDNA: vcDNA=SeqID_79926; Strand=+; Position=1 -90,167-422,491-613,896-1089
MSIKQAEKVVLECKGEADENLHEDKLKGLRESLRLYQEEKELIDNATADDSNGPTVITAENVKKFFDELCELPFFGADIRQMFETKQKSRHEHQKEYSEKKTNVGVKLRPTKSGKVVQPEQCLNEEQRKLLKAYKKKQKEMEQLEREMENENTLQRQRIPSYNYLFGSSSSQNVSSSSYGTHSRNSFNLSSNFSSYGAWEDDRGVMPKNKQWHNPRWGPK

SEQ ID NO: 153504 - protein, 490 aa, Heterodera glycines
  Coding regions on vcDNA: vcDNA=SeqID_79927; Strand=+; Position=1 -135,1306-2645
  Homolog annotation: Hit_ID=NP_704477.1; Match level="QueryCoverage =49%, HitCoverage=15%, E-value=2e-10, Identity=23%"; Hit description =hypothetical protein [Plasmodium falciparum 3D7] emb|CAD51296.1| hypothetical protein [Plasmodium falcipa
NSHERYIDELLNDGVSQLPKTCVKKAISTNEQNSNAVASSSKSKEHKNEENISIPKLIFLKTKANSISHMTIAKSIHAHMQKMRINEHANLNTVQSDQAMEDIDQNIGGTDQTNVSMPIDVINESANSLISLLVMPIAHSSAADQAHPPLSEGTTNTNLTSDKSDQTGPETPNSQRKRSRQRKQSSSNIQRTEFLGFASTETEIAVIKQKDQRNDQPRNQRNDQPSDQRNDQPSDQRNDQPSDQRNNQPRDQRNDQSSDQRNYEFNEQQSYQMLGLYDHDDQNIEPMFVDTNAPQMIDTSDFDQIAQLAGDDLMFPHPMEVYDEPNNAEEQFVMIPVGNSTQQIVAESVGKTKSNSKSGHGKSPQSADQNMRDYASPSIQLKQKAGRQKKPKIDEKMEKAKSKMGVEKAPIKPAKHKSKMTMGRPLMRNKSIMITERPPMKNKSMVISERSMMKNKSIVITEKQNTKADKGKSIMIEEEDSATDSSDEVH

SEQ ID NO: 153505 - protein, 358 aa, Heterodera glycines
  Coding regions on vcDNA: vcDNA=SeqID_79928; Strand=-; Position=1 -955,1033-1154
  Homolog annotation: Hit_ID=NP_494302.1; Match level="QueryCoverage =96%, HitCoverage=27%, E-value=9e-45, Identity=32%"; Hit description =predicted CDS, putative protein of ancient origin (2C878) [Caenorhabditis elegans] gb|AAB95006.1| Hypothe
MPWKLREFFALILVHCNPAKPEELWNMFKDSLSEDFSRNFRREIANAKAYREIALSIMKAGKTLADFPSMEQINVDDDVEQVFDLAEELDLGQRNYTLMYDEQRKVCDEILQRVWNPVNEPAFYFLSGPGGTGKTHVNKTIVHMLRGQKKKVCTMAFTGIAATLLPAGRTLHNRFGLTLDMSNSSISPRSRVWQELKETDLFICDEAPMINKRAMRTLDEKLKEIMNNGIAFGGKVMLWTGDFRQTLPIQKHATRAEMVSSTIKRSEYWRLAKRYKLTKNMRALATEQEFARDLLEIGSGKWNNENDEIILPENCISNAPKNIDVSEMNNRVLEMLPGEEVVYTSIDLAQDENRQRAY

SEQ ID NO: 153506 - protein, 68 aa, Heterodera glycines
  Coding regions on vcDNA: vcDNA=SeqID_79929; Strand=-; Position=1-207
MRTGQKLRRRMAFLLFGLSIGVPFLNSRALPATVGIRRIGYVNNGLQVLAVRECHRGIFGEPKCQPKS

SEQ ID NO: 153507 - protein, 147 aa, Heterodera glycines
  Coding regions on vcDNA: vcDNA=SeqID_79930; Strand=+; Position=1 -104,499-838
MIKDSSSSDASPCSSPYNFRLTSAFRRSWTIENLKKLTNRTSPSNKNSAKASNGKMTVPDNSPTSTVSRRSILKRGSSTDEVEQTVKTLASEGKQLRRRLLIKKVKTWSIIDFFQLNKMTHKSGQNISGVILLKLSLISPKQKLEAK

SEQ ID NO: 153508 - protein, 216 aa, Heterodera glycines
  Coding regions on vcDNA: vcDNA=SeqID_79931; Strand=+; Position=1-651
MKCSLLSYPFIGISLILVVGVASSIGAPAAASGRKIKPPIMERGAVNGGTKPTEMGKEEAEQWKKEREEVKKLLAEHNEKVQKKLLKQAKALEKDEKYQQRMKEQKAARARLPKEKRVPAMDIPEINENSPEAAYLYQGDIQLSLEEAKILFARDDDVEEGRPSTRTPNASSDAVASSGRRRRGAPMNAVTFPDSNGLISSTRSALTTASVCFSVW

SEQ ID NO: 153509 - protein, 161 aa, Heterodera glycines
  Coding regions on vcDNA: vcDNA=SeqID_79932; Strand=+; Position=1 -20,303-504,643-771,1223-1337,1609-1627
  Homolog annotation: Hit_ID=NP_510440.1; Match level="QueryCoverage =93%, HitCoverage=24%, E-value=3e-38, Identity=50%"; Hit description =defective HatCHing HCH-1, hatching and cell migration factor, Zinc protease of the tolloid / BMP-1 family
FWACGSLGIIAHEIGHSLGFFHEQSRYDRDDFVEVNTDNIKPKKLHNFDKQSNINNNNYYVGYDLGSVMHYASKDFSINGEPTLVPKAGPLYLHTIGQRYGPSHSDYKMMNEHYCGLTCEMETTCFNGGFQNPNNCSACICPPGYWHEKCEHPLDMNTAGS

SEQ ID NO: 153510 - protein, 68 aa, Heterodera glycines
  Coding regions on vcDNA: vcDNA=SeqID_79933; Strand=+; Position=1 -65,509-602,867-914
MFRIAEIFAKNSLSVGISINVRPALLPFIANDAPNFPPSLLRRWTHRFSPKIKGVKGDSSKRRRSNPA

SEQ ID NO: 153511 - protein, 57 aa, Heterodera glycines
  Coding regions on vcDNA: vcDNA=SeqID_79934; Strand=+; Position=1-173
MSMKLASKMGGYTEYALLPKESGKRGRAVGARVWVFAGFGSLSQLAMDLENNYLFGD

SEQ ID NO: 153512 - protein, 54 aa, Heterodera glycines
  Coding regions on vcDNA: vcDNA=SeqID_79935; Strand=+; Position=1 -30,209-343
MARGTLWMGEDPYVIVTDYELIRSTFLLNYNEQTSGRHFFRIAELVSGISHWNA

SEQ ID NO: 153513 - protein, 97 aa, Heterodera glycines
  Coding regions on vcDNA: vcDNA=SeqID_79936; Strand=+; Position=1 -58,717-952
MLIGLREMSAKLRSDIKQNGGFAIFPPFSTTFKLIDQTLTGPYDLIDKEIAKIVKRRQFESNLCAVSLVDDFLDTIQNSEQRKKNGTMPLAQDKHFQ

SEQ ID NO: 153514 - protein, 147 aa, Heterodera glycines
  Coding regions on vcDNA: vcDNA=SeqID_79937; Strand=+; Position=1 -120,417-740
MNDLWANCLCFEWTIGHFRPLVSLLEVMGKAAAEEYGNCKLLSAHKILLVTASEVFETMLCSDDAENEKTKNSAKNYRQIEIKNIYLFFAPSHLRPVPITDIDANVFKVMLRFIYTADLSGLNGDNAIPLFCAGQNKTKNIKSFCFN

SEQ ID NO: 153515 - protein, 84 aa, Heterodera glycines
  Coding regions on vcDNA: vcDNA=SeqID_79938; Strand=-; Position=1 -13,87-149,205-255,410-466,1197-1265
MAEMGNNATNAMPPLAGDENYETKSENSSTVPMPLPSSGNSSVLEITKNAAVPSRSDKNDIVHYTVWPIVAVIVLLIFYFLVKK

SEQ ID NO: 153516 - protein, 52 aa, Heterodera glycines
  Coding regions on vcDNA: vcDNA=SeqID_79939; Strand=-; Position=1 -3,1571-1707,1749-1767
MVGEHLAEVLLTRQHCRRPIHSDRFFRSVQMITSDRLLAWRPRVLPLEIDTK

SEQ ID NO: 153517 - protein, 451 aa, Heterodera glycines
  misc_feature (431)..(431): Xaa can be any naturally occurring amino acid
  Coding regions on vcDNA: vcDNA=SeqID_79940; Strand=-; Position=1 -196,355-584,774-908,1040-1198,1293-1356,1435-1553,1610-1655,1750-2042
  Homolog annotation: Hit_ID=CAE68454.1; Match level="QueryCoverage =93%, HitCoverage=65%, E-value=2e-88, Identity=43%"; Hit description =Hypothetical protein CBG14244 [Caenorhabditis briggsae]
IVVCPFTFHRSFLLSHNVSAPLAQYLELAFPSPEHPFQYELYTKMIAQQRMDQMESELSKLLENSQIAFTEFVKRSAFFVDPRTCEKAEEIMTSAGKCFRLRGGEQRSDGFGHGQRIILRLPKKLYNPGVNQMLNDGVVVKLAERGKGIDHDMSFVPSGVHAIPLTATRYEFKNYPPHFKCREDDPSGVYSRVWCFEDCFMSQAERDCNCSLAAASRPTTPYICTTSQFFRCVYPKLYRKGFEERIAVFYRCKSHCGPPCNYWRFDKTVTYSLFPSEQAKHFLFPSEQAKHFVNDSSKWEELRNTIILDVYYITLDYTIIRHMLSMTPPSFVAHMLSMTPPSFVAQLGGQISLWQISLWIGGSIISIIQLLIYLSSAFCAYLRRGATKRRRTTTMRRDGIIGHERGGKEKCQRNTEKRRRKEERKRDGERXAKEEGREKGEDERQGRKLKE

SEQ ID NO: 153518 - protein, 234 aa, Heterodera glycines
  Coding regions on vcDNA: vcDNA=SeqID_79941; Strand=+; Position=1 -85,1795-1995,2686-2841,3333-3539,3692-3745
MVRSMLRPSIFALLPLVCLLSVLPKPGHGLFLFNAWNCIGMDMTQEQCDTLSANKANGDRAQLNMSKVAVSDWKCKCALGNAGEDMANANFESPEAKMACKYRMESENAELNEQLNNKLNKKFNNNEKIQCIKEKGKCGAVFCKTKDGELKWNKWACFSADYSKKVCAKNETNAVNDERDKWSDSKLPKADDWKCRCRFGGNGKDLTNNKFVPRNSTAIRHGDGMPMIVVGIIM

SEQ ID NO: 153519 - protein, 20 aa, Heterodera glycines
  Coding regions on vcDNA: vcDNA=SeqID_79942; Strand=+; Position=1-60
MNMLREKSKNIQFEAFHVFK

SEQ ID NO: 153520 - protein, 203 aa, Heterodera glycines
  misc_feature (192)..(192): Xaa can be any naturally occurring amino acid
  Coding regions on vcDNA: vcDNA=SeqID_79943; Strand=-; Position=1 -99,157-210,369-452,517-562,612-665,726-773,884-925,1119-1195
  Homolog annotation: Hit_ID=CAE69788.1; Match level="QueryCoverage =97%, HitCoverage=29%, E-value=5e-38, Identity=46%"; Hit description =Hypothetical protein CBG16079 [Caenorhabditis briggsae]
QVFGKDSNCIVRNWLSSTVIDHFNCTLPYLDTVRGISTELPTCEPLKIAKNRGISTELPTCEPLKIAKNYTDIIQLVHSGSVHGPKCIPGCNRWEYSVSLQQSPSLQEFANYTFNLEVSFTFNLEVSFYDLQYEHLKEVVTITVPGFMVVTITVPGFMSQIGGQFGFFLGLSIITVIQEIRLGFFIKWNFAXKASARKCSQKR

SEQ ID NO: 153521 - protein, 57 aa, Heterodera glycines
  Coding regions on vcDNA: vcDNA=SeqID_79944; Strand=+; Position=1 -36,87-224
MPTKTTNGREAPLYSNAETSVEMLLAINRCMELLRPELAFAIFSGQIFINIFIRRLE

SEQ ID NO: 153522 - protein, 46 aa, Heterodera glycines
  Coding regions on vcDNA: vcDNA=SeqID_79945; Strand=+; Position=1-256
FTPSGSEPAPSALKMMPQNPQSHRDSEVLSMLKVKSDHVFVISVIK

SEQ ID NO: 153523 - protein, 101 aa, Heterodera glycines
  Coding regions on vcDNA: vcDNA=SeqID_79946; Strand=+; Position=1 -96,142-216,406-540
  Homolog annotation: Hit_ID=NP_504172.1; Match level="QueryCoverage =97%, HitCoverage=28%, E-value=5e-10, Identity=36%"; Hit description =predicted CDS, putative protein family member, with at least 6 transmembrane domains (5E718) [Caenorhabdi
MAMFTKPVLFSGVYLSWFYNPYVGYTDDFGEIYSNTIASAHNYIVIIGLSSIYLLFPIFIQVIIISLFNSIASVIYISMQFVRISKIYIIVGTYAWVFSSG

SEQ ID NO: 153524 - protein, 100 aa, Heterodera glycines
  Coding regions on vcDNA: vcDNA=SeqID_79947; Strand=+; Position=1 -182,787-852,1014-1068
MPRLGIIKKRKCRLKSNCTDVRDSMRTKFHLNNGQADRQPPEPMFPKSFLKKAYRKKVHMRDLKIQDKSEKSGHLGALAITDCQKLSKNNFYSLIAVANE

SEQ ID NO: 153525 - protein, 65 aa, Heterodera glycines
  Coding regions on vcDNA: vcDNA=SeqID_79948; Strand=+; Position=1 -154,232-275
MRIGFSCEKKKEVLIISLFHTITAVIYVSMQFVRISKIYIIVGTYAWVFANGCHGVFVAEQTNSK

SEQ ID NO: 153526 - protein, 287 aa, Heterodera glycines
  misc_feature (17)..(17): Xaa can be any naturally occurring amino acid
  Coding regions on vcDNA: vcDNA=SeqID_79949; Strand=-; Position=1 -80,3351-4140
  Homolog annotation: Hit_ID=XP_314866.1; Match level="QueryCoverage =98%, HitCoverage=24%, E-value=4e-41, Identity=36%"; Hit description =ENSANGP00000015731 [Anopheles gambiae] ref|XP_313291.1| ENSANGP00000010399 [Anopheles gambiae]
WPSEFIIASLPGSFRQXYLSKTNCKWKEVPKVLRLHWELKPDKLYIDFPSMDTESRCVTCRTVLQQLASVFDPLGLVCPALHDAKMFFQSLWETKLDWDVPLPTDIVQKWNTIAATWNQQKVRVPRRVIPLEAASHQLHAFVDASKDAYGACISRAQHGDAITAHLIFAKSRMKPKGSISLPRMELMGMLIGIRMLQFAEKQLDLPFATNIWCDSKPVLGVSSSEQQPRFVENRLKEIRAVDLVRFLYISTEQNPADVASRGCTVIELTSHPLWWSGPSWLIHPEDP

SEQ ID NO: 153527 - protein, 76 aa, Heterodera glycines
  Coding regions on vcDNA: vcDNA=SeqID_79950; Strand=+; Position=1 -94,145-281
  Homolog annotation: Hit_ID=CAE58304.1; Match level="QueryCoverage =84%, HitCoverage=18%, E-value=6e-10, Identity=43%"; Hit description =Hypothetical protein CBG01414 [Caenorhabditis briggsae]
MNALETGILGIIGAVYCDYPLLIYTTGALGAALWYAETSVEMLLAINRCMELLRPELAFAIFSGQIFINIFIRQLE

SEQ ID NO: 153528 - protein, 69 aa, Heterodera glycines
  Coding regions on vcDNA: vcDNA=SeqID_79951; Strand=-; Position=1 -124,578-663
MKTSRKFLWDQFLRDKFPKIQNIAVYCDYPLLIYSSGILGGDISTSDYHKFDTFNYSHNLLLNAICQNQ

SEQ ID NO: 153529 - protein, 83 aa, Heterodera glycines
  Coding regions on vcDNA: vcDNA=SeqID_79952; Strand=-; Position=1 -87,427-556,611-645
MFICSANLLWFCSCHVHKTRSVQWDLFVVTFLQVIVISLFNSIACVIYVSMQLVRISKTYIIVGTYAWLFSHGFLIEILLSLN

SEQ ID NO: 153530 - protein, 225 aa, Heterodera glycines
  Coding regions on vcDNA: vcDNA=SeqID_79953; Strand=-; Position=1 -254,297-477,520-762
  Homolog annotation: Hit_ID=AAL93203.1; Match level="QueryCoverage =96%, HitCoverage=33%, E-value=2e-19, Identity=27%"; Hit description =transposase [Bactrocera dorsalis]
MDKDIINFIACCNLPFQIINHKTFKKLLRNPSENLRDESHYRRNVLPEVYKVVKNKIKGEIAEFENICCTSDIWTSDTTKDSFISLTAVGVSSKFSRKKFTLAIQKFHGAHTSERIAEILKALLENWNVKECHCFVTDSAANLVKAFDLMYIERISCAAHDLNLCVKECFSKEKDEMAQIFEKCRKIVGTLKHSAKLMDDLKDVQGELGLPKAKLLQVANYQILI

SEQ ID NO: 153531 - protein, 411 aa, Heterodera glycines
  Coding regions on vcDNA: vcDNA=SeqID_79954; Strand=-; Position=1 -126,442-545,6101-6379,6432-6870,6922-7209
  Homolog annotation: Hit_ID=AAL78214.1; Match level="QueryCoverage =36%, HitCoverage=75%, E-value=4e-12, Identity=30%"; Hit description =putative esophageal gland cell protein Hgg-20 [Heterodera glycines]
MQEKFDKKEEQLEKNLEELQKKLVEMDHQQKEQQKSIDQMEKQMAFQEKLEKNVMAQIDVKVQTKVYCQIVKGNEQCWICNDVWMDILPSFDHAQLGLKLALLSPRFNALVDKHFDGKSELTIWRKIKIHRKDKGPEPKLSVQMDDKFVPFPLPDRPLPSKIRFKNLQIEYIDHSVIAFLRSNHQIFNKRNIKLLLSLPSPHNTDGQPIWDVFVREIWPFFSANIRHLRFNDGDHLDNLLRQISPTILIDLNQLNSIYSFGLSPAAIDADFDATISAGQALSKWLHSPRKDGQPKRLHCEDHNEQTNTDWINNFKEHFLRANAISSVSYEIHFSVHVPSIQMVPFELVNESTNEKLTLAKAKENEWGGIGWIMKRCKIIGETAAVHWEDGNWDNNWDNVIILLDGGTNCIG

SEQ ID NO: 153532 - protein, 75 aa, Heterodera glycines
  Coding regions on vcDNA: vcDNA=SeqID_79955; Strand=+; Position=1 -184,666-709
MEKRGKRRKRMKIALGKEERRKRESEKGKIRSKKDGEKEEEERMKQKRGRNSSNLTLFNFAEQTKVAFHSFGKNQ

SEQ ID NO: 153533 - protein, 100 aa, Heterodera glycines
  Coding regions on vcDNA: vcDNA=SeqID_79956; Strand=+; Position=1 -160,211-353
MIVISGLFKLVSAESLVVIPDIEAQAFKVMLSFIYAEDLSELNGDNVMAVLFAANKYNISLLVKACLDFPINELSDVFLAYKQARLLNKKVLMIFKYLIY

SEQ ID NO: 153534 - protein, 70 aa, Heterodera glycines
  Coding regions on vcDNA: vcDNA=SeqID_79957; Strand=-; Position=1 -96,547-663
MSEVADLSRDFNGEVFNNTSNSSGFPHFTTFTVIKELMDPSKGFYNKSEDKVTLTVDFIVKEAKMAEDKS

SEQ ID NO: 153535 - protein, 94 aa, Heterodera glycines
  Coding regions on vcDNA: vcDNA=SeqID_79958; Strand=-; Position=1-8,64- 239,327-427
MKKKEFLGPRETFEVYEKRTNSPLNVSRVPSPQGVPVASPPNPYDHMPVPISMPAEEAKRKVPLPFIIGLAVAVPIFVILMLFLAIWLQEMGII

SEQ ID NO: 153536 - protein, 52 aa, Heterodera glycines
  Coding regions on vcDNA: vcDNA=SeqID_79959; Strand=+; Position=1 -141,1014-1031
MLKWTLMSFYKRTDEGQKCPSAHWNFGMEEKMRWEENWMIWAEIFRGKILPI

SEQ ID NO: 153537 - protein, 36 aa, Heterodera glycines
  Coding regions on vcDNA: vcDNA=SeqID_79960; Strand=+; Position=1-111
ECESSHCRGHVEKQRKPPPSDDGNGGGGPGPSSIST

SEQ ID NO: 153538 - protein, 33 aa, Heterodera glycines
  Coding regions on vcDNA: vcDNA=SeqID_79961; Strand=-; Position=1 -19,1159-1241
MFLFYSVIHLDIEQFNHHQFLFQIVIYLSIDIL

SEQ ID NO: 153539 - protein, 94 aa, Heterodera glycines
  Coding regions on vcDNA: vcDNA=SeqID_79962; Strand=-; Position=1-282
MLRHFLLRPLPIHRRLAFVPFSTGINVGHFSARATPAAQNAMPTAPMATTAALAAAADGDPPKQQKHQHFLASLPELKQGQGDAVVDFEALDKK

SEQ ID NO: 153540 - protein, 122 aa, Heterodera glycines
  Coding regions on vcDNA: vcDNA=SeqID_79963; Strand=+; Position=1 -322,840-887
LKRFENPPEPPRERMPFYSSTVARFECQSELDSAAKPRGREERGDRERMSLGMSGKRMFANTLKSAVGTVEDRPCIPPEGLNREMLKRRPTPAPVPQFTTRSAERSPANSIFRMLSNNTRNV

SEQ ID NO: 153541 - protein, 53 aa, Heterodera glycines
  Coding regions on vcDNA: vcDNA=SeqID_79964; Strand=-; Position=1-219
LFSFSSKLNIPGIIRKHSKNAISLQIFKNFYLCTKKSEQKKVRITGFLSSFWP

SEQ ID NO: 153542 - protein, 106 aa, Heterodera glycines
  Coding regions on vcDNA: vcDNA=SeqID_79965; Strand=+; Position=1 -113,179-276,365-475
ELCVVKNNDTTILNHHLSTSDSCLYQHTNAIDTLVRLAERKEFNGISGKYFDANGKEIKLGADTSDVRVQDKLWIESSLICNAILGRKTATESTIENSFKYATIFQ

SEQ ID NO: 153543 - protein, 124 aa, Heterodera glycines
  Coding regions on vcDNA: vcDNA=SeqID_79966; Strand=-; Position=1 -63,124-284,371-459,730-791
  Homolog annotation: Hit_ID=NP_653082.1; Match level="QueryCoverage =97%, HitCoverage=39%, E-value=5e-17, Identity=33%"; Hit description =guanine nucleotide binding protein, alpha transducing activity polypeptide 1 [Homo sapiens] ref|NP_000163
MMELVDVVTDLGLQFGNASLINDVNVLHKHIANGLEFAMITEILKQAIQPIWQDQSIQIAFEKRSNYQIQDSAHHFFDQIERIATRDYRPTNMDILLTRVPTAGGGQRSQRRKWIPFFDDVLFN

SEQ ID NO: 153544 - protein, 45 aa, Heterodera glycines
  Coding regions on vcDNA: vcDNA=SeqID_79967; Strand=-; Position=1 -112,280-305
MGSCQSTEAIIAREASNKINKMLHQKPERYVQKLLLLGKTNAACF

SEQ ID NO: 153545 - protein, 348 aa, Heterodera glycines
  misc_feature (17)..(17): Xaa can be any naturally occurring amino acid
  Coding regions on vcDNA: vcDNA=SeqID_79968; Strand=+; Position=1 -354,417-490,664-892,940-988,1035-1306
  Homolog annotation: Hit_ID=NP_498420.1; Match level="QueryCoverage =81%, HitCoverage=48%, E-value=6e-47, Identity=41%"; Hit description =mannosyltransferase (3H551) [Caenorhabditis elegans] gb|AAC77507.1| Hypothetical protein T26A5.4 [Caenorh
CQNLTSSKNLIVDPQSXYYRKCFLRISYLVLIEGFFGRRASFNFCVSNAMKNDLERRWGVNAITVYDRPKLVQSVSIFKVFDPFLRNTSSEEKIKFLHCFTSETLSGLTEFVHEFVHEEADGTLTLRENRPFLAVSSTSWTPDEDFSILLDALVRLDQRMADVETQRTSKTHPKIVVVITGKGPQKEFYEERIRNTKWEKVRIFTAWLSADDYPKFLSCADLGVSFLSCADLGVSLHTSTSGFDLPMKVVDMLGSGVPVFDLPMKVVDMLGSGVPVLAKNFPAIGELIGTNGLLFDTPEELENLLADLSLGFPGNSVLVYFLVMLETKNFPRPRLDPETRDPKPRDQK

SEQ ID NO: 153546 - protein, 83 aa, Heterodera glycines
  Coding regions on vcDNA: vcDNA=SeqID_79969; Strand=-; Position=1 -142,1381-1487
MEKNEPYENSVVEDDEFHVVQSHNSLVHSGSALLRKPRNLGKRWTWKSLQVVLKSILCAMAPLLQLGYWCCLQLSFLPSSDWS

SEQ ID NO: 153547 - protein, 54 aa, Heterodera glycines
  Coding regions on vcDNA: vcDNA=SeqID_79970; Strand=+; Position=1 -44,434-551
MAKKKTFVPTNPIGPSISFPNSAASSKVRCPNGPTNCVTAPHEIHRLRRHCSHK

SEQ ID NO: 153548 - protein, 49 aa, Heterodera glycines
  Coding regions on vcDNA: vcDNA=SeqID_79971; Strand=+; Position=1-292
VGVNSVWPTPSQQCSKSYNFFLCWPNFTIMVSLESPRCLEDIYKLFLSD

SEQ ID NO: 153549 - protein, 39 aa, Heterodera glycines
  Coding regions on vcDNA: vcDNA=SeqID_79972; Strand=-; Position=1 -73,209-255
MPFTQSPENELLYQKGAVCGKKVFSELDDLDESFSKRKR

SEQ ID NO: 153550 - protein, 34 aa, Heterodera glycines; identical to SEQ ID NO: 125570
  Coding regions on vcDNA: vcDNA=SeqID_79973; Strand=+; Position=1-102

SEQ ID NO: 153551 - protein, 245 aa, Heterodera glycines
  Coding regions on vcDNA: vcDNA=SeqID_79974; Strand=-; Position=1-736
MENKFILVPSDLYKNLLKPESGEINVENAKNKLSSLLKQRKLDATSKNLLYNQELRRFLKLRKEVEEKPVKVELSDGSLMVFKPKQRERDSKIPTQIVNDEGLDETGSIPTLEDPYTTAEESDAESTTSTPKTRPLIRPMRVGTSKFRQKQKSFVVKKKGKIMSIINNDPEKFGVGSKGHILRADGTAYLKSNVNQALERILRRSPENAPSPIGTKALEQRLRNDPRTSGILKQKFNEQSGSSVK

SEQ ID NO: 153552 - protein, 85 aa, Heterodera glycines
  Coding regions on vcDNA: vcDNA=SeqID_79975; Strand=-; Position=1-258
MKVARINSQYIVLMSAPNAALQIRNLGVQLFPKNLTFFLSAYKDATASPYGYLFLDLHPASSPLLRIRTKIFKEDEEKALYIQND

SEQ ID NO: 153553 - protein, 261 aa, Heterodera glycines
  Coding regions on vcDNA: vcDNA=SeqID_79976; Strand=-; Position=1-786
  Homolog annotation: Hit_ID=NP_001004509.1; Match level="QueryCoverage= 96%, HitCoverage=17%, E-value=3e-19, Identity=28%"; Hit description =si:busm1-180o5.3 [Danio rerio] emb|CAD60788.1| novel protein similar to DNA polymerases [Danio rerio]
MKSEPGKRYIAKLCLNSLWGRFSMRNLLSKAIIDNDESLIHQYTEDKKIELIDLEMMDEDNDVFMLTYKPKEEFVDENKYSNVVISLFTTSMARLYLYDALKKVADTPGCEILYFDTDSIIYVHPEDNDPLPTGKGHLGELTDEKPDHDILEFISAGCKNYGLKLQRKDNAGIEYDLKIRGFTLDAQTVQMIHYDTVKEQILRYGSDDPADPIIVTYPHFIRPNLIQGKVFTHSLTKHYQPIFTKGIINDSFQVLEFGYRK

SEQ ID NO: 153554 - protein, 116 aa, Heterodera glycines
  Coding regions on vcDNA: vcDNA=SeqID_79977; Strand=-; Position=1 -202,1139-1284
MDTGETTPPPLAIDERSERIEQLEKQLKDRDDTIKFLREQVRNREALISDLRRQLDEHMVPPMAPPTRDEALHSVWRRLEQLWKTMPDSEQMRQQLEHHFVSNWLLDTGRLDELKL

SEQ ID NO: 153555 - protein, 91 aa, Heterodera glycines
  Coding regions on vcDNA: vcDNA=SeqID_79978; Strand=-; Position=1 -124,175-326
MAKRKLLSKLIGRESVKKRWNKREERQAQTVKARQAYLAKRTAPQPNPNAEMPPQDEAGPSTSAASVEEAMEPPPSTPGPVPTPEMDEEIL

SEQ ID NO: 153556 - protein, 44 aa, Heterodera glycines
  Coding regions on vcDNA: vcDNA=SeqID_79979; Strand=-; Position=1 -78,665-721
MALNLTYLLTLSLYCSNSMHEVGAVQAFGANANFGQTGGRFPFI

SEQ ID NO: 153557 - protein, 161 aa, Heterodera glycines
  misc_feature (1)..(1): Xaa can be any naturally occurring amino acid
  misc_feature (27)..(27): Xaa can be any naturally occurring amino acid
  misc_feature (153)..(153): Xaa can be any naturally occurring amino acid
  Coding regions on vcDNA: vcDNA=SeqID_79980; Strand=-; Position=1-489
  Homolog annotation: Hit_ID=CAD22154.1; Match level="QueryCoverage =80%, HitCoverage=53%, E-value=9e-43, Identity=68%"; Hit description =pherophorin-dz1 protein [Volvox carteri f. nagariensis]
XPPPQPHPPPHPPPPPQPPPQPPPPPXPKPPPPQPPPPPPQLTMIGPPPPPHPPPPPPQQHPPPPPPPPQQQQPPPPPPKLNPPSPPPLPPQQHHPPPPPPQQQLCCGSPVPSACSLISVTKKAANIKGKRVEEKRPIVLSHTKREQTNFIGXMSKFFRVL

SEQ ID NO: 153558 - protein, 55 aa, Heterodera glycines
  Coding regions on vcDNA: vcDNA=SeqID_79981; Strand=+; Position=1 -130,270-307
MAATSAATAAADPSAANKVHFSSAGNNYCNVVKERVWCQAVSIINCIAFVSSLLG

SEQ ID NO: 153559 - protein, 40 aa, Heterodera glycines
  Coding regions on vcDNA: vcDNA=SeqID_79982; Strand=-; Position=1 -102,404-424
MADDGNGEAEDNENENARDGGGDDDADDYWTVAESSTKKN

SEQ ID NO: 153560 - protein, 542 aa, Heterodera glycines
  Coding regions on vcDNA: vcDNA=SeqID_79983; Strand=-; Position=1 -123,170-442,674-1049,1212-1418,1504-1763,1807-1950,1997-2222,2366 -2385
  Homolog annotation: Hit_ID=CAE67424.1; Match level="QueryCoverage =85%, HitCoverage=52%, E-value=1e-46, Identity=30%"; Hit description =Hypothetical protein CBG12912 [Caenorhabditis briggsae]
MRDDIPPLLEKAHRKNIESHAKETEELDGEVGLSAIGTFTKSDESQKSEQKNTRETAKLENGEISQTEAAKNQQEEKMDTDEQQHENTEESGGAEKDKEEAVVREAKEMTTEAIQVAAATALGAAATKAKYLLEAQRQQLIAERQAFHLDQLRYLEQRARSDAQHQLTNDGRMPTILPPGFEVSLNLTPLELEEWARIMLQVSNPTQPQAVVAPAGIPPSQSAAKAQPPPSVQAAQQPLPPVSVPPQQTQPVPPPASAEVSTAAATTSTPNTAPIAAAPPAPSPHATASSTAAPYAPQQPPTSAPPSIPPQQQMPPPPAQGQQPQYSQPPLSTAYYPPPSAYPPPVHNQSYAPPPHNATATYPPPQAFPPQAAPPPQHYYGSVSRAAQPPAQYGQSPQAVGPPGRPIANYPPQYDYYAGSAGQPPPQHRYGQQPPYASYGPPPTSAPQQQPQHYPTPGQSQYYARLSHTQHSLQGQPPPPQPMGLPPSAGPQQPQEMIVGAGSVHHHQQQQHHQGPTGGIVQTAADATSATPPMHQESNKEC

SEQ ID NO: 153561 - protein, 126 aa, Heterodera glycines
  Coding regions on vcDNA: vcDNA=SeqID_79984; Strand=-; Position=1 -11,86-201,273-526
  Homolog annotation: Hit_ID=CAE67424.1; Match level="QueryCoverage =79%, HitCoverage=12%, E-value=1e-22, Identity=54%"; Hit description =Hypothetical protein CBG12912 [Caenorhabditis briggsae]
MPPKGFKRKREEGSEVAESVDLDRIDDDENSRLTLTPSAIIKTKDKDIEIGYSKQQKLTELDDDGPAANQLDPTQTNLSSTVEPQTHYIIVPSYSAWFDYNAIHQIEKQAHPDFFNGRNKSKTPET

SEQ ID NO: 153562 - protein, 209 aa, Heterodera glycines
  Coding regions on vcDNA: vcDNA=SeqID_79985; Strand=-; Position=1 -417,462-674
  Homolog annotation: Hit_ID=BAB78478.1; Match level="QueryCoverage =93%, HitCoverage=34%, E-value=4e-13, Identity=29%"; Hit description =preproMP73 [Cucurbita maxima]
MGSSKDTYGGKNGSERTRKARRARGREKVQTDGQSDETLKNRESLREMSRREAEWADERTQHRREVDQLHAEMQETRKMAECRETELIREHTRADEAEREAHARAKRVEDEMTTLAEAQRKARARAEAEFEAERARSCELMAQRTHLETEIERKDAELSEGRENYEEALRERDKFAQALHEAKLKNAMTNSECERLMEKLRRERNDAIE

SEQ ID NO: 153563 - protein, 89 aa, Heterodera glycines
  Coding regions on vcDNA: vcDNA=SeqID_79986; Strand=-; Position=1 -65,292-496
MSVPNLVENIGETDERPSNSQREQRKQKAILEHVQEQARKGTERRTPCFLLLPFSCFVRAFGTRIGEARGVIHRQIRRHDQKKRSGKRK

SEQ ID NO: 153564 - protein, 22 aa, Heterodera glycines
  Coding regions on vcDNA: vcDNA=SeqID_79987; Strand=+; Position=1 -25,669-712
MNSNPQNYLFVNSRKAELSSAD

SEQ ID NO: 153565 - protein, 95 aa, Heterodera glycines
  Coding regions on vcDNA: vcDNA=SeqID_79988; Strand=+; Position=1-288
MTGQRIREFLPKNTEAGISTNIKTRKANSSKKAIETNVQKLAQNDDEKRDEISKDGRDVKILIKMRRNSSENVEQFGKKDNINGPKKCQKWKIGK

SEQ ID NO: 153566 - protein, 124 aa, Heterodera glycines
  Coding regions on vcDNA: vcDNA=SeqID_79989; Strand=-; Position=1 -54,220-339,474-674
MSRNIRNLRTRRFKTFTEGLNQFTDVTRKEKAFFLLWNGFIGKRTNRQLGVCQLFALLKRFIDTHGKELLTIRKGLVTNFILHCANFENFGYISNSERAELMDYAALKLSSLAKEFEGKMKRGK

SEQ ID NO: 153567 - protein, 39 aa, Heterodera glycines
  Coding regions on vcDNA: vcDNA=SeqID_79990; Strand=-; Position=1 -85,243-277
MCYHQIDHVGVVASRCARRFEKGATIFREDMSRVVNYMD

SEQ ID NO: 153568 - protein, 456 aa, Heterodera glycines
  Coding regions on vcDNA: vcDNA=SeqID_79991; Strand=-; Position=1 -1133,1325-1562
MYKFLKRVKRFDKVSLHLLLILFLGCCQINATNEKHTDKKTEKTSTKFQIGPIGLVNVTEEDQSERENPSHQSTKTLKIQDAKHFVEQLQIPITNLTSRHDPDQVTTEIPITEGSGDDKPMTNSITIPINRTNYQADSKTKEIPIAGDVDMKEPNEHQVADKQDQSPIGGNIRQLMMAELDETSAKDNQQKSGNNDNFLSKSSHSSKSFASHATNIGTPSTSMALSIKSPKVGSKSSLVAVPKASGQLALSKSYPQEKHHGISKFFKFSCSPPKQPDPNFLSNINIRTKSFRMTSRMPSLDNATSKKSLARMYSNQKTKKPPLPPLPPKPSPSASFRRNGPILGVHEGSLKAVGSFREQIEEQKKYLIPADRNSGPTNLAVDNPTKMITMLKQGNFLDLEPNPNAEELLDEMDKCNKFSIGAMKILRIQNSAQTKINEYYVFPEPISGGATSRVIL

SEQ ID NO: 153569 - protein, 387 aa, Heterodera glycines
  misc_feature (367)..(367): Xaa can be any naturally occurring amino acid
  Coding regions on vcDNA: vcDNA=SeqID_79992; Strand=-; Position=1 -73,130-163,222-271,389-522,602-633,702-959,1225-1267,1331-1382,1700 -1798,1967-2167,4177-4285
  Homolog annotation: Hit_ID=NP_741209.1; Match level="QueryCoverage =99%, HitCoverage=94%, E-value=2e-75, Identity=39%"; Hit description =pim (mammalian oncogene) Related Kinase (prk-1) [Caenorhabditis elegans] gb|AAM15548.1| Pim (mammalian on
FVLKKVLDVSICLFNHFGFRHDKEHTLREFHRQYRHTLREFHRQYRICICGEIGSGGFGRVYKVTYRLADGLPVAVKSIRHKRVNGWTMAERRIIPTEICFIEECQDVQGVVRLIGWFTSRRRRGFLIVMERPANFMDLFDLINTFGWLEERMARGLFVQIVDTVVELYKKHSVIHRDIKDENVVVDLDSGTVWLVDFGAAELLERANSPNSSGTLSYSPPEVFKRDCFYPLEGVFKRDCFYPLEGTVWSLGILLYLLVVGKPPFRNELQICTGKLRFPRNVSSECRAIIRRCLCPSPEGRVSLEELQQSEWILNNETTDSFFATFEAQWRKRKRVNKVLSVGIGEQTDKGLFSLIFFLKIHITRFXGCFEALSTNQASISTNFEPL

SEQ ID NO: 153570 - protein, 150 aa, Heterodera glycines
  Coding regions on vcDNA: vcDNA=SeqID_79993; Strand=+; Position=1 -345,587-680,743-756
MHPQGQQQKQQQQKQQQQQKQPKHSPHSIPIVSRMGGAALSHPHHSQPYHHQQQQWSPGAAVAPVADFGPSSAPSVSGSIIFMPSVVSGDNAGGGGMGFSSTSEFSSRMALLIRDGASVYLSASSSNNDDDENESDSEISPNCWKEELLK

SEQ ID NO: 153571 - protein, 45 aa, Heterodera glycines
  Coding regions on vcDNA: vcDNA=SeqID_79994; Strand=-; Position=1 -23,359-473
MGKMLNLGGNLRRRARIRSYFGSVSNPEPGLEQKFENSIFRTSQF

SEQ ID NO: 153572 - protein, 84 aa, Heterodera glycines
  Coding regions on vcDNA: vcDNA=SeqID_79995; Strand=-; Position=1 -23,82-313
MKKDERHFLGITFGFAVKQQIKLDRSIQWEKGTYAYESDGYLLINGKGKGINAEYSYGVGDTVGIGVNSATRQLIFTKNGLRLG

SEQ ID NO: 153573 - protein, 343 aa, Heterodera glycines
  misc_feature (37)..(37): Xaa can be any naturally occurring amino acid
  misc_feature (110)..(110): Xaa can be any naturally occurring amino acid
  misc_feature (175)..(176): Xaa can be any naturally occurring amino acid
  misc_feature (197)..(198): Xaa can be any naturally occurring amino acid
  Coding regions on vcDNA: vcDNA=SeqID_79996; Strand=+; Position=1 -143,231-379,509-758,812-919,1048-1173,1748-1819,3020-3160
  Homolog annotation: Hit_ID=CAE68940.1; Match level="QueryCoverage =99%, HitCoverage=36%, E-value=1e-55, Identity=39%"; Hit description =Hypothetical protein CBG14920 [Caenorhabditis briggsae]
WRCACACANPVAVPRRALGGFLMQFIILLLITFFSVXCFILLKLNFLSRFLDAISLFTPLNTPSKWRQVIHDMWPFANGSYVSGRAVTKSREVQVVVVCRFSNRNFEKKXCFHQKTASFFFKNNVRVHHEHRNCCSRDLCLQMRGGRQAGGEHRQVTSRSGHRGGGGENENFKTXXKTSFTPSPNPPNPLGKSVKTXXKTSFTPSPNPPNPLGKSVNSERFFNLFFAIFLVYHLQFYPSNVSFLSGLWEKEFERTIRTYKSPYISFTYFHSQTLAEEAKRNAHTLVLHFVFAFFILICRRCTTCPICRAHNCYIDWTLSKPFLAILGVVNAGMGIVTAIGLLN

SEQ ID NO: 153574 - protein, 101 aa, Heterodera glycines
  Coding regions on vcDNA: vcDNA=SeqID_79997; Strand=+; Position=1 -75,261-491
MLLSLRPSTKLGDQSINLNCFLIIMFKNDDGEVVEFDDDVLKAVLNKALLSDSAAQAQAMDISFRPHDYLVGILEWISRDLIPLFYQIHGYPGFDFLKFFY

SEQ ID NO: 153575 - protein, 51 aa, Heterodera glycines
  Coding regions on vcDNA: vcDNA=SeqID_79998; Strand=+; Position=1 -54,102-203
  Homolog annotation: Hit_ID=EAL49175.1; Match level="QueryCoverage =94%, HitCoverage=85%, E-value=3e-10, Identity=58%"; Hit description =hypothetical protein 50.t00006 [Entamoeba histolytica HM-1:IMSS]
MCQCMCDCLLLILCFIFPPIAVLMRQGCTIHFCINILLTCLAWIPGVIHAI

SEQ ID NO: 153576 - protein, 335 aa, Heterodera glycines
  Coding regions on vcDNA: vcDNA=SeqID_79999; Strand=+; Position=1 -261,376-699,1000-1232,1274-1463
MPTRLRRFAICVGVDEENGTCLMVYENDLNAIEVRMVFSGVQIGKWYRFDLAKGTRRNWEVAEERLPTRIMPRGDAGSGGTRGDRIQLCLPIFFVPNFKCFGCTWRVTSPTSFNDKMHFNFVSPRLEAPGKINFSEERLAEWNIRPGEQCFAFLTLYYKICLFKKWMPLFRDCQGPGPSIKPPQWTLDAVEHFHRVNVDPLALSVLSVSLGASKEWGILLDLVIESEDERNGMGFILCLRDGKFAFGRILKTEGHNDSCWRANVGDTVGFSLIDVDCFNYPVRLALNVIAWQSPAFTSVDSDVLSDQFPQESLPEFPSVRLISKSTGKMAQHLVI

SEQ ID NO: 153577 - protein, 89 aa, Heterodera glycines
  Coding regions on vcDNA: vcDNA=SeqID_80000; Strand=+; Position=1 -89,286-466
MSRICHFLSEKKIKPENADFFFCITPSSYSNFCCVFNLYCLKIKIRLYLAIVTFISALHGCIVSLGLLNSGNLHGDLMITCCFIDFFMV

SEQ ID NO: 153578 - protein, 95 aa, Heterodera glycines
  Coding regions on vcDNA: vcDNA=SeqID_80001; Strand=-; Position=1 -133,311-465
MPAQKRRRHKILWTRKVRESLCYALLSKSMPYVMRYLVKSPLCHALIESVFFGFRTRSQSAGGPSRLAPCLDEARKVQGWAKHEKVQVIKLKSKN

SEQ ID NO: 153579 - protein, 57 aa, Heterodera glycines
  Coding regions on vcDNA: vcDNA=SeqID_80002; Strand=+; Position=1 -171,232-234
MPMLVAVLLLATLITMNMLMLTNGLCEYNHTLGWCQNDGDCLKNCAPVAENECDCVS

SEQ ID NO: 153580 - protein, 107 aa, Heterodera glycines
  Coding regions on vcDNA: vcDNA=SeqID_80003; Strand=-; Position=1 -96,1061-1182,1242-1347
MPLLSLDTLTIEHIVWPISNGLGLVAFSSCTPTSVFFNGILPLLGLNLLTFEYINGLFLMAYSSCTPVLFMCSTEYRKAFCKYLCRNQYGSNVVVPLLNMRSSQIRS

SEQ ID NO: 153581 - protein, 221 aa, Heterodera glycines
  Coding regions on vcDNA: vcDNA=SeqID_80004; Strand=-; Position=1 -375,713-1003
MLHEMGLELVYSKSFPDAIGHFMAQRGREARQLMESMNALETVVDARRLETEKGGVEAAQREYGAALARLRKSSGTPTTDGEGDSANDKDGSGRNEGPTGWGRPHNQQQQRQWHQRQQRPVETTVRFFEAWGNELFSLLLTPFIVQGTLSTSEWQVLTMYRVFAFRRRPRQCQTDKDDDTRGKNETEEGQNGANDDEVAKTVTEATAEEEDYANEEKKEEE

SEQ ID NO: 153582 - protein, 104 aa, Heterodera glycines
  Coding regions on vcDNA: vcDNA=SeqID_80005; Strand=+; Position=1-315
MLGPSPQHFAAFAVRQPQLSVSARNDFGRVPSLLPLLLLLVHLQQRVEPPTVAFANPAKAKQMPQQFLHRESDREPKWKRIKPSEWMPNCAVNILNNPINAMNL

SEQ ID NO: 153583 - protein, 458 aa, Heterodera glycines
  misc_feature (9)..(9): Xaa can be any naturally occurring amino acid
  misc_feature (35)..(35): Xaa can be any naturally occurring amino acid
  Coding regions on vcDNA: vcDNA=SeqID_80006; Strand=-; Position=1 -108,257-286,331-440,492-588,901-1090,1228-1430,1475-1617,1678-1977
  Homolog annotation: Hit_ID=CAH40833.1; Match level="QueryCoverage =96%, HitCoverage=84%, E-value=3e-69, Identity=37%"; Hit description =protein-O-fucosyltransferase 1 [Caenorhabditis briggsae]
LLIVLVVFXLFLFVSIINLHFFLLKKFSLANGPTXNAFVLFCPCMGRFGNQMEQFLGAFAFAKSLNRTLMGRFGNQMEQFLGAFAFAKSLNRTLVLPPIINYPPGAEGMIEFDQFFLGMIEFDQFFLVPPLAQFHRIVSLRDFSHGIAPMFCWSPRPGLANASLLGCHATEGNPFGPFWRYAGTHFVGEEYFGVKTGGFDTQRETIREKWATEFPAHSSPVLAFSSAPAAFPVRPDHRFIQRFGQWNDRIKQKAIEFASRNFGHGKAFVGIHLRNGRDWVNVCQFLREEKKRQLFASGQDWVNVCQFLREEKKRQLFASGQCTGPEEENGPLTADACDPSMDIILEEVRFHVVRLSASAVFVRFHVVRLSASAVFVASDRDHRLAQIGAHLAKSALARHRKKCRRMPMDLALLGMADHFIANCVSTFSAFVVRQRHFGDEQRHRSVSFLAFPNAAMEL

SEQ ID NO: 153584 - protein, 187 aa, Heterodera glycines
  Coding regions on vcDNA: vcDNA=SeqID_80007; Strand=+; Position=1-562
MANFSPPSDNTAPKKFLSDLDQLQIPKEIDSDNSIPDYAKLLIKQLHSLLSTASVLIHSQAAAVDAVEEERRLRTVVVTNVPESISDKAAERAREDRAVVDEILNATDVDQAPIVFRVGKRMDGRPRPLKMEFPTKHAARHVIRMRGKVQALNGLHNVRVRESMTKEQLSERRKLIEDCAKKRQTDS

SEQ ID NO: 153585 - protein, 412 aa, Heterodera glycines
  Coding regions on vcDNA: vcDNA=SeqID_80008; Strand=-; Position=1 -580,624-847,889-1058,1108-1221,1271-1419
MGAKRIEFKIGDQVQFVNYQNGKTVWLFGKIVAKNGLILKIQSPQLAHKIITRQANAVRLSAATGTDHEWSNDEVIRPLQQYLPAPVHSPVRSPQGHKQNTPSPDHRMQPQERTDQRDQQQETEEQTPELRRSKRTTKKVRFLSPRPTGQRHEIRDKVKLEHDGALYVFDQLSADGLKKFWRCEFHGPSDKCKGRLHTDLNNVVQKLVGVHSCDMNAAHVECQRLVTGLKRRAAETCEAPATIRAQVLQNTCTPVLAAFPSKSATKKWVIKRLRRDENAPRTEPLNLEQLEIPNTYRIYKRTEIGTISIGDTGVFQIQGQNGPQRILIFGRASTADWAHQMSDIYADGTFSLTPPLFSQIYVLRDGWVFPICYCLLTSKCAAIYTRMLQLLLERWPNFAPQTISMDFELAMV

SEQ ID NO: 153586 - protein, 46 aa, Heterodera glycines
  Coding regions on vcDNA: vcDNA=SeqID_80009; Strand=+; Position=1-140
MNAAHVECQRLVTGLKRRAAETCEAPATIRAQVLQNTCTPVLAAFP

SEQ ID NO: 153587 - protein, 34 aa, Heterodera glycines
  Coding regions on vcDNA: vcDNA=SeqID_80010; Strand=+; Position=1-105
KVKLEHDGALYVFDQLSADGLKKFWRCEFHGPSD

SEQ ID NO: 153588 - protein, 232 aa, Heterodera glycines
  Coding regions on vcDNA: vcDNA=SeqID_80011; Strand=+; Position=1 -133,627-795,1055-1210,1608-1707,2323-2462
  Homolog annotation: Hit_ID=XP_415510.1; Match level="QueryCoverage =40%, HitCoverage=19%, E-value=3e-16, Identity=45%"; Hit description =PREDICTED: similar to Folylpolyglutamate synthase, mitochondrial precursor (Folylpoly-gamma-glutamate syn
VLGTTLPQIAWNKAGIAKPGAVMLSVEQPRDAMRVIEERCAERTCPLFIVPPLTDYRWPSSTGGQRPFELGIAGPHQHINASLALQLARIWLLKRHGRHIEADQNGTEIANKSSDTNSNDLQQLLQLDGNNTVDKKEPNFPTNRLNAFALTHVLCPMVPPKCRCHRHSAVRFSHSHFVVPLHRRPNCVSDALDKVRAVAVENSKGSAGTELHVLVTGSLLLVSDWLGGGFFR

SEQ ID NO: 153589 - protein, 46 aa, Heterodera glycines
  Coding regions on vcDNA: vcDNA=SeqID_80012; Strand=+; Position=1 -129,416-427
MTLMLHNIRGLFRQKLSGCLEMSSLSSFWFGPFAQREFGHFSFEKL

SEQ ID NO: 153590 - protein, 203 aa, Heterodera glycines
  Coding regions on vcDNA: vcDNA=SeqID_80013; Strand=-; Position=1 -145,1780-2246
MSSFAVPFLITLLLVTLTIQSDNATTVDDQDGQMAAAAGDKRIFRFKREMANPIATKKQKVKLSYEGHLYTFAKMSSDGMTKFWRCEFKNSTDKCNGRIWTDLHDQFIRLATPHTCPADASRVDAQMVTTAIKRRAIATFEPPSVIRAEALQNVPSPSAILVSKQAAKDVKTKYFSYNKNNSNLVNQKSSPRSECAPRRSCKS

SEQ ID NO: 153591 - protein, 70 aa, Heterodera glycines
  Coding regions on vcDNA: vcDNA=SeqID_80014; Strand=+; Position=1 -165,685-732
MHLKLCLLFCSILFLIILTDPIEAENKKLEQKSFEEIFGEKLEEKRYGEICKKIGNMSPKNVIESKKNHF

SEQ ID NO: 153592 - protein, 213 aa, Heterodera glycines
  Coding regions on vcDNA: vcDNA=SeqID_80015; Strand=+; Position=1 -149,640-820,1978-2157,2441-2569
ESKLEGPFNFSAVPLHGNFKDVEAKVNVTNHIKPVWICSINTHKKTLAYSYEVPFQNASKLIMDKLMRWYHSENHDKQFSLVPLPFQNVGRMREALNKELDANYDGCRDFANGDDALANVSLRLHRLPIPSYMNKQMATITVPPFLTTLLFVCAFSMLKDIAVERESGIMAYMSVMGLNQFAFYGSHLLIAVLKMLPFALIFASLCVIYRLIE

SEQ ID NO: 153593 - protein, 40 aa, Heterodera glycines
  Coding regions on vcDNA: vcDNA=SeqID_80016; Strand=-; Position=1 -105,153-170
MPKWGDNDCTMDGPTKFEQQFEQCQHLFEWRKLHLNNLLR

SEQ ID NO: 153594 - protein, 18 aa, Heterodera glycines
  Coding regions on vcDNA: vcDNA=SeqID_80017; Strand=+; Position=1-54
MPSCNGDRHPQGEGEQRR

SEQ ID NO: 153595 - protein, 430 aa, Heterodera glycines
  misc_feature (291)..(291): Xaa can be any naturally occurring amino acid
  misc_feature (383)..(383): Xaa can be any naturally occurring amino acid
  Coding regions on vcDNA: vcDNA=SeqID_80018; Strand=-; Position=1 -72,126-323,362-495,551-860,960-1023,1066-1258,1368-1477
  Homolog annotation: Hit_ID=NP_505849.1; Match level="QueryCoverage =90%, HitCoverage=45%, E-value=3e-52, Identity=33%"; Hit description =beta-galactosidase (5L700) [Caenorhabditis elegans] emb|CAA98542.1| Hypothetical protein T19B10.3 [Caenor
LQGGSKANRRTIGIHFHLFRLWHSKGPPVNSEFYTTWFSMKGPPVNSEFYTTWFSMWGEKSMVRQEIGPVLKTMDYMWAENASFSLYMIHGGTSFGFWSGRETNGPVITSYDYAAPIDEAGQIVITSYDYAAPIDEAGQITPLYGAIRNWIGAKKDWPNPPLPLPKNSPSKMFAVKLGDFIPSKMFAVKLGDFIALTNSSSLSSSDSRQRCIHSSDGPLNFEAFYRDHGFVWYSASLETDGKTLEVPELRDHAYAFLDGIFQANSKGKNVKTLVFLIAGQFESQRNDVTNXVENIGRLTYPLTNNFKGLFSPPFIDGKVISKRWIYPLTNNFKGLFSPPFIDGKVISKRWIQCGVNLDNVYAEIEKRMAKSKNRKEVGKRGIXREKAFANAKNDTFLDSRGWGHGVALANGFNLGRYWPTQGPQVFLNFE

SEQ ID NO: 153596 - protein, 170 aa, Heterodera glycines
  Coding regions on vcDNA: vcDNA=SeqID_80019; Strand=-; Position=1 -93,657-916,1792-1899,2603-2654
SDAYDLLFSDADDMTANLPTSSSSLAASTSGLANHNETEVLLLEHAIAESLKLKENEDIELAKAISISEVRNDFGNGNGHELLSIDPAEIDTQKALMKQIKKDRKMKMRHKRGAFPMNKLRSHFIVSGNTNEKIDNVFGIHIGIGIIVIILGEGNRVSEGLSNDTNSVGF

SEQ ID NO: 153597 - protein, 58 aa, Heterodera glycines
  Coding regions on vcDNA: vcDNA=SeqID_80020; Strand=-; Position=1 -145,207-238
MHFPYFHQIFVFALIIVNRAHGQAADDNQIDGTGYENYDSDDLEALGWSFYLFSKNCT

SEQ ID NO: 153598 - protein, 21 aa, Heterodera glycines
  Coding regions on vcDNA: vcDNA=SeqID_80021; Strand=+; Position=1-64
ISNLNIFIEQTTGTLVLLCGA

SEQ ID NO: 153599 - protein, 77 aa, Heterodera glycines
  Coding regions on vcDNA: vcDNA=SeqID_80022; Strand=-; Position=1 -75,491-646
MARKVKDCFVPEVNLLNDATEKLAQASAQRPIRQLLLHLYCSKAHPPKKDIPNDEDGMRMRSEGDEPSQQQKPAIVQ

SEQ ID NO: 153600 - protein, 73 aa, Heterodera glycines
  Coding regions on vcDNA: vcDNA=SeqID_80023; Strand=-; Position=1-332
LFSPPLLLRLNLNFILGLNIVYTILFSFVPSLSIISPSSFPIFIVFFSAGASVYSRHRLFQFLITCIKYLISL

SEQ ID NO: 153601 - protein, 555 aa, Heterodera glycines
  Coding regions on vcDNA: vcDNA=SeqID_80024; Strand=-; Position=1-1668
  Homolog annotation: Hit_ID=NP_001004509.1; Match level="QueryCoverage= 97%, HitCoverage=35%, E-value=8e-52, Identity=28%"; Hit description =si:busm1-180o5.3 [Danio rerio] emb|CAD60788.1| novel protein similar to DNA polymerases [Danio rerio]
MPVPLGALPGAFGLNVQDKEFFPHLANVEANYGHILQSLPPKADYLYGGMTPDRQRRFDQWYAEHRHQQFDLCEQLAAYCTNDTRILIEALVAFRTEFLTISDPMERHGCLDDDDDDDEEEEEQDDDNAFEVIGGGIDITWEPMTIASASMRHFRLNHLKRDQLAIVPECGYDTTNTQSLVALKFMDWYAKKNGVSIQTLHSPDGEKKIGQYTVDGYIAATDTVIEVNGCHWHAHDHPRHRFQPQTVMANGKTAQRIREDDARRMAFITSQVQQVLVFWECEINAEKRNNDEMKRAFAQYNDSGPIRLKDCYHGGRVGPQRLHYEVPEGWRMKYYDVRSLYPHTNAVTAYPVGHTTRVNIIGEAEQAVDWRRADQVPVRGILKVFVVPPHHVDVPVLPVKFDQRLLFPLCRTCALQHPHGAVNEDYECTHREDDERGWVSTVTSIELEEALRNGYRCTAYYRSVEWDDTRWSDRVFRGYVAEFMAMKTHASGFPDEIGTAEEDQQQFIEECEEKFGIRIEREKMVHNKAKRTIAKLCNNSLWVDSLYATGCPKRL

SEQ ID NO: 153602 - protein, 406 aa, Heterodera glycines
  Coding regions on vcDNA: vcDNA=SeqID_80025; Strand=+; Position=1 -23,80-174,253-357,399-431,496-593,651-732,778-838,927-1021,1276 -1309,1357-1618
  Homolog annotation: Hit_ID=CAE58810.1; Match level="QueryCoverage =100%, HitCoverage=59%, E-value=6e-99, Identity=51%"; Hit description= Hypothetical protein CBG02017 [Caenorhabditis briggsae]
GGWPGGQACLPAIQMAFACLPAIQMAFEDNMEPDLLPNYALLLHQFNSQCQPGLTAWQLFQCQPGLTAWQLFELLYKPPTKLILLSGCSPVTTLVAEAAPVWNLLVTLVAEAAPVWNLLVLSYGASSPALSLSYGASSPALSNRARFPTLFRTHPSANMQNPTRVHLFEKFKWKRITILQSVEVHLFEKFKWKRITILQSVEEVFDSTAKDLEEQCSEKGIRVERHSDLEEQCSEKGIRVERHSFYGDPTDALKPTDALKAIRRQDARIIVGLFYVTEVRPDICSAYLHGLYGRRYVWFMIGWYSDAWFIPPEEEALNCSVWFMIGWYSDAWFIPPEEEALNCSRAQMERAAQFHFTTESVMLSRDLQPAISGMTGEQFQTRLRRRISTDPARTGGCPEAPLAYDA

SEQ ID NO: 153603 - protein, 119 aa, Heterodera glycines
  Coding regions on vcDNA: vcDNA=SeqID_80026; Strand=-; Position=1 -49,158-426,663-704
MFRGPFTLILSGATGSGLIGEGVETFNGIPDMNKIKEQEKPLLLILDDLMLNMQNNFLDLLFTRGSHNWNVSVIFVTQSLYGRDIKTARANAHYLILMRNPSGQLQLRSKGEYSVPKEA

SEQ ID NO: 153604 - protein, 151 aa, Heterodera glycines
  Coding regions on vcDNA: vcDNA=SeqID_80027; Strand=+; Position=1 -360,469-642
  Homolog annotation: Hit_ID=S52407; Match level="QueryCoverage=96%, HitCoverage=78%, E-value=5e-14, Identity=27%"; Hit description=TATA box-binding protein - Entamoeba histolytica
YIVSKMQKPIIVNIIALANLGTGIKLNSLTITECEFKYNPRKFNAAVIKCTTPIKATALLWESGKMICLGTKSLIDCENAIKKFIEIIKGSGCPGASYTGLNFKRGKSMTALIFWTGKVVITGTKNNSEIEEMYHHILPYLKMAQKKLGRR

SEQ ID NO: 153605 - protein, 79 aa, Heterodera glycines; identical to SEQ ID NO: 128068
  Coding regions on vcDNA: vcDNA=SeqID_80028; Strand=-; Position=1 -3,121-216,812-952

SEQ ID NO: 153606 - protein, 112 aa, Heterodera glycines
  Coding regions on vcDNA: vcDNA=SeqID_80029; Strand=-; Position=1 -9,1062-1292,1590-1688
MSLERENAYKCELLYPLQKWPILLRLHSNCLPFLSIHTLDIAAKYFVVAETDSPADYLLKFQILIVIDKNNHPFEQMRDLPLGKWFNFIIFGTLEFGRQFFVNMTVKLGKPF

SEQ ID NO: 153607 - protein, 38 aa, Heterodera glycines
  Coding regions on vcDNA: vcDNA=SeqID_80030; Strand=-; Position=1 -34,530-612
MAQPNTPTVEVAQLTRIRNRPILYNWLPVRVHDAYNSF

SEQ ID NO: 153608 - protein, 83 aa, Heterodera glycines
  Coding regions on vcDNA: vcDNA=SeqID_80031; Strand=-; Position=1 -118,261-394
MYIDEKAVATATTNLKKGRTMPPRAAETGTFVTDRVGAVVFAFFSTTLSQTMQNGEFDCTTICCWSTLRNDFMRSMLINKCFV

SEQ ID NO: 153609 - protein, 201 aa, Heterodera glycines
  Coding regions on vcDNA: vcDNA=SeqID_80032; Strand=-; Position=1 -169,629-756,1426-1488,1677-1819,1908-2010
MGRKTMTLTAVVVMVKSANITHSEFGSRTEQAFHLSFNVSFLLLGPAKSYKMIPSPNSTDQFSILWLAVPAAEHATENHPNRRFPISGQFSKIGTVSGKELAGANGFSSLMVVTSAKIEESKILKIIRSNLFFFFIFQGRCHYVLRSHGLYAGQRADVGDEPANFFAVQANVMELEMYIDEKAVATASTNAASSGNGNICH

SEQ ID NO: 153610 - protein, 99 aa, Heterodera glycines
  Coding regions on vcDNA: vcDNA=SeqID_80033; Strand=-; Position=1 -195,441-545
MKRLLLASTEISSIGTPFSMDIADLLDEIRELHIFGRADLMTQEQIDNFSNKCSMAISRQRYFFSSERFMRYKGDELLLKIGEHQTLLNSIFDRQIGFL

SEQ ID NO: 153611 - protein, 189 aa, Heterodera glycines
  Coding regions on vcDNA: vcDNA=SeqID_80034; Strand=+; Position=1 -239,635-965
MFYEAVRQVLDNITQMVSPSHTMNSNGTMAQSNNQQQKAPLSSAPPPPPPPPPPDFKNLLAGKQQQATFADKLRDVKLRKIGFVVASYGGTPSTAGAASAAHDSQLTCEPVVKGPTQLTCEPMVKGPTSSAHNDIANSEARPKATTTSSDFERMKGELLELFSNELQNFKRELAQTIRDEVAKLSADRR

SEQ ID NO: 153612 - protein, 36 aa, Heterodera glycines
  Coding regions on vcDNA: vcDNA=SeqID_80035; Strand=-; Position=1-131
MARKDFRFPTFLGSEFRLPKFLMKSRKFFKFFFSQN

SEQ ID NO: 153613 - protein, 24 aa, Heterodera glycines
  Coding regions on vcDNA: vcDNA=SeqID_80036; Strand=-; Position=1 -58,468-484
MNSHNKIYPMINLHEKNKGSTHSD

SEQ ID NO: 153614 - protein, 62 aa, Heterodera glycines
  Coding regions on vcDNA: vcDNA=SeqID_80037; Strand=-; Position=1 -45,107-250
MLDTKNNNIVGHVFGFGYKRLVLDKDLNVEKKLDFVSTGKAEIKRHNEFQPASISSEFISFF

SEQ ID NO: 153615 - protein, 120 aa, Heterodera glycines
  Coding regions on vcDNA: vcDNA=SeqID_80038; Strand=+; Position=1 -109,173-324,367-466
MTHPMKRPIITNAKETPKIVITVIENAVEKFEKLIYYECVENVLLLANHFGLDTIENRSVEFLVEKSKKSAIQKFNLAHQYAIISMKKKILKDMTRKDFVVAGKNIYRDLLEMEKRTLEN

SEQ ID NO: 153616 - protein, 44 aa, Heterodera glycines
  Coding regions on vcDNA: vcDNA=SeqID_80039; Strand=+; Position=1 -22,527-639
MLLKFFDTAPQPNPNAEMPPQDEAGPSTSAASVEEAMEPPPKTG

SEQ ID NO: 153617 - protein, 133 aa, Heterodera glycines
  Coding regions on vcDNA: vcDNA=SeqID_80040; Strand=+; Position=1 -154,206-351,954-1055
METAVDQFKAFLDEQTMVRTLLSKKTKAHLLLHHFVPFARQHRFLGLLDEQGDEALHSVWRRLEQLWKTMPDSEQMRQQLEHHFVSNWLLDTGRLDELKLNSSEMRNYWLGQILAIVNQKKPIFFVLHLQGIF

SEQ ID NO: 153618 - protein, 46 aa, Heterodera glycines
  Coding regions on vcDNA: vcDNA=SeqID_80041; Strand=-; Position=1-167
NHRNTSIACTGNRTWDSPFGDLLTDHFATHTNLFWYRSSVSGRRVY

SEQ ID NO: 153619 - protein, 107 aa, Heterodera glycines
  Coding regions on vcDNA: vcDNA=SeqID_80042; Strand=+; Position=1 -121,500-699
LLVNRLSEHADNASASVAADDGVQQDIGPLLIRCSLDIVAEAIMGVRLDAANAKCREYVQAVKEFNDLAHIYSTSALFTFIPISWHLFGRAKETKKCVAKLKQFTRG

SEQ ID NO: 153620 - protein, 57 aa, Heterodera glycines
  Coding regions on vcDNA: vcDNA=SeqID_80043; Strand=+; Position=1 -61,244-356
MEHALDREELREQVDTFMFEDRIMQEMPRHGLHINEMDMDELDLDLDELDISMIEFG

SEQ ID NO: 153621 - protein, 112 aa, Heterodera glycines
  Coding regions on vcDNA: vcDNA=SeqID_80044; Strand=-; Position=1 -135,829-1032
MRLVGFYQQIVVSESAEVWQCVSGTSHDDCKNFFAELGAVLRLANNSLLIEIDTSSTIGGEDIFEFSCDHFSLFGVNSIIGRALVLRKPGEGSVPCKTGEGSGIFLYYLLFI

SEQ ID NO: 153622 - protein, 162 aa, Heterodera glycines
  Coding regions on vcDNA: vcDNA=SeqID_80045; Strand=+; Position=1 -79,139-200,428-508,564-669,746-906
MLRAKIAELEGATSIASFDVLAPNGNEAINESDTCFGKFGGVDQQLKNFRGQFVKLEMELRETKQMNVVTNLENKALQAELKHQKLLMLTEQKAMEEKIAKMEKEQQKMADQLAQRQNDQQMKLEQFKQKNATDLEQLNKSQEGILVKIDEVETNERTHNNY

SEQ ID NO: 153623 - protein, 50 aa, Heterodera glycines
  Coding regions on vcDNA: vcDNA=SeqID_80046; Strand=-; Position=1 -34,181-299
MFFHKNFELLSENGQGLGPEIHVFRDSRYFVQKNRGPEPRVSAKSRSLQA

SEQ ID NO: 153624 - protein, 151 aa, Heterodera glycines
  Coding regions on vcDNA: vcDNA=SeqID_80047; Strand=-; Position=1 -69,1366-1462,1513-1584,1635-1850
MQNDQKFLLEKVNELKKEQKQRKPTTYFSPVICLLCNIFTQCWYGFSKNVKTWTKTLACPPLSSPADDLTVHIGNRKVKIEKKLVNGYSDYGVRCLVYVPIADGPSNAQRGNEEEAAAVVTLNELGIDMEQFMDFLEAISTNALLFPILPN

SEQ ID NO: 153625 - protein, 96 aa, Heterodera glycines
  Coding regions on vcDNA: vcDNA=SeqID_80048; Strand=-; Position=1 -123,679-744,805-906
MEKTSDVVYFVSINNRPSYIRHHIYDETKGRNRKFIRGATHEFREKFAKMEMELKLAKLELEIKVLEQKLKHQEMMVEQKALKEKVIKIEQKNEKK

SEQ ID NO: 153626 - protein, 90 aa, Heterodera glycines
  Coding regions on vcDNA: vcDNA=SeqID_80049; Strand=-; Position=1-273
MGEIWQAERDPIMRIMADQLCELCHGMFSHVNPNLRAQCSSQCYKNAQFRKCLEMYTALPEGHPGGTVETKRGKGGGRERNRTMAMGAEE

SEQ ID NO: 153627 - protein, 104 aa, Heterodera glycines
  Coding regions on vcDNA: vcDNA=SeqID_80050; Strand=-; Position=1-315
MNWPKSNWNGQKMIKERPANFGRSVKRAKKHRINKPINQRHFFLDKRPLVRQTLYLVRHAEKLDIIDKSWSNDKNELEREDSPLSPLGLRQADELGKWWANWGP

SEQ ID NO: 153628 - protein, 112 aa, Heterodera glycines
  Coding regions on vcDNA: vcDNA=SeqID_80051; Strand=-; Position=1-339
MASVRDQGIYGLLIVVFWHSENSTNLSTKRQLSVLDGLRFVHCSDDHSRGVIKRDEQKLLDWMGEQRQCFGDAQKHFSLPNRFFRQIRSKINAWNAKLSELKKCVRISKLSA

SEQ ID NO: 153629 - protein, 115 aa, Heterodera glycines
  Coding regions on vcDNA: vcDNA=SeqID_80052; Strand=+; Position=1 -55,183-277,398-595
  Homolog annotation: Hit_ID=CAE66773.1; Match level="QueryCoverage =77%, HitCoverage=31%, E-value=2e-19, Identity=51%"; Hit description =Hypothetical protein CBG12128 [Caenorhabditis briggsae]
MADNQKQQRFKGKVVIITGSSAGIGQAAAIEFAKDGAVVVIHGRDGQRINETEQKILALEVPADRILKVQGPIEEEKTAQKLVEETLNKFGRIDVLVKYLKVEEKMVILYKFNHK

SEQ ID NO: 153630 - protein, 352 aa, Heterodera glycines
  Coding regions on vcDNA: vcDNA=SeqID_80053; Strand=-; Position=1 -165,208-436,674-865,1034-1251,1342-1595
MPENNSQQRQVVKQYQQMNSATANERLLEHCESAICSGDAEPMERRTSDAGVNEVSDADGTSAEDCSGAECQSSGNQSPILPVESSAGTNALAAAACKALLFGQMDSKVLAKTLLSSSRATNICGAIGQQKDSSADLSNPLQMQATNDEIMRILQQVSSLTDQQQQQQQQQNHQNDASSTAAVSAAAASSKLATQSRDLIAHLASNAHKFPASTPPAATAPNWTHGSNNGTNPLLRISSANGTPMAEQTHLHNVQQQQPQEVVGQLFKEMSPATSLTTATTTQASNFGAGDDGNHQQQLVANELKELRNTVADLRTSAGSSNKLEQASQKGNDQKKQRMAKKKPTKDQNQLE

SEQ ID NO: 153631 - protein, 92 aa, Heterodera glycines
  Coding regions on vcDNA: vcDNA=SeqID_80054; Strand=-; Position=1 -114,407-504,618-684
MAGTVNRIMAHNSNTLCTPHLAATNRRTVAAQISKTAGPFSKNPQSWQCWVFKNFSYKLGFIDDFMARVLGTLMAPAFSCHWASIRLIGSEG

SEQ ID NO: 153632 - protein, 115 aa, Heterodera glycines
  Coding regions on vcDNA: vcDNA=SeqID_80055; Strand=-; Position=1 -40,388-590,703-812
  Homolog annotation: Hit_ID=CAE65859.1; Match level="QueryCoverage =88%, HitCoverage=24%, E-value=1e-31, Identity=63%"; Hit description =Hypothetical protein CBG10997 [Caenorhabditis briggsae]
LCVMCEVFQKRMLQQQQQISLVPQPGDVSQQHPQHKAFVCEICGKAFRFRSNLAEHRSVHTAVKPFVCKFCGKSSRLKGNLTKHILKHHKIEQKEYIGTEDYIIKKGKKSVKDPA

SEQ ID NO: 153633 - protein, 180 aa, Heterodera glycines
  Coding regions on vcDNA: vcDNA=SeqID_80056; Strand=-; Position=1-541
MVLVSEFCAQFLSCPTKSLRDRLNHPEDRVRVLQQLIGKKVQTTYKDRNGMRKSFLVGGMTERGAAFEPAYGRLRKPFNINVAAHFYARHRVKLHYPYVPCIIEGFTRGEDRYYPMELLEIVDDKKGGRLFGRLFTEIEAQEEEDTKSEASHSSNSSYLQFNGKGCKWYESIDEITNTGR

SEQ ID NO: 153634 - protein, 561 aa, Heterodera glycines
  Coding regions on vcDNA: vcDNA=SeqID_80057; Strand=-; Position=1-1683
  Homolog annotation: Hit_ID=CAA45514.1; Match level="QueryCoverage =45%, HitCoverage=92%, E-value=1e-24, Identity=32%"; Hit description =hydroxyproline-rich glycoprotein [Zea diploperennis] pir||S22456 hydroxyproline-rich glycoprotein - perenn
MTSNSFFVFLPSNVSDYPDNQPNKYRVRLPKPLHFSGSWVCGLHSISYPYSWHSTIGTLDDQWIDIHFTNLHSVDEDRQRVIRVPVPQASHKKVEQLRDFLQATLKSQEKVRLKPLAHEEGYFDKPVVLGSPPHAKRLKRSTIDDLSSLPSPPRYDETDEQQSRQQQQPQSPPRFDETEKEDKKVKEATPPPVTKQPIPPAPTLAPPSHPPTEAPKAPKQAAPKSATVPPQKPSVTPATTKTSPAPAPIPPIKQAPSAPKPSPSKTAAVPKPTPTPTPASKSTIPTPASSTKAQNIPKIPPTLAAKPKEPNVAKKSTVPTTVSTTSISKLTSQIESSPTTPKPPPPPIKPIPTSIPAPSPPPKSIAKDIKRSVEAPNESKKESKRLDVDDRFFGGLAAGDEFPDDDDKESEWPYDPFKNIVDDVEIQYLDDFERFKVVFKNPVISHLSFSPQLGYVLGFENPQHVGPQEISKYGCDLRGGFSSFAVYSKGLTENMIVGNSLSSLLRVVSVSGATPGDYNEKIYDSPIYARVLPREISEIEIELRTMDKGRLVPFAYGTTMV

SEQ ID NO: 153635 - protein, 359 aa, Heterodera glycines
  misc_feature (21)..(21): Xaa can be any naturally occurring amino acid
  misc_feature (58)..(58): Xaa can be any naturally occurring amino acid
  misc_feature (109)..(109): Xaa can be any naturally occurring amino acid
  Coding regions on vcDNA: vcDNA=SeqID_80058; Strand=-; Position=1 -34,868-1235,2113-2797
  Homolog annotation: Hit_ID=AAS21408.1; Match level="QueryCoverage =98%, HitCoverage=38%, E-value=1e-43, Identity=30%"; Hit description =putative integrase [Oikopleura dioica]
VFNVKNFKLSFEESLKERREXIKTKNTKFTILLHHLPHYHPCTNDQTPPPPPRSIQSXTEKGSTTNKVEKIRLATASTIASTSRKERTKNRARPSSTSSQCLQKGTESXTSSSSSSRVTSPKRNQNLKLTHERPRRVRFPRAKTIAAGFMTDVQVDLADFQALSRHNGGHRYLLVAVDVLSKRLFVVPLKNKRAEEMLEAFKELIEQMPMAPHRIFSDKGTEFKNKLVKEFFEEHEIEHEPVHSSVKASVAERAIRNVKQRLYRYFAEKQTLNWVDTVQQIVDGINSAPSRVHGMRPIDVNFRNAQKVWERMYGQQSFVKKTPRFRKDDFVRMSREKGQFEKGYLPNYGDEILEVDPSA

SEQ ID NO: 153636 - protein, 26 aa, Heterodera glycines
  Coding regions on vcDNA: vcDNA=SeqID_80059; Strand=-; Position=1-80
MKASFGRWADQMKECFGDGTFSLAPP

SEQ ID NO: 153637 - protein, 100 aa, Heterodera glycines
  Coding regions on vcDNA: vcDNA=SeqID_80060; Strand=-; Position=1-303
MKNEYKQKRKYSPNEWEKNYAEICKKVRVSHRTIENWKKQFGIRCKRITDEQKIEKMKIYWKIKKENPKMSDTEIEKILKIGKTNISKWKKHFVEEILKD

SEQ ID NO: 153638 - protein, 311 aa, Heterodera glycines
  Coding regions on vcDNA: vcDNA=SeqID_80061; Strand=-; Position=1 -367,814-941,2273-2475,2828-3017,3080-3127
  Homolog annotation: Hit_ID=NP_187133.2; Match level="QueryCoverage =40%, HitCoverage=18%, E-value=7e-14, Identity=34%"; Hit description =expressed protein [Arabidopsis thaliana]
AIIKFGVSKCLASLNCVQFVRVCRRRNSLCAEAVVQRFHCHRNSVRWPRVEAEQCGGASGPKRAPGTECEKCQEDATTTTTVPPSDDGKGEKPTRLTDQQFDQMQRVAAGTDEERKMDIDLKDWSKEERKNLYQFIRANFDASALDTECVDGQLTVRRMGANGRRDVDASSVDAAQLGARIAQWTRDGFLNYFGTQRFGTCGVDTAHIGRLLLSEQWEAATAALLAPRAEANGSLNACLRCYAGSSANASAALRMLERSNASAGATVERALLSALAKCPAGHKAAILALHRDMRTMYIHAYQSLVFNSIVS

SEQ ID NO: 153639 - protein, 114 aa, Heterodera glycines
  Coding regions on vcDNA: vcDNA=SeqID_80062; Strand=-; Position=1-347
HSKRQYFAKPSHCHGTKDAKAIEQIGSGGIGTNKGRIGQEGQQNQQTVGGIAGGEGRPFNAEGRPRGGSTGLEGMAMPTTEEWHCGGRAMPVTEEWQCQRRGIAMPMTEELQCQ

SEQ ID NO: 153640 - protein, 181 aa, Heterodera glycines
  Coding regions on vcDNA: vcDNA=SeqID_80063; Strand=+; Position=1 -198,713-860,1032-1200,1810-1838
  Homolog annotation: Hit_ID=CAE71854.1; Match level="QueryCoverage =99%, HitCoverage=48%, E-value=1e-43, Identity=46%"; Hit description =Hypothetical protein CBG18898 [Caenorhabditis briggsae]
SCGGPLVCPSGVSVATRDPFKCPQKASTAKGRRYTDKLGRSLYALTLAAKQKDPSYCLKNSRSDVKVIKYYEVECDQAKNTCAGMIAVSEEAKALYVIYRDSTIDRQLLQVEHFAIAAQFGAWEKFVNGSGVMTYFHGAFRSLFLEGGMKSQLMKLKETHERHRIWVGNFSISMSLSFLSL

SEQ ID NO: 153641 - protein, 215 aa, Heterodera glycines
  Coding regions on vcDNA: vcDNA=SeqID_80064; Strand=+; Position=1 -562,622-707
MLFLLFIFVFLIINNSTDKTLSVNLCKKCRPTFAEIFGEEWQNEIIIGGDENENETDQNANFHQNDQNESTDQNDQLDVQQKIEIIHKFHAIREGIKKRGKYSAKFWVKTEQKIAEKLGISRQKIYKWKKEFGIYYYKKKKQEFIERIDEFKRMSKNGKQKQFAKELGISEKTLSKWKKEFGIEIGKSRIRFTDEQKMSKMNDYYEMKKANPFFK

SEQ ID NO: 153642 - protein, 89 aa, Heterodera glycines
  Coding regions on vcDNA: vcDNA=SeqID_80065; Strand=+; Position=1 -21,240-488
MVRDSELVDEHAVRIADNVFKFVDWATFVTARRHLKSDPNIRHLFYSLDPATAQQLGIALEPKITTTVITFWSDVSTRYQSIPYEFFEF

SEQ ID NO: 153643 - protein, 53 aa, Heterodera glycines
  Coding regions on vcDNA: vcDNA=SeqID_80066; Strand=-; Position=1-162
KSKAMEYFQLDRRHGDELYGCLLLLLLSMAFTICATTFSQMQRTSVISQMHEA

SEQ ID NO: 153644 - protein, 153 aa, Heterodera glycines
  Coding regions on vcDNA: vcDNA=SeqID_80067; Strand=+; Position=1 -205,406-663
VSSKVNESESYDATTLGKLMNLDAKVVEWLEKGPYTDDDPLLVLDFLGPFINLHGDYNQNKAFLVQKLVAAGGAIIAANVDNVIKFATWDMFYEARRILMADLEVRHFFYNPNPAIALQNNINQFPIVSTTVVTFWSDDSLKLKTQPYQFFEF

SEQ ID NO: 153645 - protein, 85 aa, Heterodera glycines
  Coding regions on vcDNA: vcDNA=SeqID_80068; Strand=+; Position=1 -112,151-293
MSTSEVKPEDKSMDETSKNELRAEDTSIKDKGIGSVKETETNGAITTDNEPKIHAEKNETGDAAVGQKSTEEQFDKTDEKAEQQN

SEQ ID NO: 153646 - protein, 113 aa, Heterodera glycines
  Coding regions on vcDNA: vcDNA=SeqID_80069; Strand=-; Position=1-342
MPAKQNNDAKQGKVNDDGIFAVQQQHSADDTTDDGWEEDGIFAQCQKLPPCQQQKSSLLLTPAATSSSSAMVDSVISCHSSLASTSAFSTQQRWHRHDTIYICPCICFLISKI

SEQ ID NO: 153647 - protein, 79 aa, Heterodera glycines
  Coding regions on vcDNA: vcDNA=SeqID_80070; Strand=+; Position=1-242
LGSAAPSYAICSFDGHAMRGALLADGADMHLLWAALSIYGMHFDQPMAFHLFSIHKCGDDDGDETNVMMTGQAEQIVID

SEQ ID NO: 153648 - protein, 214 aa, Heterodera glycines
  misc_feature (213)..(213): Xaa can be any naturally occurring amino acid
  Coding regions on vcDNA: vcDNA=SeqID_80071; Strand=+; Position=1 -44,98-204,580-739,835-1011,1167-1293
  Homolog annotation: Hit_ID=CAE63759.1; Match level="QueryCoverage =88%, HitCoverage=53%, E-value=2e-46, Identity=49%"; Hit description =Hypothetical protein CBG08294 [Caenorhabditis briggsae]
SIDARIFKNFIRNYLQVYVTRSYLQVYVTRSVVGGMKRRRFGHISFVCSAAGQLAIWGYSAYSPSKFALRGFANALHMELLPWNVGVSILFPPNTATDGFRDELRTMPPQIRAIIRAISGTAGLFQASDVAARLVQAIEKGHFATTVGMEGWLLGTLSAGASPEPNGIQAFLQVMLGGLLRGVLLIYGHFNRLVRNCLHEAVETAADPQDSSXK

SEQ ID NO: 153649 - protein, 40 aa, Heterodera glycines
  Coding regions on vcDNA: vcDNA=SeqID_80072; Strand=-; Position=1-120
MCAVLSEERKGGGGGGKKRMSKRKEKEEEKEGRGKEREEE

SEQ ID NO: 153650 - protein, 292 aa, Heterodera glycines
  Coding regions on vcDNA: vcDNA=SeqID_80073; Strand=+; Position=1 -300,537-596,1165-1260,1396-1632,1932-2115
QQKKRIRLPLANPCPIQKIVWSSFDYLRGPELEFVWEADFLPAPTAEEGADGEQQQNYGQKSYCCTNGGTDGTTNAILEDAETVADVSCTNSSTDSSFSKNTGASGTSTAQYEEIDEFYNNELLQLSGDTFHNAGQFLVSSSTSEHCAGGPSQQRLTDELSSLNLSCQTDDTLRAVPSASRRTDNATAYNSQNADGDGEVVAVTTETDFATITTTTNHNNPPSSSSCADAMMKCCSIRMTSAAASKCAAAVPAEGTCSTITFRKRRRSSSSARSMPTRRPANSAMGTVPIAK

SEQ ID NO: 153651 - protein, 190 aa, Heterodera glycines
  Coding regions on vcDNA: vcDNA=SeqID_80074; Strand=+; Position=1-570
MYIETAQENLGKELTDQSVRADLLAGRQNLCKAISLLEKYNGKWEAIFLRVKGQALQDEEQNYRDFKPEGKAFMHWVDQARGLVDTIEGALGLSELGDAIPQPNQPAQVVQQPQLVHQRHDVTLPPITLPKFSGEPREWPLFWKLFETSVESLQIEDFKKHIYLLGCLPEKSVTRRAIDLYPPSDENYPR

SEQ ID NO: 153652 - protein, 566 aa, Heterodera glycines
  Coding regions on vcDNA: vcDNA=SeqID_80075; Strand=+; Position=1-1701
  Homolog annotation: Hit_ID=NP_508324.1; Match level="QueryCoverage =81%, HitCoverage=18%, E-value=1e-51, Identity=29%"; Hit description =predicted CDS, peptidase family A16 and RNA-directed DNA polymerase and Integrase, catalytic domain and Z
MGHNSQNCTSPRRCSQCGERHHFMVCYGEKSREGTSRGQPNNQMKREARKSSQSHLTMCEHAHKSVSGSEVFPDVESLSITTNVMTSVMVKKPHAFLMTRKILVRSKNNRRVWMEVPFLFDPGSQTSYASDPLIERLKPPKVTSEEMEVYGFGGERNGPMRFHSPVYSIQIRRTDGKCEEILLNRTERISTPFKMAEWNSEEFPLEEMDMADAMRFSREEPEILIGARHFWQFFQAKKEVSPGLFVIKTTLGPLVNGESDFGPELPNPGLSMMAIDESNQGQMPTAKEIEYFFNLESLGIKDDPNENDDQTAMSLFNKSIRRDKDGRYSVKWPWKEEVPDLPSNYRMAFSRLMSTFGKLRNSPDLMEQYDATIRDQLEKGIIEEARKAPGTLEHYIPHQGVLAKGKKLRVVYDASAHTRGTNSLNACLYRGPVILPDLVGMLMRFRCPKFPLLSDIQAAFLQIALEPEDREVTKFLWVKDVSKSLAPTNLITYRFCRVAFGVISSPFILAATLQHHLKGYDSPVANELAQSLYVDNTLLECESAEEALHKYAESKASLPHYLTLLV

SEQ ID NO: 153653 - protein, 112 aa, Heterodera glycines
  Coding regions on vcDNA: vcDNA=SeqID_80076; Strand=-; Position=1 -165,214-384
  Homolog annotation: Hit_ID=CAE59888.1; Match level="QueryCoverage =100%, HitCoverage=9%, E-value=1e-35, Identity=61%"; Hit description =Hypothetical protein CBG03371 [Caenorhabditis briggsae]
GVFTNPIYCTIWVFTLIVQFVIVEFGGRWFSTEPLTLDQWLWCVAFGVGSLLWAQVVTSIPTKGLPKSLTIGGGEVEPDTANILSGDEGGEAREKRSGQILWIRGLTRLQTQ

SEQ ID NO: 153654 - protein, 279 aa, Heterodera glycines
  Coding regions on vcDNA: vcDNA=SeqID_80077; Strand=-; Position=1 -450,503-893
  Homolog annotation: Hit_ID=AAM97979.1; Match level="QueryCoverage =79%, HitCoverage=17%, E-value=2e-76, Identity=64%"; Hit description =Membrane calcium atpase protein 3, isoform c [Caenorhabditis elegans]
VHFQLRPKVNVNGHRAEEVRIRFFHLWLPRVQQRGIRNHSEKVGRIQRNSLIVVLPFYRCKWMLGRNGHLSQFGSKDLDRLVREVIEPMASDGLRTICLAYKDYIADGTAQVEGNQLAFGGEIDWDDENAVISDLTVVAIVGIQDPVRPEVPEAIAKCKHSFETPKALLKANLMSVFLGQRSGIVVRMVTGDNINTARSIATSCGILKPGEDFLALEGKEFNDRIRDEHGEVCQEKLDQIWPKLRVLARAQPTDKYILVKGIIDSKLSANREVVAVTGD

SEQ ID NO: 153655 - protein, 80 aa, Heterodera glycines
  Coding regions on vcDNA: vcDNA=SeqID_80078; Strand=-; Position=1 -151,421-512
MAIKYGQQIAKYGHKMAKIWTYIFQIEGVISQFFFKFAKCKVKRSKMAKYEKCQNMDIKYGQNAKIWTNMEIWTNMEIWT

SEQ ID NO: 153656 - protein, 44 aa, Heterodera glycines
  Coding regions on vcDNA: vcDNA=SeqID_80079; Strand=+; Position=1-132
MPSLLLNPGPSTMNFFSSSLPLPSFFFRNRKKCYDLNPAEESHQ

SEQ ID NO: 153657 - protein, 923 aa, Heterodera glycines
  Coding regions on vcDNA: vcDNA=SeqID_80080; Strand=-; Position=1 -669,787-1234,1291-2292,2352-3001
  Homolog annotation: Hit_ID=NP_502797.1; Match level="QueryCoverage =21%, HitCoverage=54%, E-value=1e-22, Identity=32%"; Hit description =HASI (4P602) [Caenorhabditis elegans] emb|CAB16520.1| Hypothetical protein Y57G11C.19 [Caenorhabditis ele
MFFKHPFTMCVAGCTGSGKSQWVDRLLSHIDLMVSEGPITGVLYCYGEVNDNVLRLQRMENTATTSSDSNTTEGKHSIRMCHGAPEERDVEREARATGGRHLLVLDDLMSGGLRCSFLDTVFTRGSHNWGVSVVLITQHLFTRELRIARNNCHYMVLMRNPVGALQIRNLGAQLFPGGALRYFLEAYEDATAEPFGYLLVDMHPTTEQQLRLKTHIYPGEMCVKRTEGSGEKRRPSSRKLAPSRPPVLSEHVRRHIDFFRQLKAARSSPTRCQALVAGASSEQLLCLVESALNILRARVPIQRRHLASLRQRASDVRTLSRVRSTRSARRLLLNAHAPSTAQTGRGIPTLVGLLASVLVPVLVQRVFETTSSTHCTHATHPRGCLSTSDGQPQCSGGDVFYHVHEQVATPATPIERTARKMVVASSKHMNDDERLIHYQQEFKRYQKLLEEEAERPLNVQLSQRTTNALRDTVLQKAAPATATTTPARPQRTTPLSRRRGLQQQNQAPSASSSSSTRPTKSSSSSSSDEQQQPLPQQTVAPQKIGGLPKQAEPRMHAAMAYAQQNPGLLGVGGEDGQQILHLAQGAYRPIRGSNLDTLLRYHFVGRHQQQQPRSSTTTPTASVAKAPPGYKTFVNNARDDLQMWRLLFPDERAAAAAAGSDSASTVGGQPRRHQPLRGQKKTGAGRFSLSRLLQPNHHHAHKSVQKTSIMVIGSNAVRSLTVESLLDPIYKDERSPACFTSVEPLLREAKRRHPDARLTRAEISRYLAGQRVYTLHRQVRRRFCRLPTLASGLHTDWQADLADFQRLRAQNRGYAYLLVCIDTLSRQVYVQPVKSKRSDDMIAALKRTFARCGYTPWRLLTDKGREFTASAVQRYLRDEAEVRHHCMETSPLWHAGMAERANRSIKERLYRYFTHRGTHAGTR

SEQ ID NO: 153658 - protein, 190 aa, Heterodera glycines
  Coding regions on vcDNA: vcDNA=SeqID_80081; Strand=+; Position=1 -107,204-669
MDSFGTVAWILRPTAQTTGTAVGSMEFEEEENGTGKGSDGHGTLLFIESDDVEEEDEDIEDTPVATDSPSAATATVVDDSSDTVKGVEQQRSSEHTDVTDGAGGGGGSEGAKLLGGGEKEEVGGGQLIFYLPPLFVACSNAAAQLPVRVQRLFNEGAATPLPQCPRTTAYGGASATTLPTSYRASETGGA

SEQ ID NO: 153659 - protein, 155 aa, Heterodera glycines
  Coding regions on vcDNA: vcDNA=SeqID_80082; Strand=+; Position=1 -223,276-343,431-607
MNHKKLEHEGHLYVFAKLNADGFIKFWRCENKNNKDMKCRGRLHTNLNDVVLKQVNEHVCGANPARVEAQRVVTGIKRRAIETAEPPSTLRSIALQNLIKRARNEGITPAMPLNLNQLQIPQQYQIYARNENETENFLLADSGTFLLNENGPPQR

SEQ ID NO: 153660 - protein, 145 aa, Heterodera glycines
  Coding regions on vcDNA: vcDNA=SeqID_80083; Strand=+; Position=1 -240,296-493
MTSQVIGPALFVLHGKTEALIWLPRKEQHFFINDENVGSYKLGDWVLFDYNREKIIEQQKETPYETKVLYSKVVKQKFVQIKVPLVFFSDKHSSEVIAYSPGFGRVGAFVPNLAMDTMCFAWIALYVDFSAHNSQILYYVWVPNN

SEQ ID NO: 153661 - protein, 117 aa, Heterodera glycines
  Coding regions on vcDNA: vcDNA=SeqID_80084; Strand=+; Position=1-355
KTESNGEKKVIRCDLDKSPPNWAVTPIRNTVQAVEQRLHKILSALFKIELTAFVPRKWRPEIIAPESRMVPTNWFDEMLDFGMLLTEDMADKSVKVLAERNKVKNAIVRLTLLLLFI

SEQ ID NO: 153662 - protein, 146 aa, Heterodera glycines
  Coding regions on vcDNA: vcDNA=SeqID_80085; Strand=-; Position=1 -139,528-767,1047-1108
MDAMNFSHTRLLTDEVLSANNHEYVLHPDDLSDHKNVHRQKTKRFKASENPIWKIGLYRKINDKEIECIVCKKPNKGCEGGRRPTKAIRHLKTVHKNSHYVHKYEELLKPTMEQVEQMVNKIKVENEAPRKCKAQVKESEQEKETL

SEQ ID NO: 153663 - protein, 236 aa, Heterodera glycines
  Coding regions on vcDNA: vcDNA=SeqID_80086; Strand=-; Position=1 -169,546-725,1488-1642,2310-2516
MPITPPPAAEQHQRRRDSSPIRSAISSTFFADHSRRSLNSMLNSISSNSRNRSASASNASAPRPTISKRNEQLSDDGTTARPLNLTNCNKKCEAAESIIERLSYLGCSKMGDPTSENFWKPAKNARPKFAHFQSKGFVFVHEANPRHRKGPKNEIIYYIYFLFFFFMYTARALFCFAQAFNRRQQQSIGSAASSKAPSPSTPVQFQLPPSTEQCGTSEELFEFETLIEIKAQNFKY

SEQ ID NO: 153664 - protein, 46 aa, Heterodera glycines
  Coding regions on vcDNA: vcDNA=SeqID_80087; Strand=-; Position=1-138
QKNSVWAIHKNLSVGDPQKNSVWAIHKNLSVGDPQKISVWAIHKKS

SEQ ID NO: 153665 - protein, 72 aa, Heterodera glycines
  Coding regions on vcDNA: vcDNA=SeqID_80088; Strand=-; Position=1-241
NVEMQRTKGKHFSSNCVGYLLFFSPVIFHKCRMRWLEHLFVLQTDQLARLESKKHLVRSFLFIFERRWTGDQ

SEQ ID NO: 153666 - protein, 461 aa, Heterodera glycines
  Coding regions on vcDNA: vcDNA=SeqID_80089; Strand=+; Position=1 -190,252-419,521-772,841-970,1025-1670
  Homolog annotation: Hit_ID=NP_741149.1; Match level="QueryCoverage =85%, HitCoverage=57%, E-value=1e-15, Identity=22%"; Hit description =splicing regulator, Suppressor of White aPricot related (86.3 kD) (swp-1) [Caenorhabditis elegans] gb|AAM
GNSLYSSLLKGLHSVLPGTSPKVENTVKLEAEPPQPHIDEPISKAESVGIPSLFESDQQQRTDDYNKWHMEFYGRPSPFLPGHPPVCQRPVPDSAVESAISVAAKYVALHGAYAEQRLIARSPYYTFYQSQVRQIQWKIFQQSQQNRQQAFHAPQLFTTPFGNIAAVPSPPPPSVAELVKVPSGRQMADTMEKGEEGMELKEAEPDSKQLERREKARLFMERILNERMAEKRRTKTNNKPNEEEDNCVTVSETASTSAAASVGGVAIQPLPSSALSPLALSKAISCLIDEQIKRTLGTSPPQAPAEARKKKKEKRREGEERRRRRKKRRTRSYSSESSSSSPSSSTDSNEEERSRKRRRRKSSKRRKRGREHGSESDHSEGDEEEKRRQRRKQKGQEEGDSRWTNRARRSSAIGECERTFAINALFKVLFVPVSVFPTVVINIGVGHVRHVDEGKEKIISD

SEQ ID NO: 153667 - protein, 135 aa, Heterodera glycines
  Coding regions on vcDNA: vcDNA=SeqID_80090; Strand=-; Position=1 -49,544-871,919-1072,1120-1253
  Homolog annotation: Hit_ID=CAE57463.1; Match level="QueryCoverage =57%, HitCoverage=8%, E-value=2e-21, Identity=62%"; Hit description =Hypothetical protein CBG00428 [Caenorhabditis briggsae]
GFNVSMEHQLRGLASGDTLDSDARETIREAALFMYHQYLSQEVNLRVPLSEAIVNKFLARLRNDEPSDGWFEQIQEQANKPSPKRNPMPILITKHPLQKTRAVRSDARPTRNYHWRERSRCRVGRIRCCPMSQTN

SEQ ID NO: 153668 - protein, 304 aa, Heterodera glycines
  Coding regions on vcDNA: vcDNA=SeqID_80091; Strand=+; Position=1 -310,706-753,1127-1326,1368-1472,1528-1776
  Homolog annotation: Hit_ID=NP_503026.1; Match level="QueryCoverage =97%, HitCoverage=28%, E-value=1e-47, Identity=37%"; Hit description =sorting nexin 13 (4S24) [Caenorhabditis elegans] emb|CAB55131.2| Hypothetical protein Y116A8C.26 [Caenorh
MTQAITRVPLSEAIVNKFLARLRNDEPSDGWFEQIQEQANKPSPKRNPMPILITKHPLKIVEILKSEERFFPAFKRHALYGRMLDQLGITTGGSEVAAESAESAFPLTFDEYSSAEFVELSAIANATNGTSVRIEMLGVGQQGRQLFALYNVRVHRTATDLRTGSSSNVTRRYSDFHSLHNLIVVKFPNLRTLSFPGKKTFNNLNKTFLEKRCRALNQYMRCILQPSLWAANPGLEQLVFDFLTQKLYGGDKEGLSGAMNTMLNPLMSGVKAFGTAAAAMPSDLIDGIGKMGSELNKAASNVFK

SEQ ID NO: 153669 - protein, 245 aa, Heterodera glycines
  misc_feature (217)..(217): Xaa can be any naturally occurring amino acid
  Coding regions on vcDNA: vcDNA=SeqID_80092; Strand=+; Position=1 -130,179-388,449-772
  Homolog annotation: Hit_ID=NP_503026.1; Match level="QueryCoverage =84%, HitCoverage=19%, E-value=5e-37, Identity=42%"; Hit description =sorting nexin 13 (4S24) [Caenorhabditis elegans] emb|CAB55131.2| Hypothetical protein Y116A8C.26 [Caenorh
TFSSVQGSSTRHLILSRGRSVSSSTGNLPDSGRVAAHLDENVDESIPLRVLLLLVDEVFGLRESIPLRVLLLLVDEVFGLRAKNQWFRRRLVSLLRHIHAAVGQSINRRIIDAVNWLTSEEQVAQYLVAFRDSFWSDSAADSFWSDSAAASSRADNSPQLEQKTRFLARFLVLSAVPEQLRLFVGSSTVQSGVETVCEALQNRHLNRRLCYVMLERXAEVIKTIPNHFRINYRICSNYSPWGIIF

SEQ ID NO: 153670 - protein, 52 aa, Heterodera glycines
  Coding regions on vcDNA: vcDNA=SeqID_80093; Strand=+; Position=1 -54,393-494
MVEQFQLEEARMKKHMEESEQKWAEILLTNGRQLEKGIANSEEENWRKQMEG

SEQ ID NO: 153671 - protein, 80 aa, Heterodera glycines
  Coding regions on vcDNA: vcDNA=SeqID_80094; Strand=+; Position=1-241
MTGVLKGGVITAADVQDLKRGWTQLELDAKVGALKAKNDRMYQSICARLQGQAATIQRLRATKGLKRSRGDKRKTSVRGN

SEQ ID NO: 153672 - protein, 89 aa, Heterodera glycines
  Coding regions on vcDNA: vcDNA=SeqID_80095; Strand=+; Position=1 -24,370-615
MQAKTCSLAHLGDAALGGLRKNAIGIQMLGIRGHDPDSVAIRSVYLISDEVSPVRAPQGSSATFELNNNGLCAKNGELAPFLYGFNSCG

SEQ ID NO: 153673 - protein, 181 aa, Heterodera glycines
  Coding regions on vcDNA: vcDNA=SeqID_80096; Strand=-; Position=1 -218,587-954
ISSSSRPISVMLRSEDCARTPSGFKCSGSVGTILTLLPSDQFISFLMRSAQYELLRAVRLRLSSITMVCVPKTENWLRSYTVSTVAVKRCPAAGSCHDNEIFLRPKTPPGRSLRVQKRLSASAFPLETSRALLVVRWPLSLRHPLGVQLFCCRMARQPIPPSDWSEMCHWTSIQAFRLRAS

SEQ ID NO: 153674 - protein, 26 aa, Heterodera glycines
  Coding regions on vcDNA: vcDNA=SeqID_80097; Strand=+; Position=1-81
YKAFASIDVDIVCNNTDRLLHLGVHP

SEQ ID NO: 153675 - protein, 75 aa, Heterodera glycines
  Coding regions on vcDNA: vcDNA=SeqID_80098; Strand=-; Position=1 -126,730-829
MKRRVRAVIEDEEEEENGKNGGGRSGPMVIHSSSSESEEEEASDEEDLIGAGSYDEEEEANFVVPDDEIEEDEGD

SEQ ID NO: 153676 - protein, 120 aa, Heterodera glycines
  Coding regions on vcDNA: vcDNA=SeqID_80099; Strand=-; Position=1-363
NTVESSSEKTEKIVRLIRAAMECIGFLGANSKEFKERKADKINVNEFFQWLEQNIPENTTKSMLDHLKSVKDGKMKQFLVEIESECAEFKRHMWEQMETKGRQRSDESMGQMVERKKFVL

SEQ ID NO: 153677 - protein, 122 aa, Heterodera glycines
  misc_feature (21)..(21): Xaa can be any naturally occurring amino acid
  misc_feature (98)..(98): Xaa can be any naturally occurring amino acid
  Coding regions on vcDNA: vcDNA=SeqID_80100; Strand=-; Position=1 -94,1287-1526,1616-1647
  Homolog annotation: Hit_ID=CAE71479.1; Match level="QueryCoverage =86%, HitCoverage=27%, E-value=3e-28, Identity=56%"; Hit description =Hypothetical protein CBG18398 [Caenorhabditis briggsae]
LKKSKFRLTFLHFLPRKCHSXGCIFNPDPDRALANEIARRVRIFCWILTGKQNHQKRAIHVKATWAKRCNKFVFMSSEDDPTLPAVNLNISEGRWRIXKKYFQKFVYAYQSLLNFFETIVFN

SEQ ID NO: 153678 - protein, 76 aa, Heterodera glycines
  Coding regions on vcDNA: vcDNA=SeqID_80101; Strand=+; Position=1 -52,155-225,295-391
  Homolog annotation: Hit_ID=NP_524296.2; Match level="QueryCoverage =100%, HitCoverage=2%, E-value=8e-26, Identity=69%"; Hit description =CG9484-PA [Drosophila melanogaster] gb|AAF54431.2| CG9484-PA [Drosophila melanogaster]
QELCFFWTGSPNLPSSEEGFRPLPTIMIRPADDQHLPTANTCISCISRLYLPIYSSKKLLRDKLSLAIKARNFGFV

SEQ ID NO: 153679 - protein, 57 aa, Heterodera glycines
  Coding regions on vcDNA: vcDNA=SeqID_80102; Strand=-; Position=1-173
MDALRLLVGANNTSNLSAVVDEQQNAIDDYSDGQQQPPQQQHQTVEQLMAPGHRLRE

SEQ ID NO: 153680 - protein, 357 aa, Heterodera glycines
  Coding regions on vcDNA: vcDNA=SeqID_80103; Strand=+; Position=1 -22,65-1116
MLMELCEIRWAASELEAIKTILRLWPVLHELFQHISLQVKEFDKEQRIRAYSYFLSLSHLSFYALVSFLADILEILNKASLNFQISSASLIGHGRKIRNLIDQLQSLKEENGPYMHKFFNSITCIISDRNYPQHPCHQKNIMDNEEGYSHVQRMYLTGYSGSDYEADFVFATDGRKYANAQFLMKQQINTRSSADENIVVGISPPIPEFNRRIRRQLIDNVVEEIKNYFPVGNIIDDIDLLDPSRLPTQASNINNYANSIKKLAIYFNYDENLIYLEFSTILSQILNDSRLINLKNKLSPQRFWKLIIEQLGDNFGNEFKNFLHHMLILGLGSADAERAFSVLFYIRGKRYKNAWFS

SEQ ID NO: 153681 - protein, 126 aa, Heterodera glycines
  Coding regions on vcDNA: vcDNA=SeqID_80104; Strand=+; Position=1 -126,559-813
MPPASMPLWARQWQKFFVERAGIDSLHFGLLLLMLLSLLMLFRCLLQPNGICAGQTQQKQQKNAKTEEQRKMEQRDGQAVTGTNVVDDDPEQSAAQSFQQQPKATENVTIVDETVTVAILNILLES

SEQ ID NO: 153682 - protein, 32 aa, Heterodera glycines; identical to SEQ ID NO: 130522
  Coding regions on vcDNA: vcDNA=SeqID_80105; Strand=-; Position=1-137

SEQ ID NO: 153683 - protein, 108 aa, Heterodera glycines
  Coding regions on vcDNA: vcDNA=SeqID_80106; Strand=+; Position=1 -71,290-398,452-598
MTQLTKECPICRKNITKTAEFYLKKESNIGDKIWNSLGRKKSNAEQNIEQLQCLKCKENMRRVVFYPCKHASVCVRCAKVMANPGKAEAKKCPICKQKIEKILPFYLS

SEQ ID NO: 153684 - protein, 57 aa, Heterodera glycines
  Coding regions on vcDNA: vcDNA=SeqID_80107; Strand=+; Position=1-220
IVKMRWLGQNWPLIKSIFGCFVRICVQNWALPISSSIFGFIFGIGISINKCIKLSDG

SEQ ID NO: 153685 - protein, 40 aa, Heterodera glycines
  Coding regions on vcDNA: vcDNA=SeqID_80108; Strand=-; Position=1-166
FLRKSLQRMSHHYLQLSIEITNCRVHLLYPIHLFFYFIKT

SEQ ID NO: 153686 - protein, 503 aa, Heterodera glycines
  Coding regions on vcDNA: vcDNA=SeqID_80109; Strand=-; Position=1 -54,108-270,1333-1729,1844-1938,2008-2141,2502-2741,2793-2988,3162 -3394
  Homolog annotation: Hit_ID=CAE67078.1; Match level="QueryCoverage =83%, HitCoverage=54%, E-value=2e-24, Identity=36%"; Hit description =Hypothetical protein CBG12487 [Caenorhabditis briggsae]
MNPDGYEMDRAGDRVGYLGRANAHNIDLNRNFPARYPFHKEATGGTLPEPETAALMKWLLQYPFVLSANLHADNRKQTDIRPRSRQPQTCCWSELTRRPGNCSLGWPPTRARWIPNKNRELVRLLFIRQISSLNLCTKAHLLHESVQLHIVAEYTQTELAPYLRSVFADALIVFASGPPQSIVFSAGEYTPRLFNERTFGESLKKVFAPHSVDNEDEQQLVLATTENCEDRLGQLVSVAAMVDQMGLDRLFQLGVGIGCGNSTERDIDSAKLDVALTAIIEMMVNVLKRDEVHEFSVVVPSVAPTDHFTPSQIAAVTSVGFDRLSQSTVCSARLIESADGMKLHAVGSHRGPHTLVIAVEKKTSALVYQLGARLCDQMDAEMAEAVTAPAYLEEEDKQLARILAGSTIVLAPEIPQYYLRNIIPSDHNSQVRFIDVLRPGEDNGMLKNGTAAPFEEEQELMGTEQGMAEEKLPEGNWTATPMAFGQMYIKHHEQMRQVSDEMI

SEQ ID NO: 153687 - protein, 352 aa, Heterodera glycines
  misc_feature (339)..(339): Xaa can be any naturally occurring amino acid
  Coding regions on vcDNA: vcDNA=SeqID_80110; Strand=-; Position=1 -21,67-168,216-360,586-703,749-839,903-1001,1048-1149,1325-1510
  Homolog annotation: Hit_ID=NP_498209.1; Match level="QueryCoverage =99%, HitCoverage=55%, E-value=1e-78, Identity=47%"; Hit description =biogenic Amine Synthesis related (58.3 kD) (bas-1) [Caenorhabditis elegans] gb|AAV58886.1| Biogenic amine
SHSSVDKGIMLSGVKMRKLPTNREGIMLSGVKMRKLPTNREKGGNFVLRAEVLEAAIKEDKANGLTEDKANGLTPFILVVTVGTTNTCAVESCRELGPICNREGIWMHVDAAYAGSFFICDEFRHLSDGVELADSFNFNAHKALMINFDCSPMWFKNGDEAIAFFKNGDEAIAFFNVDPVYLKHEHQRDAYDFRHLQVALGRRFRALKIWFVFHLQVALGRRFRALKIWFVFRAIGIQRIQDFLRMQNKFGKLFADQNKFGKLFADLLLGDDRFELFVPQHLGLVCFRMKETSNELNESLFLAINDDRRIHLVASFTHGTFFLRFVVCSSKTRETNIEXAVEVIREMADKVT

SEQ ID NO: 153688 - protein, 96 aa, Heterodera glycines
  Coding regions on vcDNA: vcDNA=SeqID_80111; Strand=+; Position=1 -45,657-776,933-1058
MAECNTNRPKIFVGKFGLILHSLSYVASWFSGLSLFVLFILAVFTVPKTYELYKETSREVALPQIARGREKGRINECSEGKGQAEEKQRKEPANCA

SEQ ID NO: 153689 - protein, 306 aa, Heterodera glycines
  Coding regions on vcDNA: vcDNA=SeqID_80112; Strand=-; Position=1 -94,143-271,321-540,649-797,856-1029
  Homolog annotation: Hit_ID=NP_508202.1; Match level="QueryCoverage =100%, HitCoverage=88%, E-value=9e-67, Identity=47%"; Hit description= UNCoordinated locomotion UNC-1, stomatin family member (31.7 kD) (unc- 1) [Caenorhabditis elegans] gb|AAC
AVLSLAFLLFLLTFPFSLLFCVKIVHEYKRMVVFRLGRLLVGPPKGPVVFRLGRLLVGPPKGPGIVFLLPCIDHHTQIDLRVKSYDVPSQEMLTKDSVTVSVDAAVYEMLTKDSVTVSVDAAVYFRTSDPIAAISCIVDSALSTKQLAQTTLRNILGTRTLTEIMLERESISKVIQVDIGKGTHPWGIKVERVELKDIRLPKGLLRALAAEAEAARRASARVVSAEGELNASASLRDAADQISGSPVAASASLRDAADQISGSPVAVHLRFLQTLTRISTFRNRTFVVPIPTEAIRKMMGMAHKKD

SEQ ID NO: 153690 - protein, 90 aa, Heterodera glycines
  Coding regions on vcDNA: vcDNA=SeqID_80113; Strand=+; Position=1 -37,383-618
MTYRVYLYKIVKFANSMQRRSTRKLGSVALEVQQENESQPSEGNSSKRDEGGEEEREEEQVKVGEQYQQQQQEENNSTGTGRDDTKQMRE

SEQ ID NO: 153691 - protein, 86 aa, Heterodera glycines
  Coding regions on vcDNA: vcDNA=SeqID_80114; Strand=+; Position=1 -8,165-417
MPRLILVLKEEERIAQDKVRTYELDPTSGLNLQPRRRTYYNNDVAIRTLVTRFDALANPKPDQIMHHLRALQYRLASNGFDNLIHE

SEQ ID NO: 153692 - protein, 300 aa, Heterodera glycines
  Coding regions on vcDNA: vcDNA=SeqID_80115; Strand=-; Position=1 -139,216-345,476-555,663-713,766-872,969-1277
  Homolog annotation: Hit_ID=NP_491915.1; Match level="QueryCoverage =90%, HitCoverage=30%, E-value=1e-62, Identity=50%"; Hit description =protein kinase (1H242) [Caenorhabditis elegans]
FENSLFQQSAVRSIPQIAAFVPHGFVNKRLIPVLQSQAPFFQEHIPRQIDLLVAVRQIDLLVAVAHLSDRCDAQTLHYLLTVTSVCSTLHPAIVHSKSRLVQRILTCDVSRLRDPLVIAHHLLNPLVLGLALPELSPAHFDDVMSSSRILLDIVEQLRYEFDDRVMSSSRILLDIVEQLRYEFDDRNESGERRGEVGKNRLCNRRVSMSSNHLPRLLITAARPSIGDGRKMSFLSADGRLEDRRGSRRESKDSRCSLESEVSLRICNISRVTKLMSHQPNQWLTQFSAKILNSNIFLSVI

SEQ ID NO: 153693 - protein, 358 aa, Heterodera glycines
  Coding regions on vcDNA: vcDNA=SeqID_80116; Strand=+; Position=1 -146,492-648,1108-1880
  Homolog annotation: Hit_ID=XP_526077.1; Match level="QueryCoverage =66%, HitCoverage=68%, E-value=1e-17, Identity=29%"; Hit description =PREDICTED: similar to flagelliform silk protein [Pan troglodytes]
MYVDMGYRTNPARTDTKVPSSPYSLSRQEKAADTRTKRDQQQLKPNRERITEEEVRMFGMDVTDQMDSGDPTESDQMESDQEGKAENLLPKTGVENHPNLASLGPTHQHSSHWDSFSCISINGTQPSSISITGTQFSSISITGTQSSSIPVTGTQFSCISITGSQSSGISITGSQIYGIPNTGTQFSSISITGSQPSFQSLGVNSPAFQSPGLNPPAFQSLGLNSPAFQSLGLNSPAFQSPGLNPPAFQSPGLNPPAFQSPGLNPPAFQSLGLNPPAFQSLGLNSPAFQSPALNPPAFQSLGLNPPAFQSLGLNSPAFQSPGLNPPAFQSLGLNSPAFQSLGLNSPAFQSPGLNPPAF

SEQ ID NO: 153694 - protein, 46 aa, Heterodera glycines
  Coding regions on vcDNA: vcDNA=SeqID_80117; Strand=+; Position=1 -36,120-224
MAQFDEAEFKTTQSKELKRSDEITIYHLAIKSKFIYAKEKKVHKKE

SEQ ID NO: 153695 - protein, 28 aa, Heterodera glycines
  Coding regions on vcDNA: vcDNA=SeqID_80118; Strand=+; Position=1-87
KCSFITVAEQLKNVHSNFKVLQWNIGRA

SEQ ID NO: 153696 - protein, 187 aa, Heterodera glycines
  Coding regions on vcDNA: vcDNA=SeqID_80119; Strand=-; Position=1 -369,416-610
MYRMQHQIDAKRNRSTLQHDGHLYKFAKTSTDGTIKFWRCEFKDSGVDKCKGRIWTSLRDEFIRMATPHTCERNPSHVVAQKVTTAIKRRSVEKAPSVIRAVSTQSISSPALSEVPSKKATNLMINRARHLVDAPPAVPLNLEQLQIPQSYQFYEKTMYKNVFYSAKLTFDADQKSLLQQLDQITPL

SEQ ID NO: 153697 - protein, 121 aa, Heterodera glycines
  Coding regions on vcDNA: vcDNA=SeqID_80120; Strand=+; Position=1 -114,164-257,302-459
  Homolog annotation: Hit_ID=CAG07746.1; Match level="QueryCoverage =91%, HitCoverage=16%, E-value=4e-10, Identity=35%"; Hit description =unnamed protein product [Tetraodon nigroviridis]
MSLSVVDRMKRMLSTGEDADVHFLVGEGEEKEASLKIKRVAAHKVILKHASEVFEAMFRFDSQNQNVENACTNCVVEVPDVEAAAFKVMLSFIYADDLSQLDGDNAMAVLYAGQIVFVKLI

SEQ ID NO: 153698 - protein, 153 aa, Heterodera glycines
  Coding regions on vcDNA: vcDNA=SeqID_80121; Strand=+; Position=1 -106,222-577
MALDVQQRIAVKCLARHCSKFAFPLVSKEEFSRNIVPSGVLTVEEVIGIYQFHCHPNLHMVSELYPLKFPRQGRISDRTEGTLQLEIEKMSEFAGETVGSCRYSKTVHIRGLPFEIFAKINATTENDENFVGKWLGIFLWCTAPTEGDYRRNF

SEQ ID NO: 153699 - protein, 43 aa, Heterodera glycines
  Coding regions on vcDNA: vcDNA=SeqID_80122; Strand=+; Position=1 -92,317-356
MGRRIAQGNALTMCLTANQTAWDSPLSLLFGKANNGRNGETAQ

SEQ ID NO: 153700 - protein, 140 aa, Heterodera glycines
  Coding regions on vcDNA: vcDNA=SeqID_80123; Strand=+; Position=1-421
MDYLCFRALLLERNRLVLKFAPFFQGLHYDISKIKQLMDPRNGFYDRDEDKVTLAIDVIVGQAEMDRAISADQSKSKGTLFMDIEKVSQFARESIWSERKSETVTCLGGLPWKISVQIFTIMGSAVKCLSLFLCCTAPKE

SEQ ID NO: 153701 - protein, 22 aa, Heterodera glycines
  Coding regions on vcDNA: vcDNA=SeqID_80124; Strand=-; Position=1-67
MARAHPAALTWLALSWPCTPPI

SEQ ID NO: 153702 - protein, 58 aa, Heterodera glycines
  Coding regions on vcDNA: vcDNA=SeqID_80125; Strand=+; Position=1 -126,172-222
MSSDDEIPPFLDGPYTPVRDGDEPFEDAPPLVEVINQLPIQLILDDVKGKNEHVTRSD

SEQ ID NO: 153703 - protein, 189 aa, Heterodera glycines
  Coding regions on vcDNA: vcDNA=SeqID_80126; Strand=+; Position=1 -324,431-676
MAETILTHFEIVDQSNKAKERPSLLEESFVIDITAIDSGGKRQKMAGKGGRRRDFNVPYDLLEGATYGLENNDAYCLFRAFEFLRMKHVMPHQRFSEYKRDEGQQLNNIKITFKKYYNEMHPGMFRLFCFDTFGKMKPIWKSAMSDYRYELCVLYTREMMELLDTMTQSNQLEKISAQRITDCKLDYNP

SEQ ID NO: 153704 - protein, 185 aa, Heterodera glycines
  Coding regions on vcDNA: vcDNA=SeqID_80127; Strand=+; Position=1 -127,619-870,1197-1375
  Homolog annotation: Hit_ID=NP_508617.2; Match level="QueryCoverage =46%, HitCoverage=9%, E-value=5e-20, Identity=53%"; Hit description =putative secreted or extracellular protein precursor (XE208) [Caenorhabditis elegans] gb|AAB52504.3| Hypot
MPYIGETNDFKFEQKDVEQSLVLMDDDGATDVAKSSFDVEDKTAQGQRVRSNRRRISTFTTPSTTTSLSSFPTSTSPQLSSTTNGEEFWMTTRSTVMTPYQRVATTPYDIAKFYRMPNGNSRQRETVLTFCSKRAAIRDSANMVIACAGEDGDVWTPLRCPPGTDCLPAADSTFRICCPVAVGKR

SEQ ID NO: 153705 - protein, 215 aa, Heterodera glycines
  misc_feature (1)..(1): Xaa can be any naturally occurring amino acid
  misc_feature (53)..(53): Xaa can be any naturally occurring amino acid
  Coding regions on vcDNA: vcDNA=SeqID_80128; Strand=+; Position=1 -92,216-321,373-492,535-689,750-811
  Homolog annotation: Hit_ID=NP_499056.1; Match level="QueryCoverage =96%, HitCoverage=58%, E-value=7e-34, Identity=41%"; Hit description =fatty acid ELOngation (elo-4) [Caenorhabditis elegans] emb|CAA79555.1| Hypothetical protein C40H1.4 [Caen
XTMSSLINLFNSFEMYHENNTRNMHSSYKHKFQFPYERIEDPAGLTAYFQKYXHQTITIGILYYVIVKSIEWTMRDRKVKSIEWTMRDRKPFDLRNCLFVWNTALALFSICGFIRVGEESLINLIYEGFTFTICHTESLINLIYEGFTFTICHTVNARGPGPFWGFLFFLSKFAEFGDTLFIVLRKKRLIFLHYLIFLHYYHHAAVLIYSAHVGA

SEQ ID NO: 153706 - protein, 107 aa, Heterodera glycines
  Coding regions on vcDNA: vcDNA=SeqID_80129; Strand=-; Position=1 -76,226-317,363-516
FAPEGYGLFILALPNCPTRWSAVFENKYGCRVIQFVLENVVQLVHGTANANNSLEKEISIQILHVLMEPILKNAYSVAQNEFANYLVQFIIKSPYLRRQRCYIIKTH

SEQ ID NO: 153707 - protein, 347 aa, Heterodera glycines
  Coding regions on vcDNA: vcDNA=SeqID_80130; Strand=+; Position=1 -237,291-404,450-667,787-1121,1355-1491
  Homolog annotation: Hit_ID=CAE68298.1; Match level="QueryCoverage =80%, HitCoverage=13%, E-value=2e-41, Identity=34%"; Hit description =Hypothetical protein CBG13987 [Caenorhabditis briggsae]
MPSHTNRTPLSPPLQRVVCASPTRPSLLPLVAAGQSSPQALADIARHGLLARLSVVQAADAAVLASTNFTFFDCQQLSSCSACASARFPCDWCALSARCVPNAEDVCQGETLVNSISRVGPSSRRGPEFCPHFTVPGGDQYLSSGKRRSVSVKAHNLHDQMSAFKCRYSLESSAGVVHEKLAQRQEDKIICEDMLFEFSGPGDGNGTVVARFDILWASSSDQNANQFHPLDNAQGMRMVRSYFFPITNSLFTHSFIAQIIYKCAQLASNCGICLGLDERRFDCGWCDEETQCVPKDNCDKGAVVGIRSAMDELDDIFKDELDHTTAVLILQKRHAISQLNSQRRNIL

SEQ ID NO: 153708 - protein, 110 aa, Heterodera glycines
  Coding regions on vcDNA: vcDNA=SeqID_80131; Strand=+; Position=1 -120,317-531
FLALLEWIPSAPNNPIVPDNGTAFAPGTNLCKLSMQLTKSNCVVKAWEQKSNASVERQFNVKSVNAKIDKTKKKGIQREFDDETSADQIFQGKPNVLEQPDQIEHILKEK

SEQ ID NO: 153709 - protein, 32 aa, Heterodera glycines
  Coding regions on vcDNA: vcDNA=SeqID_80132; Strand=+; Position=1-96
MQSFLLLVNILLCSIVLLHLLSNEHGLVNAMP

SEQ ID NO: 153710 - protein, 123 aa, Heterodera glycines
  Coding regions on vcDNA: vcDNA=SeqID_80133; Strand=+; Position=1-372
QMATNLGKTGGFFLVVRSNHISGGCPTGRNTDLSRQFIINVPKFRLFLTLAAVVPGLSAEQASLLSEIAQLAYEIFKLSSRVHQLDIESVFKLPLPDASHVPYSVTNTGKPLGKQFRWRRSFP

SEQ ID NO: 153711 - protein, 437 aa, Heterodera glycines
  Coding regions on vcDNA: vcDNA=SeqID_80134; Strand=-; Position=1 -225,311-493,543-662,715-833,956-1032,1111-1295,1346-1415,1462-1573
  Homolog annotation: Hit_ID=AAC48327.1; Match level="QueryCoverage =100%, HitCoverage=80%, E-value=0.0, Identity=84%"; Hit description =beta-1,4-endoglucanase-1 precursor [Heterodera glycines] gb|AAC15707.1| beta-1,4-endoglucanase-1 precursor
MCRLQATHLLARLFLLFALCTALVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHNPHPDEAVKFFTRIAQAYGSYPHILYEDFNAVKFFTRIAQAYGSYPHILYEDFNEPLSVSWTDVLVPYHKKVIAAIRVIAAIRAIDKKNVIILGTPTWSQDVDVASQNPIKDYQNLMYTLHFYASSHFTNDLGAKLKTAVNNGLPVFVTEYGTCEALPVFVTEYGTCEASGNGNLNTDSMSSWWTLLDSLKISYANWAISDKSEACSALSPGTTAANVGVSSRWTSSGNMVAVGVSSRWTSSGNMVASYYKKKSTGVSCSGSSSGSSSGSSSVSCSGSSSGSSSGSSSGSSGSSSGSSSGSSSGSSGS

SEQ ID NO: 153712 - protein, 252 aa, Heterodera glycines
  Coding regions on vcDNA: vcDNA=SeqID_80135; Strand=+; Position=1 -63,118-273,369-488,538-731,937-1087
  Homolog annotation: Hit_ID=AAC72366.2; Match level="QueryCoverage =99%, HitCoverage=19%, E-value=1e-122, Identity=90%"; Hit description= guanylyl cyclase [Heterodera glycines]
KFGTYPFFCNGSCMGGAAEQSPSQYARALFDTTPSQYARALFDTTYAYFRALNRTMEKRKSNGRDLLRNGTELNAETAGTTFQGETGRITFDAHGNRQPTFFVTMLNALNVPTVMVKVNITNGVLKMERLYGSEASLKMERLYGSEASLWVNWGGFRPMTTPLCGYNGTMCGQNVTVYILIGVTLMLLLLVAALLGIGYAIREKMREKQRLTRECLIPFAELRNLKELRSSEELKSETEKSMRSMRSSQSGE

SEQ ID NO: 153713 - protein, 185 aa, Heterodera glycines
  Coding regions on vcDNA: vcDNA=SeqID_80136; Strand=+; Position=1 -240,479-559,727-812,867-967
  Homolog annotation: Hit_ID=CAE72406.1; Match level="QueryCoverage =82%, HitCoverage=18%, E-value=2e-36, Identity=57%"; Hit description =Hypothetical protein CBG19565 [Caenorhabditis briggsae]
NFKFYFSKRTKFKKCTDDLKKKGVAFCLTLKIQNSAQIMSSWRSVFDSVLISFGGWPSLEASSEPNIRIRIERLYGIMVAKFRADSLFKATVQPDDKNSDKHVLLIDQPALNLFARDFYMLLETEDERLAYRTLIRDVLVLLGADPRIAERIRDVLVLLGADPRIAERDSLEILQFETELANVSL

SEQ ID NO: 153714 - protein, 126 aa, Heterodera glycines
  Coding regions on vcDNA: vcDNA=SeqID_80137; Strand=+; Position=1 -49,128-182,647-750,817-893,1071-1166
  Homolog annotation: Hit_ID=NP_494343.2; Match level="QueryCoverage =45%, HitCoverage=7%, E-value=6e-13, Identity=63%"; Hit description =neprilysin-like zinc metallo-peptidase (2D10) [Caenorhabditis elegans] gb|AAB95021.2| Hypothetical protein
MNFGGIGVVIGHEITHGFDDRGRLYDQYGNIRQWCLSCLQKVRTLSHNAAAIARRQSDPGSAVFPELCADLVWHYERQRGHSQIENVRTFARANSYYFKNGSAGKKKQAFVSAFRQKMNKFLPFWV

SEQ ID NO: 153715 - protein, 366 aa, Heterodera glycines
  Coding regions on vcDNA: vcDNA=SeqID_80138; Strand=+; Position=1 -186,245-304,578-754,817-1003,1320-1519,1746-1874,1932-2093
MFTVYSIVHLLLTCCLLLAITDVVISDPLPQNATVADQPTETLTNQTVTAETTAATESTAETTIATTATDQQNVTVNESIETSPVLTSEIDQQNVTLQNATVIEPVALIAATVNGTDQAAAQTLFNATAQQIDQNNNTTVMYGHDQKLKKNTFKPLLASTNEPNITLNFTVESMHLITDNGTDQNRTDEAGAAGPSVAGGELGGEVPLVSSGQADEQNAKNESASLNGTASAVSSGTVVDTTKFIPHGDDDCWTDQNGEDTPRWFANGDQFRALPYEMYAVWRECASTRDPAVCRTDNWTKRTCGAKSCVNSEKQIWWQCVLENAWLGGCVDEASGNRLNVGDAIDRNLTTYEFISFFTVLPKLAF

SEQ ID NO: 153716 - protein, 64 aa, Heterodera glycines
  Coding regions on vcDNA: vcDNA=SeqID_80139; Strand=+; Position=1 -64,892-1022
MDEKAVKREQKQRRKSEDRREEAYPNIHCFLLFFMGWGLNLITILTIKIIKYCHFWTKFVRKVH

SEQ ID NO: 153717 - protein, 17 aa, Heterodera glycines
  Coding regions on vcDNA: vcDNA=SeqID_80140; Strand=+; Position=1-69
HKHLFDLFYHIHNLIKI

SEQ ID NO: 153718 - protein, 64 aa, Heterodera glycines
  Coding regions on vcDNA: vcDNA=SeqID_80141; Strand=+; Position=1 -45,100-249
MTKRNNFDFLLASKMFIEENIFGLGYFEICIYLASGPVSRGQLTNQLTDNSADGQLSRTIKITK

SEQ ID NO: 153719 - protein, 46 aa, Heterodera glycines; identical to SEQ ID NO: 147106
  Coding regions on vcDNA: vcDNA=SeqID_80142; Strand=+; Position=1 -93,135-363

SEQ ID NO: 153720 - protein, 45 aa, Heterodera glycines
  Coding regions on vcDNA: vcDNA=SeqID_80143; Strand=+; Position=1 -126,322-333
MPGRAGLVFPGVTGFRSRPLKTRSTRNPVNPAFQIAGPGTGLRFF

SEQ ID NO: 153721 - protein, 90 aa, Heterodera glycines
  Coding regions on vcDNA: vcDNA=SeqID_80144; Strand=+; Position=1 -94,150-328
  Homolog annotation: Hit_ID=XP_316282.1; Match level="QueryCoverage =90%, HitCoverage=17%, E-value=6e-11, Identity=37%"; Hit description =ENSANGP00000020626 [Anopheles gambiae]
MSEINAYCSTGTIPTNSDPLEFWKERANEFPALAEEANKFLCIPATSVASEQLFSTACDTYDYRRRRLRPRKAEILIFLNRNLPKIQYKY

SEQ ID NO: 153722 - protein, 21 aa, Heterodera glycines
  Coding regions on vcDNA: vcDNA=SeqID_80145; Strand=-; Position=1 -59,189-195
MMKKRVKMTQSFKKQFFYWRL

SEQ ID NO: 153723 - protein, 145 aa, Heterodera glycines
  Coding regions on vcDNA: vcDNA=SeqID_80146; Strand=+; Position=1 -88,186-282,345-432,1622-1786
MKVFVLLICLLFITKAESVEEKQPNYDGQDFDKDDIQTIFEDAVDYAQALALVTLPHTHEGRGDEALIHPFTLFPTPFPRQLYEQAIELQWIEFNTGQLGGVHLARLLTQLHRRTMQKAGLEASKDQLLNNGSDFVIAEALFMAW

SEQ ID NO: 153724 - protein, 270 aa, Heterodera glycines
  Coding regions on vcDNA: vcDNA=SeqID_80147; Strand=-; Position=1 -27,195-503,780-1017,1067-1305
  Homolog annotation: Hit_ID=CAE61462.1; Match level="QueryCoverage =99%, HitCoverage=84%, E-value=1e-119, Identity=70%"; Hit description= Hypothetical protein CBG05354 [Caenorhabditis briggsae]
MNNEVNYCKGSAHDIWSEVNQLRHVVPTGGAAHNRTARQAAGYGEAAAPSSGVAGGQQQAASGGGCDACCLPGPPGPAGTPGKPGRPGKPGAPGLPGNPGKPPTQPCEPVTPPPCKPCPAGPPGPPGPPGPPGDAGGPGQSGQPGQDAPPGEPGPKGPPGPSGQPGQPGAPGEPGQPAQSQPIVPGPPGEPGDAGPPGPPGPPGNAGQDGLPGQPGPKGPPGPPGSPGNDGQPGASGQPGQPGGQGEKGICPKYCAIDGGVFFEDGTRRR

SEQ ID NO: 153725 - protein, 99 aa, Heterodera glycines
  Coding regions on vcDNA: vcDNA=SeqID_80148; Strand=+; Position=1 -19,57-337
MNEIRIYGQSANGRASEAGGAIVGPNERCERRKAKGETEHGTARSTGQTEHNLWTDEAKKHGIEKENNLEVIDDRSMRHKIFETEKKEFSRVEKGKSLP

SEQ ID NO: 153726 - protein, 208 aa, Heterodera glycines
  Coding regions on vcDNA: vcDNA=SeqID_80149; Strand=-; Position=1 -69,210-589,1025-1199
MAAVAAAAVAVGTESMPNFNCPKIEVRLLDGAERIQSAVADQQDAKKEEDKVAPESGTDQQNEPEAEKRKKRNANKKKLPKTRREKHAKVPEASSVCQRVVAGRKLDGNALLAAMPEEKHEKRRRRLARLGMDNVVFIKVPAVIPTIESQINSLLIITLFIGEVADDQQSVQHDQHAQQGQRVLMESPSTATIRARREPFIGVKYALQ

SEQ ID NO: 153727 - protein, 15 aa, Heterodera glycines
  Coding regions on vcDNA: vcDNA=SeqID_80150; Strand=+; Position=1 -28,193-212
MNCQHIKSKSSNYNE

SEQ ID NO: 153728 - protein, 180 aa, Heterodera glycines
  Coding regions on vcDNA: vcDNA=SeqID_80151; Strand=+; Position=1 -172,329-699
MKPKNFFVLIFPLFVCFSIFEGISSYKWDSKNLPNNVHTFAGFMDDLYEDYRVKGQMDIHWLNQPKLYTEKGFSDKQKRTVFNLTFVKCAAEIAHFQVLSQNDDSKDAYLNLKVVTISEIKLVKDEFVGFLHFDQTLGQQIAKKFKDEIFSKEKQIPEEVVHQIQQLAFSFAARVILSIM

SEQ ID NO: 153729 - protein, 303 aa, Heterodera glycines
  Coding regions on vcDNA: vcDNA=SeqID_80152; Strand=+; Position=1 -65,153-238,312-810,942-1203
MKKKVVLGLLKNLISGVKNWPRSNQIEMELFNEPLWNYLRVFGIDANVALDVFKFCKDLHTVVQKKIEEHKKSVFDKMNLQVKNVTTEMKEFKNLNSILKLVEDKENSTALENFSSNYKGKNLSQKKEVLKELLAILMKIYTDYSNASKKEISKNAIRLTHSGNVTLRFGQILYETIENLENLPEDRVKYDENEQLLSILLPFANHLLKRLYEFLERNLTEKSKISDDFDFVQTLQTVAEESTELEAEKRQMPISAGVNVNLFQLLFSLAIRLCLLIDEKEKLANKYLPKFVFALKMCTKETR

SEQ ID NO: 153730 - protein, 35 aa, Heterodera glycines
  Coding regions on vcDNA: vcDNA=SeqID_80153; Strand=+; Position=1-106
MKIDGKNVHINLRNWHLPYFVYKQKEDEFKMEKEE

SEQ ID NO: 153731 - protein, 144 aa, Heterodera glycines
  Coding regions on vcDNA: vcDNA=SeqID_80154; Strand=-; Position=1 -162,246-518
MILLDQIGLFNYRTHVKSSEPRIASSSLTVMKADLQQSIPSSLVQFECRGQEKKFTDEQIVHVVVHRMVAQVIRDEMSNILTHKAIPNETNVMKPITDEQIVRATVNRMVAIVTFEVNQKELIALKRKNSTVEQDLVKKPRTDL

SEQ ID NO: 153732 - protein, 69 aa, Heterodera glycines
  Coding regions on vcDNA: vcDNA=SeqID_80155; Strand=-; Position=1 -15,293-434,570-622
MKDYKDKQVDDSSDGKAGQQQHPQSDGEDDEQHHFRHCAETDSDEETASANNEIKNIYLFMKHNCSEIG

SEQ ID NO: 153733 - protein, 270 aa, Heterodera glycines
  misc_feature (33)..(33): Xaa can be any naturally occurring amino acid
  misc_feature (232)..(232): Xaa can be any naturally occurring amino acid
  Coding regions on vcDNA: vcDNA=SeqID_80156; Strand=-; Position=1 -277,474-502,552-596,658-763,1187-1386,1441-1535
  Homolog annotation: Hit_ID=NP_740976.1; Match level="QueryCoverage =85%, HitCoverage=27%, E-value=7e-54, Identity=48%"; Hit description =DDHD domain containing 1 (2E882) [Caenorhabditis elegans] gb|AAA93436.1| Hypothetical protein M03A1.6a [C
KFRKFSYVYKKKKVRGKKFKNTENLLNICKCLXKKLPQFSGIGQKGYQNLIAKNSAQIREAMLQLMDKNYPNEKRRPAVLPVEWRSALTLDEGVTDVATLPKMEFARSTLNSTLMDLMEFARSTLNSTLMDLMYYMYYQSPLYRTEIVNGVIRCLNSIYTTFKANNPNFDGPVSIVGHSLGSVIAYDIITRWSPFLLYDQIVSNAIEENMNSSVSGNQRKLFEDFHNSRKRXKKIQSEIEIPGFMEQILISPEQQIGFKVKNLFCLGSPL

SEQ ID NO: 153734 - protein, 90 aa, Heterodera glycines
  Coding regions on vcDNA: vcDNA=SeqID_80157; Strand=-; Position=1 -85,209-396
MDTILTKRNRAKLQHNGHSYTFHKPSADGVYAVKLTHRHQFRTVWQDFNPDSVSMHFETGAITALNVVFTPGIIALDMALPNELTPVLDW

SEQ ID NO: 153735 - protein, 93 aa, Heterodera glycines
  Coding regions on vcDNA: vcDNA=SeqID_80158; Strand=+; Position=1 -148,198-331
  Homolog annotation: Hit_ID=CAE66976.1; Match level="QueryCoverage =97%, HitCoverage=14%, E-value=1e-09, Identity=37%"; Hit description =Hypothetical protein CBG12372 [Caenorhabditis briggsae]
MKISEETIRKRLQSINQTQEAVQTCSKWVLHNREMIDRIATCWMDIYKKAPEKLRIALIYLLNDVVQKAASKKDNNVTLALHPHWINATAMSK

SEQ ID NO: 153736 - protein, 316 aa, Heterodera glycines
  Coding regions on vcDNA: vcDNA=SeqID_80159; Strand=+; Position=1 -123,172-468,744-1274
MASFLESVERHRQKGMKLMELMQYAKQTFNLQLRDVTVVNDAYEKFAEGMRETKQQLEKMEKSGALTSLDAPSSPPRDAPSPTAGDDPFVHGVECDEAVGAEDMEMDEEYGPGPSSCFLKSSKDYVASIPAVPEMDPRLQRLVNQTISACQLSDNSNIPMPSASLSRTTLDPRQLDPRQARFFPPPQQPPPQLTQHLNFPPPIIPPPGLSPPPATQNATQDTAETLLTIDKSQPPPQFFSMPPPQIPNGNGNVTVLHENASNSHGRGSTLSPPIALFNPSNPPPSLMVSQNLIIFFSYFNFLNLFSFSIFHLLLLI

SEQ ID NO: 153737 - protein, 83 aa, Heterodera glycines
  Coding regions on vcDNA: vcDNA=SeqID_80160; Strand=-; Position=1-249
AVMGAYNENNGTIEVPLHGYNVGKAIVERILNTKNGTVLLHGMREPISLAKAVEIGFFDNLSLTVVDPNTTQRLFLDEALKRK

SEQ ID NO: 153738 - protein, 82 aa, Heterodera glycines
  Coding regions on vcDNA: vcDNA=SeqID_80161; Strand=-; Position=1-249
MDEELHRRRLGPKADTEGDEAEPLLGGRVTAEQIVHLLRQRQMRYAKLKLGEGFYHDLDKELANGILRERKQHGVGLLKLTL

SEQ ID NO: 153739 - protein, 16 aa, Heterodera glycines
  Coding regions on vcDNA: vcDNA=SeqID_80162; Strand=+; Position=1 -21,85-114
MAYKEQKSPQQQKMIH

SEQ ID NO: 153740 - protein, 288 aa, Heterodera glycines
  Coding regions on vcDNA: vcDNA=SeqID_80163; Strand=-; Position=1 -57,107-266,315-502,546-633,677-738,783-920,1286-1459
  Homolog annotation: Hit_ID=AAO49799.1; Match level="QueryCoverage =84%, HitCoverage=67%, E-value=1e-133, Identity=95%"; Hit description= arginine kinase [Heterodera glycines]
MAVPQEVIDKIEAGYKKLQAAADCKSLLKKYLTKDVVDACKDKRTKLGATFLDVIQSGVANLDSGVGVYAPDAEAYTLFKPLFDPIINDYHGGFGPSSKQPATDLGEGKTQLLTDLDPEGKFINSTRVRCGRSLQGYPFNPCLTKENYVEMESKVKAVFEQLKGDAELGGTYYPLQGMTKDVQNQLIADHFLFKEGDRFLQEANACRYWPTGRGIFHNAKKTFLVWVNEEDRWRRLRHQQQGPSWSHGVRSGEADVRRSETPDRIGEESIMGGPIYDDDFILRNVEIC

SEQ ID NO: 153741 - protein, 96 aa, Heterodera glycines
  Coding regions on vcDNA: vcDNA=SeqID_80164; Strand=-; Position=1 -121,172-339
FCCPSFAFALPFLSLFSSFVCSPMIWPLPSAANVPFPRSHRSVLSTGSEPSRTFGRYFSATAPNSAKEAKEQISKALEEKKGTQSKAKQMPSPLAG

SEQ ID NO: 153742 - protein, 316 aa, Heterodera glycines
  Coding regions on vcDNA: vcDNA=SeqID_80165; Strand=-; Position=1 -268,319-857,901-1041
  Homolog annotation: Hit_ID=CAE72641.1; Match level="QueryCoverage =83%, HitCoverage=52%, E-value=4e-77, Identity=60%"; Hit description =Hypothetical protein CBG19843 [Caenorhabditis briggsae]
LVKNYLIVPNSHKMPPIPMDVDVVPGQFGISLAIHSFNTQFFDSEAVGQTFLFTSESVSEGHPDKMCDIISDSVLDAHLGQDPNAKVACETVTKSGMILLCGEITSKANLDYRQLVRDVVQKIGFDDEPNKGMTKGRKIGGGGSKNERGRNDEARDLSLFHRTSNSQGFDYKTCKILVELEQQAPEIAAGVWMNKADEKDIGAGDQAGHSLCCFYCFAFFKGLMFGYATDETEEAMPLSLLIAHKLLAKLHQLRRDGSLGWSFPDSKSQVTVEYKFNKGACVPVRVHTVVISAQHKQFDGDLEVVRSDLKEKVIKE

SEQ ID NO: 153743 - protein, 47 aa, Heterodera glycines
  Coding regions on vcDNA: vcDNA=SeqID_80166; Strand=-; Position=1-238
GKKLVKIVENVGPAVPIGAAGKNFWKFECYLLRNLPIKLFNFRLGGG

SEQ ID NO: 153744 - protein, 298 aa, Heterodera glycines
  Coding regions on vcDNA: vcDNA=SeqID_80167; Strand=-; Position=1 -97,145-608,664-777,1119-1227,1270-1379
  Homolog annotation: Hit_ID=CAE66231.1; Match level="QueryCoverage =73%, HitCoverage=46%, E-value=2e-67, Identity=60%"; Hit description =Hypothetical protein CBG11474 [Caenorhabditis briggsae]
MNVIVRRLIQTLFAKPKLSKLVKMKLDESEAFRAWIRDSVLNAFFTLNVSPKRIAGGAVRDLLMGTRPSDVDFATDATPTQMKEMFEREQIRMFNKRGEEHGTVTCRINDRENFEVTTLRVDVVCDGRRAKVNFTTDWELDAFRRDLTINSLFLGLDGLIYDYTGGIEDVKQRRIIFVGDPIQRLQEDYLRILRYFRFFGRFSKLDAPHEQKNLEAIVRCRDGLKKWLCETIVERREEASEERANPSYFRHFILNQTFERGGEMREQIKRECVELMKYVGTDAKMRAEIEQWEVPPMP

SEQ ID NO: 153745 - protein, 59 aa, Heterodera glycines
  Coding regions on vcDNA: vcDNA=SeqID_80168; Strand=+; Position=1-178
SEFVFLGEMREQIKRECVELMKYVGTDAKMRAEIEQWEVPPMPVGGFDLIAMNVPKGPK

SEQ ID NO: 153746 - protein, 119 aa, Heterodera glycines
  Coding regions on vcDNA: vcDNA=SeqID_80169; Strand=+; Position=1 -14,147-317,375-456,1164-1253
MLVHLAKLDAHPVYHFWLRVLEDRREWERLYRPDRLIVDQQLMLVFRFAITHGFLELVHRLWGDLTEGQIETIGDFLAFLNFENAYDFESDEMPREEQMKRFHKLESLLINWCPELRKA

SEQ ID NO: 153747 - protein, 55 aa, Heterodera glycines
  Coding regions on vcDNA: vcDNA=SeqID_80170; Strand=+; Position=1 -35,205-337
MTFRMNSPPSITQNERANAGESVENDGILVEFGEGFRVDSAESTVPKDLKDKRMK

SEQ ID NO: 153748 - protein, 32 aa, Heterodera glycines
  Coding regions on vcDNA: vcDNA=SeqID_80171; Strand=-; Position=1-97
IQSVTQSVLHHLRHKLRFPGDQFGVHHSEFVR

SEQ ID NO: 153749 - protein, 37 aa, Heterodera glycines
  Coding regions on vcDNA: vcDNA=SeqID_80172; Strand=-; Position=1-112
MVLVSVTLRQLCTMSRSHYDKIMFPPISAHGMLTLDR

SEQ ID NO: 153750 - protein, 40 aa, Heterodera glycines
  Coding regions on vcDNA: vcDNA=SeqID_80173; Strand=-; Position=1 -33,1169-1258
MVCAEVTPTRLNCYVQLKIQLDRFMGSGQTPKKQGVFILN

SEQ ID NO: 153751 - protein, 124 aa, Heterodera glycines
  Coding regions on vcDNA: vcDNA=SeqID_80174; Strand=+; Position=1-654
LIDSHCQIGEQQTLSKCSNFALIIMIINYHNPPPPILINYYFLLPNFHVTLSFLPLKIVSSHYVALRLHHPSSFAHNISQFALLLLHPPRHHFPPLPCPPKRLGGFFPAPPNHHLLIPKAMMSD

SEQ ID NO: 153752 - protein, 28 aa, Heterodera glycines
  Coding regions on vcDNA: vcDNA=SeqID_80175; Strand=+; Position=1-84
MAIGMVALTTFVPRAALLLLLTARRAFR

SEQ ID NO: 153753 - protein, 31 aa, Heterodera glycines
  Coding regions on vcDNA: vcDNA=SeqID_80176; Strand=-; Position=1-95
FRQKPIFFLSSPWPETHEKHDFWAVVKLLFE

SEQ ID NO: 153754 - protein, 376 aa, Heterodera glycines
  Coding regions on vcDNA: vcDNA=SeqID_80177; Strand=+; Position=1 -196,346-1046,1079-1309
SDQITVKLKKNDTVQVLKGKIMEKLDKKIENVIGHELGINQPKPTLKYQQKSPADNNAFVVELEDTLKRIIQTLTQIEPQKQTLRRDNCGAVLKDTETMANCNSKHIVYLAIDEFQIQVKLEYCNNEHTVWVHSMDTVSTVKLKICNQMISYISAYKHIRANEQTLKYDGTDGVLDDNATMAFYGIGAGATVQLSLDEIFEFFVKYEKAEEQKEEKKVETFSLEVKKTNTVASLKEMIKNEKKFVPKRQTLRRFSPYHMLLMDTEILAPTIQHEPTIYLAIDEFQIFVEYASERYNTIWNKIANGLKPSKYIDPDSQALQYGTLALINDRKLLNDYGIGKGGATVSLSIDTFSIDVAHEDQQGRHDHTIWVWKSDT

SEQ ID NO: 153755 - protein, 66 aa, Heterodera glycines
  Coding regions on vcDNA: vcDNA=SeqID_80178; Strand=+; Position=1 -106,1031-1125
MALRQCLKTPLKLWHFMALAKMITTFTLDKLNPISYNSFLKYWSANVRLTDLGLCYIPLGYLALFS

SEQ ID NO: 153756 - protein, 176 aa, Heterodera glycines
  Coding regions on vcDNA: vcDNA=SeqID_80179; Strand=+; Position=1 -215,696-796,942-1082,1444-1515
  Homolog annotation: Hit_ID=NP_497055.1; Match level="QueryCoverage =98%, HitCoverage=50%, E-value=3e-57, Identity=60%"; Hit description =glutaminase family member (2P6) [Caenorhabditis elegans]
LLGPFAFVGLPAKSGVSGVTIVVVPNLMGIALWSPPLDRMGNSCRGVHFCKKLIDRFNFHNYDSLAHNESQQKFDPRRRVGEREKTAVVSLLFASKAGDLNTIRRMYLQGCDLEMADYDKRTALHLAASEGHFDVALFLLETGKVQPDPRDRWNRTPLDDARSEHHTSVALMLERR

SEQ ID NO: 153757 - protein, 145 aa, Heterodera glycines
  Coding regions on vcDNA: vcDNA=SeqID_80180; Strand=+; Position=1 -189,319-403,846-1009
  Homolog annotation: Hit_ID=AAA80437.6; Match level="QueryCoverage =77%, HitCoverage=38%, E-value=2e-20, Identity=42%"; Hit description =Carbonic anhydrase protein 5 [Caenorhabditis elegans] sp|Q10462|CAH5_ CAEEL Putative carbonic anhydrase 5 p
MVNFFVIFVPFLLLIVSNQLKAEETEENRHKTEETWNYEEPEEWGGKCQKGDRQSPIDIHKQWFIDYKIPAISFANYEKNGTVTMKNNGHTVVVSGFDTWEKQPNIADGGFGSKYMLSQFHFHWSQNENGSEHTVDGEHYDAEVL

SEQ ID NO: 153758 - protein, 364 aa, Heterodera glycines
  misc_feature (106)..(106): Xaa can be any naturally occurring amino acid
  misc_feature (121)..(121): Xaa can be any naturally occurring amino acid
  misc_feature (354)..(355): Xaa can be any naturally occurring amino acid
  Coding regions on vcDNA: vcDNA=SeqID_80181; Strand=+; Position=1 -51,268-518,577-693,748-944,994-1039,1089-1218,1263-1388
  Homolog annotation: Hit_ID=NP_502262.1; Match level="QueryCoverage =95%, HitCoverage=50%, E-value=9e-45, Identity=32%"; Hit description =solute family 5 member (64.3 kD) (4M703) [Caenorhabditis elegans] emb|CAA98070.1| Hypothetical protein ZK
PPLLSPLLLSLCPLFPPVVIYAPAISLTGVTSVRLWPFVLLVGVGSTIYTAAGGIRAVIWTDTLQAGFIYGGLAVIIVRGTAAGGLTNVLAINQRTGRLCSLSVLXCPFDQYNNLSLSVLXCPFDQYNNLWVAMFGGILQWTCIYGLNQMAMQRYCSMPSLRHARVVLSLTMYCSMPSLRHARVVLSLTMPANLLIQLMIGYIGLLMAAYFDQCNPLALGEVETVDQVTILMASRIFEGVPGLPGLFLATIFSGVPGLPGLFLATIFSATLSATLSTASSGINSLTAVLWEDFLKVPLKDLSDAHKSCAMKGISVVFFGALAVFFGALATVMAFACSNLGGIFNVVLTILGPFXXFAFNVPFVR

SEQ ID NO: 153759 - protein, 127 aa, Heterodera glycines
  Coding regions on vcDNA: vcDNA=SeqID_80182; Strand=+; Position=1 -129,303-557
MPTRAIVSRSVPFLCPLSVPNFTSALPTVPSFPNCLPSAIPAWADFCLHLFWLGKTNRKKAKFWRRDWPNGITKAGAKFKLNVSGGSAARTESNRRRGTDNEQKEKQQIGDVQSDGRETQSDRQTNW

SEQ ID NO: 153760 - protein, 164 aa, Heterodera glycines
  Coding regions on vcDNA: vcDNA=SeqID_80183; Strand=+; Position=1 -207,633-698,756-977
MLGNAKLINSSKCPHAENVYAEKRNPGTGTLRCYNPTKNQYYDCSCHGDKKCLAEEKWAHDRFLCPIMQVNGIQIQKDPRYNWTRLDIDCYKAEAGTVSFWGYSKPDTKEIIRVDEIHCLTDGVLKRFKSLQVDEQSPMKKLSPTSPFLANNASSLIHVFVPFV

SEQ ID NO: 153761 - protein, 119 aa, Heterodera glycines
  Coding regions on vcDNA: vcDNA=SeqID_80184; Strand=+; Position=1 -68,218-298,352-562
MNSFSLLTVFLCLVINCSAPPIRPLSSDVSIWKLCNGKNGKILVENGCTKLLLCYQSEMAKNRKIGKRFGVGKGIIGKLKFVECAEEIAEDQWHGLIITKHQDGVISYESRQIGRDKIF

SEQ ID NO: 153762 - protein, 388 aa, Heterodera glycines
  Coding regions on vcDNA: vcDNA=SeqID_80185; Strand=+; Position=1 -338,396-593,639-798,855-1049,1305-1412,1641-1808
CLTKAPFVGTTKFHRPTTATTTTSIPTTTEQQTFSFQPFSEFVSHFGTNCSKIVFPVEVAKFIVNITARPYRIACNDYEKEYEIGQLPKDYVANAYKGFFNACMSVPTTKCAKHAELNACYKSMKPVVPSNNAIAKLCQNHLNESNAAGFAVQICIHRDEKEQKLVFETFLNLSTTDEFIKMTRSYQISIEEIIETKKTIPIFFLEFGTDHQQSAIREKANGKVISESLNENAIGIGTVLNDIKSEKFNENLAKMIHLVPPVADRMLAFFQIPTPEFSKLISAQTNLKPYENNPKEVGRSSRCDTYGKDCAVITKLLNKIEQLRNCKNETIDTSGFRLPPSVDVPSPAIPYLSPTKTLTCFGDMYCNKEILQQQYDRERESKLRKEAF

SEQ ID NO: 153763 - protein, 124 aa, Heterodera glycines
  Coding regions on vcDNA: vcDNA=SeqID_80186; Strand=+; Position=1 -299,886-961
MRTGFCWSLSVIPHFFEQELGVSSARSLRSNKTLEKRSIGKWLGLNRYVINQSIINQSKGCGLKPENLISRRKRQFRPLNGTQLGKWNSFPIMISSAEKTATTILNNYIIAIVRATDYQNITSN

SEQ ID NO: 153764 - protein, 275 aa, Heterodera glycines
  Coding regions on vcDNA: vcDNA=SeqID_80187; Strand=+; Position=1 -172,233-420,486-665,714-850,895-1045
  Homolog annotation: Hit_ID=CAE71032.1; Match level="QueryCoverage =95%, HitCoverage=62%, E-value=2e-85, Identity=58%"; Hit description =Hypothetical protein CBG17873 [Caenorhabditis briggsae]
MSTDRYDIVLYGASGFTGQHVLESFVKNGHLDQFNFAVAGRSEKKLKQTLEDIEFITGKVLTKIPIIIADSSDAQQLAEMAKQAKVIVNVVGPYRLYGEAVVKAAVENGASHVDISGEPAWIEAMQMKYSEKAKEQGVFIVSACGWDSVPCDLGMNYLKQYFKGTLSHAETFAHIQIGEAGYSFNAGTYQTLILGLWQAKNDGLGKIRRSIMPEKMEKTKWRPPKRGMFWWNDSLDAYCLPFMGADKSIVQRSQYFDNIADKTYPVRKAFRFFIL

SEQ ID NO: 153765 - protein, 28 aa, Heterodera glycines
  Coding regions on vcDNA: vcDNA=SeqID_80188; Strand=-; Position=1-85
LFYMQPRENDPHAKTATRKRPRENVLAR

SEQ ID NO: 153766 - protein, 98 aa, Heterodera glycines
  Coding regions on vcDNA: vcDNA=SeqID_80189; Strand=+; Position=1-299
VLQIIPVLVAELEEMLENGNWNYTNLSHLKMVEWKMLEFALHKRGESQKWKEIQKLWNKWRRKFIRKFKNANKMPNFKKVMEELKDKMEQLRAEKEAE

SEQ ID NO: 153767 - protein, 54 aa, Heterodera glycines
  Coding regions on vcDNA: vcDNA=SeqID_80190; Strand=-; Position=1 -124,314-354
MSTNGPSGKRKRLFGDLMISGAILICQKVMKMIHLITTSVHELILKIVLLNNLT

SEQ ID NO: 153768 - protein, 47 aa, Heterodera glycines
  Coding regions on vcDNA: vcDNA=SeqID_80191; Strand=+; Position=1-145
PNFGVIINVEYRLDKISSFFLVLDSILGKLSVSSSTNNNNVHCVMNN

SEQ ID NO: 153769 - protein, 107 aa, Heterodera glycines
  Coding regions on vcDNA: vcDNA=SeqID_80192; Strand=-; Position=1 -64,321-580
MPKFKFDKADRDLHQIGDLWHAHFSININNFCLKITSNGEGYPKDTENTKNNANSNSDKNAKTERIDEAIGIGVAGGTFGKSFATKNDHKWLPKLLHVLVFRRMPTV

SEQ ID NO: 153770 - protein, 226 aa, Heterodera glycines
  Coding regions on vcDNA: vcDNA=SeqID_80193; Strand=+; Position=1 -149,195-250,298-364,437-522,565-699,1306-1325
  Homolog annotation: Hit_ID=AAC97507.1; Match level="QueryCoverage =99%, HitCoverage=57%, E-value=3e-49, Identity=47%"; Hit description =thymidylate synthase; TS [Ascaris suum] sp|O96650|TYSY_ASCSU Thymidylate synthase (TS) (TSase)
LTGETKNSDEMNYLRQVGEILSRGTVRTDRTGTGTISIFGMQTRYSLRGGTIPLLTTKKVFWKGIVEETIPLLTTKKVFWKGIVEELLWFIRAETNAKTLSSRGVKIWDLLWFIRAETNAKTLSSRGVKIWDANGSRAFLDSAGFTDREEGDLGPVYGFQWLHFGAENRGADADYWLHFGAENRGADADYTAKGTDQLAELIQGIRTDPNSRRHILCAWNVCSLRL

SEQ ID NO: 153771 - protein, 71 aa, Heterodera glycines
  Coding regions on vcDNA: vcDNA=SeqID_80194; Strand=+; Position=1 -91,193-317
MRFLYEREHKTLARAQEREDERNFLRQWLLGGPQGQQGHGGVQQQGQGLQTLIRPFEFDYLNVYQKCLYCI

SEQ ID NO: 153772 - protein, 170 aa, Heterodera glycines
  Coding regions on vcDNA: vcDNA=SeqID_80195; Strand=-; Position=1-513
  Homolog annotation: Hit_ID=AAO52058.2; Match level="QueryCoverage =97%, HitCoverage=27%, E-value=2e-09, Identity=26%"; Hit description =similar to Dictyostelium discoideum (Slime mold). Homeobox -containing protein (Fragment)
MPKQHQHQQQQQQHQDQQHQTDVIDHDHCYARPTKQLWKLKRQKYMLTFKLCKMCAQEIYNRKDDIAECNDGGVDLNFHRCKHCTMLNMRLSDMNSVQFMAYQPRNNNYNNTNNSNKNRNNKNNDNDENDSQNNFWYDNYGPTYCRGGPRNNYMQGKRKCLERIDMDDMH

SEQ ID NO: 153773 - protein, 131 aa, Heterodera glycines
  Coding regions on vcDNA: vcDNA=SeqID_80196; Strand=+; Position=1-396
MEKLKNFTLADLFKVLALPDKEFEEWLKELKLLHTTRFCDCGNEMSYKWKQDRQQPLWICYSKKNHDGKQPTIGFYTGTFFEGAHLSPKQVLNTLNLHDQLILRFWNFPTIGHENFQMMKSVFKCNWDVIQ

SEQ ID NO: 153774 - protein, 28 aa, Heterodera glycines
  Coding regions on vcDNA: vcDNA=SeqID_80197; Strand=-; Position=1-90
ITNKRRFTCLLGTIPRFGSTNYKKYPVL

SEQ ID NO: 153775 - protein, 163 aa, Heterodera glycines
  Coding regions on vcDNA: vcDNA=SeqID_80198; Strand=-; Position=1 -231,318-578
  Homolog annotation: Hit_ID=XP_522522.1; Match level="QueryCoverage =87%, HitCoverage=30%, E-value=6e-09, Identity=30%"; Hit description =PREDICTED: similar to Huntingtin interacting protein E; huntingtin interactor protein E [Pan troglodytes]
MLHIRKKAIKELRSLPPRTYDVVVHGSTSQHQPPHFKEVPALYSDYLTWLNSEIVKVQNNEREGGILRFAAEVHNKLVKAHVWGDGNGRTARAVRNIVLEKCQQHQVSFETVPHAEYMRAVGDALDGNPQNFENLLDGLLRAAEDAYMTAVHGKPGPSGHQTG

SEQ ID NO: 153776 - protein, 68 aa, Heterodera glycines
  Coding regions on vcDNA: vcDNA=SeqID_80199; Strand=+; Position=1-228
WSKCQEISNGFLCNILMAFRSKNCWCTIQTHIQHPNLNVFRQFDGVPPVQFVVESAQPAQSVPFTPPL

SEQ ID NO: 153777 - protein, 105 aa, Heterodera glycines
  Coding regions on vcDNA: vcDNA=SeqID_80200; Strand=-; Position=1 -46,621-892
MAVARPDLVMKAIIPGTNESRTVGGGGGRFSPSTTKNGGTPKSKRGKCKRNDGKGGETIATTETPDAGEEDGVIHAESILAEDLQLSESSSEDEEDGGRDSEDTD

SEQ ID NO: 153778 - protein, 502 aa, Heterodera glycines
  Coding regions on vcDNA: vcDNA=SeqID_80201; Strand=-; Position=1 -1470,1893-1973
  Homolog annotation: Hit_ID=NP_510671.1; Match level="QueryCoverage =97%, HitCoverage=51%, E-value=3e-89, Identity=35%"; Hit description =predicted CDS, endonuclease/exonuclease/phosphatase family and RNA -directed DNA polymerase (XR69) [Caenor
SNYPTISDIEFDAGEISCMLRTLPNRESTSPDEISFKFLRNCYLPLTPVISELFRLSMDTGKIPYIWKKSIVIPLFKKGDRNDPHNYRPISLTCCLCRVFEKILARHIYDFLHKKISEHQFGFVKKRSTNTQLISVLEDWYDSIYGNRNIDCVYVDFKKAFDSLPHHIMVQKLDNIGIKGKLLNWLSEFLKERTYTVKINNKYSKSYPIKSGVPQGSVLGPLLFLIYINDLPKVIPSEIKVKLFADDVKLYGNERIKLNTALQNIENWASLNGLKISPDKTFIIFFGKNNSKQQYKLCNKIINEVESINDLGVLIDNKLKFSDHYLKITKAAYLRIRYIAKFLKSRSIRVWTTVYKTYIRPLLEYAPEIWNPKLKKDIIKIERCQKYFTKIALFKCRLPYIPYQQRLSFFKIQSLEERRKVIDLVQAFKIINGLTHLKNIFPLISDHFPYNLRRKVETSHSFINRTALIWSKLNKYFPEFIWRQRFGDRENAFYNFWLHVSE

SEQ ID NO: 153779 - protein, 216 aa, Heterodera glycines
  Coding regions on vcDNA: vcDNA=SeqID_80202; Strand=+; Position=1 -230,277-484,529-741
MKKKLGDQNLTQVVSIFQFNILNFIDFKRFNTDPIFAESAKMLTLIAFVQIGDPTEAVNALDVAFRNLPEIQPMLEWLMNNYTGRPRADGSRTEPRFKAEAWNVYERMLSNDDRTNNFAAHKRIQCHFNCHPTLWNFIDVLRKAQTTTDADYSKFVKGIEPPPKKKKYRDTDSRILAKVQNYYIDIPNNNAHNYVNRHPRIIEYLKGISRNYQMNP

SEQ ID NO: 153780 - protein, 103 aa, Heterodera glycines
  Coding regions on vcDNA: vcDNA=SeqID_80203; Strand=+; Position=1 -178,614-747
MKHRWIIKENRQQKNKNKMMGQEMGAGKSDTGKSDTGKSDTGKSDTSRKSDTGGKSDTSIGVGFSNVGFTACVGFSTGVGFSACVGFSSVGFSGVGFSSVGFS

SEQ ID NO: 153781 - protein, 40 aa, Heterodera glycines
  Coding regions on vcDNA: vcDNA=SeqID_80204; Strand=+; Position=1 -13,480-589
MAPARLWHAQAKCSISAIWPPLRCCAKMKWAMDEFYRDKK

SEQ ID NO: 153782 - protein, 139 aa, Heterodera glycines
  Coding regions on vcDNA: vcDNA=SeqID_80205; Strand=-; Position=1 -290,363-492
MPIFMAFSGTIAIEKAPVKMQDDASDQTDQSQPQQKQIMLGVTIMELGEETLHERIYGNPTDFNDKNGAQKLDKQIREIAKPLKELHKGNNIIFWHLDWPGSGPRPGFFLAPEAQVQAIFWQPRFFLDLDCPWIFVQEI

SEQ ID NO: 153783 - protein, 144 aa, Heterodera glycines
  Coding regions on vcDNA: vcDNA=SeqID_80206; Strand=+; Position=1 -219,557-772
  Homolog annotation: Hit_ID=CAE68736.1; Match level="QueryCoverage =85%, HitCoverage=45%, E-value=3e-37, Identity=60%"; Hit description =Hypothetical protein CBG14666 [Caenorhabditis briggsae]
MRSQQAKVSASEAAKVSRGSGAASAESLEEQCKCEVMQPGLYDIETEMCTPELDDAKQFIPTELQNNVMDKTPISMFITVYLMDLQTHANESYLSAFGRAILQRRMAQSTVACFLMGLDVTLATAQQQQQSQAQQQQMPVAMEK

SEQ ID NO: 153784 - protein, 42 aa, Heterodera glycines
  Coding regions on vcDNA: vcDNA=SeqID_80207; Strand=-; Position=1 -116,164-176
  Homolog annotation: Hit_ID=NP_499789.1; Match level="QueryCoverage =95%, HitCoverage=9%, E-value=3e-09, Identity=60%"; Hit description =glycine receptor family member (3O570) [Caenorhabditis elegans] emb|CAB04879.2| Hypothetical protein T27E9
MICWKCPDATAKKIDKYSMIIFPVCFILFNVWYWFIFMGRLR

SEQ ID NO: 153785 - protein, 45 aa, Heterodera glycines
  Coding regions on vcDNA: vcDNA=SeqID_80208; Strand=+; Position=1 -132,365-370
MLSALDGVTFLYIFCHHKLILGPFCTSPTIGEEEHVIDVHGEEGF

SEQ ID NO: 153786 - protein, 58 aa, Heterodera glycines
  Coding regions on vcDNA: vcDNA=SeqID_80209; Strand=-; Position=1-173
YPLLPMHIDDMLLFPNCWACAKRAKNEFVMTKDVKKCNTVQRREHFWERSHQLSYGRL

SEQ ID NO: 153787 - protein, 366 aa, Heterodera glycines
  Coding regions on vcDNA: vcDNA=SeqID_80210; Strand=+; Position=1-1098
  Homolog annotation: Hit_ID=EAK89729.1; Match level="QueryCoverage =94%, HitCoverage=65%, E-value=8e-15, Identity=24%"; Hit description =uncharacterized glycine-rich low complexity protein [Cryptosporidium parvum]
DSIHQHSNHWDSTHLHSITATQSTIVPIVGAQPTNISITGTQPTAFQSPGLNPPSFQSPGLNPPAFQSVGLNPPAFQSLGLNPPAFQSPGTNPPAFQSPGTNPPAFQSLGLNPQHFNCQDSIHQHSNHWDSTHSISIARTQSTIVPIAGTQPTSIPITGTQPTSNSISGTQFSSFPITGTQISGIPISGTQISGIPNIGTQICGIPITGTQPTAFQSPGLNPPAFQSLGLNPPAFQSLGLNPPAFQSPGTNPPAFQSPGTNPPAFQSLGLNPPAFQSPESTLQHSNHWDSTHHRSNRRDSTHQHSNHWDSTHLHSITATQSTIVPIVGTQPTNISITGTQPTAFQSPGLNPPSFQSPELNPPAFQS

SEQ ID NO: 153788 - protein, 167 aa, Heterodera glycines
  misc_feature (28)..(28): Xaa can be any naturally occurring amino acid
  misc_feature (162)..(162): Xaa can be any naturally occurring amino acid
  Coding regions on vcDNA: vcDNA=SeqID_80211; Strand=-; Position=1 -81,170-469,1169-1292
  Homolog annotation: Hit_ID=YP_117020.1; Match level="QueryCoverage =99%, HitCoverage=2%, E-value=1e-25, Identity=39%"; Hit description =hypothetical protein nfa8110 [Nocardia farcinica IFM 10152] dbj|BAD55656.1| hypothetical protein [Nocardia
AGGLSPTDWNAGGLSSGDWNDGGLSPGXLNAGGLSPSDWNAGGLSPGDWNDGGLSPSDWNAGGLIGDWNAGGLSPSDWNAGGLVPGDWNAGGLVPGDWNAGGLSPSDWNAGGLSPSDWNAGGLSPGDLSPNVWMGDLSPRDWNAGELVPGDWNAGGVVPGDXNAGGL

SEQ ID NO: 153789 - protein, 202 aa, Heterodera glycines
  Coding regions on vcDNA: vcDNA=SeqID_80212; Strand=+; Position=1 -183,306-554,597-773
MPSWIFPRVAQQQQQSPFPQPPTTAVGSFQQHFQSPGSRGAPLPPHIPPQPFFSAGPPNGTMNSTPAMNNFGTDGAQLHPSFMYDGQVPTNGGAGHMLMNGAGGPGGTIDFNEDFSGGINGTMPAQYILSDELMGKIHNSTKRKTLLELQIGFEQIAYDVSNIFETWAMVIKERLVGSDPLSSSDLEIGAAILIEMVSRNCY

SEQ ID NO: 153790 - protein, 180 aa, Heterodera glycines
  Coding regions on vcDNA: vcDNA=SeqID_80213; Strand=+; Position=1 -157,209-315,367-502,577-719
MVKDTLAKMIHFVPPSNDDKMLPFFQIERPKFSKFINNDTDLLPYQDDPNKFNNPDPCDEYGADCVPIKNLLLKIEALANCTGNENNAIFEMPKWAPLPPAMPWKKRSETMLCDGDLFCDKRRLHEQYNRLREICGLQPEKVESQRKKRQYNPNEKWTESPIKITFNKKARNNLTTLYRI

SEQ ID NO: 153791 - protein, 324 aa, Heterodera glycines
  Coding regions on vcDNA: vcDNA=SeqID_80214; Strand=+; Position=1 -129,160-293,336-431,475-602,726-960,1864-1942
  Homolog annotation: Hit_ID=NP_492109.1; Match level="QueryCoverage =95%, HitCoverage=38%, E-value=9e-41, Identity=36%"; Hit description =metalloprotease III family member (1I107) [Caenorhabditis elegans] emb|CAA96596.1| Hypothetical protein C
FNLYLIKDFNMSVVAGHELMHALGFTHEQSRSDARNYIILRLDIIFHVLILKQSEIDPYTKNFIIFHVLILKQSEIDPYTKNFGFAYDFGSVMHYQSGAIMNSKKKLVITLPRFYQQTIGQSERISFKSKKKLVITLPRFYQQTIGQSERISFKDAAIINRIYCKDSCKGHEDKCQNGGYSCKGHEDKCQNGGYLNPNDCTKCHCPDGYGGEYCKELEESEQAKCGGNWPCRCRWRIKAINNIFEFLGFLINANFNCFQPEAGKKVRIQFIEQFFECTHNCSSAYVEVKYRDDKRAQGINFWGYSKPETNEIIRVDEIHCLMDD

SEQ ID NO: 153792 - protein, 132 aa, Heterodera glycines
  Coding regions on vcDNA: vcDNA=SeqID_80215; Strand=-; Position=1-397
MCSSFSNPFFFHFPQSPASAGVTVSSDRTERLLAKNATPTVGTRAVEKAEEGEAVDAFEGTKESVEEEEGEGRGGAGGRGRKGGVGEGRKGGGGEGRKGGGGEGRKGGETAHQQQHTEFEGDQRMWPRPVLC

SEQ ID NO: 153793 - protein, 172 aa, Heterodera glycines
  Coding regions on vcDNA: vcDNA=SeqID_80216; Strand=-; Position=1 -114,249-443,747-833,1450-1572
  Homolog annotation: Hit_ID=NP_491133.1; Match level="QueryCoverage =65%, HitCoverage=33%, E-value=3e-09, Identity=32%"; Hit description =putative nuclear protein, with a coiled coil domain (34.4 kD) (1D834) [Caenorhabditis elegans] gb|AAK6848
MPPATHQIYSQNLDAIPHVPSTSKSSMPLMKQEPISEQEQINLQLGLDAPKSSRESSVASGSIHFKYHKEGTQPSVSSLRPRRYRIKPDSEKQNPLYRIKRQKNNDAVRRSRDKAKRIQEAKESELKLLQDDNCRKAELIETLKASNAQLQGENLLLRQNCRCGAVLRVAKR

SEQ ID NO: 153794 - protein, 174 aa, Heterodera glycines
  Coding regions on vcDNA: vcDNA=SeqID_80217; Strand=-; Position=1 -361,512-675
MLLLLALFTLALCASFCDGMGDKNNKSFGKNWLSLGDSKGKSKASNAFNSNSGSTTNFANNHNANNSLSNPFNSNPFGSYQPNQPNWASDQFHQLDSSSNPTQSRGQNTSTLGQDFLSIGGEKVYENGSTEFIEEVYKKTGGDFPVVYHSMDQIHENGSAESIEEVYKKTGGGH

SEQ ID NO: 153795 - protein, 56 aa, Heterodera glycines
  Coding regions on vcDNA: vcDNA=SeqID_80218; Strand=+; Position=1 -63,132-238
TLCNLIITTAPFSRPKHSLPPKWCNVYKSIEQKYNTATLARQVRGVNAHSLINEYI

SEQ ID NO: 153796 - protein, 105 aa, Heterodera glycines
  Coding regions on vcDNA: vcDNA=SeqID_80219; Strand=-; Position=1 -174,438-578
MDCASKIKLPDEFLSELANAFRFNFRWSVLRISSSVFNYFLAKRQQQILQNVDLKLQKIVKSYEQREGFSSVEKMSIVINKIIASVVRNVAEAVLGARALINLHT

SEQ ID NO: 153797 - protein, 71 aa, Heterodera glycines
  Coding regions on vcDNA: vcDNA=SeqID_80220; Strand=+; Position=1 -142,1028-1101
MLHNIAIDCQAPQPAFDDDEIENEQQENLNDENIALSAEAVRTDYINQMASSAAGFAIVTGANTGLGFAFC

SEQ ID NO: 153798 - protein, 35 aa, Heterodera glycines
  Coding regions on vcDNA: vcDNA=SeqID_80221; Strand=-; Position=1-108
RRATLFSKIFNPGLRNPGLIVNPGLLNPETSNRPL

SEQ ID NO: 153799 - protein, 58 aa, Heterodera glycines
  Coding regions on vcDNA: vcDNA=SeqID_80222; Strand=+; Position=1 -125,427-478
MIRSALSSPNSTSVPIKRAVCDCSSTMPALWAIPFNWSTALRCISPPTIWVIFCSQIC

SEQ ID NO: 153800 - protein, 16 aa, Heterodera glycines
  Coding regions on vcDNA: vcDNA=SeqID_80223; Strand=-; Position=1 -35,1015-1030
MDKKRLLGTEKRIFTT

SEQ ID NO: 153801 - protein, 19 aa, Heterodera glycines
  Coding regions on vcDNA: vcDNA=SeqID_80224; Strand=-; Position=1 -34,848-873
MINFGAVLCFRGVRKLDQP

SEQ ID NO: 153802 - protein, 53 aa, Heterodera glycines
  Coding regions on vcDNA: vcDNA=SeqID_80225; Strand=+; Position=1 -150,306-317
MSFFCGNMSFMAKCHRQAMPTPTAHRLAVYKQAMFQTNGQMASFSLIHTSKIM

SEQ ID NO: 153803 - protein, 35 aa, Heterodera glycines
  Coding regions on vcDNA: vcDNA=SeqID_80226; Strand=+; Position=1 -102,991-996
MAKLMLAPTQLWCLYVDVVVLQFDGNAMDAISLAC

SEQ ID NO: 153804 - protein, 178 aa, Heterodera glycines
  Coding regions on vcDNA: vcDNA=SeqID_80227; Strand=-; Position=1 -107,186-288,643-698,759-1029
MISANGGSSTTKVLKCLMCGQSESRSTFMAHIAEHLNYRPHQCAECDFRSVTAEQMADHEATTEHVGQLNLTITTYDKLVQIATKMNRRWICNDVWMDIFPSFDHAQLGLKMALISDRFDVLVDKHFDGKSELTIWRPIEISKDEGMSKLLVDQDFEGFPLPDRPLPIKIRFKNLRIE

SEQ ID NO: 153805 - protein, 627 aa, Heterodera glycines
  Coding regions on vcDNA: vcDNA=SeqID_80228; Strand=+; Position=1 -166,332-423,477-509,580-661,723-800,917-1008,1073-1273,1356 -1458,1747-1936,2008-2137,2383-2529,2590-2729,2783-2913,3090-3216
  Homolog annotation: Hit_ID=NP_508987.1; Match level="QueryCoverage =99%, HitCoverage=70%, E-value=0.0, Identity=62%"; Hit description =retinal pigment precursor (88.9 kD) (XG513) [Caenorhabditis elegans] gb|AAC69106.1| Hypothetical protein F4
PIPLIALLLLQIRLVSAQSLRNIHLGFPEAWDGDKFPEIYCPSKNIPKWLDGYFLCQLSAAYGDPNAPPGQKLMHMIDAIGAIGSFHLSGGEAIGSFHLSGGEVVVVFSARYYPSRPYRIWEFYDRNMTKASVPWAGWSHYNLSAMPWAGWSHYNLSAMARWEQVPANPDAARFHPNLDFWRVGHRIIAGTEAPYWVGYEFDVPKLSNFRLASFVEDNDVPKLSNFRLASFVEDNDIFGTSARPSLIPISMAMHERADSDEILWGTFSAMNFDEERFFQGLFGLFTIDSNGVRKVVGMYDYGTWDAKACSKEDEYIGDKSHLPGYMHSISSTEHYVILPITSLVINPCKFKEPPRTAGADPQIQQGGLWGMDFYDVVPMRFLVFDFLVFDKRTNSWFTQKPLEVFPSMFVTHQLNAFEDSEGNIVADMVYDSHDPYVKYFYADFLRSQLYPNTARILRFTLDLRTFRVMYSYLIPQETISADFPQINRETISADFPQINRAFDSRPYQWAYFVENPFAGGNKIVKINVNEPSGTKNLHFTPDNLHFTPDELQLVLHEPYFEQRPGATREDDGILLVRGLELEENKGILLVIDATSMEEIGRAFVPISVPFGFHNRFFSRQQLGLTVG

SEQ ID NO: 153806 - protein, 222 aa, Heterodera glycines
  Coding regions on vcDNA: vcDNA=SeqID_80229; Strand=-; Position=1 -41,242-353,669-1007,1181-1357
  Homolog annotation: Hit_ID=NP_497221.1; Match level="QueryCoverage =48%, HitCoverage=42%, E-value=6e-17, Identity=44%"; Hit description =DNA segment Chr (3B236) [Caenorhabditis elegans] gb|AAC46595.1| Hypothetical protein T19C3.4 [Caenorhabdi
MDDVLDCVWHFLCGTRGASILYRNWVHPMFMKHEEEIDNFLEQAKNESYRQVVSLGSRGLSCARDIVATAALRGAAFSHVQLTDLQRSYSTGDINNAGKGGGGERKRTTTTTTVVYQKQAATTSIEEEHLGDNDDEAQVRTWTGSYDEYGNIVENAMAESNEATVKKVNDEELVVIEVFVFTTLCPFPPIFLASLRTPSVPNRVARTPFHGAVGRVPEKTTR

SEQ ID NO: 153807 - protein, 132 aa, Heterodera glycines
  Coding regions on vcDNA: vcDNA=SeqID_80230; Strand=+; Position=1 -3,449-844
MICDDNDQSLRLANFDWLHFVKSQNDCDSQKEELQINGSEIDSYSEEDDDFIDVSDCEVGNTKEMAEVTRNSSKQQHIEDRIGSGEETTEDELEDEAHFETRKMRNIGLKSKEEDTYADCYVHFIQFNNETY

SEQ ID NO: 153808 - protein, 43 aa, Heterodera glycines
  Coding regions on vcDNA: vcDNA=SeqID_80231; Strand=-; Position=1-129
MAHERGLLTSRVRHTIFDVKGVRNAADGSIMSFKEARDAGILQ

SEQ ID NO: 153809 - protein, 212 aa, Heterodera glycines
  Coding regions on vcDNA: vcDNA=SeqID_80232; Strand=-; Position=1-636
MENKFILVPSDLYKNLLKPESGEINVENAKNKLSSLLKQRKLDATSKNLLYNQELRRFLKLRKEVEEKPVKVELSDGSLMVFKPKQRERDSKIPTQIVNDEGLDETGSIPTLEDPYTTAEESDAESTTSTPKTRPLIRPMRVGTTKFRQKQKSFVVKKQQKIMSIINDDPEKFGIGAKGHILRANGTAYLKSNVNQALERILRRSPENAPSP

SEQ ID NO: 153810 - protein, 284 aa, Heterodera glycines
  Coding regions on vcDNA: vcDNA=SeqID_80233; Strand=-; Position=1 -317,536-1073
MSSTSSKKTLQSVVEQVIQQDAEIKSSEKPLKQNELEKSERKSTHTVYNLLDHQRSFWKLARPKFAVINFLCPGCRRINYKHKDQFKLMGEDEFHFTQVMCPGCVKERDELISPHPKSVLYCYGQFNDSIPVLQKMGVHVHRGSPTDELLSSLKKPLLLILDDLLTIIDEKSLSELFIKKAHHLNMGVIFITQNLFEKKVKVARINSQYIVIMSAPNAALQIRNLGVQLFPKRLSFFLSAYKDATASPYGYLFLDLHPASSPLLRIRTKIFKEDEEKALYIQND

SEQ ID NO: 153811 - protein, 156 aa, Heterodera glycines
  Coding regions on vcDNA: vcDNA=SeqID_80234; Strand=+; Position=1 -202,722-793,1390-1457,1510-1635
IEMSSHKKMNGKFIGKKKRKIEKKWKKEEGTNTNDSKGKKPSSTAKHSPLVGHESDQKWSDFDIRIQTYRSQNRADADWLEMVANRGTFPDQALKDIFLHELLPPKRKLLTMAQRPLEQWVNPTANNKSEADKRLLMWHFEAELKQLYHQFVQGLQ

SEQ ID NO: 153812 - protein, 116 aa, Heterodera glycines
  Coding regions on vcDNA: vcDNA=SeqID_80235; Strand=+; Position=1 -142,187-394
CNLRSSDRILFDILKKIGDGRKVSFTCDSSRVAENSRVIVRLNLESNEISILQKDQSKIEGEIPVWKFIGSLVGTYCADDQSVNELTDQWLALASSVRIDELSRQMSVHLGAHDFL

SEQ ID NO: 153813 - protein, 168 aa, Heterodera glycines
  Coding regions on vcDNA: vcDNA=SeqID_80236; Strand=+; Position=1 -142,187-394,698-854
CNLRSSDRILFDILKKIGDGRKVSFTCDSSSVAENTRVIVRLNLESNEISILQKDQSKIEGEISVWKFIGSLVGTYCADDQSVNELTDQWLALASSVRIDELSRQMSVHLGAHDFLSSQHAICLPDLVLRCCFFDTKTTADLLNWSSIKASNNVQLWAKRVDDACANI

SEQ ID NO: 153814 - protein, 57 aa, Heterodera glycines
  Coding regions on vcDNA: vcDNA=SeqID_80237; Strand=+; Position=1 -96,146-220
VLDKLLAEGHKLMLAQSFYDASVVLCKAAELSSKFFGDFAPQSFLPHFNYGKALIEV

SEQ ID NO: 153815 - protein, 91 aa, Heterodera glycines
  Coding regions on vcDNA: vcDNA=SeqID_80238; Strand=+; Position=1 -108,626-793
MDYQREQRAAKDKGSGNKLRLLSLDGGGIRGLVLIQVTNSDGAAVELARRICHDKKVPFFRITPQLRDEIKIDTTDNVQLIKMMWKAKVGE

SEQ ID NO: 153816 - protein, 30 aa, Heterodera glycines; identical to SEQ ID NO: 134381
  Coding regions on vcDNA: vcDNA=SeqID_80239; Strand=+; Position=1-90

SEQ ID NO: 153817 - protein, 54 aa, Heterodera glycines
  Coding regions on vcDNA: vcDNA=SeqID_80240; Strand=-; Position=1 -87,130-204
  Homolog annotation: Hit_ID=NP_497467.1; Match level="QueryCoverage =96%, HitCoverage=62%, E-value=9e-09, Identity=51%"; Hit description =human DDP related, TIMeless related (9.5 kD) (ddp-1) [Caenorhabditis elegans] gb|AAF60525.1| Human ddp re
MEMTGGDHQLNHFVQQLQAEIQKQGLQEQILKMNNRCFDLCITDSRLPSKLDGR

SEQ ID NO: 153818 - protein, 52 aa, Heterodera glycines
  Coding regions on vcDNA: vcDNA=SeqID_80241; Strand=-; Position=1 -112,162-208
MFMPMDHNIQQQVQASASRKARDDFFTFIACGFILEIGTRALRYVGFDSFLV

SEQ ID NO: 153819 - protein, 121 aa, Heterodera glycines
  Coding regions on vcDNA: vcDNA=SeqID_80242; Strand=+; Position=1 -195,855-1022
MAICKAIDPKARPKNPFGHFERRANVHPSPRSSHHCVLPRPIASFVRRGLAAAVLKRKGWDEHDEARSSPLGLSYGNRLLIEEAMANVGGMEVWGCAGAETLREQSKTKQRHAQQAERNAK

SEQ ID NO: 153820 - protein, 65 aa, Heterodera glycines
  Coding regions on vcDNA: vcDNA=SeqID_80243; Strand=-; Position=1-198
RRNWKDREVSSLLACQSTTTVHQQSGQRWTGQKSIAYSIRWGSNAVPLPIAWVVPLTQPKKVLAH

SEQ ID NO: 153821 - protein, 124 aa, Heterodera glycines
  Coding regions on vcDNA: vcDNA=SeqID_80244; Strand=-; Position=1-663
KKDLAPKYPQHLLASIKEKAKLYRQCKIYPTKKALYDSITLHIKIQTKKIHNLIEHKAISKGKNSIFKYIQKHNVNPFEIPNLVFENKCYHESEEKSELFAILFANSFNNSEVVLNDLSLDNSY

SEQ ID NO: 153822 - protein, 104 aa, Heterodera glycines
  Coding regions on vcDNA: vcDNA=SeqID_80245; Strand=+; Position=1 -226,451-539
MSDCIWEIYTVLDKINAESERVETMWLEIERSKDFDQTTKLEEKVFKSLNETKKLHFESRRIHTKILEQESSSVYIVLPLRLSQENTIDVLLEQPIFSHFFTIG

SEQ ID NO: 153823 - protein, 157 aa, Heterodera glycines
  Coding regions on vcDNA: vcDNA=SeqID_80246; Strand=+; Position=1 -35,464-751,847-997
  Homolog annotation: Hit_ID=AAL78214.1; Match level="QueryCoverage =57%, HitCoverage=46%, E-value=4e-10, Identity=35%"; Hit description =putative esophageal gland cell protein Hgg-20 [Heterodera glycines]
MLDHPEKVEKHIFICGDCWLSLFHLLPPDKVGLEIALLSCRFDALVDEHFKTRHWTLGIIEIRNKFRRCYRATGKAEMEILNAEGNAMPIPDRPLPNKVVGFGIICTDILRGKWFRKLLQSIFIDQNILKNDYFPIIFYAASRVSRDRDLVLKNTDN

SEQ ID NO: 153824 - protein, 67 aa, Heterodera glycines
  Coding regions on vcDNA: vcDNA=SeqID_80247; Strand=-; Position=1-204
METQLGQENGNDLAVDQTNRTPIKEIEKAKSPIGRSQNAPRTSARANRAPQRLDMDPSKPKYDIIRP

SEQ ID NO: 153825 - protein, 54 aa, Heterodera glycines
  Coding regions on vcDNA: vcDNA=SeqID_80248; Strand=-; Position=1 -91,208-278,864-866
MPLGQLPVLEVNGVKFSQSLAISRYLGETYDTQNSGAFKEWPMVRLDLVPCGDK

SEQ ID NO: 153826 - protein, 37 aa, Heterodera glycines
  Coding regions on vcDNA: vcDNA=SeqID_80249; Strand=+; Position=1-112
IKVNVEASNQVETAFFMLNISKLVRKKKRHMLQNAVS

SEQ ID NO: 153827 - protein, 203 aa, Heterodera glycines
  Coding regions on vcDNA: vcDNA=SeqID_80250; Strand=+; Position=1 -116,207-383,424-581,626-786
  Homolog annotation: Hit_ID=CAE71891.1; Match level="QueryCoverage =91%, HitCoverage=53%, E-value=2e-34, Identity=38%"; Hit description =Hypothetical protein CBG18949 [Caenorhabditis briggsae]
MSSGLHSNFLNRCKQTIGVLFYLGLMLLQPLILLAVVVSFCASLYLIWYISDFETPRSGARFSESIYNWSIWTDLANFFPIEVIKTAEIPPDRNYIFSAHPHGILGTSSAILFSTNGLNFRGLFPGIKMHPVTLGMNFWIPFRREFILAMRIISSDRESIKYVLSLPKEGNAVGMAPGGAAEALEAHPGSHRLILANRKVNSR

SEQ ID NO: 153828 - protein, 124 aa, Heterodera glycines
  Coding regions on vcDNA: vcDNA=SeqID_80251; Strand=+; Position=1-375
MSSSLVLILLVHFCLATNESEDKNNGMFYFNEEGISFISPLLPSLASSSSSLASSSSSSNFNQMTFYQAIQQLPFEENEELLLLCSFSEVNEDKVPNKFKDYLKMHLIFNLGTFSNLVLLQNQR

SEQ ID NO: 153829 - protein, 87 aa, Heterodera glycines
  Coding regions on vcDNA: vcDNA=SeqID_80252; Strand=+; Position=1 -53,168-378
MKPEARKEGIEQYGMMVTYFNNILIFNKWEDPRQVATKCDGYHCFLMTDQNEVNVLAVRYLDNQYERAKRANNWYNEKVVEIANVIE

SEQ ID NO: 153830 - protein, 46 aa, Heterodera glycines
  Coding regions on vcDNA: vcDNA=SeqID_80253; Strand=+; Position=1 -55,607-796
MKKKHESDHRSKVNHHHHHHHSVLIVVVAASPPAFRPERPPARPSA

SEQ ID NO: 153831 - protein, 92 aa, Heterodera glycines
  Coding regions on vcDNA: vcDNA=SeqID_80254; Strand=+; Position=1 -265,1047-1060
MCWKRYKSDKRGTKVMRRGTKVIRRGTKVIRRGTMVIRRGTKVIIRGTTVIRRGTMVIRRGTKVIIRGTTVIRRGATVIRSGTTVIRREILE

SEQ ID NO: 153832 - protein, 235 aa, Heterodera glycines
  misc_feature (94)..(94): Xaa can be any naturally occurring amino acid
  misc_feature (231)..(231): Xaa can be any naturally occurring amino acid
  Coding regions on vcDNA: vcDNA=SeqID_80255; Strand=-; Position=1 -132,306-445,583-662,762-865,975-1089,1206-1330
  Homolog annotation: Hit_ID=CAE70763.1; Match level="QueryCoverage =91%, HitCoverage=54%, E-value=9e-57, Identity=51%"; Hit description =Hypothetical protein CBG17512 [Caenorhabditis briggsae]
SRARSLMAILFIAITFYRLPSFMVELQIKWQPVFRIQKRLETTELSPYRIWLYSVIDPIVSHFLPFVLMCVFSLLTLCEIVKSRQFAYAHYIFXTERQFTLSHPLRRRIDGVRQKQEYRATYRATLSIVLIILLYLVLHSMELYILARKWQLLAQDDCPTRADYIQSHVSKILSVLSASVNAFVFIAFTNRMRTYIQMLIRRTSRSLSSNSSEPPLHKNKRNTNSGISRDXCLEN

SEQ ID NO: 153833 - protein, 110 aa, Heterodera glycines
  Coding regions on vcDNA: vcDNA=SeqID_80256; Strand=+; Position=1 -189,567-710
MKYGGGGTPTAAANFDHHQQQQQHHQRQQQQQQQRGGVIAGNTNNANSSNNGGQMFVMDGQSSVIKTAPPCRANASNSSSTNSAMMMDFSPKQEPIDLAPLAHPCLQVSA

SEQ ID NO: 153834 - protein, 424 aa, Heterodera glycines
  Coding regions on vcDNA: vcDNA=SeqID_80257; Strand=+; Position=1 -264,875-1079,1309-1703,2198-2431,3063-3128,3507-3614
  Homolog annotation: Hit_ID=CAE63912.1; Match level="QueryCoverage =37%, HitCoverage=27%, E-value=6e-19, Identity=40%"; Hit description =Hypothetical protein CBG08484 [Caenorhabditis briggsae]
MPTQLEHYYVASSKGGIGMPAGYGATAAGPAYYEYLNVGSAAYPTPTQPGPSGVAGGASAALLQPTAAAVVALQGTAGGQPHAAAPHQDWPYMSYSSVAAHAGLHQQHQQQLQAVQQQQLNGYLDVVMEHQQQQQQQQQQQRLYCGGIGTGGGTANVGSSKIFNGIFSSHISSELLLFDRFGHFNLSIPIPITFCLDHFSIPDHFMSLGPFFVHYPKRRGHYNSLFATDQINTKRCAGKAMDAVTAATLAVNAATGGIGTVGAGGGGLLSPVDSGIGTELSLLEHAKQLHEFFAPGCSLASAAVLQLPQSVQAQQPSSASSALQSVIHHQQQQQQQELVAGVVQQQTQQQRRDHNNGRSGAGSSESGQFYTVSLDYIPDLHCPLKGLTSQIMVVFREDKTFEDELRTWMLWHKRQHSHKQRIIE

SEQ ID NO: 153835 - protein, 435 aa, Heterodera glycines
  Coding regions on vcDNA: vcDNA=SeqID_80258; Strand=-; Position=1 -100,152-473,523-713,756-792,837-1011,1069-1293,1346-1448,1507-1660
  Homolog annotation: Hit_ID=NP_491190.1; Match level="QueryCoverage =98%, HitCoverage=56%, E-value=2e-78, Identity=39%"; Hit description =MDIG like (86.0 kD) (1E200) [Caenorhabditis elegans] gb|AAB53055.2| Hypothetical protein T28F2.4a [Caenor
DFFNKRVLMVNRKAKDYFEGFFGTVNLFKMLQKFDLDIGTDVNLSLYENDVPTDHNCADGERATAAAVWGHFGRGRAAQFDRPQCYNDNIWYLCDVLQELFCSFVGAKWSVLLSAHQMDISFSYLTPPNTSAIAPHWEDNDAFLLQIEGRKYFKVYSPASDKDTSPLDSSGTMSESDFDGREPTFEGWLEQGDTLYIPKGWIFKASAGDVHSLCVFVSICRGHSFTDFLEKASAEFVKTMVSGSKHLRKNLPPLLFDMAGNSGNDYPGEETLEEKIIPVAEVFSRKFGENFAAFVPSYIDLMAREFFRFALPPLLTPEEETKICFGGAIDSSLDIGKKTEVRLVRKHTQRLLFENAEKAFIVHRMANSRSCEEYPEKTIDFPIEFEDGFVTLVDSYPNWLEVGELGLESQEANVELAKLLFTNGILLVQREKSFG

SEQ ID NO: 153836 - protein, 43 aa, Heterodera glycines
  Coding regions on vcDNA: vcDNA=SeqID_80259; Strand=-; Position=1-131
MEVIGGRKEKGGMWERKRRLTEGRKGRDWRKKRGSLIKEEEKE

SEQ ID NO: 153837 - protein, 53 aa, Heterodera glycines
  Coding regions on vcDNA: vcDNA=SeqID_80260; Strand=+; Position=1-159
MAPLCRHASFPIGSAPPARIPSLIVPYGWPPTNEFVSIQKRRWKENAGRVVYF

SEQ ID NO: 153838 - protein, 92 aa, Heterodera glycines
  Coding regions on vcDNA: vcDNA=SeqID_80261; Strand=-; Position=1 -141,396-530
QPKTKFRNGPYNQLKLTVRGEAQVRASVLHRRLHHGTSAVTMDQKVIFARFIARFALNAQEVLIIGAIGRSESDDHFGRLFTAQNLRVFSAL

SEQ ID NO: 153839 - protein, 112 aa, Heterodera glycines
  Coding regions on vcDNA: vcDNA=SeqID_80262; Strand=+; Position=1 -55,184-327,831-970
  Homolog annotation: Hit_ID=CAE68649.1; Match level="QueryCoverage =91%, HitCoverage=91%, E-value=1e-18, Identity=38%"; Hit description =Hypothetical protein CBG14543 [Caenorhabditis briggsae]
MAATGGSFVCRRYLLNDDEVSDTFDMLDMDKDGRLSRAEIAALLRTANVEPTRKEWTSFSREMDKDRELKNMLANIANLHDDDTIGQMFEHCDLDNDGRLTFDEFLRMIRRE

SEQ ID NO: 153840 - protein, 32 aa, Heterodera glycines
  Coding regions on vcDNA: vcDNA=SeqID_80263; Strand=-; Position=1 -93,545-550
MHTLLNDEYVMDVCTELETRGDDFVLILTRSE

SEQ ID NO: 153841 - protein, 25 aa, Heterodera glycines
  Coding regions on vcDNA: vcDNA=SeqID_80264; Strand=+; Position=1-77
LGHFVAWTFCGSASRRPPYEAAKRP

SEQ ID NO: 153842 - protein, 41 aa, Heterodera glycines; identical to SEQ ID NO: 138623
  Coding regions on vcDNA: vcDNA=SeqID_80265; Strand=-; Position=1-347

SEQ ID NO: 153843 - protein, 101 aa, Heterodera glycines
  Coding regions on vcDNA: vcDNA=SeqID_80266; Strand=-; Position=1-306
MKNEFKQKGRKYSTKEWKQNYAEICKKIGVSQGIIEKWKKQFGIRSKSITEKEKMEKIKIYWQIKKENPKISDQKIAKMINTSAKNICIWKAKFGEENLQF

SEQ ID NO: 153844 - protein, 126 aa, Heterodera glycines
  Coding regions on vcDNA: vcDNA=SeqID_80267; Strand=+; Position=1 -161,237-397,615-673
MRATHVGIWHHRMWDSCVFHYITHDSALVTWHCGECNRRSFQTFEFAMGDKTDRWGRYLLHQSKERRHVVNIDEADVHREFMLMRGTGHYNLFYYNCKHWAEEFVINNPGLKCLNYNGTQMTNVFS

SEQ ID NO: 153845 - protein, 39 aa, Heterodera glycines
  Coding regions on vcDNA: vcDNA=SeqID_80268; Strand=+; Position=1 -14,675-780
MYENIYGVLVMIQTELWGPISNSIWPVAEEGHLIMLCFL

SEQ ID NO: 153846 - protein, 71 aa, Heterodera glycines
  Coding regions on vcDNA: vcDNA=SeqID_80269; Strand=-; Position=1-216
MDKDKDNKDKIEPNGRSDHPNRPCHSAGTKRDGVGTKNGILPLFESKATAATVSARTRYTPQFKTFDVLIV

SEQ ID NO: 153847 - protein, 103 aa, Heterodera glycines
  Coding regions on vcDNA: vcDNA=SeqID_80270; Strand=+; Position=1-350
IESLELWRVSCAGRNCSRRCFGFEEWENPVFCADSIPFCTSGVAWPIWMIASSVGLNFVLIVLVLVHLAVVRVRRDLLFASFGVCDQCQRRVSVLSSRIVSSM

SEQ ID NO: 153848 - protein, 259 aa, Heterodera glycines
  Coding regions on vcDNA: vcDNA=SeqID_80271; Strand=-; Position=1-780
  Homolog annotation: Hit_ID=CAB39733.1; Match level="QueryCoverage =91%, HitCoverage=21%, E-value=6e-29, Identity=34%"; Hit description =protease, reverse transcriptase, ribonuclease H, integrase [Drosophila buzzatii]
MLSYFRKFVYGFAEIHQPIYELTKNESTTEWGPPHEKALEELKTKLMTAPVLAPPKFGQPFVVETDASIKAIAGCLLQENREGEVHPICYFSRVLTKHEKRYSVVELEALAICASLKNFRPYLEGAGKSTVITDNLALTSLFRRKDLEGRLSRYQLAIMAFDVEIIHRPGKRNQFCDHLSRYLDDNDTQINWLKIEPKISQSEMREAQKQETDTQKRRETLKKDQNSEEPNEFSGKWKLRKIFCVQWTEENGKFMCQAV

SEQ ID NO: 153849 - protein, 106 aa, Heterodera glycines
  Coding regions on vcDNA: vcDNA=SeqID_80272; Strand=+; Position=1-321
MMANVRERIYRCLFTLSDFLKGLKMFNHKFMWSQNEEEAGKIREHGQMFVGGFEVTPGTRIGGFEMVPGPLVRGQLLAFINDLNDRFGNAKKDCVKLAVWAHRELV

SEQ ID NO: 153850 - protein, 223 aa, Heterodera glycines
  Coding regions on vcDNA: vcDNA=SeqID_80273; Strand=-; Position=1-669
MDIDALKRRVTTLERQLQEHANPRTGLPLPGTFDGTTDFYNYLKSFNLVATAHGWNPARCVQILPLYLRGSAKAIYDGLDQNVKTNWKDLVDGLADKLKKVSSGLMARQKLAQRRQFAGETLDEFAQEIRSLVAKAYPDNTLEMDLATLALGDRENEVKEENAKRIQQFRSEIARDFFRANMLPEIKERVMYMEEPQNLMEALTQAKRVEQIQGSLANDQWRM

SEQ ID NO: 153851 - protein, 291 aa, Heterodera glycines
  Coding regions on vcDNA: vcDNA=SeqID_80274; Strand=-; Position=1 -19,1509-1646,1696-1815,1943-2057,2104-2281,2358-2455,2546-2597,2808 -2880
  Homolog annotation: Hit_ID=CAE70374.1; Match level="QueryCoverage =98%, HitCoverage=19%, E-value=2e-96, Identity=64%"; Hit description =Hypothetical protein CBG16933 [Caenorhabditis briggsae]
KTNDKYSIFPFLFQVLFQQFKFFLNLYFLLMACSQFFPAIQIGSPITYWGPLGFILFITLIREGFILFITLIREFVDDMVRLLRDREVNSEKYAEGRVLIKSAEIHVGDLIIIEKDRRVPADVVLMRTTEKSGACFIRTDQLDGETDWKLRLDGETDWKLRIAIPYTQNLLDDMQILDLNCEVYAEKLQKDNHAFVGTYRVSVIQNSRENSLSVENLSVENVLCVWANTVLASGTAIGLVVYTGRETRSVSVMTTLPDSKVGLLDREANNFTKCFLFVLTLSAVMVLMKGH

SEQ ID NO: 153852 - protein, 110 aa, Heterodera glycines
  Coding regions on vcDNA: vcDNA=SeqID_80275; Strand=+; Position=1 -222,277-372,1583-1597
MGGQKKIHLVYADKPVSALEEEFNAAGKLYGQPVPALGAYKNGRSTPIEPRLDYSAQSNADDHPGLGYKCGRWQVEGMVPEILEEDIGERVFYTQAQVEQMLDDFKTGLF

SEQ ID NO: 153853 - protein, 129 aa, Heterodera glycines
  Coding regions on vcDNA: vcDNA=SeqID_80276; Strand=+; Position=1-387
MTKKVFVETDAAVDGRRDAILAGARRKAAFYQLKKGVVMRMDSMYQQQQQTGQIGQKGENEAEQQQWGKAHTEEQAAFEFVDVVVHPEDLFVNETHSTSTFVYQAGDKILQNNSLRHRMARFLLPPGEL

SEQ ID NO: 153854 - protein, 171 aa, Heterodera glycines
  Coding regions on vcDNA: vcDNA=SeqID_80277; Strand=-; Position=1 -436,550-629
MVADGVLSELVLCESRPTVADAAASAENAGPPAGTTGDNETSPQPHHQQQCHRPQRVYDALRQRSAEVADFLMPTDNEAEELGEGGLFYACGDVKNMSRELWACLSDILQREKGERYLADLNRDGIEPMVLVETNPEYPFVKKPQGFSPVEAIHLLKKLREKERLIEDVWS

SEQ ID NO: 153855 - protein, 95 aa, Heterodera glycines
  Coding regions on vcDNA: vcDNA=SeqID_80278; Strand=-; Position=1-287
SSSNTLWQCGAPIPTAFGPLLRTRVVRNECVTRTDTGRIGKAKWELELALITTDQDGADDQQEQQQRELLESCDAGDSFNVLFENPEQEVDFVLK

SEQ ID NO: 153856 - protein, 69 aa, Heterodera glycines
  Coding regions on vcDNA: vcDNA=SeqID_80279; Strand=-; Position=1 -99,328-438
MIPNNKNTFCGEREKKRDQQREEKRERKTETWKQNDDPKMWGEIFSKEIPSQCATDREFCTQSNVKCSR

SEQ ID NO: 153857 - protein, 20 aa, Heterodera glycines
  Coding regions on vcDNA: vcDNA=SeqID_80280; Strand=+; Position=1-62
SPCAAPTAAVFEAAPARPLI

SEQ ID NO: 153858 - protein, 32 aa, Heterodera glycines
  Coding regions on vcDNA: vcDNA=SeqID_80281; Strand=-; Position=1 -50,442-490
MSRMVGHTKPTSEKRNRTSIIFKSLKTARFIL

SEQ ID NO: 153859 - protein, 19 aa, Heterodera glycines
  Coding regions on vcDNA: vcDNA=SeqID_80282; Strand=+; Position=1-57
MFTSINPLVLFLLFFVAGD

SEQ ID NO: 153860 - protein, 55 aa, Heterodera glycines
  Coding regions on vcDNA: vcDNA=SeqID_80283; Strand=+; Position=1-181
STGYREAIPEGFGLPINLSASVRGDCPENKKIDFFKCPFGVLKQLWGAKIQRRKT

SEQ ID NO: 153861 - protein, 211 aa, Heterodera glycines
  Coding regions on vcDNA: vcDNA=SeqID_80284; Strand=+; Position=1 -189,259-534,591-770
  Homolog annotation: Hit_ID=AAL78214.1; Match level="QueryCoverage =72%, HitCoverage=75%, E-value=8e-11, Identity=27%"; Hit description =putative esophageal gland cell protein Hgg-20 [Heterodera glycines]
MAPPVKKKKKFSSDNRRLISSTGIGEHEQQSMGSLTTSFGKRQSLFRHAKKMNNRILRKIWICTDIWMDTFPFFDHAQLGLKLALISPRFDVLVDKHFNCQSELTIWREITIVKDTGSELNLTVRIGGKSVQFPLPDRSLPNKIRFDNLNIDYIDHSVLVFLRANKQIWDKGTNLSLYVCWSHNQNDNNNNFLPIWDVFVCKIWPIFAPNI

SEQ ID NO: 153862 - protein, 30 aa, Heterodera glycines; identical to SEQ ID NO: 126607
  Coding regions on vcDNA: vcDNA=SeqID_80285; Strand=+; Position=1-91

SEQ ID NO: 153863 - protein, 30 aa, Heterodera glycines
  Coding regions on vcDNA: vcDNA=SeqID_80286; Strand=-; Position=1 -49,157-200
METDLITLVKEGDFEAGPPKQYYVDYSIFF

SEQ ID NO: 153864 - protein, 87 aa, Heterodera glycines
  Coding regions on vcDNA: vcDNA=SeqID_80287; Strand=+; Position=1-264
MLKNENWNYFNLNHVKMVEWHLLALALRKDGQCQKWEEIEDKWEEWKSEFNLSFGNTNESQKFQKLMEEIKEKMENLKKIMEKREKE

SEQ ID NO: 153865 - protein, 39 aa, Heterodera glycines
  Coding regions on vcDNA: vcDNA=SeqID_80288; Strand=+; Position=1-117
MRIWPSPFVLPSLPLALFLPICFRVVLLLRFGAGRDDAA

SEQ ID NO: 153866 - protein, 80 aa, Heterodera glycines
  Coding regions on vcDNA: vcDNA=SeqID_80289; Strand=+; Position=1 -99,220-363
MSLDFMNFPRYVLENRHTRPWKRIIDDESPALNALLNFEQNYWDANACHTDLEIIGDKNLTVHYKERASGNFIPKIKLMG

SEQ ID NO: 153867 - protein, 120 aa, Heterodera glycines
  Coding regions on vcDNA: vcDNA=SeqID_80290; Strand=+; Position=1 -35,178-401,450-553
  Homolog annotation: Hit_ID=CAC21848.1; Match level="QueryCoverage =89%, HitCoverage=52%, E-value=8e-10, Identity=37%"; Hit description =hypothetical protein [Globodera rostochiensis]
MIFRSIKDFFKSGVCFGFGVKKQPKSDERMYDGEGFYTYDSNGIFWINGSYKGMFERNAYGVNDIVGCGVNLATRKIFFTKNGHRMGAFDFDSFSDIYQLFPFVSLPYWSERIEANFGPF

SEQ ID NO: 153868 - protein, 55 aa, Heterodera glycines
  Coding regions on vcDNA: vcDNA=SeqID_80291; Strand=+; Position=1 -45,738-860
MMDKLVQQMDKEIDEAFSRVRPGPRCKPGFSLVQGPGYFPGHGFLFTNLAPVEIG

SEQ ID NO: 153869 - protein, 90 aa, Heterodera glycines
  Coding regions on vcDNA: vcDNA=SeqID_80292; Strand=+; Position=1 -258,308-322
  Homolog annotation: Hit_ID=AAO85453.1; Match level="QueryCoverage =87%, HitCoverage=61%, E-value=1e-26, Identity=64%"; Hit description =putative gland protein G16A01 [Heterodera glycines]
YCWKTYLGPLLEQPKSDDEEKPKPEGGEEATTAGDKEEKKAGSKGDKHKKSGSKGDKHKKDKKSGSKSDKDNGPADENKQPQTSAYATPT

SEQ ID NO: 153870 - protein, 479 aa, Heterodera glycines
  misc_feature (3)..(3): Xaa can be any naturally occurring amino acid
  Coding regions on vcDNA: vcDNA=SeqID_80293; Strand=-; Position=1 -275,446-1566,1815-1880
  Homolog annotation: Hit_ID=NP_917837.1; Match level="QueryCoverage =97%, HitCoverage=23%, E-value=1e-78, Identity=35%"; Hit description =B1158C05.18 [Oryza sativa (japonica cultivar-group)]
NLXQEGKSLKDKNLPQKTLENENINYEEEKKIANLYKSMNADQKIIYENKTNSISKLNPKLIYIDGPGGTGKSFTLNALYHLVRSYTLHMTNMAFSGIAATLLKNGRTIHNRFKFPLNLNAHIISGVVQGTKAAEEIIKSDFFVIDEAPMTPRFALDAIEKKLRELTNCKQLFGGKTIILAGDFRQTLPVKKFAVRSEIIDLTIKKSIFWSKFEQMKLTINNRAKDQIFAEQILEIGNGTGDSIQLPNNCIIANDSNLIDEIYDDVFKERNNELKNRLILSPYNDLVDQHNTAALEKFPGECVTYLSIDEVETTNNFPVTPEIMNSFNAPGFPVHELKLKLNCKIMLLRNISIENGLCNGTILQVKELKNNVLKCIILGGDKDGSEAYIHRISLITESEFPVPKRHQFPVRLAFAATFIKGQGATYKKIGVDWTRQSFSHGQTYVALSRVGSWQQIKALVRSRRGCDSRLKSRSQNQSK

SEQ ID NO: 153871 - protein, 142 aa, Heterodera glycines
  Coding regions on vcDNA: vcDNA=SeqID_80294; Strand=-; Position=1 -94,143-474
MLFLCLLQYLLLINTVIYGQESNGGGYGESYAVNGKFGEGNWQTGRFEGQHGQFRGRNWQNGQNREQNGRSEVNILTSQGGGANHRQAASNSCDQIRKSPSTAIEQLIKGRLINPIEDNSQRYTLYAADFARTNKSGGCFPQ

SEQ ID NO: 153872 - protein, 243 aa, Heterodera glycines
  misc_feature (208)..(208): Xaa can be any naturally occurring amino acid
  Coding regions on vcDNA: vcDNA=SeqID_80295; Strand=+; Position=1 -115,2622-2752,2797-2940,2982-3183,3348-3383
  Homolog annotation: Hit_ID=NP_507845.1; Match level="QueryCoverage =95%, HitCoverage=28%, E-value=2e-36, Identity=36%"; Hit description =transposase family member (5U321) [Caenorhabditis elegans] emb|CAB81975.1| Hypothetical protein Y116F11B.
HLTLVHRLLYLLVINTVEGKEMHIFILFSKITFLFYFRPFVLLPKKRPVPEIVKRFKNDLVLCWCGRTWMDNELTTKFLEEVLGGFAFRTRLLVWDSFRCHVLGGFAFRTRLLVWDSFRCHISDDTKQTLRRLSIESAVIPGGTTKYIQPPNVCWNAPFKQIRQIYPPNVCWNAPFKQIRQIYDEWMVNGEKETTSSGNMKAPPMETXFGTRRKRWSTLLMNNILIKFKNCGLFQFTRPISDH

SEQ ID NO: 153873 - protein, 114 aa, Heterodera glycines
  Coding regions on vcDNA: vcDNA=SeqID_80296; Strand=+; Position=1 -237,781-893
  Homolog annotation: Hit_ID=NP_501064.1; Match level="QueryCoverage =97%, HitCoverage=11%, E-value=2e-38, Identity=67%"; Hit description =proteasome Regulatory Particle, Non-ATPase-like, S2 (107.4 kD) (rpn -1) [Caenorhabditis elegans] gb|AAF986
HLTRYGDAAIRRAVPLALALLNTSNPQLTIIETLSKYSHDADTETARNAIFALGLVGAGTNNARILAILSFHSNDQNTMMLLRITQGLMHLGKGTQTLNPFQSDRQLMCPAIVP

SEQ ID NO: 153874 - protein, 130 aa, Heterodera glycines
  Coding regions on vcDNA: vcDNA=SeqID_80297; Strand=-; Position=1 -139,989-1129,1204-1315
  Homolog annotation: Hit_ID=NP_501399.1; Match level="QueryCoverage =100%, HitCoverage=13%, E-value=4e-33, Identity=59%"; Hit description= vacuolar proton ATPase, Vacuolar proton ATPase VHA-5 (99.3 kD) (vha -5) [Caenorhabditis elegans] gb|AAA81
VRINMQKEEMHVIRNGRNATKHDEVHSVDEAHDHVSGAGGGAHHDESFGDIMVHQSIHTIEYVLGCVSHTASYLRLWALSLAHAQLSEVLWTMVLKNAFAFHLGVAGYFVLYFIFFAFAVLTFSILVLME

SEQ ID NO: 153875 - protein, 220 aa, Heterodera glycines
  Coding regions on vcDNA: vcDNA=SeqID_80298; Strand=-; Position=1 -98,464-572,643-779,844-958,1598-1675,1724-1846
  Homolog annotation: Hit_ID=CAE58454.1; Match level="QueryCoverage =100%, HitCoverage=29%, E-value=2e-74, Identity=55%"; Hit description= Hypothetical protein CBG01592 [Caenorhabditis briggsae]
MGLFSIHAGLLYNDAFAKSFQIFGSAWANIPYNDTEIDSWLSKPEEAGKEMEVHLNPMTAYDRARGPYPFGMDPVWNLADNNKLNFLNSMKMKLSVIVGITQMTFGVALSYRNYKFFESPIEVFTVFIPQLVFMSSIFIYLCLQIIAKWLFFWSRDAGFQDDNGKELPGCYLNQWYPGQSFVEAILVIIAVLCIPIMLFGKPFHILMHQRRAKRAVSDNM

SEQ ID NO: 153876 - protein, 185 aa, Heterodera glycines
  Coding regions on vcDNA: vcDNA=SeqID_80299; Strand=-; Position=1 -84,142-237,1042-1419
MVFYTTPFFMVFINDSAPYLRLILSESEKKRNISILNRKNTLQVPNFNRIKNLKKFFNIKLVKKAKSEDKDEILEAISKIREMLEDSLKGNADEQLIDELVSADVLDALVDCLSKDHASRPTLMANAMAALAIIVTRKEKLVFEIQNVMDYLNYWLMNSTDDEVKKNAVSILKKIMPNVRILAGI

SEQ ID NO: 153877 - protein, 36 aa, Heterodera glycines
  Coding regions on vcDNA: vcDNA=SeqID_80300; Strand=-; Position=1-113
IKVNVEASNEVENAFFMLNISELVRRKKAYASKVGL

SEQ ID NO: 153878 - protein, 163 aa, Heterodera glycines
  Coding regions on vcDNA: vcDNA=SeqID_80301; Strand=+; Position=1-493
  Homolog annotation: Hit_ID=CAF96846.1; Match level="QueryCoverage =100%, HitCoverage=17%, E-value=7e-24, Identity=25%"; Hit description= unnamed protein product [Tetraodon nigroviridis]
ESAKAKSEKEERKDKRKDKRKDKRKDKRKEKGRTKGRTKGRTKGRTKGRTKGRKKEGQKEGQKEGQKEGQKEGQKEGQKEGQKEGQKEGQKEGQKEGQKEGQKEGKRKDKRKDKRKDKRKDKRKDKRKDKRKDKRKDKRKDKRKDKRKDLLGLRVKSEDELEE

SEQ ID NO: 153879 - protein, 107 aa, Heterodera glycines
  Coding regions on vcDNA: vcDNA=SeqID_80302; Strand=-; Position=1 -197,328-407,840-884
VCPSQLPSLSVSSSVSDCAPSRINLLWSLNSRVPSLLLLQQRAHKLCLLPIEVPFSVIAHSTELFRYSLRNALRHFALCHSSNSSSLLTLNPNLAFADSLYSDILYF

SEQ ID NO: 153880 - protein, 262 aa, Heterodera glycines
  misc_feature (3)..(3): Xaa can be any naturally occurring amino acid
  Coding regions on vcDNA: vcDNA=SeqID_80303; Strand=-; Position=1 -86,156-330,674-968,1057-1259
  Homolog annotation: Hit_ID=CAE59422.1; Match level="QueryCoverage =80%, HitCoverage=85%, E-value=2e-49, Identity=40%"; Hit description =Hypothetical protein CBG02791 [Caenorhabditis briggsae]
ILXYVCFFTKEILHFVAMEMGKGKKKKSFKACNREWSGDFEKKACNREWSGDFEKEFAMNASDFYDFPFHPKVLDYGQFLAYCRLADRQTQCFIERCGDQSADRVFSPSNFLCTFKRQHFLRARSCLEDSEPISFLRCDQKCHPPKEGTENAAKEREREKGEVYSGDEMDGYERELGRVCAFQHCYSQCQEQIATQICPPGPATLAAELVRTYVQWHSADLLDWHILTGNELRMPQSCAKLAKSMTTAKGPDPVLKAMLVAV

SEQ ID NO: 153881 - protein, 790 aa, Heterodera glycines
  Coding regions on vcDNA: vcDNA=SeqID_80304; Strand=-; Position=1-2370
  Homolog annotation: Hit_ID=AAM51140.1; Match level="QueryCoverage =40%, HitCoverage=30%, E-value=1e-41, Identity=32%"; Hit description =SD27140p [Drosophila melanogaster]
MPQLPMDRVRRRIPFESVGLDYLGPTVTLDANGQRQKTWVLLITCLTTRAIYVDATRDLSAQSFISVLRRFIARRGAPSRILSDNAPTFTVMGKTLSDFGMAGDDPRHFSDSRGIQWRFTPQHTPWAGGIFERAVQLVKRALQKTLGSAVLGYDSFATLLAEVEATVNSRPITYVNSTAGEPLPLRPIDFIQENGRLWVDPPDTTGQAQDERRDPPHKQLARQWRESQQRLEHFWRRWHREYLMTLREKAGWNHAQRRVNAPGTPKVGDMVLVEDKFHPRNLWAMGRIEELRGSDGHVRSVLIRMANGRIWGRPVNKICPLEEAPPKMHDQADQAVHEPCGDDARAVETQSEERSRNELSAATKEEENEGNVSEESAEKRGREVEAVQPDGRVNREIRNDNSLGNGPDDPDEKCDDATATEKMAVFETAAEVPSAAPGETGFLAHPHSAPRHEKKYLGDSSTAPGLLNVPTKFQPNPTRSEGGDRFGADGPQAVQTAESGDEFPEATAVEQQQNEFERTPNNPEEEVHDEQDTQGVQAVPEVEPRKSTRTRRNRAVWSPERHVPRKRGRRSPLVALAVLLTLLCPAPSWACQPTLRAAPQEPAEPGMSTTMLPCHMQCTRRGVRTVSGQLMEKIEICCPDGCWTTIPTSTVINYELPDEMLIHGYSCSGQCWRGLGPPVNVTQRCPARAECELISCAFCWEQLANPTCNPRWASTLFGFGAALMLAALGCCCSIASRFWSGATLFSRAIAWGVSYPITFINWATGRHLPRPTANQIESKVRKGARVARAE

SEQ ID NO: 153882 - protein, 103 aa, Heterodera glycines
  Coding regions on vcDNA: vcDNA=SeqID_80305; Strand=-; Position=1 -159,439-588
MDVPLAAPPYQRMASLPPVLPSGHSSSVAQMPAGGGGGGGGISFGTTIQQQQQRPYQLYHHHHHTVQQQHQNGMPMICGGSGNSATNGNTINGNANNDYAAFV

SEQ ID NO: 153883 - protein, 63 aa, Heterodera glycines
  Coding regions on vcDNA: vcDNA=SeqID_80306; Strand=+; Position=1 -180,558-569
MDQQQCALQLAGRTAAHRVPAVRRFMRVLQSDQLVRVVMDAEIPAAFHRTKKPKQNPAEQKIA

SEQ ID NO: 153884 - protein, 26 aa, Heterodera glycines
  Coding regions on vcDNA: vcDNA=SeqID_80307; Strand=-; Position=1-80
MKDSFGRWADRMKECFGDGTFSLAPS

SEQ ID NO: 153885 - protein, 281 aa, Heterodera glycines
  Coding regions on vcDNA: vcDNA=SeqID_80308; Strand=-; Position=1 -81,266-350,667-1038,1212-1516
MPDGTRVTVNAGNDENWLGEVKNGQAEVAIVPNAVKVTVDGPRDSRNASVKYHLNGQHVPRKLRSNLELDAMMGQLKKAAQQQQQVQHRNGIFKSAPPPPHFVHPNFFLTAARQPQLLRCPPTMLQQQNGTGQPPSSQSHFSPLSVAVPSLPMMPFMMPAAASLHSFALLNGNNMMSNRTAFRQPTCAFGNNSLLDAKLADAGMTPPATTVTPAVSSAPRPQQGFIAASPPLRHCATPSAFRALSIFPDPKMMASAAGPISRLRPGRGACVRFCRRRQWPV

SEQ ID NO: 153886 - protein, 600 aa, Heterodera glycines
  Coding regions on vcDNA: vcDNA=SeqID_80309; Strand=+; Position=1 -85,140-1265,1368-1576,1755-2137
  Homolog annotation: Hit_ID=NP_001004509.1; Match level="QueryCoverage= 68%, HitCoverage=26%, E-value=1e-46, Identity=31%"; Hit description =si:busm1-180o5.3 [Danio rerio] emb|CAD60788.1| novel protein similar to DNA polymerases [Danio rerio]
MKARPFPIGTPHVWTGEQLWQAGAHAFEASAPPPAGLCPPPALPWRRPEDNPFRGFLFCRVLPPTAEELGDREPLLPYRTQADGRLIFGLCARCAELRQQRICHHTERERAWTAAYTHVELNRALSIGYRVLSVHEVWHYERWASPDNGNGLFTEYVNTFLRLKAEASGWPAGCDTEAARAEHIRQFAEQEGIHLRPDNIGHNPGLRQLAKDLLNSLWGKMAERPERDEVVYTNSARDFHELLMRPEQEVVSFTHLNDQLDRCVVRKREPFARAPEHNNLAVACFVTSHARLYLYDWLEEVRRVGGRSLYCDTDSVLYVKQRGAEGVREGNALGDMKRELPGRRIIDFFAAGPKNYGFQHVDACTGGDLKAERKVRSFELNYAADQQLQYERMRQLVINHFGVGQHHQQQQQRGPAADAADGSDGQEERTISVPCQRFVRNRQADIFTRRSTRVYRPVYTKGRVLRRGAAECVDEVPPQSIRTRPFGWSCCAGDVESPDSSVMNEEEEEEEPMQMAPDEADQGEEDRWGEHVWPEEIADDNDEPGPERKRARVEQCVAPPPPSPPPSPLREPHAEPEPVAGCSTWDQITRHTKHICRNNF

SEQ ID NO: 153887 - protein, 98 aa, Heterodera glycines
  Coding regions on vcDNA: vcDNA=SeqID_80310; Strand=+; Position=1-297
MNEEEEEEEPMQMAPDEADQGEEDRWGEHVWPEEIADDNDEPGPERKRARVEQCVAPPPPSPPPSPLREPHAEPEPVAGCSTWDQTTRHTKHICRNNF

SEQ ID NO: 153888 - protein, 413 aa, Heterodera glycines
  Coding regions on vcDNA: vcDNA=SeqID_80311; Strand=-; Position=1 -360,412-1068,1145-1369
  Homolog annotation: Hit_ID=BAC87890.1; Match level="QueryCoverage =34%, HitCoverage=75%, E-value=4e-13, Identity=33%"; Hit description =aspartic acid-rich protein aspolin2 [Theragra chalcogramma]
MDMFRFNVHNAVKDTDDAAADSAAHDQCQQRQQREVASPRTMPLLVEEQAHVSAAAEAAAEAASAVDQKMSAAPNDTPAITDTKIDFMTDEQTVAAAPPPLFSEIEPTQQQQQQQQKQQQGRTAEIIAPKVELSAEDNGDDDDDDDDEAGQQVKQEADRNGMDAHHSNCAKGPLLFIDEQENEEEESEEDEDISTTHRRQGMDSSFDYEDDDDDDDNDNDDDDDDDDDEMESVSGCAESDKCGHCHHPHQLPRNALEVLKMPLIDYLCALNHGCSVGELQALFLSKGARGRMLTHLQKRCLLRTVHLRPTERNITLHAHNFSARSASLTFACGGYLNLTVRQYFFAKHGVRLRHPSLPTLVEFGGGMHASYYPLECIQVHVAVTAPEDAASTTSTTTTTTTTASSTACVRLTN

SEQ ID NO: 153889 - protein, 265 aa, Heterodera glycines
  Coding regions on vcDNA: vcDNA=SeqID_80312; Strand=+; Position=1-798
MKQQQQQTKEQPLRHQQVPPVFKHPFTMCVSGCTGSGKTKWVLRMLANLDTLVGPAHISGVLYCYGEVNEDVLRLQQLETESGDEEENMGGQPRRRWVRPCHALPDEEAVKRAAKACGGRLLLVLDDLMVGMRAPFLDLLFTRGSHNWGVSVVLITQHLFTRELRIARNNAHYLVLLRNPAGALQVRTLGIQLFPGPGALHHFLEAYDDATADPFGYLLIDMHPTTRPLMRLKTHIYPGQLTVVYAPRVSAATVATTSMFNAEEH

SEQ ID NO: 153890 - protein, 349 aa, Heterodera glycines
  Coding regions on vcDNA: vcDNA=SeqID_80313; Strand=+; Position=1-1048
MKHTTRMLLVPEEMYRSLLSKAPGAAATDALDITPTTTTTPIEHVAKRMARVARTAQQTATRALMNDDERLIHYQQEYKRFKKLLADEQERPAPVRLNQLPNDPASKGVLRDALTEAAKTLQQQLPQQLQHSPPSLTKRRRRTTAVVPARAGVHSTPPVSPQPPAAAAAPQHPERRQDKDKSGITGQKGKRKRTTTASSYTSAASGAEKEEEQQQQPAAASTSSSTGAVVVAGAQRLGEAEQRRKQQALDYTSRHAGTLGIGDGQQVYKFMHGAYRPIKNSSLQAVLAYHFTSAQQPQQQHHRLKPPPGYQTFIANAKQHPQLSHLLFPTSSTSSISGEGHGGGGGGGG

SEQ ID NO: 153891 - protein, 107 aa, Heterodera glycines
  Coding regions on vcDNA: vcDNA=SeqID_80314; Strand=+; Position=1 -169,214-368
MKKSFYEQKKKEFIERFDEFKSLYSQGKQNEFVKELGISEFTFVKWKKELIPNYHKKHNTNEDKLKKMKQYFEIKERNPKMSDEIVAKKLGISQDTLRIWKKKFAST

SEQ ID NO: 153892 - protein, 122 aa, Heterodera glycines
  Coding regions on vcDNA: vcDNA=SeqID_80315; Strand=+; Position=1 -108,241-501
MARPRGGGRNPAKARGARAKRRIGNKRKAAAGTAANVQAADRRPICPICLKKMTGVRQVRTICDHVFHYVCFHRWLKYRLFCPVCERNFRTELYHAGNAVVEGAYADGHVVLRTDGEQSNSG

SEQ ID NO: 153893 - protein, 29 aa, Heterodera glycines
  Coding regions on vcDNA: vcDNA=SeqID_80316; Strand=-; Position=1-88
MPTPSRARVYADVNVNKPREYWDYECHQI

SEQ ID NO: 153894 - protein, 41 aa, Heterodera glycines
  Coding regions on vcDNA: vcDNA=SeqID_80317; Strand=+; Position=1 -70,136-191
MSADKSDELCQTVAEIRQGIDRKGRCLFNSMRRSVRAGKKR

SEQ ID NO: 153895 - protein, 119 aa, Heterodera glycines
  Coding regions on vcDNA: vcDNA=SeqID_80318; Strand=+; Position=1 -62,873-949,1075-1295
MTTIRCSRVHRTNCPNTPATLNVQLMASMPRFLISYWMSFSSSHGFRRPHPQGQDSVENSAHIGRVGQCPNSSVRGPATAGRGGGPDEQLHLDGQREFVLFRRTVPPHLHPKVAERDGQ

SEQ ID NO: 153896 - protein, 171 aa, Heterodera glycines
  Coding regions on vcDNA: vcDNA=SeqID_80319; Strand=+; Position=1 -74,337-393,435-497,563-818
  Homolog annotation: Hit_ID=AAK94490.1; Match level="QueryCoverage =87%, HitCoverage=12%, E-value=4e-57, Identity=78%"; Hit description =PAZ/Piwi domain protein [Heterodera glycines]
SVIFSFSNPFFPPGDFPLILLKPKFPPLVNYRRIGDPAYYPMEVCFVLDGQRVKSSQQNPEQIRPMEVCFVLDGQRVKSSQQNPEQIRMIKETAIPPTVLRVHNERVKESLQLVNNEYLTKASVHFDTTPLHVDYRVLGPSATLYRNNHRVPPATSNWEWRPGDPLKNAQI

SEQ ID NO: 153897 - protein, 258 aa, Heterodera glycines
  Coding regions on vcDNA: vcDNA=SeqID_80320; Strand=-; Position=1 -470,525-833
ERSLSLPIVNSVPTNNGAVIGKEEDSGKGGGAVSAQPEEEQPKKQQQNLTHSPTPQIRTKAQSQNNNKEQNQQRQHYHQQQQKQRVQAVPATQPQSQAAVTAADGADSGIGSDSPRTHTQPLSQHEIMPEMTSTSVQQADDIKERHSFENGRDTDEVPTLNRKMSPPPVPPKSRRNSSMDLDEMEPNDPMRSAYEDSTIGRDHSVLPPGARPTFGRKYSAQGTDRMPEGSSSDEKGATEGTTRKVCPMVQPELVAMGR

SEQ ID NO: 153898 - protein, 196 aa, Heterodera glycines
  Coding regions on vcDNA: vcDNA=SeqID_80321; Strand=+; Position=1 -72,130-219,279-368,425-505,563-793,1175-1201
  Homolog annotation: Hit_ID=EAL47359.1; Match level="QueryCoverage =96%, HitCoverage=32%, E-value=2e-10, Identity=26%"; Hit description =hypothetical protein 106.t00024 [Entamoeba histolytica HM-1:IMSS]
MHVGQQRLPLRDLPQFEDHPQNVPAVRVQPMQQMQQPVPMRAVPQFLHPPPNAPEIGVGPIHDGQQPLPLRALPQFAQPPPNVPAVRVQPVQQPIPLRDVPLFVNPPPNVPVIRVQPMPQPLPLRDMPQIHHPPRNVTSIWIKLWLLFLSLWVFLQGIHVRQIQREYAVPQFAHPPPNVPYHPPENVPKLDAKPNL

SEQ ID NO: 153899 - protein, 32 aa, Heterodera glycines
  Coding regions on vcDNA: vcDNA=SeqID_80322; Strand=-; Position=1 -86,210-222
MNGTITVGVGLVWRFSLRRCFSQGEGLVWRIL

SEQ ID NO: 153900 - protein, 193 aa, Heterodera glycines
  Coding regions on vcDNA: vcDNA=SeqID_80323; Strand=-; Position=1 -151,800-909,1059-1125,1386-1640
EFTIVTTDYNKVLKIADIGNASSSNPLNEEPLAQIVRWHWDQNGAPKIIETKTLNKGSEVNFAIFDDTSSFVIRILKKREKKSEEKRAFPAPSDSSPDDDLTVKIGEKQITNNIDKIGDFDQVAVSAHWLMTVSPVISRMMKEKQQRMITLDELGVDMDQFIAFLESIFYMTKIGPFLPNRNPLKNNYPLFMD

SEQ ID NO: 153901 - protein, 105 aa, Heterodera glycines
  Coding regions on vcDNA: vcDNA=SeqID_80324; Strand=-; Position=1 -99,181-267,356-472,780-794
MLGELELLLTPAAAVGEEDMAQQRNNNSGHNNQARISRVSGAIGGGGTAHTDSATFAMAQRNAPHMSDGRGGVAVDGRASRVDNLAGISVAQPPTIAAGNNRGCQ

SEQ ID NO: 153902 - protein, 143 aa, Heterodera glycines
  Coding regions on vcDNA: vcDNA=SeqID_80325; Strand=-; Position=1-430
  Homolog annotation: Hit_ID=CAA09789.1; Match level="QueryCoverage =94%, HitCoverage=83%, E-value=2e-13, Identity=27%"; Hit description =HASPB1 protein [Leishmania donovani]
MATRKRPRENGHAKTATRKRPRENGHAKMATRKRPRENGHAKMATRKWPRENGNAKMATRKRPRENGHAKMATRKWQRENGHAKTATRKRPRENGHARTATRKRPRENGNAKMATRKWQRENGHAKMATLKWPRENGHAIGGR

SEQ ID NO: 153903 - protein, 41 aa, Heterodera glycines
  Coding regions on vcDNA: vcDNA=SeqID_80326; Strand=+; Position=1-193
TKLRFFQLYNMDQQQKIKTKRNKVKLEHDGALYVFEQLSAD

SEQ ID NO: 153904 - protein, 414 aa, Heterodera glycines
  Coding regions on vcDNA: vcDNA=SeqID_80327; Strand=+; Position=1 -1105,1711-1850
  Homolog annotation: Hit_ID=NP_508324.1; Match level="QueryCoverage =87%, HitCoverage=14%, E-value=1e-43, Identity=27%"; Hit description =predicted CDS, peptidase family A16 and RNA-directed DNA polymerase and Integrase, catalytic domain and Z
MIFACDEVTNLVAGTNDCAVTQEGKIECSYDQTTQLSITPEHLTCLKLDNTKTNTTMETLQITIETLTIICTEKSDYFTRGYELSSTSQKRCSGAGKCTGQTCQSVKMSDRNPEVNDHANNQPGYSYCVPSCGGWHCQCFLATDGCLFYRTYAESVGDEIFEVVNCPSWTIQATIKLSINPELTYSVDLKPGILTHIGDESNSSISVTLTSTSIPPTPLFGSTFIIVREELKAAIVANGNLLKNILRCKNKEEAQSFSCTFPPEACQCHGGDSVVHCECEKSPLTEIFARQENLLPIKTQGSYVYFDSQIKAKIQQTTSLQMQVTLKGHKVKAIYDKNICNIVTISLEGCYSCTSGANWTLSCKTCPDEIGIVKGKRKSKQLMGKWQIQTDNTQKHILIKMRNCSVLWCKKNRI

SEQ ID NO: 153905 - protein, 55 aa, Heterodera glycines
  Coding regions on vcDNA: vcDNA=SeqID_80328; Strand=-; Position=1-182
HRQRAAKAGCSERRWAGAGKLRREPFVSNLKFPEKSTPLNTIFFAPKYATISHFN

SEQ ID NO: 153906 - protein, 71 aa, Heterodera glycines; identical to SEQ ID NO: 149698
  Coding regions on vcDNA: vcDNA=SeqID_80329; Strand=-; Position=1-217

SEQ ID NO: 153907 - protein, 108 aa, Heterodera glycines
  Coding regions on vcDNA: vcDNA=SeqID_80330; Strand=-; Position=1-327
MTSSCNGEFDVLTWQSGADRTGSTVRRMGTAGQTGRAAGTAGQMGTAEWTGTTGRTSTAGRTAGQMGTAGKARSRVVAPILVVATRNLRRTLRGEGDVKGMKWARRAE

SEQ ID NO: 153908 - protein, 2190 aa, Heterodera glycines
  Coding regions on vcDNA: vcDNA=SeqID_80331; Strand=+; Position=1 -569,656-6659
  Homolog annotation: Hit_ID=NP_508324.1; Match level="QueryCoverage =61%, HitCoverage=49%, E-value=1e-165, Identity=31%"; Hit description= predicted CDS, peptidase family A16 and RNA-directed DNA polymerase and Integrase, catalytic domain and
MNKEEWNNEWKVQKIFREKHDYLKTIKEIDEILDTLKDVNLEVKRRLKLLKAKSSSDSDPEDESNDYEHENEDEVEEQEEEKEYESDNEDESPELSLNDQIHHDRIPFVNYRSRIKLPPQTLTHFNGKFSQWPSFWDDFKSSVDNDPNLENIQKLKYLRGLLHDEPYRIVSPYPLTNKNYTIVIKLLKSRRFILLIDRIILQMKSQGEDINHPQIKQSIETKLPYNIRLKLKEKFKIYSTKEIMEFLNDHTQAREDIERMEESNRQIRNFPSNRPPQNGVQRQFYPNFPHNQMKPNPWNQQNTSSSPFPYTSAFTTNSNPVRLAQFKSNPTQTRTQNKIFCRFCERENHASKECKIYSTPEKRNERVRELKLCLNCLNKGHMVNDCKSTYLCFNCKYKHNTLLCTRKQTQYKTKEQKTRVNMAQNYENREETQTFMTMDYDKNLYNYEEEELLMTTEVNVINPDKPKIKKEIILFDNGSQKSYITEECAQTLQLSTIEEKLLAISTFNQNKPKIIKSRLVKVGIKTLKGEIEYLTLQTVEKITDVTKMVNKETVDVLGVKIPISHARPQILIGIDHYWHFMLPNSQIQLLPSGFYSINTKLGKILSGKGNIEDTNCNSVTEKRKRDETNQILQKFWELENIGIIDSPHMTDEDTAMIHFDKNVTFKNNIYHVRWPYKRENPNLPTNFGLCLGRLRNVVKQLIKNKNLENYDKILQEQMDTDVNEIAELKSNNLLHYLPHHPVIKESSNTTKIRPVFDASAKLKGNNSLNDEIHQGPKLLPDLCGMILRFRLKNYVLIGDLEKAFLRVGLNELDRDTTRFLWVNKSYLNEIKQKYREIEMRDIELRRFTRIPFGVNASPFLLTAVVNLHLSKIDEMFEKFKTLKVNGELCLNDKEEEFKNLCIELKQNAYVDNFVMMCDNEKEIKFKHYWSKQIFKLASMNLREFISNHEQSNKEIQKLEGSEIPKVTKMLGIKWNVDSDELDLQIKIPLMSKDTTKRQILTMIAKNFDPMGWISPVILKYKLFFQKLWRSNKDWDDKLDDQEIIEWNNISNTDIITIPRSPFTSQYLNHSILHIFSDASELAYATSAYLHTNDQVNLLFAKTRLTPLKGLTIPKLELLGLLIAARAAKFIKTESKLNLENTYIWSDSKCVLSWLKCKKNLPIFIKNRVEEIQQIALELHITFHYVKSADNPADLASRGATMSELKYNKLWWNGPKWLKLEKENWPPHSFYSPDQEEAPYLDNTEEIINTQINLIKNEYNGIIEWDKFSSWLKITRICQTLLKFIFFKLENSKKFKEKFIYSKFENALQLKIMAQKMLIRIIQREMEPNKEEERQLRIYLDNDMILKCEGQLKNAQIQGVNPIFLPRKHYGTHLIIMDYHTRNLHAGTMTTLSEIRKTYWIPKGRRIVDQIRRQCYHCRRYNAKPFQQPQMPPLPKSRVEITEPFQNIGLDYMGPIQIKNFNEKCWIILFTCFTTRGIHLELVTSLSVQHFLNAFRRFISRRGTPKHVWSDNAAQIKLASKILPEVLKLREILKDESIKSYFLNENINWTFSIELAPWQNGAIERLNQNVKTAMRKVIGKRFIEFDSFQTLTCEIEALVNSRPITFIYDEINSYQILRPIDFILPHKNLCIPPILENQETKDPTYYPKKTSYDQTIELWKKTTKLLDDYWKIWTDEYIPSLRERYKIENKNPRNCMKSFPELNEIVIIHDQTPRAMWKTGIVKNVITGSDGIVRGANIELPNKTVLNRPLKLIYPLEINSNDDKEQETLSNLIINQKPNYFNRKRKMDNPLVPIKMNRLFQNSLTIISLLTLISLCSSYSYECPKEPKIWKTRYTTLCIENGFTIRQNKITKEFCYKQLVCKDKHIIKRRPPYCGEKCKCPEGFKFCSFASYNKIKNESVEKINYQSIISFFKPNICAPNKTENCPIMKRKLFNSIVLHDNSIHIVKTLNLLFSQIDSINNFRCFGEGNLTIGTPIYCREHDCFKNNSFKQIYGTKFCFYDPYEKIYLVKSDEELIQIKAWGTIEKIFYLPNNLNQPFIENRRNKREENSSITEESTIECLKGGIIIKAINDIQELQISIENYTIIKKNPQKEEIIYLPPKLTSFEYKPVIKFISNPDKSNEKQITCQSSPVCELINCRFCMDYLKNPQCVDQIHWALMLVIIMIILCYFIKPPNYSNTHTFYPLDFTIYF

SEQ ID NO: 153909 - protein, 605 aa, Heterodera glycines
  Coding regions on vcDNA: vcDNA=SeqID_80332; Strand=-; Position=1 -375,422-729,780-1180,1228-1570,1619-2009
  Homolog annotation: Hit_ID=NP_001004509.1; Match level="QueryCoverage= 81%, HitCoverage=33%, E-value=1e-57, Identity=31%"; Hit description =si:busm1-180o5.3 [Danio rerio] emb|CAD60788.1| novel protein similar to DNA polymerases [Danio rerio]
MPHHPVSPQQPERREHQPNFIAAQVACPECIDNGSWRSRTTAGCRICGPHRTVAFCQRRFVDTHVDHQVVVADDNPLVAFVHWLVFELPMSYDTYAYSHFGGRFDMVLVFRELFRIGFNPEMLRRGNKMYEMKVRKQKRRNPNVVFRDSFNLMPCSLTALVPSYGLEVEDKPFFPHLSNRPENYGREIHPTPDDYMASGMMPSKRRQFDAWYAENRHHPFKLDEALASYCTNDVEILMAALVAFRREFFDISRRQEYVDGIDDRENHNGIDVLRECMTIAGACMRHFRTNHLPAEHLAIVPERGYDNAQNQSLLAFRFFHWYAEEHGAEVQTAHSAGGEKRIGQYSLDGWIEAEGCAIEVNGCTWHGCKKCYPNDNMLLPSGKTAGEVRERDAKRLEFLRRQVNRVDVHWECDIHRMLERSREMRKSFADYVDDGPLVIRDAFMGGRTGPLKLLRKAGPGEKISYYDFTSLYPYINFVTRYPIGHPKVHVLNRQVDWRNAADNPYPLALLKVWVVPPRRVDVPVLPVKVGERLCFPLCSTCAKENPTGGVNPNYHCEHNDRQRGWVSTCTSIELNTALDEGYIVTEGIPRAGVRAERRQTVPPVH

SEQ ID NO: 153910 - protein, 97 aa, Heterodera glycines
  Coding regions on vcDNA: vcDNA=SeqID_80333; Strand=+; Position=1 -97,255-451
MSSSETKLDEKSNEISNNELMGENNAKDGNVKEANNSTDKSAEAEVHTDEAQLGIAAVDPKPTDFSEKPTDIQKSGKPEEQQQQQVIDNISSTIIRC

SEQ ID NO: 153911 - protein, 43 aa, Heterodera glycines
  Coding regions on vcDNA: vcDNA=SeqID_80334; Strand=-; Position=1 -120,644-655
MSQTEKELLAEKVDRQPNEEAKPTASLNLFDLSVMPDSETFIK

SEQ ID NO: 153912 - protein, 199 aa, Heterodera glycines
  misc_feature (11)..(11): Xaa can be any naturally occurring amino acid
  Coding regions on vcDNA: vcDNA=SeqID_80335; Strand=+; Position=1 -51,428-575,666-923,970-1051
  Homolog annotation: Hit_ID=CAE59524.1; Match level="QueryCoverage =86%, HitCoverage=42%, E-value=1e-32, Identity=42%"; Hit description =Hypothetical protein CBG02919 [Caenorhabditis briggsae]
RQTLKAFIFSXKFAQNRVNFTDIDYEVFTEAALLAREGHSPYEQPEYRYTPLIAWLLVPNGQFADFGKLVFKLVFCATDVLVAFLHLLILESRQQNQRNPSSQNEGKTIHSSSVVFRHFGVLFWLFNPFTAIISARGNCDAIICALVLLALFLLIRGHWVVHAGATHFRIFPVSRGHWVVHAGATHFRIFPVSTHLLYF

SEQ ID NO: 153913 - protein, 31 aa, Heterodera glycines
  Coding regions on vcDNA: vcDNA=SeqID_80336; Strand=+; Position=1 -3,109-201
MRKKMNNRDHFELELSAESDHRSPDKSSKFQ

SEQ ID NO: 153914 - protein, 163 aa, Heterodera glycines
  Coding regions on vcDNA: vcDNA=SeqID_80337; Strand=+; Position=1 -219,746-882,1120-1203,1525-1576
MYEESLLGLGLELEHANATAIVKFLFPKFFFFFSTNYLIKNPNIKFVLIHAPFKVLMRQAELMMVRMPVHRNDEWNLTDGFVNACLKRLKFLDFDPRIKKRIEPETYFCQPFVAQHFECFVGYEHPETFFTRADRARMVHDLLIRARTEMLKSKHILGMGFLK

SEQ ID NO: 153915 - protein, 683 aa, Heterodera glycines
  misc_feature (670)..(670): Xaa can be any naturally occurring amino acid
  Coding regions on vcDNA: vcDNA=SeqID_80338; Strand=-; Position=1 -73,127-209,258-385,424-571,619-830,994-1139,1179-1231,1301-1433,1492- 1666,1735-1801,1843-1905,1970-2346
  Homolog annotation: Hit_ID=AAK94490.1; Match level="QueryCoverage =99%, HitCoverage=54%, E-value=0.0, Identity=76%"; Hit description =PAZ/Piwi domain protein [Heterodera glycines]
EIPRKPPQHGKREEMAQLLESRKVDQGATFVDQGATFVEPRKLPGTAGQKGRMQLITNAHILAHILKLLGTQAIYHYEVTINAVSSRSDRKCCVSEPSGPRDRDDFPLLNRRDKFPLLNRRDKCREVFSAFYRTMEQSLKDTGNLLYYDLSKTIFTLKKLQIESEGKFMFNIGTVPTAERPDAARYKSEGKFMFNIGTVPTAERPDAARYKHYEFIIRPATGFEVNDLSFITNDVSKMERSLEQFLDIATAQKANMDGKQFIGFSSSRVYLLAPTDYGFGANECPVFDSNHSFLGVGVNKGCRIVEGDQGPGQMTPAIVIQTKKDQGPGQMTPAIVIQTKKSAFHIPDMCILDKAKTLSAFHIPDMCILDKAKTLLFRENQGRFETGDFTQSDYEALCNGLVGIYAEPRYGTSGRIYAEPRYGTSGRFFRISDITKPNTGNGLNAENTFITHQVSGKISVKQYFEDTYRKTLQYPKAPLLVNYRRYPKAPLLVNYRRIGDPAYYPMEVCFVLDGQRVKSSQQNVCFVLDGQRVKSSQQNPEQIREMIKETAIPPTVLREMIKETAIPPTVLRVHNERVKESLQLVNNEYLTKASVHFDTTPLHVDYRVLGPPATLYRNNHRVTPATSNCEWRPGDALVNAQIGTWVAYAFGNPVGDSVRRLGLTETMWRXLALKFLISFRTKK

SEQ ID NO: 153916 - protein, 136 aa, Heterodera glycines
  Coding regions on vcDNA: vcDNA=SeqID_80339; Strand=+; Position=1 -72,188-351,376-411,448-633
  Homolog annotation: Hit_ID=CAE63953.1; Match level="QueryCoverage =52%, HitCoverage=15%, E-value=3e-10, Identity=50%"; Hit description =Hypothetical protein CBG08535 [Caenorhabditis briggsae]
SAKGQPTRQKQFAEVKTWHGGYISNFLNLFTERDKRTATKHSPYVQRYIDKVLALNRSLSQTTTPPAPTNPPWTTTTNPPRTTTTNPPRTTATITKTRSTIWSTKATTRPNAWTTTTTPMSRTMDYRTTTAAHYGN

SEQ ID NO: 153917 - protein, 485 aa, Heterodera glycines
  Coding regions on vcDNA: vcDNA=SeqID_80340; Strand=-; Position=1 -925,1042-1574
  Homolog annotation: Hit_ID=CAE66074.1; Match level="QueryCoverage =71%, HitCoverage=89%, E-value=4e-15, Identity=25%"; Hit description =Hypothetical protein CBG11288 [Caenorhabditis briggsae]
MPEPMELDQEPGTSTSTSSARPGTSTSQQVISSLMLISLLCLLFTSSAKGQPTRQKQFAEVKTWHGGYISNFLNLFTERDKRTATKHSPYVQRYIDKVLALNRSLSQTTTPPAPTNPPQTTTPPAPTNPPWTTTTNPPRTTTTNPPRTTTTNPPRTTATITKTRSTIWSTKATTRPNAWTTTTTPMSRTMDYRTTTVYRSRPQQRPRPGIKLIRWPKSPITTEEGRDVFWCSNHGSTLWELKGPENSPFCRPPPALTAQWTPLTITLYTKIHRPEPIATAWHCFIKTTKENYYTTSSAISSSKSTKNFLDFPGPITGLFKGKQTSSVTNCFAQPATLFVKWHSLQLLSPIHRADHCNYASEYCQLQNNSSLIWTSACPNDNCFMCDFQEAEEIHGEFTKLNGQTTAFWISDDRQKALTFTETHAVQACDGRQIVLSEQNFGIPKEQFDIIMSDHTRPKRNVQPEQLASQLSAAQLAQQWHSHSFT

SEQ ID NO: 153918 - protein, 305 aa, Heterodera glycines
  Coding regions on vcDNA: vcDNA=SeqID_80341; Strand=+; Position=1 -480,874-1311
MIGGAKILFSAFIFMINIEGIFSTYGDDLYADIWEKAFPKNSQNLMAKSKNGKKVGNAQKIIVKQKKTDERQIKLGEKNVKIEENEGGTTAAEEAKVRNVQKMLKIVKNEPIFDEKIQIDEKSGQNFQKIQTNLKFKQAKNWPIKNFEPKTEKYEEEFDKEYEESNRIKQANSKDKSKHSDHFDEKEILKIIKEFDKRREILKNKNIYNWKQLKLIEREIARELGTKFYRIRDWKREFGLVKRAKKEDKETKLALIEQFDRMKNERKMKKGYKNAEKVGIECEIAKELGTHRDKIYKWKSELLSG

SEQ ID NO: 153919 - protein, 513 aa, Heterodera glycines
  Coding regions on vcDNA: vcDNA=SeqID_80342; Strand=+; Position=1 -299,344-915,958-1117,1191-1249,1331-1461,1504-1824
  Homolog annotation: Hit_ID=NP_001004509.1; Match level="QueryCoverage= 85%, HitCoverage=31%, E-value=3e-54, Identity=31%"; Hit description =si:busm1-180o5.3 [Danio rerio] emb|CAD60788.1| novel protein similar to DNA polymerases [Danio rerio]
MLLPNGKSAGEVRERDAKRLEFLRNQIGRVDVYWECEIERMLAGDRGMRQMFSKYVDDGPLEIRAAFMGGRTGPLKLFRKARDGEKISYYDFTSLYPFINFTTRYPIGHPRVHVLNEEVEWTTSADNPYDLSLLKVWVIPPRNCDVPVLPVRVGERLCFPLCMKCASDHPTGGVDENYHCTHNDSQRGWVSTCTSLELNAALDEGYRVTKLFRVLEYQSSDDQLFKSYIAEFMALKIQASGFDTSIKGNPELEEAFVRECYEKFGITIDPIKMEPNKGKRSIAKLCLNNLWGRFSLRNFGLSQTLITDDPVVLAEYLDNRSLEVTAIDELDAEHILISYEKKKDNISLDNFGGSAGITKGNAEDTDSLILVHPLEVCPLQTGPHLGQFTDEYPNHEIEEFCSGGAKQYGLKLRRKAAPADAESEYVLKVRGMTLNYDVIQNQGLRYETFKEKVLRYGETGEPQPINITYPNFLRPSIKNGRVTSYPLHKIYKPFVGKGIVGADLSVLDFGHTL

SEQ ID NO: 153920 - protein, 206 aa, Heterodera glycines
  Coding regions on vcDNA: vcDNA=SeqID_80343; Strand=-; Position=1-621
MAWDYEWGDEYKSFTPSADKLILVFLSKMVLLSVFCAELLNCRVSQLRDRLNHPEDRTYILNSLKGRKVTTTYKDRNGMTKTFFIGGLSEKGAALTMAYGCLSRPFNINIAAHFYARHRIKLHHPYIVCIIERFSKGKEDRLYPMELLELTEDNPIWQRWSGPLFAERDPTPSHTSGRFENDDDDNDETLKDVGRNQCTQSPDLFW

SEQ ID NO: 153921 - protein, 237 aa, Heterodera glycines
  Coding regions on vcDNA: vcDNA=SeqID_80344; Strand=-; Position=1 -198,515-1027
MDAIELTSILMQNRRSAQIFRGCYASDQLPSPGTLEYPAALIVNRDPHNKKGSHWCAIYARGLEGPQISSFLSKMVFLSVFCAELLNCRVSQLRDRLNHPEDRTYILNSLKGRKVTTTYKDRNGMTKTFFIGGLSEKGAALTMAYGCLSRPFNINIAAHFYARHRIKLHHPYIVCVIERFSKGKEDRLYPMELLELTEDNPIWQRWSGPLFAERDPTPPRTSGRFENDVDDDETLKD

SEQ ID NO: 153922 - protein, 108 aa, Heterodera glycines
  Coding regions on vcDNA: vcDNA=SeqID_80345; Strand=-; Position=1-327
MIPKLSYSVAITFKIITKSSSFFNFDENVCVVGLDRTAITFPSTTEPYKRLLFEMGGQIEMLCLIMCFGVSVCWLLFSHSNCSFSPKWAIARAPASGPKSKASADRWK

SEQ ID NO: 153923 - protein, 184 aa, Heterodera glycines
  Coding regions on vcDNA: vcDNA=SeqID_80346; Strand=-; Position=1 -76,175-653
MSLYDDIGIESSTSVQVKEENLEKKADDFPTPNSAQKPQNVTVSAVSAVNKMNLSFLKSQLEAKKAILQNAAAAASQNVRQFLKLKNAFSFGQFCHLFGTFFSEISPRRCLRAAVTRHSSEYASAAEQEGRHVQAEATQSNSIAHRFDRRFHFGAEIAERRQSNRLEKGFRHFCYVLTTIFCIF

SEQ ID NO: 153924 - protein, 114 aa, Heterodera glycines
  Coding regions on vcDNA: vcDNA=SeqID_80347; Strand=+; Position=1 -152,333-363,454-615
MFEILKVAILSIFFTSIFAEYLYDSVRISEAQLSVKMKDKKDKSRPLGTVDVPLNEKLSKLIVDGANGRPIENLQQKFLRFSHSKSPEHEVFFVAKEHKESNGHYQLEMVQNFL

SEQ ID NO: 153925 - protein, 69 aa, Heterodera glycines
  Coding regions on vcDNA: vcDNA=SeqID_80348; Strand=-; Position=1 -59,286-436
MREMVIYRLGDGGLTASIVSFSPTKAKAETRTISKQRDNVTMCVGVVERQKSTAKMDKWAKICSQNMNK

SEQ ID NO: 153926 - protein, 36 aa, Heterodera glycines
  Coding regions on vcDNA: vcDNA=SeqID_80349; Strand=+; Position=1-113
WHSHFALLCAASALLKWRQNGKRTAWHSIHPTGPQK

SEQ ID NO: 153927 - protein, 788 aa, Heterodera glycines
  misc_feature (9)..(9): Xaa can be any naturally occurring amino acid
  Coding regions on vcDNA: vcDNA=SeqID_80350; Strand=+; Position=1 -36,3863-4924,4952-5107,5137-6174
  Homolog annotation: Hit_ID=NP_001004509.1; Match level="QueryCoverage= 100%, HitCoverage=52%, E-value=1e-101, Identity=29%"; Hit description= si:busm1-180o5.3 [Danio rerio] emb|CAD60788.1| novel protein similar to DNA polymerases [Danio rerio
LLFLLNRIXMIKFHDSYNVMPIKLSGLIKSFGLHIKDKQHFPHMFNKSSNYDKVLQHLPPREDYCPNQKKKADLQKFDDWYSNNLYQKFDLKEKLPEYCCNDVQILTHALVELRREFKQLTQRNGKHGESTFFDKMTIASACVKNYALNHLKPNSLAIVPEKGYTPQQQSALAIKFIDWYSHINNVNIQTAHSRYGEYVFKREGQIYQVDGYIKDGRRDKIIEVNGCLWHGCEECFDEMDDETKMPNGKTLREIREREEKKHEILSRYVDFIWEHEINEKLKKDTAMREFFDNWKDRSPIKIRDAFHGGRTGPMKLLHTAKPGQKISYKDFTSLYPWTNFSTDYPLGHPKIISVPPNEQTPYKGLLKVLLLPPYKGLLKVLLLPPNNISVTVMPVKFDQRLLFPLCEKCAKYITNKYPNGLKDNDRAFVSTCTHLELNAALEAGYTVRKVFHVNDRAFVSTCTHLELNAALEAGYTVRKVFHVLQYDQWSNNVFKSYVSEMMALKIHATGFPSWCESEEEKSEYIEECWMKFGIHLEKEKMKAEPGKRYIAKLCLNSLWGRFSMRNLLSKAVINNDPFVLRQYTDDKKIDIMDIELMDDDVFMLTYKPKEEFVDENKYSNVVISLYTTSMARLYLYEVLKKVADKILYFDTDSIIYVHPEANDPLPTGKGHLGELTDEKPDHNILEFISAGCKNYGLKLAMGKLSMKIRGITLDEQTVQTIHYDSVKDQILRYGSDDPADPIIVTYPHFIRPNLIQGKVYTQSLTKHYQPVFTKGIINDSFQVLEFGY

SEQ ID NO: 153928 - protein, 27 aa, Heterodera glycines
  Coding regions on vcDNA: vcDNA=SeqID_80351; Strand=-; Position=1 -67,674-690
MAINSKISEKECNFLGSDKPFLNLHIV

SEQ ID NO: 153929 - protein, 81 aa, Heterodera glycines
  Coding regions on vcDNA: vcDNA=SeqID_80352; Strand=+; Position=1 -107,365-442,535-594
MPASVDSGNPPKPKLKDYQKQQLKDEGEKEAEEKKDSKEDYEQKEQQLKKTEEKQVEEESDGKMTVPTDEHTTRRRREESE

SEQ ID NO: 153930 - protein, 45 aa, Heterodera glycines
  Coding regions on vcDNA: vcDNA=SeqID_80353; Strand=+; Position=1 -63,302-376
MNTVRPCSIFTTLHTSRNYTLLDFVCIFSSKLFFNMIFWIYKFLN

SEQ ID NO: 153931 - protein, 119 aa, Heterodera glycines
  Coding regions on vcDNA: vcDNA=SeqID_80354; Strand=+; Position=1-372
TQQCGNSCPLFLSAPQFLFSLFFSLWQQQRAPAGHINYFSTSFSLSTQTTLDLTTYTHRTFTLFRTDQPPHLLHCFSTSHFSVTTDSKTRHTVGMVGNARHCPRPGGWGNGVSEHERDR

SEQ ID NO: 153932 - protein, 178 aa, Heterodera glycines
  Coding regions on vcDNA: vcDNA=SeqID_80355; Strand=+; Position=1 -183,459-699,1204-1316
  Homolog annotation: Hit_ID=NP_872129.1; Match level="QueryCoverage =80%, HitCoverage=33%, E-value=8e-20, Identity=38%"; Hit description =aspartic protease (46.6 kD) (asp-2) [Caenorhabditis elegans] gb|AAO25990.1| Aspartyl protease protein 2,
MTPAAQFPGFRHAETEVPPSCQNLSKFDSQKSASYQETNMTFSIEYGLGFAAGLIGQDLVQFASDSNETDGLRVCQAYFGQANQKDTQTPTFNGILGLALNTIKQNVDPLFIQAYKQGLFKKPLFSLYLATQGAANGTLGGVLTLGDVDDQNCAPITDWIPITPNRFGLWEFHIDVRS

SEQ ID NO: 153933 - protein, 309 aa, Heterodera glycines
  misc_feature (15)..(15): Xaa can be any naturally occurring amino acid
  Coding regions on vcDNA: vcDNA=SeqID_80356; Strand=-; Position=1 -842,3290-3404
  Homolog annotation: Hit_ID=DAA04499.1; Match level="QueryCoverage =99%, HitCoverage=23%, E-value=2e-48, Identity=40%"; Hit description =TPA: pol polyprotein [Schistosoma mansoni]
LISGYWQIKDDGQEXTAFVTEFGLHEFVMPFGFCNAVATFQRFMTHLFGDKLNDSFLYIDDVLVAYETFEQHLEHLKFVFEDINEAGLKLKVAKCQFSIEELQFLGHVLTRSGIKMDESKTILDMPMLKSKKELHSFLGFMTYYRMSMAAPLFKLLKKDVSFKMDNAEIAAISKLKGKILSYVVLYFSDFKAAMGKFLIMTDASKTGISAVLCQPDQQNRIRPIFASRQCNKHESRYSTTELEALAVRFGVKKFAQYITMIPTRVLTDHKALQWGRSEKGFQKTRKRVNMKLLKFATSTYRPGRTKENV

SEQ ID NO: 153934 - protein, 111 aa, Heterodera glycines
  Coding regions on vcDNA: vcDNA=SeqID_80357; Strand=-; Position=1 -69,122-237,296-449
  Homolog annotation: Hit_ID=CAE67202.1; Match level="QueryCoverage =90%, HitCoverage=15%, E-value=2e-25, Identity=56%"; Hit description =Hypothetical protein CBG12638 [Caenorhabditis briggsae]
MCKESEEPFKFIPVCCYEDAQAIRAVAFHPSGGYFAIGTNSRNLLICRYQSYERRTSLNDDFLHGFVPPPTILMSRSKHHRGSVYCAAFNQTGNLLATGSNDKTIKLMAMQ

SEQ ID NO: 153935 - protein, 211 aa, Heterodera glycines
  Coding regions on vcDNA: vcDNA=SeqID_80358; Strand=+; Position=1 -18,436-567,940-1256,2376-2544
MGNDDEAESSSSSSNGTPRDNHYDNDHKPLIKAEIAADLFVLLNLKTQLQMDYMTNESTTMELVNEFNKKYANFVMELPDNLMTKGKFEKTLHKINEKLEQIQFKNEIDIVANNLLIMVKLENKFKNGIEQIECGENVYEVVQYHLERVNSELYRRLDHNVMSHEKISLIYLHACALRLTTELGILINELEEIGTEWTSADAIDDAVEVGC

SEQ ID NO: 153936 - protein, 88 aa, Heterodera glycines
  Coding regions on vcDNA: vcDNA=SeqID_80359; Strand=+; Position=1 -108,244-402
MELSKNDQTMRSNVVQHEGPAMESVAYESDNEILRQSSTFLKMPVPGPGPGFHVGPGPGFPGQKSRSRKPGYSGPGFFETNFKNQKKV

SEQ ID NO: 153937 - protein, 153 aa, Heterodera glycines
  Coding regions on vcDNA: vcDNA=SeqID_80360; Strand=-; Position=1 -176,890-1177
  Homolog annotation: Hit_ID=CAG11829.1; Match level="QueryCoverage =65%, HitCoverage=19%, E-value=3e-14, Identity=43%"; Hit description =unnamed protein product [Tetraodon nigroviridis]
AIYQKFGQTTEEELFSNDSSNCAAFDEFLSVIGHRVQLRHFDGYRGGLDTVHGQTGTEERTRASLLDGLYSNLKERAQFYGMAFLDSVDSATKQQQQEKHHHQWQNNGQKPSPAQPTAATDERRNEPNVLFSIGTALVLMLLLFNDQKSKTHF

SEQ ID NO: 153938 - protein, 283 aa, Heterodera glycines
  misc_feature (277)..(277): Xaa can be any naturally occurring amino acid
  Coding regions on vcDNA: vcDNA=SeqID_80361; Strand=-; Position=1 -127,175-336,418-760,1065-1262
  Homolog annotation: Hit_ID=CAE73668.1; Match level="QueryCoverage =94%, HitCoverage=60%, E-value=3e-49, Identity=42%"; Hit description =Hypothetical protein CBG21177 [Caenorhabditis briggsae]
KSLQPLFIICGCTGTGKSDLGIELAKHFNGEVINADSMQIYKGLDIATNLDIATNKVTTEEMQGVTHHLMSFCDPCSNYNVHHYRNAVLPLIERLWANGKLLNKQQNKQQFFLLVGGTGYYMEAAIYYDNLVQTTPKNQVFNNILMIQIVAISDDLRNELSKISHLRLIHEELKRVDPISAGEVHKNAKFKVLRALEIFYSTGQTKSEHHKMQREGQGIHLAGRLHTKSTLLFTLDADKEVLSQRLNSRVDDMLKRLIEELDSFYIEVNQQILRNWXQKIIKC

SEQ ID NO: 153939 - protein, 55 aa, Heterodera glycines
  Coding regions on vcDNA: vcDNA=SeqID_80362; Strand=+; Position=1 -164,383-386
MPKNMYYGCAALKVVVLDAACARPPPCFSYAAPPTAVAFLFQHVTGVGHLHNKRR

SEQ ID NO: 153940 - protein, 257 aa, Heterodera glycines
  Coding regions on vcDNA: vcDNA=SeqID_80363; Strand=-; Position=1 -70,195-808,841-930
MAPSLKLLIQFAILIAAASHAILVDSDLMSQGQSQSRAWRTSIPETKGQNGSETEDEQAVYESDASRITIPETKDQSGTETEDEQAVYESEEIRTSIPETNGQSGTETEADRPNNRKTDLATNGQSAAKTNPVAKQIWEELFLVRGKRQALDPFTGVAIEIGKGAGNALQYMHGKIVDGIAVVVKKAACKGIQKLCSSCGYGACIEHPGYTADAICCSNNFELKCCEKLVMAQIQKGLKNGQKFTKIKNPAKIVLFC

SEQ ID NO: 153941 - protein, 302 aa, Heterodera glycines
  Coding regions on vcDNA: vcDNA=SeqID_80364; Strand=-; Position=1 -108,231-339,391-1080
  Homolog annotation: Hit_ID=AAM98028.1; Match level="QueryCoverage =93%, HitCoverage=14%, E-value=2e-39, Identity=37%"; Hit description =Inositol triphosphate receptor protein 1, isoform g [Caenorhabditis elegans]
MVDEYLEGIRRRARPGEPVLRERAENAHENRLTFEIALAHFGFYDFQELLKLSQNLLVIVDSCSGREQQRSFNKNTDRAEGTRSKLIRQLTKKFSQQLAYDRASTADPPPLLQSLSISTHHPLLKRTSATGKDFRAETEAAESLACAKMSREMVLQTKLLVAELLQFIMDIRRDFRITTALAFFKRHFPCGDSGELSASAPQIDEQLVQRMCRAVFRWQNGDSFELDMDREHGQQLLRILLQMTMSDFVPLTSLSLQILFRHFTQFQELVEDMGQVWRNVNVNANFECLMKGATAGVQQGSA

SEQ ID NO: 153942 - protein, 160 aa, Heterodera glycines
  Coding regions on vcDNA: vcDNA=SeqID_80365; Strand=+; Position=1 -291,451-642
MQWIKFNCTLCPIGLHCFYPRKYAKPVLCAHPSVRNITDFLSTGQLEEAATTATTTTPFPTTAVVSAAAAECAPPPAQLTAWIAVCTALLALLVIAEQIVINNLYRNERRSSEPPAGKRTDSADLAGYVGRRFSAPDGRQFDCGPRENPRKNIKMVTSKS

SEQ ID NO: 153943 - protein, 857 aa, Heterodera glycines
  Coding regions on vcDNA: vcDNA=SeqID_80366; Strand=+; Position=1 -54,90-2608
  Homolog annotation: Hit_ID=NP_507780.1; Match level="QueryCoverage =95%, HitCoverage=53%, E-value=2e-77, Identity=27%"; Hit description =predicted CDS, DNA polymerase type B, organellar and viral family member (5T899) [Caenorhabditis elegans]
MQKYTFIKCKGCGTSNIPMSPITKSDITDYQFPILLYHNNNHFDGIKTLSKFFNKKNYCLSCESPYYKKIEHSLKCTSLCHGCREVGVDYPCEPQQGYSKKCEHCNNTFYNNSCYERHLHKDLCTKFQRCEDCGVIYNIKVHGSVGHKCGEQFCKLCKQFHIKEDDDDGMNPCTKCFIQPLKQQRIKSYRIIAYDFEATQDKKVGNRFEHEVNFAAATIICTDCIINSYWNKSLQGKKCQICGPHRSITFSPFDYTETTVDQKIITQQPLREFVHWLLFDHNKKFPTVAFAHFGGRYDMTMIIKEVLAQGIHNPDIIKQGNRLYELKIRENEHGPLTIFHDSYNLMPIKLSGLIKSFGLHIKDKQHFPHMFNKSSNYDKVLQHLPPREDYCPNQKKKADLQKFDDWYSNNYEQCFDLKEKLPEYCCNDVQILTHALVELRREFKQLTQRNGKHGGIDILWQAMTIASACVKNYALNHLKPNSLAIVPEKGYTPQQNQSALAIKFLDWYSHINNVNIQTAHSRYGEYVFKREGQVYQVDGYIKGTNGKRDKIIEVNGCLWHGCEECFDDLDDETRMPNGKTLREIREREEKKHEILSRYVDLEVIWEHEINEKLKKDTAMREFFDNWKDRSPIKIRDAFHGGRTGPMKLLHTAKPGQKISYKDFTSLYPWTNFSTDYPLGHPKIISIPPNEQTVNWSSPSDNPYKGLLKVLLLPPNNNINVTVMPIKFDQRLLFPLCEKCAKYITAKYPNGLKDNDYSCPHFNPNDRAFVSTCTHLELNAALEAGYTVRKVFHVLQYDQWSNNVFKSYVSEMMALKIHATGFPSWCSSEEEKSEYIEECWMKFGIHLEKEKMKAEPGK

SEQ ID NO: 153944 - protein, 196 aa, Heterodera glycines
  Coding regions on vcDNA: vcDNA=SeqID_80367; Strand=-; Position=1-593
FQSLGLNPPAFQSLGLNPPAFQSLALNPPAFQSLALNSPAFQSLGQPTNISITGTQPTSISITGTQPTNISITGLNPPTFQSRDSTHQHFNHWDSTHQHFNHWHSILLHFNHWDNPPTFQSLGLNPPAFQLPGLNPPAFQSSGLNPPAFQSLGLNPPAFQSFNIRITGTQSHQLFGITIIRTQYHYFKFFPNTFLS

SEQ ID NO: 153945 - protein, 98 aa, Heterodera glycines
  Coding regions on vcDNA: vcDNA=SeqID_80368; Strand=+; Position=1 -117,298-477
MPFGHWLPQGMAFPRPIGRSSAPFVGLGCRQRAVSALPLHWHNWGETRRYIIGKSCFRRGHSATWYKLAEIGRTSHFERKDFQFSAFLERILIVFVVN

SEQ ID NO: 153946 - protein, 86 aa, Heterodera glycines
  Coding regions on vcDNA: vcDNA=SeqID_80369; Strand=-; Position=1 -139,343-464
MPKAAKSNAVLNRHWISKFPEGTYSTDGKINPGLYKLIDIAKILIGALVICEYFLLCHSFISALVKFVDKKEMTNMNSTFTVRYMQ

SEQ ID NO: 153947 - protein, 236 aa, Heterodera glycines
  Coding regions on vcDNA: vcDNA=SeqID_80370; Strand=+; Position=1 -272,445-883
MDVFNRLLPRPGNGNVQFKKLRHTSNSASIFASDEATGDKQHNDETTNNGMMPATNSPRVELGLMLSNISAEMRHGQNSATEGNGKANGTGKQNKSFVEEKANGNGPSSEVTALSKGKSNGTAKGGGKRFLSALLPGKRKGRLGLSVSEPRLNFDIEPSKNDFEFGIYSESTFHSFFFKTHGNRRGRKCERRTNCGPSTEFWGEEPIMRWHFGRKSQKSAEFCRGTSKGGILENTL

SEQ ID NO: 153948 - protein, 74 aa, Heterodera glycines
  Coding regions on vcDNA: vcDNA=SeqID_80371; Strand=-; Position=1 -218,1108-1114
MPIEPFELVNEVTNEKLTLTKDENGTGEFNWLLERCPIIGETAAAVQKQQQKKDENSDANLNKVFFRLYDDIGI

SEQ ID NO: 153949 - protein, 20 aa, Heterodera glycines
  Coding regions on vcDNA: vcDNA=SeqID_80372; Strand=-; Position=1-59
YRICSNYGPVSINTAVSNYP

SEQ ID NO: 153950 - protein, 78 aa, Heterodera glycines
  Coding regions on vcDNA: vcDNA=SeqID_80373; Strand=-; Position=1 -11,74-299
MNRRWLCSDVWMDIMPSFDHAQLGLKMALLSDRFDVLVDKHFDGKSELTIWRTITIRKDEGPKAKLSVLIDSVPRWNC

SEQ ID NO: 153951 - protein, 35 aa, Heterodera glycines
  Coding regions on vcDNA: vcDNA=SeqID_80374; Strand=-; Position=1 -4,281-384
MDEQIENVMLLNNTKFLIWFTLTQLMTSFLLKISI

SEQ ID NO: 153952 - protein, 150 aa, Heterodera glycines
  Coding regions on vcDNA: vcDNA=SeqID_80375; Strand=-; Position=1-450
MIAIFFVHLFFIGIQGTEEDLFADLWKNLIPMKQQKLAKNYERNLKRENWIHQNIRNADKNLLKTSLKAEDVSSERQNEEDIKPKILEEIKKETFSDEEQNAMNVRTKLKFPKKEIYDEMISDGIDEKQAGDQSNSCSSKTDDLGHSSDS

SEQ ID NO: 153953 - protein, 37 aa, Heterodera glycines
  Coding regions on vcDNA: vcDNA=SeqID_80376; Strand=-; Position=1 -68,708-755
LNEIVPEGPEMNDDYNEEEGKAILLRDWDSKNQETSQ

SEQ ID NO: 153954 - protein, 191 aa, Heterodera glycines
  Coding regions on vcDNA: vcDNA=SeqID_80377; Strand=+; Position=1 -192,521-904
MKCPSNDKFYPIYEPLVSRFSTQEGDRAELCTEELPADEECPEGFQIGISMLNGQKEDFTWQTWGAFWVNNIKFGENNVMYKKVEFGVHFKLDISPKLNESSNIVYRVNVYCADNGNLEFKTFTKSETDVVFSSNYKTYEQIGAEYVPSSSEGKKCKKYQVKVWPSNEKRLSYIKEKQEVGNAVTNSICYT

SEQ ID NO: 153955 - protein, 109 aa, Heterodera glycines
  Coding regions on vcDNA: vcDNA=SeqID_80378; Strand=+; Position=1 -51,113-388
MKNFGLCNYLLKKAPLVLLEPEFVASGVITNGKLYNNVKFPVHFNLIIEPSLDHEAEPIYYVKVKCNGKESNTFKTFTHGNTKVVLNVKGCTKFDISVSKMDRESESPE

SEQ ID NO: 153956 - protein, 405 aa, Heterodera glycines
  Coding regions on vcDNA: vcDNA=SeqID_80379; Strand=+; Position=1 -76,121-516,688-917,979-1047,1094-1438,1548-1649
  Homolog annotation: Hit_ID=CAB51072.1; Match level="QueryCoverage =46%, HitCoverage=5%, E-value=2e-21, Identity=37%"; Hit description =hypothetical protein [Homo sapiens]
MPSISAAMIAAASASTQFPPATLSKWHSIVTPPSSLAQGGALEEFLRHGLLAPQASSFAPSSGRGAESVGTSAMAAPTSFDELFQPKMSNTSSSPRTFPLNQPQMHQQILANVPQRNATGTNISHQQQVERINCSTGTTPGICLTMRGCRKTKQSISANATTNSAKSGSSTTDAATAPNSATSIGPQQPHFVHTNVPLQPSPQHILPIAEPQQHQEQVQQLAQQKMVKKQSSANKYPVLWQGQLAMKNADTLVQMLKVCGNESLVQQMNAELSSVNENGIPLLRINQRMRLEHTHLESENSYQNGIGLKKPNCPLLLDLIRKMEREDNQLALICVPCGRDREDVVIQTQKMNISFIEYFSSKSAAGIVSSGPSDAPVAKCAEPFEDGGESQRGIPLCDTNQQIEH

SEQ ID NO: 153957 - protein, 35 aa, Heterodera glycines
  Coding regions on vcDNA: vcDNA=SeqID_80380; Strand=+; Position=1-106
DEKLIAFFCLHSKQSTEIFFNAFKKTDLPNWVAHK

SEQ ID NO: 153958 - protein, 25 aa, Heterodera glycines
  Coding regions on vcDNA: vcDNA=SeqID_80381; Strand=+; Position=1-77
SKSSLTTAQKNMFFVRFRPRGSQEK

SEQ ID NO: 153959 - protein, 114 aa, Heterodera glycines
  Coding regions on vcDNA: vcDNA=SeqID_80382; Strand=-; Position=1 -101,181-424
MAFERIRHGGDNTREAGRTNKTDAGRASTRDGPSFANFAFRISLFIFQFGPSLASTALPSNMMPYVGTILNAKFIYSKQISIKVQESNDYYAIISRLAKLPFKMDNTAYASARL

SEQ ID NO: 153960 - protein, 25 aa, Heterodera glycines
  Coding regions on vcDNA: vcDNA=SeqID_80383; Strand=+; Position=1-76
SKSSLTTAQKNMFFVRFRPRGSQEK

SEQ ID NO: 153961 - protein, 34 aa, Heterodera glycines
  Coding regions on vcDNA: vcDNA=SeqID_80384; Strand=+; Position=1 -3,621-722
MVPDFRHVAVTDQIQTKRSVWQVPVAPLGIVATV

SEQ ID NO: 153962 - protein, 88 aa, Heterodera glycines
  Coding regions on vcDNA: vcDNA=SeqID_80385; Strand=+; Position=1 -139,193-320
MNTTAAVPMAQNFRLFCHQTPPSVNSDGSEAKRRQINEPPKEGSGGAPSLSVDPFGWEPTKWERFFLVLTRCYERSADIPAIIPLVVQ

SEQ ID NO: 153963 - protein, 65 aa, Heterodera glycines
  Coding regions on vcDNA: vcDNA=SeqID_80386; Strand=+; Position=1 -76,439-560
MKTIALFALLPLIEILLIAMVNQCLCIDCRSGYFFGNGYGRTESMECAGGKDCFAAKCHNGSFLY

SEQ ID NO: 153964 - protein, 57 aa, Heterodera glycines
  Coding regions on vcDNA: vcDNA=SeqID_80387; Strand=+; Position=1 -43,152-282
MLKPNLWARSINGTSVFLKQIKSFSDESIPTGDSIALLPSLLPIVIMALFGHFVKTH

SEQ ID NO: 153965 - protein, 24 aa, Heterodera glycines
  Coding regions on vcDNA: vcDNA=SeqID_80388; Strand=-; Position=1 -39,90-125
MCMFPYFGIFPKKIKMGFILSNII

SEQ ID NO: 153966 - protein, 75 aa, Heterodera glycines
  Coding regions on vcDNA: vcDNA=SeqID_80389; Strand=-; Position=1 -54,518-691
MSDHSSDDSSGAEGGDIQVTTFMADVVCSLPTVPIEGEQKMSYYTVLLYFGNNNNDCRHWVSTIVSLNGYIKIRC

SEQ ID NO: 153967 - protein, 32 aa, Heterodera glycines
  Coding regions on vcDNA: vcDNA=SeqID_80390; Strand=-; Position=1 -3,944-1039
MPLDLLALDKECKVWSSVSVKNVCPRDLPNIN

SEQ ID NO: 153968 - protein, 129 aa, Heterodera glycines
  Coding regions on vcDNA: vcDNA=SeqID_80391; Strand=+; Position=1 -40,344-416,746-839,960-1094,1222-1269
MSTNEFMLQKFKTIAGDNLSTTRIEKELHKLRIGPEQGCWLKTAIEGNEWLRAELLRFADFARQDLLKTTLIATQCANITNNGNMTEIEKEMKAIETLLGEISHHMADWIEEKLRWNSMVLMVMFMDKC

SEQ ID NO: 153969 - protein, 226 aa, Heterodera glycines
  Coding regions on vcDNA: vcDNA=SeqID_80392; Strand=-; Position=1 -176,482-574,625-702,915-975,1083-1216,1628-1768
PSFAVNFAVSAAPKKANESGQAINLRQLRSHADIEVDDEEEEKKNRRPDGRRRKVPKVPRRCDKCPMEFDEVWKLERHYSTHSDFKQFKCELCPHRTHQKAYLKRHMSLHRYGEKCRFCGAPIVPQWFKHHEKTCAAGTNAGAADGGGGTLRRHQSPPPPAHPSPALPPPLLDHQRDQHEALLNFRQNYCDANACHEKLEIIGDQKMTVRYKGNEKGILSKLLSKI

SEQ ID NO: 153970 - protein, 192 aa, Heterodera glycines
  Coding regions on vcDNA: vcDNA=SeqID_80393; Strand=+; Position=1 -48,591-1121
MENNKSIALSLSAVYEFFNVINPLPGVVESPATAAETTTPFVDLRCERRGPVPSTVAAAIVVPLSSSAIGIAAESAVGSGAASSTYDGSAAEENRDGRRHTGAVVVVTALEETVHDEKLPEEWAADATLKQFNLNNFLNRKKCLKMSFNEKKEENSVFKMKEHCRFSMSKINFSSALKLHEGQQNKTKKVVK

SEQ ID NO: 153971 - protein, 185 aa, Heterodera glycines
  Coding regions on vcDNA: vcDNA=SeqID_80394; Strand=-; Position=1 -239,291-606
  Homolog annotation: Hit_ID=NP_499994.1; Match level="QueryCoverage =71%, HitCoverage=24%, E-value=6e-22, Identity=40%"; Hit description =predicted CDS, mitochondrial ribosomal protein L46 like (4B557) [Caenorhabditis elegans]
MFVKTFSRSVRNSTRFFYSTNTKLDPSKWRIEVALLIYRPPVVAPPMTEVEEQFYRMSEFANQKSSYKCDFELQLEKDEKLLEKRRQLENEGRDLSALDEEINVSSAQLRDDWFEKSEQLTKQYKLDSPQTTTDEDKNLKTFGRMQQKKLALLVKQRFPDALNSDYVSPWILPQLIRTGDDTLRQ

SEQ ID NO: 153972 - protein, 193 aa, Heterodera glycines
  Coding regions on vcDNA: vcDNA=SeqID_80395; Strand=+; Position=1-582
MSGQLRAKIPLLNRVLIKEIQKIKSKIEEGNFEYDKNNFDDCSRIFNKTKEIIQRIEPNFEKLKILHQKWQNLMRQMNKTEWNSEWKLQKIFREKHNYLKTIKEIDEILDTIKDINLEVKRRLKALKPNSPSESDQENESIDESKKTMMKKPEKKKMKMKKNMIVIKRTNHKKCIQVIKHIVIAYHLFINDQE

SEQ ID NO: 153973 - protein, 1480 aa, Heterodera glycines
  Coding regions on vcDNA: vcDNA=SeqID_80396; Strand=+; Position=1 -4425,4578-4595
  Homolog annotation: Hit_ID=NP_508324.1; Match level="QueryCoverage =84%, HitCoverage=47%, E-value=1e-162, Identity=31%"; Hit description= predicted CDS, peptidase family A16 and RNA-directed DNA polymerase and Integrase, catalytic domain and
MERMEDSNRQIRNFPSNRPNPNKIQRQPYQNFSQNKPKFNQRNQYQTPITPFPYTSALTTKSKPLHPAQIKPIPTQTKTQYKIFCRFCERENHTSKECKIYSTPEKRNERVRELKLCLNCLNKGHMVNECKSTYLCYNCKHKHNTLLCTRKQTQYKTKEQKTRVNMAQNYENHEETQTFMTMEGDKNLPNSDEEELLMTTEVNCINPNKYKVKREIILFDNGSQKSYITEECAQTLQLSTIEEKLLAISTFNQNKPKIIKSRLVKVGIKTLKGEIEYITLQTVEKITDVTKMVNKETVDVLGVKIPISHARPQILIGIDYYWHFMLPNSQIQLLPSGFYSINTKLGKILSGKGTIEDTNCNSVTEKRKKDETNQILQKFWELENIGIIDSPHMTDEDAAMIHFDKNVTFKNNRYHVRWPYKRENPNLPTNFGLCMGRLRNVVKQLIKNKQLENYDRILQEQMDTDVNEIAEFKSNNLLHYLPHHPVIKESSNTTKIRPVFDASAKLKGNNSLNDEIHQGPKLLPDLCGMILRFRLKNYVLIGDLEKAFLRVGLNELDRDTTRFLWVNKSYLNEIRQNYREIEMRDIELRRFTRIPFGVNASPFLLTAVVNLHLSKINEMFEKFKTIQVNKELCLNDKEEEFKNLCIELKQNAYVDNFVMMCDDEKEIQFKHYWSKEIFKLASMNLREFVSNHEQSNKEIQKLEGSEIPKVTKMLGIKWNVDSDELELQIKIPLMSKDTTKRQILTMIAKNFDPMGWISPVILKYKLFFQKLWRSNKDWDDKLDDQEIIEWNNISNTEMIAIPRSPFTSQYLNHSILHIFADASELAYATSAYLHTNDQINLLFAKTRLTPLKGLTIPKLELLGLLIAARAAKFIKRESKLNLENTYIWSDSKCVLSWLKCKRNLPIFIKNRVEEIKQIALELHITFHYVKSADNPADLASRGATMSELKHNKLWWNGPKWLKLKKENWPPHSFYSPDQEEAPYLDNTEEIINTQINLIKNEYKGIIEWDKFSSWLKITRICQTLLKFIFFKLQNSKKFKEKFICSKFENALQLKIMAQKMLIRIIQREMEPNKEEERQLRIYLDNDMILKCEGRLKNAQIQGVNPIFLPRKHYGTHLIIMDYHTRNLHAGTMTTLSEIRKTYWIPKGRRIVDQIRRQCYHCRRYNAKPFQQPQMPPLPKSRVEITEPFQNVGLDYMGPIQIKNFNEKCWIILFTCFTTRGIHLELVTSLSVQHFLNAFRRFISRRGTPKHVWSDNAAQIKLASKILPEVLKLREILKHESIKSYFLNENINWTFSIELAPWQNGAIERLNQNVKTAMRKVIGKRFIEFDSFQTLTCEIEALVNSRPITFIYDEINSYQILRPIDFILPHKNLCIPPILENQETKDPTYYPKKTSFDQTIELWKKTTKLLDDYWKIWTDEYIPSLRERYKIENKNPRNCMKSFPELNDIVIIHDQTPRAMWKTGIVKNVITGSDGIKKEDG

SEQ ID NO: 153974 - protein, 90 aa, Heterodera glycines
  Coding regions on vcDNA: vcDNA=SeqID_80397; Strand=-; Position=1-273
MPTATPWRTNVLLWGAEGRFGSAVVVAVVGTVVVVVVVHLTVVITTDVFRDDCQRFARQQMPTTEWTRPALARVRPQADAAKALTAAART

SEQ ID NO: 153975 - protein, 252 aa, Heterodera glycines
  Coding regions on vcDNA: vcDNA=SeqID_80398; Strand=-; Position=1 -102,160-249,307-387,444-524,584-673,729-809,866-1096
  Homolog annotation: Hit_ID=AAG15241.1; Match level="QueryCoverage =71%, HitCoverage=84%, E-value=5e-14, Identity=30%"; Hit description =ENOD2 [Cladrastis kentukea]
MFPNDDGYESEDDEILLPPPPIPPQLGHPPPNVPAVRVQPMHVGQQRLPLRDLPQFEDHPQNVPAVRVQPIQQPLPLRDLPQIFHPPPNVPAIRVQPMQQPVPMRAVPQFLHPPPNAPEMGVGPIHDGQQPLPLRALPQFAQPPPNVPAVRVQPVQQPIPLRDVPLFVNPPPNVPVIRVQPMPQPLPLRDMPQIHHPPRNVTSIWIKLWLLFLSLWVFLQGIHVRQIQREYAVPQFAHPPPNLPYHPPENVP

SEQ ID NO: 153976 - protein, 201 aa, Heterodera glycines
  Coding regions on vcDNA: vcDNA=SeqID_80399; Strand=+; Position=1-606
MANIRRNAEEHLRRELHEGAMLCAAHLGPFTNVRFDGFFRYGPANTHMSPGRTFREHFRRRGFQVNPNLPCLQEYGGFSHSQQGIHVDYFPIDMINIQKGLGVGPRPPPTEAEILRPRRIQAYLAFEEIPHEQEELNRRALFFEVIGLRSNRPNDGTAKEEGAQQTRPQDFQRKKELDDPHTDRHLEDQPRKKTSNGPTRH

SEQ ID NO: 153977 - protein, 81 aa, Heterodera glycines
  Coding regions on vcDNA: vcDNA=SeqID_80400; Strand=-; Position=1-246
MGAPIWLIVMKLLVLLLLLLRKFRDHDTQTVILDRTKEIKHQRSKTKKHVTKKRRGKAERQKWRRRKKKRQRKMKKLFWMS

SEQ ID NO: 153978 - protein, 208 aa, Heterodera glycines
  Coding regions on vcDNA: vcDNA=SeqID_80401; Strand=-; Position=1 -445,767-949
FFDGFVAAFFTERKKQLSRKRIELAIFSRPTDESKNAFKSLWSLFNSQIGAITSVCNASAADRRNASVADERRNAENTGIYDLGPYFDTVPDWLVAPTLRPVDGIFGLETIYKWIYNDEGGDVVKTFTMHPPEEGAEIPAGDFERFLLGFFRFCDDAPPRYIAKFLHGVVAEDVREFSITKGGHSLSMDSYVEADGTTKDWTLKCSKN

SEQ ID NO: 153979 - protein, 71 aa, Heterodera glycines
  Coding regions on vcDNA: vcDNA=SeqID_80402; Strand=+; Position=1 -114,308-409
MKSANQNGFGRATMNVFVEDFANRDSLESILLIRCCKLPDFIYPASFPISTWNEYSEDIMLSERTYNNMEA

SEQ ID NO: 153980 - protein, 138 aa, Heterodera glycines
  Coding regions on vcDNA: vcDNA=SeqID_80403; Strand=+; Position=1 -133,177-283,328-501
MSMHYFIAIFACISQIFGTAKGMNSEMGFQPHFQQNPSSFLRKLELANGVKMLIPIENVIAFLKQFSQLNSLLNSDDFRIQCVDIQILQINKEINEIIETNQLKIGRDLCRILYNLLMSCKEIGYELDGNSRLNAPSA

SEQ ID NO: 153981 - protein, 681 aa, Heterodera glycines
  Coding regions on vcDNA: vcDNA=SeqID_80404; Strand=+; Position=1-2046
  Homolog annotation: Hit_ID=XP_318550.1; Match level="QueryCoverage =88%, HitCoverage=60%, E-value=1e-132, Identity=44%"; Hit description= ENSANGP00000020240 [Anopheles gambiae]
MPVPTHVSEVRSFLGMINHYQQFVKNMRFIRQPLDELLKQDKVWQWSADCQNAFENVIKILKSDQLLTHYDPAQEIIVSADASEHGIGAVISHRFPDGSLKAIAHASSSLSAAEKNYSQIEKEGLAIVFAVQKFHKYLFGRHFVLQTDHKPLLSIFGNKKGIKACTANRLQRWAITLLGYDFEIEYQNTADFGQADVLSRLIAKTPVPDNEVIIANIRESNETGVLNFVTKTLPLDHSDLANAAKSDQVIKNVKKFVCSHWPTKNKMAADIVPFHRRRDALTIEDECLLYADRVVIPASLQKDVLQLLHRGHPGMKRMKALARQYVYWPGMDEQIENFVKMCNECTMEAKMPVKSELHSWPKADGPWKRVHLDYAGPFMGKMFLIIVDAYSKWPEVFEMRSSNSAATIDKLRSLCASYGLPEILVTDNGTQFASKEFKEFVTENGINHLFSAPYNPMSNGQAERFVDTFKRTCRKIKGEGASEMLTTFLATYRTTPCEALPECKCPAEMFLQRKPRTTLDLLRPKPKAPIIRDEAMEKQFNRRHGAKPRSFALGDKVLARHRLSQPWRPGKITKCKGVIYDVEFVDGKYGRFHANQLLVRSTDENGTNALNVFNDAFDLPLAPPLVQHGGQAQLPVVAPAAVIAPAVAEEPVVEEADRAPEVPAQRRSQRNRRPPDRYTPS

SEQ ID NO: 153982 - protein, 283 aa, Heterodera glycines
  Coding regions on vcDNA: vcDNA=SeqID_80405; Strand=-; Position=1 -73,120-229,746-898,972-1110,1239-1615
  Homolog annotation: Hit_ID=NP_060267.2; Match level="QueryCoverage =61%, HitCoverage=32%, E-value=5e-24, Identity=36%"; Hit description =BTB (POZ) domain containing 2 [Homo sapiens] gb|AAK25826.1| BTBD2 protein [Homo sapiens] sp|Q9BX70|BTB2_H
MLSFIYTDDLSELNGENAMAVLYAAKKYNIPSLVGSSSQIPISELRNVFFAFAQARLLDLKNFANCCLAYIGKNADTLLKSDAFLQIDQKLLCEILECDELQISGEISIWNAALRWADEKCRENGIDCSAENRRQMLGPALFKIRFPLLSNEEFTKKIVPFGVLSKDEVIAVYQFKSLPNCHGISDGIFPMPFSINGRISDRKEGTVLMDIEKVSEFAREEVESSRYSEKVYINGLPWKILAKIKAKSGSTVNEKSLGIYLWCDAPKEGAKLLIINIYKQLIN

SEQ ID NO: 153983 - protein, 166 aa, Heterodera glycines
  Coding regions on vcDNA: vcDNA=SeqID_80406; Strand=+; Position=1 -139,189-286,873-1136
  Homolog annotation: Hit_ID=CAE62051.1; Match level="QueryCoverage =80%, HitCoverage=40%, E-value=5e-44, Identity=61%"; Hit description =Hypothetical protein CBG06069 [Caenorhabditis briggsae]
MLRRPRDSSSGPVLHFFFIVLCNLPFQIDAVGLAPGLYCGTVTCYDVLEISRDDFNKTDLPKLYRRMARQYHPDRVKREDLREETEEKFRLIATAYETLKDDETRTYYDYYLDHPEERYYNFYQYYRLRTAPRVDVRIVIAVTILLISVVQVNSRAEQDRTRWSCT

SEQ ID NO: 153984 - protein, 74 aa, Heterodera glycines
  Coding regions on vcDNA: vcDNA=SeqID_80407; Strand=+; Position=1 -143,361-442
MEEYMACELWKRAEFDRWKEDKDKEEKERLSNSGRYRQYKRFMKKQAGDCSFFKRNEPKSMKSEKLDVVVKRAL

SEQ ID NO: 153985 - protein, 204 aa, Heterodera glycines
  Coding regions on vcDNA: vcDNA=SeqID_80408; Strand=-; Position=1 -41,83-143,377-451,526-829,1925-1990
  Homolog annotation: Hit_ID=XP_395716.1; Match level="QueryCoverage =93%, HitCoverage=50%, E-value=5e-42, Identity=48%"; Hit description =similar to ENSANGP00000025039 [Apis mellifera]
MGRKKKKPQKPWCCCLRYCNREFEDEKILICLRYCNREFEDEKILIQHQKAKHFKCHICNKKLFTGPGLAIHCMQVHKESIDKIVHKESIDKIPGALPGRDNVNIEVYGMEGLPPESNEKQGINGLSMAFQHSWPCRGRLGHATLQNSAPAFPPGMSMGMVPPIAAYNQYTPRTPFGMPSYGRVSPRGLFGKSSHFQMPSALSL

SEQ ID NO: 153986 - protein, 598 aa, Heterodera glycines
  Coding regions on vcDNA: vcDNA=SeqID_80409; Strand=+; Position=1 -70,112-429,502-718,1116-1303,1364-2002,2405-2531,2805-3042
MMIYSVLVIIFISFIGSAKSVNLEQIFKNIDENYSKLFNLPLDENEISDRNLEAFQMDQNLKLQLEAAIFYSNAKEMVNLRQDGKPKKIREQNANTLKVLVENFAASSTVSLVNLCHLWKLWRTLGDTLVENPKIPKNVKNYLKNRDQIDLNGVECDESIGRNRVFVRDTALANFSAIIALLQLQNGKLTIKFGIDEEFRMIDLPNFFNDKRAKKESNFAFQIRHLRSMDKNKLMIRMKDKLRELIGPFFMTKLELIRPIEMNFDIVGDNELAMDYAKFLSQEHLVEEKAVTKISVRIIFGRIMQIFARIYAIWETPKIKILKKTILNLWNGKELQTIHTDLKMPGLKAVTKYFEFYLKLLRIFNSSQGIGEQEEQIGGLLPTQTFAKFTWEFAAKNKMFEMTWVALLEDHAKNILRLTESTTPNAFTALLKDSLMKEKGTKAKLNGFFTNNTEKGDEIYEALAKKYPKLKQLIAREELSDDQIRDLQIRNYIRFLNVTSSRNESMKSRFKLNLLLYYQWVKQMRDGQNSAEGKKEFDAKMGQIEITMDLVADENMAIEAYLVTVEANIIQELEQFKQNKFLVNNGTPIKRHKEKWTK

SEQ ID NO: 153987 - protein, 137 aa, Heterodera glycines
  misc_feature (7)..(7): Xaa can be any naturally occurring amino acid
  Coding regions on vcDNA: vcDNA=SeqID_80410; Strand=-; Position=1 -45,185-339,674-807,1148-1228
  Homolog annotation: Hit_ID=NP_493670.1; Match level="QueryCoverage =91%, HitCoverage=19%, E-value=2e-35, Identity=60%"; Hit description =hippocampus abundant gene transcript 1 (2A441) [Caenorhabditis elegans]
KISIFPXTYIFIPPWWYFTLFTLSGLFSVTFSVVLAYVADITERSERTTACGLVSATFAASLVTSPALGAYLSRAYSDDAVVLLATGIAALDLLFIALCVPESLKSPVAAGQIRPISSVSILKIEGTDPLFVLRFLR

SEQ ID NO: 153988 - protein, 235 aa, Heterodera glycines
  Coding regions on vcDNA: vcDNA=SeqID_80411; Strand=+; Position=1 -24,769-1452
  Homolog annotation: Hit_ID=CAI00635.1; Match level="QueryCoverage =65%, HitCoverage=23%, E-value=3e-10, Identity=35%"; Hit description =hypothetical protein PB001086.03.0 [Plasmodium berghei]
MGTQVKKTLFRRSVIKKKHLILNPILDKGAKILNILDKGAKILDKGAKILKILDKGAKILKILDKGAKILNILDKGAEILKILDKGAEILKILDKGAKILDKGAKILKILDKGAEILKILDKGAEILKILDKGAEILKILDKGAEILKILDKGAEILKILDKGAEILKILDKGAKCLYSRKMTINACTRLASRRTRAEPTAAVPSMAADAADIRRRLTQNSERARLLILCQKSGE

SEQ ID NO: 153989 - protein, 77 aa, Heterodera glycines
  Coding regions on vcDNA: vcDNA=SeqID_80412; Strand=-; Position=1 -128,916-1018
  Homolog annotation: Hit_ID=NP_493670.1; Match level="QueryCoverage =100%, HitCoverage=12%, E-value=4e-12, Identity=51%"; Hit description= hippocampus abundant gene transcript 1 (2A441) [Caenorhabditis elegans]
MSRRARSLFCVSRRRMSAASAAMLGTAAVGSARVRREASLVHAFFSWGLLTVPVINVLAETFPANKFLMNGLILGLK

SEQ ID NO: 153990 - protein, 47 aa, Heterodera glycines
  Coding regions on vcDNA: vcDNA=SeqID_80413; Strand=-; Position=1-146
FGILKKPGPGFHVGRGFSGQKFQVAEKYGLDLGIQEKSRPDLDPSPG

SEQ ID NO: 153991 - protein, 23 aa, Heterodera glycines
  Coding regions on vcDNA: vcDNA=SeqID_80414; Strand=-; Position=1 -16,1043-1098
MRNGEAEENIQFYKLRNFWQFIF

SEQ ID NO: 153992 - protein, 519 aa, Heterodera glycines
  Coding regions on vcDNA: vcDNA=SeqID_80415; Strand=-; Position=1-1559
  Homolog annotation: Hit_ID=NP_507780.1; Match level="QueryCoverage =61%, HitCoverage=22%, E-value=1e-16, Identity=25%"; Hit description =predicted CDS, DNA polymerase type B, organellar and viral family member (5T899) [Caenorhabditis elegans]
MAPKRQRVRPASDYVRKLDSESVFNKKFNVQSSKSSYIIEDLPGNPEFLLRAIFTNCILSAVRLAHENGIKPDRLGATVSSELLNPPVWIPIRQYTSNTVDAILNRLLEVAQSKSREGSLWGAPFTITTTTLDASTLPRQQQIRGRGFRTPKNVRHIVKEANLLRVRNNDSFCLFYALELSRIYHTDMMSKQRFSEYLNQYFDRQRNDVRRLMTSAGIPFNLNEYDAAVHIPPIVDYWNATYNKIFKVFVFGASGEYKPIYKYGPDNFDTSISIFYNNNHFDGIRCGVGKAVFGRDCYCFPCECPFDNANDHSRQCKARCTNCGRIGVGRPCTPDDNYRKDCVSCSKTFMNAECYQHHLTSNYCTKSKKCKKCGVVWDFERNTRDGRKGHVCEEKFCWTCRNYHDKGRGCFIKKLKPKHPKAFRLIAFDCETTQNTIIGPNKRAHIVNFVSAHVACSICIKGNTWRQSLSGRTACKICGEFRTITFSHRAFNNTQVDSMRVCESPMTEFAQWLLSGFDK

SEQ ID NO: 153993 - protein, 259 aa, Heterodera glycines
  Coding regions on vcDNA: vcDNA=SeqID_80416; Strand=+; Position=1 -102,153-294,555-746,1197-1540
SNAPRIHEVIHGITSPTTKSQLDNAFGGEEKSKNVINANHCSTNYSKHPSRPNPTPGGREERCPSFGQISPTQRSSILHEGDCDSEVTICPPSARNSGRSAAVAVASGNGAKNDENAVYTASSPPRCTTDSFRRKIKSMECLGTLDNFSTMTPNKYRKNSADPPVDCNGSDEDENEEDDEKQCHQKRRQRTVEEGQEEEDSAKYGQRSLQNLHNLHPTANRIANGAKQQQIGKLTNQNNNGTFGGGGGVTTHWSTSGTL

SEQ ID NO: 153994 - protein, 144 aa, Heterodera glycines
  Coding regions on vcDNA: vcDNA=SeqID_80417; Strand=-; Position=1 -6,352-475,708-860,1143-1294
  Homolog annotation: Hit_ID=NP_495753.1; Match level="QueryCoverage =68%, HitCoverage=16%, E-value=3e-25, Identity=52%"; Hit description =RAN (nuclear import/export) related (61.4 kD) (ran-3) [Caenorhabditis elegans] emb|CAA91119.1| Hypothetic
MTGNHDEEHWRYDTLQHIPLPDGVNTVAGVDATLGATIFWTDDGRVFGFGCDTVGQLGLGIKEEDEKVVSKPRQITSAHLDGYRVLGVSIADNHALFLAASIDQQPPLSSASPPPPPQQQKAQQQKQLQTNGNGILETPIDGKA

SEQ ID NO: 153995 - protein, 119 aa, Heterodera glycines
  Coding regions on vcDNA: vcDNA=SeqID_80418; Strand=-; Position=1 -108,379-474,672-823
  Homolog annotation: Hit_ID=XP_395784.1; Match level="QueryCoverage =97%, HitCoverage=30%, E-value=2e-27, Identity=50%"; Hit description =similar to SD03319p [Apis mellifera]
WNTKFSFFFCLISFQQFTSNKWKKNKFLISVIHQFKKGGKFNTILHFVPHQYAWVVERAGKFHRILEPGVHIVYPLIDEIRYRHCLKEMCIEIPQQEAITKDNVQLDLDAILYVQVVDP

SEQ ID NO: 153996 - protein, 106 aa, Heterodera glycines
  Coding regions on vcDNA: vcDNA=SeqID_80419; Strand=+; Position=1 -47,107-380
MSDNRNEAEEKMAKAIFISGDGWLCVFELLPASQLGLAIAMISHPFDFYVHEHFQTRYWTLRSMKIKMKFEADGTQEMDVGHANWNRLEYAKARCKEKPPISRPFH

SEQ ID NO: 153997 - protein, 110 aa, Heterodera glycines
  Coding regions on vcDNA: vcDNA=SeqID_80420; Strand=-; Position=1 -109,249-472
MDAYFDVDDFGRVGSGIDPTFAYQELSPSSNESIEKSELACFKAGQRLEVNGDLFSWWHENAARLPELSKLARMVHSIPATSVSSERLFSKAGLIFTNSLRNRSKINKYV

SEQ ID NO: 153998 - protein, 27 aa, Heterodera glycines
  Coding regions on vcDNA: vcDNA=SeqID_80421; Strand=+; Position=1 -42,87-128
MLYQTFLIINYSKLDWFPVLLYNITFL

SEQ ID NO: 153999 - protein, 20 aa, Heterodera glycines
  Coding regions on vcDNA: vcDNA=SeqID_80422; Strand=+; Position=1-60
MSRRDFFDGPTPNPSLSPSM

SEQ ID NO: 154000 - protein, 150 aa, Heterodera glycines
  Coding regions on vcDNA: vcDNA=SeqID_80423; Strand=+; Position=1 -67,533-626,1565-1854
MRRDKSTLLVIDEVIDVLAEAVGAWKKLIDQRANFHRHPKKRSLKTVTYRKKIPVMIPSLIHSPRTSAYIDTSAKQPQNLVELDLEEVRKLQQFIGQNAINHIVVEDGIFAGMFSCQQNIEFRLEDEAIMGDGKMHRMLFSFGAILSAEI

SEQ ID NO: 154001 - protein, 312 aa, Heterodera glycines
  Coding regions on vcDNA: vcDNA=SeqID_80424; Strand=-; Position=1 -54,104-142,211-239,298-350,396-446,499-527,722-795,846-867,910 -976,1045-1074,1120-1190,1285-1355,1406-1434
  Homolog annotation: Hit_ID=NP_492268.1; Match level="QueryCoverage =97%, HitCoverage=47%, E-value=1e-81, Identity=56%"; Hit description =TuBulin, Alpha (tba-5) [Caenorhabditis elegans] emb|CAB01495.1| Hypothetical protein F16D3.1 [Caenorhabdi
MREVISLHMGQAGVQIGNACWELYCLEACWELYCLEHGIQPDGRMPTDESPDGRMPTDESVGVEVGVEDHSYNTFFSETPSGKHVPRSIFVDLKHVPRSIFVDLESTVVDEIRTGTYRQEIRTGTYRQITGKEDAANNYARGHYTIGKELIDVTMDRIRKDVTMDRIRKIAEQCQSLQGFLIFHSFGGGMDRIRKIAEQCQSLQGFLIFHSFGGGTGSGFTSLMMERSGFTSLMMERLSVDFGKKCKLSVDFGKKCKLQFSVYPAPQISTSMVEPYNSVLSTHTTLEYSDCSFLVDNEAIYEIVDNEAIYEI

SEQ ID NO: 154002 - protein, 104 aa, Heterodera glycines
  Coding regions on vcDNA: vcDNA=SeqID_80425; Strand=-; Position=1 -22,69-250,489-599
  Homolog annotation: Hit_ID=NP_496710.1; Match level="QueryCoverage =72%, HitCoverage=3%, E-value=3e-17, Identity=57%"; Hit description =u5 small nuclear ribonucleoprotein helicase (2N18) [Caenorhabditis elegans] emb|CAB60351.1| Hypothetical p
MLATQRIELFSLSLKPKTKLRALIEIVSNATEFSTLPIRHKEEVTLKKLADRLQGQMKNQKWNSPQVKQRLAFARHPRDGIVPNAHSSDVFKRVVHEAIAPLHA

SEQ ID NO: 154003 - protein, 21 aa, Heterodera glycines
  Coding regions on vcDNA: vcDNA=SeqID_80426; Strand=+; Position=1 -10,933-988
MKIFNALVQQVNRICNCKRFL

SEQ ID NO: 154004 - protein, 169 aa, Heterodera glycines
  Coding regions on vcDNA: vcDNA=SeqID_80427; Strand=-; Position=1 -46,515-978
  Homolog annotation: Hit_ID=EAL37824.1; Match level="QueryCoverage =85%, HitCoverage=20%, E-value=6e-14, Identity=33%"; Hit description =hypothetical protein Chro.80459 [Cryptosporidium hominis]
MGSRKILRGVPSCAIFERCTSVALWESDGQKWNETLLKEIEQNSLGRMGENVQRTKRIKMKQKEVEETDEEEEIHQMERKTKKRETEEEEEKEKEEEKEKGEEEEEEREDRMRRRTEGEEEDKRGQSRKMNRETEEDDNRQVLDRLTGRKHPSRREWKNQDQCHESTKQ

SEQ ID NO: 154005 - protein, 38 aa, Heterodera glycines
  Coding regions on vcDNA: vcDNA=SeqID_80428; Strand=+; Position=1-375
KLIFSFALHLLFFMFHVFARIFCFKLLKIMRSILIQSY

SEQ ID NO: 154006 - protein, 214 aa, Heterodera glycines
  Coding regions on vcDNA: vcDNA=SeqID_80429; Strand=-; Position=1 -150,250-444,491-790
MKRPNPLNLPMSEKKPKLRRRLPAELNSELISFVPLVCLFASVKRAPIGPKGVIALFDVMFEEKRTPKKKKVGRLLLQEELPQDLSRNELLHYLCYGRLGTNLFETYFVMTHATNSIAIGNLFGLLLDFAMSSPTPWLMKRPICCGIFYRQHLPWILQQPMNVMLSHGFFPEVRSDGFEFFWLFNPHLKKYAGYVRILPELSQPDNLHFFLSIF

SEQ ID NO: 154007 - protein, 225 aa, Heterodera glycines
  Coding regions on vcDNA: vcDNA=SeqID_80430; Strand=+; Position=1-676
MTNNTLDTILNQFKKVAQSKQQKNVSLWGEPFTVTITTLNRNGLPPKRRVKGGARRPVKTAVHHRINDQCLIKIRNPDDHYCLFYALQATMVDKTCNWPRWKFSRYLNNQYGQQGQLHRDAVELMKQVKAPMDLDGYDADTFVPLIVDHWNNMQQQHRFAVFIFGSLGQYKPIYKYIDNIYDTPLLLYFNEDHFDGVQKQGGLFGQPYCLECERPYRRMSTHSKS

SEQ ID NO: 154008 - protein, 30 aa, Heterodera glycines
  Coding regions on vcDNA: vcDNA=SeqID_80431; Strand=+; Position=1-92
INPAVRFLEPSDILSQWVVAFPGHLEESTV

SEQ ID NO: 154009 - protein, 225 aa, Heterodera glycines
  Coding regions on vcDNA: vcDNA=SeqID_80432; Strand=-; Position=1 -171,634-750,795-1184
  Homolog annotation: Hit_ID=CAE56030.1; Match level="QueryCoverage =41%, HitCoverage=23%, E-value=5e-11, Identity=37%"; Hit description =Hypothetical protein CBG23593 [Caenorhabditis briggsae]
MVAMFSLFCGATEPIFSSCLPPHNGGYDYLLFDAKGPEADSAQSLFAATSAVPSAAVHFLESLNPLNGFKDKDDLENYLYNQSHKVEPKNGEIPNAKPKHPPEALKSPGVKQQKTPISGSSGGTFHRFPTAKSSAKSSASSPHSPCNAPSGGGGGGALLSPSHINVPTRSPASAGSASGSSMSMALAEDPNFAIVDISPGEIVESQKRWELIAFPRLRPIPSMAW

SEQ ID NO: 154010 - protein, 39 aa, Heterodera glycines
  Coding regions on vcDNA: vcDNA=SeqID_80433; Strand=-; Position=1 -20,448-544
MRHSSSNLGQISLPLNGIDLGTTTQKWTNFEAPKDVDEL

SEQ ID NO: 154011 - protein, 38 aa, Heterodera glycines
  Coding regions on vcDNA: vcDNA=SeqID_80434; Strand=+; Position=1 -90,367-393
MRHKNYKIKGQKGAFWSYRHFIQSKKDWLFKMPLENRF

SEQ ID NO: 154012 - protein, 65 aa, Heterodera glycines
  Coding regions on vcDNA: vcDNA=SeqID_80435; Strand=-; Position=1 -88,720-829
MHFYVNRAINDTGHKSKNYRSDGGAKTNYGTLKTRARPGPGSRSRSRPFFDNLVFCPGNQGPGQM

SEQ ID NO: 154013 - protein, 44 aa, Heterodera glycines
  Coding regions on vcDNA: vcDNA=SeqID_80436; Strand=-; Position=1-592
KRARISIKLMTQSVGPSAVQRLQRRAEDFLAFIFPHGFLEKSQN

SEQ ID NO: 154014 - protein, 147 aa, Heterodera glycines
  Coding regions on vcDNA: vcDNA=SeqID_80437; Strand=-; Position=1 -155,208-287,355-563
  Homolog annotation: Hit_ID=CAE65795.1; Match level="QueryCoverage =75%, HitCoverage=28%, E-value=2e-19, Identity=46%"; Hit description =Hypothetical protein CBG10900 [Caenorhabditis briggsae]
MRYEIKKDYRVTNPRELIHQYATTTPVTVIDPSLETTRTITRQHYTQTVEESFGPYPPYTSPPNVPSPLKFVQQLRDETMTESQRQANRQQQSMSASSRDSNFEQRIEVKAKPTIAMIKMQMLSICFGRKFGARQAVKRAVIRWWNS

SEQ ID NO: 154015 - protein, 203 aa, Heterodera glycines
  Coding regions on vcDNA: vcDNA=SeqID_80438; Strand=-; Position=1 -91,219-568,713-884
  Homolog annotation: Hit_ID=CAE65795.1; Match level="QueryCoverage =91%, HitCoverage=45%, E-value=5e-34, Identity=42%"; Hit description =Hypothetical protein CBG10900 [Caenorhabditis briggsae]
SQERETPFSGYGDRVGSGVAYTPTLWKGGELVTDPALVNKSIKPRRFYYAPIGDGVVAADGVELKRLPRDLTPKVEVIQQRIVEKSDRGRPGVRITEKTWSTGGQLERKTRGFRIEFEAPTEDSLKGYGHSDNPNEFPASDAGRGSRPAEDGAAGHPKNWEGDGGPRMGGRGAGRPNGGGGPYDGSSRSTPLDFGKAPATNGL

SEQ ID NO: 154016 - protein, 62 aa, Heterodera glycines
  Coding regions on vcDNA: vcDNA=SeqID_80439; Strand=+; Position=1 -43,777-922
MWERCKLKDEATELGSTLPEANNERTARRMMFSCARQWSQLNNHIELDFIYDVATVIVAFAK

SEQ ID NO: 154017 - protein, 120 aa, Heterodera glycines
  Coding regions on vcDNA: vcDNA=SeqID_80440; Strand=-; Position=1 -90,401-673
MWIIERFGQRFNLKCRGKAEIVDDIMDNIKSLLGQKSEFQSGLKRKQKLVNMDIYVRYLNRIDEKCRPFYANAFLDGLPSLKNLFCQIRFFIQSTANQFSIFKHVAETQGFEVMKQRICE

SEQ ID NO: 154018 - protein, 114 aa, Heterodera glycines
  Coding regions on vcDNA: vcDNA=SeqID_80441; Strand=+; Position=1 -67,205-328,446-532,596-662
MTHLLYIRMKANDCPGVAFIRSGCDISFISESFARKANLLGNIDRSDCETIFVPAFRGGKLLGWVNDVQVRIDELNLQFVYRLGVMADKHLGMYCPKKFDMLYVLKEEYFSLQL

SEQ ID NO: 154019 - protein, 55 aa, Heterodera glycines
  Coding regions on vcDNA: vcDNA=SeqID_80442; Strand=-; Position=1 -21,321-467
MIAVIDMVPNWANLDKSNDNFFVEERGILLVRVGLIVCTTFGVVVHKYAQMSKKS

SEQ ID NO: 154020 - protein, 34 aa, Heterodera glycines; identical to SEQ ID NO: 137149
  Coding regions on vcDNA: vcDNA=SeqID_80443; Strand=+; Position=1-105

SEQ ID NO: 154021 - protein, 27 aa, Heterodera glycines
  Coding regions on vcDNA: vcDNA=SeqID_80444; Strand=+; Position=1 -23,141-201
MLSNLSLRMKSAENGVPNSAGAQVTAL

SEQ ID NO: 154022 - protein, 27 aa, Heterodera glycines
  Coding regions on vcDNA: vcDNA=SeqID_80445; Strand=-; Position=1 -67,926-942
MAINSKISEKECNFLGSDKRFLNLHIV

SEQ ID NO: 154023 - protein, 63 aa, Heterodera glycines; identical to SEQ ID NO: 130392
  Coding regions on vcDNA: vcDNA=SeqID_80446; Strand=+; Position=1 -97,317-411

SEQ ID NO: 154024 - protein, 78 aa, Heterodera glycines
  Coding regions on vcDNA: vcDNA=SeqID_80447; Strand=+; Position=1 -58,158-336
MEVPADYSLHKHTFPNGTNEMSQQRRQQMSHSSDERSCQEEETEEEQDEEAMLYTAKYRHLLEYYKHISEVVIISGTY

SEQ ID NO: 154025 - protein, 253 aa, Heterodera glycines
  Coding regions on vcDNA: vcDNA=SeqID_80448; Strand=+; Position=1 -107,198-562,710-999
MPTSSTSSAASSPTRCLGPLFVLIGLPSPPTTTKCNSSNNSNYEPLSESDLSAEELAERLIHRRSSIDHLLPEAPEPDDDADAGEQEKGKDRKEEKSKTERRDAVFGNSKHEKEEGKDKGNGGETQQQQQRQTITQEEKTPSSEDEQHKQQMMTNTTVVPNFMKQSSDDLTEEKSPLASQSHNQQQPPSTTTASSFSPSSAVTPFVPAAIASVSIYAANDGEKRRETEEKNVDQNTTVAEDENEDDDEMEQEL

SEQ ID NO: 154026 - protein, 428 aa, Heterodera glycines
  misc_feature (15)..(15): Xaa can be any naturally occurring amino acid
  misc_feature (61)..(61): Xaa can be any naturally occurring amino acid
  Coding regions on vcDNA: vcDNA=SeqID_80449; Strand=-; Position=1 -111,344-443,600-766,923-1133,1280-1405,1478-1577,1691-1818,1964 -2078,2204-2282,2338-2461
  Homolog annotation: Hit_ID=NP_504555.2; Match level="QueryCoverage =97%, HitCoverage=72%, E-value=2e-94, Identity=41%"; Hit description =FUcosyl Transferase (63.6 kD) (fut-8) [Caenorhabditis elegans] gb|AAN84870.1| Fucosyl transferase protein
TAGQWHNLWTRNDHXKVKKRKKRKEIKNRQNLRGKSEHELARRELNRLIMELLYTRCTVIXQNKIKVKFENQILHLLAHSRQFAHVDGAEQWHRRALARVASNIQNALHALQHPKECGKARLLLCELNKGCGFGCQFHHVVYCLLMAAATNRTMLLERDGAEWRYSRDGWAAVFRSVGSCTFAEHVNNTALDKLWTPNSPRIVRLPVVDGLSSRPHHLPLAFPAQFADVLLTHHSNPPVFFLGQFVAFLMRKNERTNKFVEEAMRRIPFELGPVVGLQIRRTDKVGTEAAFHHVNEYMRWAELWFRTEQKKLGKPLKKRIFIATDDKTVIEEARTEWAKKGFEIWANDESAEAALPSNRYSDRSLLGVIADVHILAHCSYIVCTFSSQVYIVCTFSSQVSRGGGEMRPKVKIGTNKKYHLHAKKLFPK

SEQ ID NO: 154027 - protein, 121 aa, Heterodera glycines
  Coding regions on vcDNA: vcDNA=SeqID_80450; Strand=+; Position=1 -150,202-414
  Homolog annotation: Hit_ID=NP_001006029.1; Match level="QueryCoverage= 56%, HitCoverage=43%, E-value=2e-14, Identity=52%"; Hit description =trafficking protein particle complex 6b [Danio rerio] gb|AAH83391.1| Trafficking protein particle comp
MVKYFHDRDKSLEEQRELWLQKIRHLSDEETVDLLAGTDGKMMSNRIFAQRNAVTRLEASGVRVGYVLAEHFAKDLPRFSNELDKMKFICKEFWASTFGKGVDKLSTNHQAIFIVNYQYFK

SEQ ID NO: 154028 - protein, 90 aa, Heterodera glycines
  Coding regions on vcDNA: vcDNA=SeqID_80451; Strand=+; Position=1 -167,262-367
MPIQRPRLTVGNTSEVYTKRPVKEDEMANFPMSQRTRKSFGLSLRRTAKNAEAAKKRKGANKYAGTSANATKVKLTKRLPANWALNKLRP

SEQ ID NO: 154029 - protein, 382 aa, Heterodera glycines
  misc_feature (14)..(14): Xaa can be any naturally occurring amino acid
  Coding regions on vcDNA: vcDNA=SeqID_80452; Strand=-; Position=1 -207,255-415,673-733,789-923,976-1242,1334-1486
  Homolog annotation: Hit_ID=CAE65991.1; Match level="QueryCoverage =96%, HitCoverage=67%, E-value=2e-50, Identity=31%"; Hit description =Hypothetical protein CBG11182 [Caenorhabditis briggsae]
PQGCAMLNWVLAHXSIPLHLRSQSALLFGLMWVLGYCLVAPVAYFTTNWQQLIAAASGPSILFGIFYFFTIPESFHFLVAGKKLNDVTIPESFHFLVAGKKLNDVKKWVEKANKCAAKAGTRAIGSTELDQFIGQIAKEKVRHFWTDRTLILYLTVFCFLWTCDTFIYYGLSLFSAQLAGNTCDTFIYYGLSLFSAQLAGNRFVNFTLVALAEVPAYLFAPFLLEKLGRRLFTSFTHFLAASALGRRLFTSFTHFLAASAFLAVLLNDSPKLFLVLWLIGKFAISSSFTGLFVYTSEVFPTVNRGLCMGICTAVSQVNSSNKQILIYFTIIYSIAPMLFFGAFSFFAGLFTLLLPETKGKELPENSIRSRIILRIRTEKLST

SEQ ID NO: 154030 - protein, 68 aa, Heterodera glycines
  Coding regions on vcDNA: vcDNA=SeqID_80453; Strand=+; Position=1 -42,1063-1227
MKLPLPVCLVPVPPLFRTVRWKVKGFICKNRIGNVENEICEKRRQRENELVAQFEMKRHFEILTKAWA

SEQ ID NO: 154031 - protein, 25 aa, Heterodera glycines
  Coding regions on vcDNA: vcDNA=SeqID_80454; Strand=-; Position=1-75
TCTCGVVVKLSTFHNFLPGFNSPLG

SEQ ID NO: 154032 - protein, 335 aa, Heterodera glycines
  Coding regions on vcDNA: vcDNA=SeqID_80455; Strand=+; Position=1-1008
MPAQGTHQISKKLEPAYALSAVPSSALLRPDQQIGNHSAVSFYPGQIDPNAQSTLGLGPDQFHQYLAQQSYGIGPSQINQNLIEANHLINSEQLFGSNLRAPPEDVQYFTNKELKSDKTIIDYLNSHCVTDQSLFLSQNLVEPLTDSNVYQDQINMLIAENQFFNPSDQTESYLKHDENLNQMLINFVASSSPNNDEGDYRPHLLNSFNHQQGLLQHSPLDSDYHLNDPFGASSSSQMQINPSNYFHYQNVPQDSANIDQSEVETKNTEQMANENEKRKMKRLIVEDEAGKSEAKAKMEKRTKNQPPEAVGRQSASAGELPGRSSISQSEKQIGN

SEQ ID NO: 154033 - protein, 259 aa, Heterodera glycines
  Coding regions on vcDNA: vcDNA=SeqID_80456; Strand=+; Position=1-782
  Homolog annotation: Hit_ID=NP_608540.1; Match level="QueryCoverage =98%, HitCoverage=64%, E-value=2e-32, Identity=32%"; Hit description =CG2839-PA [Drosophila melanogaster] gb|AAF51469.2| CG2839-PA [Drosophila melanogaster]
SGRESGRESGRESGRERERATESGRESGRERGREQKVELKVEEEQKVEEEQKVEEKVEEEQKVEEEQKVELKVEEEPKVEKKEQEEPKVEPKVEEKVEKKEQEEQKVEPKVEEKQKVEENRKWKRKWKRTESGRESGRERGREQKVEEKVEEKVEKKEEENRKWKRKRKRNRKWKRKWKRKRKRTESGTESGRGTESGRRTESGRESGRGTESGRGTESGRRTESGRERESGKERARGTESGTEIGKKSGKERGREQKV

SEQ ID NO: 154034 - protein, 317 aa, Heterodera glycines
  Coding regions on vcDNA: vcDNA=SeqID_80457; Strand=+; Position=1 -34,1947-2874
  Homolog annotation: Hit_ID=DAA04499.1; Match level="QueryCoverage =97%, HitCoverage=22%, E-value=2e-68, Identity=45%"; Hit description =TPA: pol polyprotein [Schistosoma mansoni]
QPTQNSTTIQSDYELTQTEMVKHQIDTGEAIPVKQRMRPVPYAYREKVAAMIQDYLGRGIIRHSISPWACPIVIVPKKDGSLRFCVDYRGLNAITRKDCFPLPNIERTLLMLGGPKFFSTLDFLSGYWQIKMAKNSIEKTAFTEFGLHEFTVMPFGLCNAVATFQRFMSQLFGSKLNDFVFVYIDDVLVASESFEQHLIHLKFVFNKQEAGLKIKISKCQFCAEELKFLGHILTRNGIKMDAKTKPILELPVPKSKKDLHSFLGFMTYYRKFIYSFGSVAAPLFKLLKKDVKFQWERQKQAVSTLKEKICQKSRPLF

SEQ ID NO: 154035 - protein, 154 aa, Heterodera glycines
  Coding regions on vcDNA: vcDNA=SeqID_80458; Strand=+; Position=1 -159,408-641,1310-1380
  Homolog annotation: Hit_ID=NP_498959.1; Match level="QueryCoverage =51%, HitCoverage=3%, E-value=1e-11, Identity=43%"; Hit description =zn-finger, CCHC type and RNA-directed DNA polymerase  and Integrase, catalytic domain containing protein (
KANIIADVLSRSGALKPREWAEKIFRVEQVDGNISASVPKMEMIEWVNAIKETIPDKSVESVAKAFVEQLVLVFGKPKRIHSDKGAEFVNKTMEEISQILGVEKSTTAGYDPNANGQAERANQTILNMLKKEEEKMDIAEAEIKWTMTCEGGGH

SEQ ID NO: 154036 - protein, 133 aa, Heterodera glycines
  Coding regions on vcDNA: vcDNA=SeqID_80459; Strand=-; Position=1-399
  Homolog annotation: Hit_ID=AAG45420.1; Match level="QueryCoverage =98%, HitCoverage=61%, E-value=9e-22, Identity=36%"; Hit description =vegetative cell wall protein gp1 [Chlamydomonas reinhardtii] sp|Q9FPQ6|GP1_CHLRE Vegetative cell wall prot
MFPKPSNPMLPNPMIPNLSNAMEPNPMIPNPSNPMLPNPMIPNLSNAMEPNPMIPNPSNPMVPNPMFPNPIVPNPMSPNPSNPMVPNPMFPNPSNPMVPNPMFPNSSNPMMPNPMFPNPSNPIMPNPMFPNPM

SEQ ID NO: 154037 - protein, 18 aa, Heterodera glycines
  Coding regions on vcDNA: vcDNA=SeqID_80460; Strand=+; Position=1-56
YREAIPEGFGLPINLGAS

SEQ ID NO: 154038 - protein, 95 aa, Heterodera glycines; identical to SEQ ID NO: 125597
  Coding regions on vcDNA: vcDNA=SeqID_80461; Strand=-; Position=1-660

SEQ ID NO: 154039 - protein, 101 aa, Heterodera glycines
  Coding regions on vcDNA: vcDNA=SeqID_80462; Strand=-; Position=1-306
  Homolog annotation: Hit_ID=CAG83749.1; Match level="QueryCoverage =99%, HitCoverage=23%, E-value=4e-10, Identity=47%"; Hit description =unnamed protein product [Yarrowia lipolytica CLIB99] ref|XP _499823.1| hypothetical protein [Yarrowia lipol
MNLLITVVPLFITVVPLLITVVPLLITFVPLLITFVPLLITAVPLLITFVPLFITVVPLLITVVPLLITVVPLLITVVPLLVTVVSLLITVLPLLITVHLF

SEQ ID NO: 154040 - protein, 98 aa, Heterodera glycines
  Coding regions on vcDNA: vcDNA=SeqID_80463; Strand=-; Position=1 -82,214-428
  Homolog annotation: Hit_ID=AAO33474.1; Match level="QueryCoverage =91%, HitCoverage=65%, E-value=1e-42, Identity=100%"; Hit description= gland-specific protein g4g12 [Heterodera glycines]
MPNIFKILLIVLLAVVSFRLSASTGDKKTANDGSGNNSSAGIGTKIKRIVTAGLLFTSLATGGAEAIGRSNAQGGNAAGLVPSHVTNRSMVANCAKLT

SEQ ID NO: 154041 - protein, 33 aa, Heterodera glycines
  Coding regions on vcDNA: vcDNA=SeqID_80464; Strand=+; Position=1 -25,926-1002
MSNSQEIRRRLHTDLNNVVQKLVVSSRLEEVQQ

SEQ ID NO: 154042 - protein, 204 aa, Heterodera glycines
  Coding regions on vcDNA: vcDNA=SeqID_80465; Strand=+; Position=1-615
MVNNDESPQRSKAAQRQKNIQQKEKDELRRHQRNKLLSSIATLRSRRKRESAPISSKSIVIDLSSDSDASGIEIIQNPVRDRQAKSPNEHSTAPIPMAVQRLTPTRKSSSVAKRPAFSSSKQPKGKAANPAQTSQTNELNRKMKALSPTASGSGANHHCVATLARSSDSTTVIDKGSQQNCPNMSSATISKTPCQQHSSEKTLN

SEQ ID NO: 154043 - protein, 521 aa, Heterodera glycines
  Coding regions on vcDNA: vcDNA=SeqID_80466; Strand=+; Position=1 -713,748-1600
MAIHQECPFAKSEMTNHEAQLWSTNDELEVNFPGPIAGLFNCFAQPATLFVKRHNLQMFSPVHQVQNCQYATEFCQLPDNSTLIWKSTCNGNECQTCDYEKAEVINGKFTAAYGESMATWISEDHQKALTFAKNAPELITCDGTRIVMSEQNFGIAKEQYDDIVSTTTRWKRHPTRTARITALGIPSGNKRCVKSALHEGMSAKHEGSQPDSSGQTLTTATKHPSSLDRRNDNGSVSMPMNDCRLYIPVTAHFPDRAIAAFLDPELRIISLTAQQASCNSYRFHHLQLRSNPNIWLWIDSRTGTARRMPKDYVHELYETTINQTNSNLELHPLIFHAWQLDNESDATRFPHINEFNNSEQFKDKLEQHITARTEALGALKGGIEGFTMRWLKSLIDEAITWWIRVACVYSTFLMLRDIVLPCTLAYLLNPIRVTLLSLVGVRPHPTFRPTVSKPLGIEEGMPLREVPRTPKPPARRAEHRSMSPIKLDMIARTARYQQPRTQSHLDLTEDSPFARPRRTEF

SEQ ID NO: 154044 - protein, 133 aa, Heterodera glycines
  misc_feature (21)..(21): Xaa can be any naturally occurring amino acid
  Coding regions on vcDNA: vcDNA=SeqID_80467; Strand=+; Position=1 -189,245-400,1027-1045
  Homolog annotation: Hit_ID=CAE70800.1; Match level="QueryCoverage =99%, HitCoverage=17%, E-value=4e-32, Identity=55%"; Hit description =Hypothetical protein CBG17560 [Caenorhabditis briggsae]
LRENSCQKSVTDPLFLVESPXLSTTFFLFSVVRAENIAKQADVIAALTLDVLKGTTRAFDANVHRVRPHHGQNLVAVHRVRPHHGQNLVAGRLRALLHSDLNRSEIAESHRHCGKVQDAYTLRCVPQVYGVIA

SEQ ID NO: 154045 - protein, 73 aa, Heterodera glycines; identical to SEQ ID NO: 148250
  Coding regions on vcDNA: vcDNA=SeqID_80468; Strand=-; Position=1-222

SEQ ID NO: 154046 - protein, 196 aa, Heterodera glycines
  Coding regions on vcDNA: vcDNA=SeqID_80469; Strand=+; Position=1 -145,245-461,663-891
MCTMGSSLGHDGVIIATFANICIIYSSVICYLILYAKLKWDERKANGITVVASQPFIFKSISLILLLQVVGWSGGIIAFFVVSIHFGDDDLNLQKFLANSVINCFVCVCGTFETPVLFFHSSEHQKAMRKEWRNIVQLVKKCSPTTFGRNNKTGTAVVLVVSRPGKPTAKIRGEFGPFNPRIVSAAPKLADQTTAH

SEQ ID NO: 154047 - protein, 237 aa, Heterodera glycines
  Coding regions on vcDNA: vcDNA=SeqID_80470; Strand=+; Position=1-711
MGGSMNRLSENLWATENPEKLTYAWTGEKCETTVNDFLEEGKGGILDFFLVTSFGHNLNPYKNWEELPRKTFIWEIPEPNEKYWATHFSVGEFKAEITENAVVIESEQSVFYFEKEATDEREGIIGVPENAYKMSNDAFIVLSKTEIREKRETPKIEPKRKERPVKQEVQLKSEIGKKENVLKTKEQNATVYVLPQSTVKLVKDSQQKMPNPITILPHSTPSTVTTTSKPQVKISTT

SEQ ID NO: 154048 - protein, 237 aa, Heterodera glycines
  Coding regions on vcDNA: vcDNA=SeqID_80471; Strand=-; Position=1 -19,101-243,655-1125,1181-1261
MEIENVENWSCKSSATLRIVSQKNGTEDLIGRIGDRIFNKELNNPGFPYFISFAELLDPGKGFYDKDEDKVTLAIDVIVDEPKTEKIISDPNKSNGTLSMEIEKLSEFAREIEESDRISETAVYIKGMPWKILAYIKMKNESTEKWLGFYLWCDACKKGLLIKLYKRKCSATLRIVSQKSGVEDFKREYNEKVFNNATLLSLGWHYFISFAELMDPSKGLYNKDEDKVTLAIDFTCE

SEQ ID NO: 154049 - protein, 446 aa, Heterodera glycines
  Coding regions on vcDNA: vcDNA=SeqID_80472; Strand=+; Position=1-1341
  Homolog annotation: Hit_ID=AAA93301.1; Match level="QueryCoverage =74%, HitCoverage=89%, E-value=3e-50, Identity=34%"; Hit description =HASI
MDGSTSTTKGTQTENATRRPSAGIKSKIPKAQRNEAGERQGTRRIDTSVSNEGSQAEVDGSVSSRNGNSNQKPTSPTKEMDKSIEKVLERLYNDPKSPAAFAGVDRLWLEAKKELGNKIRKNDVKHYLEGHRTYTLMRPRRINFPRARTTAAGFMTDCQVDLADFQTLSRHNRGNRYLMVVIDVLSKRIFVTPLRTKKADDMVDGFKEVFSTMPMKPHRIFSDKGTEFRNQQLKKLFDEEEVEKYESTHSEKKAALAERAIRQIKNRVYRYFAQTKTLNWVDVIDQIVNGINKSPSRVHGMRPIDVNFKNSQQIWEKMFGDDQHMALFGKPRKRARFVPGQTVRMSIAKGQFEKGYIPNYGDEILEVDAVKRHMKPMRYKLRDSKGEKFKGFFYPEELAPVRKDAETTYRIERVFRKRKMPDGTTEVLVKFIGYPEREWIHETQLV

SEQ ID NO: 154050 - protein, 150 aa, Heterodera glycines
  Coding regions on vcDNA: vcDNA=SeqID_80473; Strand=+; Position=1 -19,714-1036,1079-1187
MVIVLFEFFKRGETQTAWFTCDLCSYFKWNSLCFCAIGSRFGMDRHSLDQVYSAIIQKALDLRVESLSMPLLGTVLLSYFLYSLNLGTLFSSLDTASNYLWACLQQFSSFGRLKKIQIVDTNDFHMRSLHKFIIAKLRAQSQLQNGSSAS

SEQ ID NO: 154051 - protein, 219 aa, Heterodera glycines
  Coding regions on vcDNA: vcDNA=SeqID_80474; Strand=-; Position=1 -11,73-258,398-821,1268-1306
MNRRWICADVWMDILPSFDRAQLGLKMALLSDRFDVLVDTHFDGKSELTIWKAIEIRKDKGRNAKLYIDHSVIEFLRSNKQIWDRSGTKLEVYIEYCDQRIWDVLDRQIWPLFATNIRHLSFTSGDALDNLRRLISPTILTDLDQLNSIDSVGLLPDGISDDGPNATAGQALTKWLHTPSKNGQPKRLYRYNLLGPPNFEWVNSFKEAIVAASGRRRSG

SEQ ID NO: 154052 - protein, 55 aa, Heterodera glycines
  Coding regions on vcDNA: vcDNA=SeqID_80475; Strand=-; Position=1 -3,1514-1678
MTQKQIMSQNRDENSQPPVLDGPYPLAQERNEFVEDEAPVLLEMLDRLSQGVVLF

SEQ ID NO: 154053 - protein, 146 aa, Heterodera glycines
  Coding regions on vcDNA: vcDNA=SeqID_80476; Strand=+; Position=1 -123,189-272,1501-1735
YGLCEEHLFIYILPMLTVTFGYSFYVLGEAAQWALFVYPDWPVLCTNSDMFSFGMSTMLLRNGLVINGLTEYRQAFRKHLRKLPLAGICLMRIGQQQQQLPNAVSMVAVFNNAIPQPSSVGRVRHITTIGGGGGTAVPKTMAPIDS

SEQ ID NO: 154054 - protein, 548 aa, Heterodera glycines
  Coding regions on vcDNA: vcDNA=SeqID_80477; Strand=+; Position=1 -412,461-1694
MSNFNQNDFAITSVHQMRNRPRNTIGEIAEVRFAPLEEVERPDRVLERLVQRLFDRVLDGRPAPMLIGLQLHPPTFENPFTIPLRPPEQNNPAAIADLIQRLNDQSAAGIDLTGGTTVTKVLAVWPMQSDHSESGRAGACSLEEEHRLVNTVRSLIRIKNPNDRLCLARAVLLGLHDWRSRSPGGGGPTAFKSFANRQHTHGPEARNLLRRAAIPRNKHMYTIDDVQKVQDWIDQRYGPGEIRIAVFEKEREYRIVFKAASGEAAKFNLCLLFENQHFNYIGRIEQLFRVQGYCIDCERRVTRWYHPQECKVVCRLCLRFGAGYPCKQQQQQQSRADGSTGNRLCRYCQFVFPNDDCFAYHLSNQAPASMYNQGGRTFRPICEWRRACRQCGAITYANYPHKCPAQIGQTEWVRCARCSGPHQSGDPCFIQPLKDEPMRRRRRRRGQQQQQQNNNNDDEDDDDGNDGNEEGDDDHGHDADNEEEEEVGTNRSVRLCFFDAETSQDLPLQLRTKVVQKHVPMLIIAEIICEACINEGISVHSGVGQYAN

SEQ ID NO: 154055 - protein, 281 aa, Heterodera glycines
  Coding regions on vcDNA: vcDNA=SeqID_80478; Strand=+; Position=1 -151,203-564,1981-2313
  Homolog annotation: Hit_ID=NP_507780.1; Match level="QueryCoverage =48%, HitCoverage=8%, E-value=5e-12, Identity=34%"; Hit description =predicted CDS, DNA polymerase type B, organellar and viral family member (5T899) [Caenorhabditis elegans]
MTHPGVHVRSAQWSIGEANVEDTGYRLDGLVTREPPQRNLAIEYMGCFYHGCPKCYANDRQQKLAGGRTAEDLYERTKRRLFELQNQHGFELEVVWGCEMKQRLRADPEFRRVYNDSFVPRPLDPREDALRGGRTEPFILHYTCSPDEEIILIDIVKKKLGETKNIFSLLKKKYTKILFHRDDVLDMEGVHVVPGSNASIRIEFPQIGRTPCSDLYTYDAHKDYQPHYVKGRIRPSMETVPFGFREAQTDQEQAEHHQRQLNDFDNNLLIVNLPGCSNWNQ

SEQ ID NO: 154056 - protein, 175 aa, Heterodera glycines
  Coding regions on vcDNA: vcDNA=SeqID_80479; Strand=-; Position=1 -85,133-434,489-629
MSWLKIIEEEEERARELQNDQMELEQVKDNIELPKHPQPQTKCSCNEKQKSVPLIDFLCKHYKCSMNELHVLLQTLSKRREISEMLRSNLHLRTNHLRPAWKNIRVHCNELTIHPAQTAYAMRGYLGITVRVYYYVKHGIKLAYPQLPCVLQFGGGDHSSLFPLECLSVVVVKEP

SEQ ID NO: 154057 - protein, 229 aa, Heterodera glycines
  Coding regions on vcDNA: vcDNA=SeqID_80480; Strand=+; Position=1-690
MADNFQKFDEKHLQLRHPFTLTISGSTGSGKSEWVLRMLRNVNALVSEPISEIFYCYGELNPNIIQLQKSGHIGGCRVIVHAGSPTEEQVNRRAKECDGKLLMVLDDLMVGLGQQFLDTVFTRGSHNWGVSVVLVTQHLFAKELRVARNNSHYLVLMRNPAGALQVRTLASQLFPTKSNYFTEAYRDATEKQFGYLLIDMHPESPELLRLKTNIYGEQGGLPPLVYVAK

SEQ ID NO: 154058 - protein, 151 aa, Heterodera glycines
  Coding regions on vcDNA: vcDNA=SeqID_80481; Strand=-; Position=1 -18,441-740,789-926
MTSSCKACPFRSKGLICRRKLSDDNMCEACGQKAIAPIHTVFVRLLLQDVEQADIAQRVTMFSSVAEEFLGMKAAELLAKEKEPESLAKHLDDLIAVKLIAKVNIKANNQTYTGFDWIVNLFKKCPGNDDSDVPKEKNDVDEIATKKAKKN

SEQ ID NO: 154059 - protein, 137 aa, Heterodera glycines
  Coding regions on vcDNA: vcDNA=SeqID_80482; Strand=+; Position=1 -120,169-234,285-378,469-600
MAMLLIWTIMDNYLMEKTVNNRSLISNSLRWTKEQKQLGEEFHEKFARMEIELKMAKLELENKEQKLKLHELIGEQKALKEKLAKLEQKKGKNAIFPNLSTSEEMIVLIARIAELNRANTAEPSIASSADLFGQDGN

SEQ ID NO: 154060 - protein, 587 aa, Heterodera glycines
  Coding regions on vcDNA: vcDNA=SeqID_80483; Strand=-; Position=1 -1660,2599-2700
MSTSGGCSSEPASGTSQACGQETKMFLSGKDDASSITAIDRKLWQGKVTVKISDLEKVQNDMGKLEDGVNRAFRHLNRSLNQKVTWVNDVVANTNANFETLKVQFETLTERVDILERDNDGANSGGTFSLINQNRASLAPFVMPMGNAQPNQLMPNQVPIQQLSSEDEDDGPTLFGLNMLMSGPAVGSGLEMFREESVFAFDDWAERFKDYLSVSGKAYTEREKVTRLKLALKDTPLALFKELLPAQTDTLDTALSELRRKLDSPQRREITKRTLSLCKQREDETVAQFLRRLTPLVDATNSSLTGNSRKEKICEEFLDRLKPNISFLIRLVGLSRAKDLDLVRAQAEELEALLMMSKSDEAVRLSDVVNALNNQSSQSRWFTEANLNNDFAGQWASGNNVRGFSSFSGSDEQTQQQGGGEGQNRSRNWGESHQEQFSQRNWSRNPRCDYCDRVGHVAYNCYQRRANFSQGRWSNQQPHQSQGQWQNRQSSVNMMDAPSSSNASAEFFQNLAQALLDLKIQERRNYKDEEPRSGAMNALTHIKPETEVKKCQVVSWFLLKMATKLSHGPNVSTLRILSNTNGNEYLT

SEQ ID NO: 154061 - protein, 218 aa, Heterodera glycines
  Coding regions on vcDNA: vcDNA=SeqID_80484; Strand=-; Position=1 -424,832-1064
  Homolog annotation: Hit_ID=NP_500443.1; Match level="QueryCoverage =52%, HitCoverage=17%, E-value=8e-11, Identity=39%"; Hit description =predicted CDS, RNA-directed DNA polymerase  and c-type lectin family member (4E715) [Caenorhabditis elega
MKKQLHKLRNEQESKIISQGQNSVNKFIRNKLSKVNEIPTLIDSAGNMFSSNEQKCEILAEIFQKSFLENSIVNGSLTQSAQNKTKLLDIELNNGTIWNILRRLPRRNSTSPDNVPYILLKNCAEPITKILADLFRLILDSVKIGEELSENFKIFSGVPQGSVLGPLLFLIFINDLPSFIANEKASVGIKMYADDVKLYYAHENDGHSNQLDKAIEAN

SEQ ID NO: 154062 - protein, 224 aa, Heterodera glycines
  Coding regions on vcDNA: vcDNA=SeqID_80485; Strand=-; Position=1 -84,1659-2249
MSNEYKQKGKYSTKEWYQNYAEICKKIGQHILSISFFHSNCNFFQFTEVIVDILARLDRLEKLLEGSGNPTLNPIIERLEKLERLVERLVEGENRYGHRFGDPQHTSSTSAPTPTNGNFQWGQPPPFAGTGAVSRMITDAIINSEQLKEKANRAVIEKLPEAIDERALVDQIAEECGVKDKLSPDIHRHPRTRPDGGVKKDRILKFHFWTNFRETNLSIISAML

SEQ ID NO: 154063 - protein, 252 aa, Heterodera glycines
  Coding regions on vcDNA: vcDNA=SeqID_80486; Strand=-; Position=1 -653,715-818
  Homolog annotation: Hit_ID=XP_320901.1; Match level="QueryCoverage =55%, HitCoverage=28%, E-value=7e-10, Identity=31%"; Hit description =ENSANGP00000017731 [Anopheles gambiae]
MASDGRQLRVFKRRKSQKKTIRNTHIQQAQQNNSASNGFFLLLPFCLSSSLSVFAPCHCLFGTFKCLGFAFPHFLVFTSFVNAQSMAHRIGTEVSTEDGMATTGTTTTTTTHGKYGHKRDWGHDNHKKDGWDHGYKHGDTMVRNGTKRTLATADYATDDGHAAGYAKGDESDWSSYQYGGQGNKAQGDSYAKGYNSAWKDGHDDGHDYATGHGDGHDNGWGSHGSHHGDGDYGNHGGQHGYGGYGGGEHGHH

SEQ ID NO: 154064 - protein, 261 aa, Heterodera glycines
  misc_feature (41)..(41): Xaa can be any naturally occurring amino acid
  Coding regions on vcDNA: vcDNA=SeqID_80487; Strand=+; Position=1 -303,1818-2021,2068-2122,2196-2239,2283-2341
  Homolog annotation: Hit_ID=NP_504414.3; Match level="QueryCoverage =72%, HitCoverage=17%, E-value=1e-52, Identity=56%"; Hit description =Na/Ca eXchanger (103.1 kD) (ncx-2) [Caenorhabditis elegans] gb|AAM29661.1| Na/ca exchangers protein 2, is
SFITVFASSPYSTRLRAVPFVLSFGGPSRAFVVSVRFVPFXPPNFPSLFFVFLFSIYSSTDENPLNLTPDQLQIAELGKPRLGEFRKCQITIKESKDFQGVVDRMLKTANASFMLGTSSWREQFIDALTVSAGDGDDEETEEGEPSEAEEPAQPSKSDYFMHFLSVPWKLLFATIPMHFLSVPWKLLFATIPPTDYWGGWACFTVSIYWGGWACFTVSILMIGLLTAVIGDLASQFVCQLLMIGLLTAVIGDLASQFVCQL

SEQ ID NO: 154065 - protein, 170 aa, Heterodera glycines
  Coding regions on vcDNA: vcDNA=SeqID_80488; Strand=+; Position=1 -86,135-238,297-374,421-547
  Homolog annotation: Hit_ID=NP_504414.3; Match level="QueryCoverage =96%, HitCoverage=13%, E-value=2e-39, Identity=54%"; Hit description =Na/Ca eXchanger (103.1 kD) (ncx-2) [Caenorhabditis elegans] gb|AAM29661.1| Na/ca exchangers protein 2, is
AFLWLLDTFASKVSAVQDKYADNSIGNVTGSNAVNVFLGIGIAWTLAAVYNVTGSNAVNVFLGIGIAWTLAAVYHWFQGSVFRVDPGTLAFSVTITLAFSVTIFCIEAVICIIVIVARRHKAIGGELGAIGGELGGPRNFQMATSAFFACLWAFYIGISALESYCVIAGF

SEQ ID NO: 154066 - protein, 209 aa, Heterodera glycines
  Coding regions on vcDNA: vcDNA=SeqID_80489; Strand=-; Position=1 -159,1119-1589
  Homolog annotation: Hit_ID=NP_740900.1; Match level="QueryCoverage =97%, HitCoverage=12%, E-value=3e-27, Identity=42%"; Hit description =chorein A (359.3 kD) (1J482) [Caenorhabditis elegans] emb|CAB02304.1| Hypothetical protein T08G11.1a [Cae
MSSDDTFTEKLIAQIIKNLQVHIKRVHIRYEDKFSNRERPFATGITLDSLNFQEAEDALDVFNLNIARQQAEFEIDKQTDLVRVEDQPQEGWVGWAKNWWFGGSPKGKEAVEDAQIFEKFEKESTPMEKSRLYKSIDYQVRMKKEIQMFTITKIGQENVPPMNYPKHFVDNVFKVHLKTLKLKLDNVMELRFSQLSAKLEQRSAASAMR

SEQ ID NO: 154067 - protein, 780 aa, Heterodera glycines
  Coding regions on vcDNA: vcDNA=SeqID_80490; Strand=-; Position=1-2342
  Homolog annotation: Hit_ID=XP_479365.1; Match level="QueryCoverage =25%, HitCoverage=13%, E-value=2e-13, Identity=27%"; Hit description =helicase-like protein [Oryza sativa (japonica cultivar-group)] dbj|BAD32013.1| helicase-like protein [Ory
MPSKQQNLKKKKQDVYRRQAERSVSRDNSPVSDGSADGNGEASASLRGTTTPSLSALQISTPASSIGSKKRGRPSKAGAKPNLATQESVSLIDIHRTVVTQNDQDSPCKKREKVAECDQPMFANEAIALTPVSTQSRGGRPAKKIGGPGRGRLSDSMSKSSEMDNNLENAPIPATSHIVSEKIDFSTVPINFATSRNFACKIWRWAAIGLYERDGETALGPRFIVAYLAYIASISQRKTVVVDSLASRTDVSRFSNVKNYTFGYDPNAVPEVVLMPLHFPNHWTLIVYDVAHGAYFLDSLHMSSLSDERMALIQSIIAEIVPGNASFAVEYVQQLTKQNDGNSCGYFVCLYAESWLMNNRTFVLPDLNINYEKKRILWHINELYGSDIVPFHPREGVSTSFAVVSHHNGDVAQTSSKDIVPIEVDDSAVLPSSEETAVLAQAPVIGENQADTHGVVADTIVQQEPIAQADDVIFVRPKTPPRRSLRVQKRLSASVSRSPSPAPKRPPPANSLGMATPITRRCSAFHKGWQCAAAAAKHFPEYCDSGKLGDKKCADCGAHLFSHEDSNICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQTPEELRFFRMTLLNERRAPAGLKDPKLHPHQIITPSTGEGMFAIHADPH

SEQ ID NO: 154068 - protein, 188 aa, Heterodera glycines
  Coding regions on vcDNA: vcDNA=SeqID_80491; Strand=-; Position=1 -91,143-248,436-600,1031-1235
MGNSCLISDSTRGQTISPPSNDFVAILRRPINTTILIKRQLKNKRTLTKMLSKPRTETAIVLPERGIYLCWHNNIVTSRSDLFHKAMHYCIHASPKMNEIIACGHYCYRDLTKWPKLNRICQAIFKFFDKLINEYKMDEDKMYDACVHLGEMHANYAQYGLKQHFMDLFQQQLLGGRILNIKYGFKMN

SEQ ID NO: 154069 - protein, 25 aa, Heterodera glycines
  Coding regions on vcDNA: vcDNA=SeqID_80492; Strand=+; Position=1 -45,238-270
MTILFDKCRLTSEPKLNLGFWKRVC

SEQ ID NO: 154070 - protein, 252 aa, Heterodera glycines
  misc_feature (249)..(249): Xaa can be any naturally occurring amino acid
  Coding regions on vcDNA: vcDNA=SeqID_80493; Strand=+; Position=1 -79,151-268,319-352,399-477,536-717,998-1056,1338-1422
  Homolog annotation: Hit_ID=T42394; Match level="QueryCoverage=96%, HitCoverage=22%, E-value=1e-54, Identity=46%"; Hit description =potassium channel protein eag homolog - Caenorhabditis elegans
MVVARRGLVAPQNTFLEAVVRRCNNTDSSFILANAQIIDFSSFILANAQIIDFPIVYCNEGFSKMIGYSRAEIMQKNASLSFMYGEHTDQLSFMYGEHTDQMAIQKIQNAMEMAIQKIQNAMETEKTEQVEIELCKKNKSVLWLSVLWLLMNISPIKNDANRVVLYLCQFKDITPLKEPFEGENNKSGRGRGGDEIKNEKRNLEGGMVRRKEEFLEKSAPHLILSYSIIKTEYNFRIFFTIYFKRQKKXFNF

SEQ ID NO: 154071 - protein, 35 aa, Heterodera glycines
  Coding regions on vcDNA: vcDNA=SeqID_80494; Strand=-; Position=1-107
MAPNYFVVLFKHIENVIRQAGKEVDEEPRLEVILG

SEQ ID NO: 154072 - protein, 355 aa, Heterodera glycines
  misc_feature (335)..(335): Xaa can be any naturally occurring amino acid
  misc_feature (342)..(342): Xaa can be any naturally occurring amino acid
  Coding regions on vcDNA: vcDNA=SeqID_80495; Strand=+; Position=1 -90,136-240,290-320,382-464,549-600,648-753,865-923,1144-1251,1300 -1384,1471-1677
  Homolog annotation: Hit_ID=CAE62526.1; Match level="QueryCoverage =96%, HitCoverage=31%, E-value=1e-104, Identity=62%"; Hit description= Hypothetical protein CBG06635 [Caenorhabditis briggsae]
DWSILALTFYTAFMVPFNIAFRPRDPLPLGSGIDYVVLLDSVVDVIFSGIDYVVLLDSVVDVIFFADILLNFHTTFVGPVGEVVIDPNVVIDPNAIRKNYFKSWFLIDLLSCLPYFKSWFLIDLLSCLPYDIFYMFKQDDERIASLFSALKVVRLLRLGRVARKLRVARKLDNYLEYGAATLLLLLCAYVLVAHWMACIWFYLWPSKISVPKPGLLSTDGLIRLSYDLKMPFNITSSNLNRLVGGPDRTQCYVSALYFTMSCMSLYFTMSCMSTVGFGNIASTTMNEKIFGICMMMFSSISYAAIFGHMTTIIQQMTSSTQRYLSMVFSFSAFNXLKVSPKXSANVRVHQIATAG

SEQ ID NO: 154073 - protein, 489 aa, Heterodera glycines
  Coding regions on vcDNA: vcDNA=SeqID_80496; Strand=+; Position=1 -110,172-239,331-480,591-616,721-815,951-1081,1225-1386,1493 -1552,1616-1714,1921-2093,2213-2421,2737-2852
  Homolog annotation: Hit_ID=CAE62669.1; Match level="QueryCoverage =100%, HitCoverage=75%, E-value=0.0, Identity=68%"; Hit description =Hypothetical protein CBG06810 [Caenorhabditis briggsae]
YKVYGQEKVPAGGVVAGIGPICGRLCVIVANDATVKGGTYYPITVKKHLRGGTYYPITVKKHLRAQEIALENCPCVYLVDSGGANLSRQAEIFADKDKFGRIFFNQAQMSAKGIPQIAVVMGSCTAGGAYVPAMADQAVIVHGTGTVFLGGPPLVKAATGEEVSAEDLGGATLHCGRSGVSDYFASDDRHALAIARRIVAGLPAQRKTILFRPFVEEPIYPAEQLYGIVGAKQRKAYDVREVIARVVDGSRFDEFKRMYGETLVTGFAHIFGQIVGIIGNNGILFSESAMIGNNGILFSESAMKGAHFIELCCQRQIPLIFLQNITGFMVGPDAEAGGIAKHGAKLVTAVSCAAVPKLTVLIGGSYGAGNYGMCGRAYSPRFLFMWPNARVSVMGGGQAANVLAQVQRERRLREGGQWSEEDEQQLKQHIEQRFEREASPLFASARLWDDGVIDPVDTRRVLGLALQATLSAQKREGKAAETKFGVFRM

SEQ ID NO: 154074 - protein, 332 aa, Heterodera glycines
  Coding regions on vcDNA: vcDNA=SeqID_80497; Strand=-; Position=1-997
MISRSFVHCSFPAAPVLLILLQPDAIGAVPAPPPALDNGSYAVASGDALLLQHHHFPPPPPPPFCYASSPTEKALNNGGVQNGGLSVNLASNNNDDGQTAINGGLATAGPPSYAEYLALAATAAHHRPGPPRTEECAAANRSGGAAHCQQRESKSSNSTSNRRRMRMKRGSNAGRGRGKPLKKGEAMITLMRKSIGEERAEEEEEKRRCGGRLIAVKAVKGEENVGRAWAAAADCDDGDDEVAANSADDRPSRGQKHSSSSSSLAHQFDSSSADSASPPPPPPFALLLRDPQQRRPRRGLKNNNHLPHPNPNHPHHQKLSRCYRTNSSSSSS

SEQ ID NO: 154075 - protein, 385 aa, Heterodera glycines
  misc_feature (5)..(5): Xaa can be any naturally occurring amino acid
  Coding regions on vcDNA: vcDNA=SeqID_80498; Strand=+; Position=1 -38,121-1031,2722-2909,3856-3883
  Homolog annotation: Hit_ID=DAA04499.1; Match level="QueryCoverage =100%, HitCoverage=28%, E-value=5e-74, Identity=40%"; Hit description= TPA: pol polyprotein [Schistosoma mansoni]
QRNSXFFEKSVEETQTNLVEHKIDTVDTKPIKAKHRPVPYAYREKVAEMINDYLRRGLIRPSFSPWASPIVIVPKRDGTLRFCVDYRGLNSVTVKDAFPLPNIDNTLLALGGRKFFSVIDFMSGYWQIKMEPESVEKTAFVTEFGLYEFTVLPFGLCNAVATFQRFMTRLFDGMVNDSVFYIDDILIASETWSDHLRDLGTVFERIAAGLKLKITKCHFAAKEIPFLGHILTRKGIKMDIDKVKPIINLPTPKTKKELHSLLGFFTYYRKYIFGFGALAKPLFRLLKKDVKFEMGEIEFGAIKTLKKSILDQVVLVLRPTSNNGGQDADGQSGSFTIMCIVAVVSEDSSSKTIESDAANQSTTRFGRIRRRHLCSIVWSSHSVNY

SEQ ID NO: 154076 - protein, 530 aa, Heterodera glycines
  Coding regions on vcDNA: vcDNA=SeqID_80499; Strand=-; Position=1 -1101,1159-1650
  Homolog annotation: Hit_ID=AAA59875.1; Match level="QueryCoverage =30%, HitCoverage=67%, E-value=4e-18, Identity=32%"; Hit description =mucin
STPATPTKQPTPPQPAKQPIPPPPPAKEQPFTAPTPATPKLQKPTPPPAITPAQPISKPTSIPPVNPSPAQIPPKPKSITPITPAKVTPSSPAFKPSAPVSTTQPFLSKPNIVSTPPAPSKPSASIDAIKHPVTTVKPTPPFAKSASSPTQTTKIASPTASAKPKDNKAADKDVKRSVEAPNKNEKESKRILDVDDRFFGGLPAGDEFPDDDDKESEWPYEPFKNIVDDVEIQYLDDFERFKVVLKSPIISHLSFSPQLGYVLGFENPQHVGDQEMAKYGCDLRGGFSSFAVYSKGLTENMIVGNSLSSLLRVVSVSGATPGDYNEKIYDSPIYARVLQREINEIEIELRTMDKGRLVPFAYGTTMVHFYVNKMVHIVFDPSIIGYDEYMQYGSGIESEDYFRGSSPFQRGYGQRGAGVGDVFRGLWRFFLPILRRVGTTVGSEALSTGQRVLERVGNEGVPFKEAFVSEGKKGIDTVLEKGGLPKQFGSGRRMGIKRKRAHAPSHQTIIGRAISKAGNKRIRSDAFGLY

SEQ ID NO: 154077 - protein, 21 aa, Heterodera glycines
  Coding regions on vcDNA: vcDNA=SeqID_80500; Strand=+; Position=1-65
MAKNRSASAQTCKPFSIMRKE

SEQ ID NO: 154078 - protein, 42 aa, Heterodera glycines
  Coding regions on vcDNA: vcDNA=SeqID_80501; Strand=+; Position=1 -44,859-943
MIIDAILFSKKRQKRIIENTLAIECYQELKIWFLLILAVFKA

SEQ ID NO: 154079 - protein, 53 aa, Heterodera glycines
  Coding regions on vcDNA: vcDNA=SeqID_80502; Strand=+; Position=1-161
SRDVPRFRFSHFAFRIIRIFWRFAFRFLARNATFTPLRIGLNSHKIFQNFTYK

SEQ ID NO: 154080 - protein, 150 aa, Heterodera glycines
  Coding regions on vcDNA: vcDNA=SeqID_80503; Strand=-; Position=1 -30,231-338,424-738
MLLKLADYFQVAVLKSRCETHLINCVEIPLIDRFLLIERFGLDNLKNYFLHLNVDKLRFRRACRLGDAGAAYSKKSVDGKLVDDGRRQRQRLQHRSALAVRRRRLLSPVANARRSDRYGDNGAPAEAAGAAVAVNAPVATPKAGAAPTPK

SEQ ID NO: 154081 - protein, 219 aa, Heterodera glycines
  Coding regions on vcDNA: vcDNA=SeqID_80504; Strand=-; Position=1 -150,503-705,957-1083,1173-1352
  Homolog annotation: Hit_ID=NP_496604.1; Match level="QueryCoverage =70%, HitCoverage=57%, E-value=3e-36, Identity=50%"; Hit description =failed axon connections (30.7 kD) (2M555) [Caenorhabditis elegans] emb|CAB55031.1| Hypothetical protein Y
MKASRGLIVRDWKPDVVYLVQFPRTHNVLSPSPFALKLETWLRINGLKYRNVNNEFTKASAKGQIPFIELNGRQFADSNLIIDHLRNHFKVSIDSRLSTHERALGRAFTILIEESLFRCLQYDHSIDFGWLATENGWAVHMSGFQKFLFQKIKLKKFQGFVSFIFIELFVKKKTNFKKYDAICVLVQKRFDGTRLWTPFRDGGGRNREKGPDSTINVIK

SEQ ID NO: 154082 - protein, 74 aa, Heterodera glycines
  Coding regions on vcDNA: vcDNA=SeqID_80505; Strand=+; Position=1 -114,173-283
MADTVLNILQKYDGVRVPNYESVCEGLTGDDYLLAIVKFLARRDKIYNRIYNEIFESVSESLKVFTIFDSENGP

SEQ ID NO: 154083 - protein, 231 aa, Heterodera glycines
  Coding regions on vcDNA: vcDNA=SeqID_80506; Strand=+; Position=1 -72,149-258,1557-1769,1950-2249
  Homolog annotation: Hit_ID=CAE71733.1; Match level="QueryCoverage =44%, HitCoverage=7%, E-value=4e-32, Identity=62%"; Hit description =Hypothetical protein CBG18715 [Caenorhabditis briggsae]
MDQNDHNIVGDEQQHIWVGRYNEKTGWFPAKCVRKLTATSGGTTDGNNMLNYGTIELSGTTESKHDKLVERGLQLFNKRQLSRVYPQASRFTSTNFNPVPMWNSGCHMVALNFQTGDKSMQLNTGRFMANGRCGYVLKPLYLMDETFSINARDHHNHSQQQQHHHQHQLQRPALSSSTFENVPSSPSNDGTAFDKLTEDRDDVPTKLIGDDGQKQRQKMSTGNGTFSAAAM

SEQ ID NO: 154084 - protein, 36 aa, Heterodera glycines
  Coding regions on vcDNA: vcDNA=SeqID_80507; Strand=-; Position=1 -18,311-403
MGPCLVHWIVWNSGGSPARDTTALKCALGLTNGRAL

SEQ ID NO: 154085 - protein, 112 aa, Heterodera glycines
  Coding regions on vcDNA: vcDNA=SeqID_80508; Strand=-; Position=1 -111,159-386
MLFHFMILNTPYLLIRLIAGDDYDEGCEQRNCCNCVAQAKGDQMYLFEITESAWLPHCNGSKAYFRLNNSATYTTCFSVQKVHFGQNGRGIGVFQVQLSWENVPRRMLKTRE

SEQ ID NO: 154086 - protein, 66 aa, Heterodera glycines
  Coding regions on vcDNA: vcDNA=SeqID_80509; Strand=+; Position=1 -174,921-947
MHGGISNKMRSLSGLRFNQKLMFPHLQFIPSGFEPMFNQRLITVFSAPAYTGQTNTGAVQLFFNVF

SEQ ID NO: 154087 - protein, 336 aa, Heterodera glycines
  Coding regions on vcDNA: vcDNA=SeqID_80510; Strand=+; Position=1 -101,148-365,410-607,660-890,988-1158,1235-1315,1363-1373
  Homolog annotation: Hit_ID=NP_498205.1; Match level="QueryCoverage =91%, HitCoverage=63%, E-value=1e-44, Identity=37%"; Hit description =g-protein beta WD-40 repeat (53.5 kD) (3G688) [Caenorhabditis elegans] gb|AAK67207.1| Hypothetical protei
MRSQCQTDGPIRVSSVSSDGIANVTEPMDSQRHKRRLYELFALIEKEMDALLMENCALRAQLGVQSEEKPAFDPPETPTSKNVASVQTVEFESEQKPSGTSSIKKNSSQSKQQRWKSAFKNPSSKLTLKVGANFPESKHKVVQSFKGHSDGVWHISTAQVGNSTHVIASASADQTSKIWFADHGSHPLVSYSGHKGSINSVAIRPETSRVFSSIYGKHLTLLTCGGDRSAHIWNVNLDELMERRKEKENEEPTQQISHPITLLDGHSDVIMAGEWLIGGDQIITASWDRTANLFDAESGKIIKCLSGHDRELTSCSAHPSQKLVATASKDFTFRPQ

SEQ ID NO: 154088 - protein, 166 aa, Heterodera glycines
  Coding regions on vcDNA: vcDNA=SeqID_80511; Strand=-; Position=1 -119,187-357,405-540,590-632,680-708
  Homolog annotation: Hit_ID=CAE59093.1; Match level="QueryCoverage =100%, HitCoverage=13%, E-value=2e-32, Identity=43%"; Hit description= Hypothetical protein CBG02385 [Caenorhabditis briggsae]
MFNYNWEEVPERVLWKQMGTELIPLVPLPKAVLRGARMAKVKTLPRPHPNIIKMYTAFVDRMPILPEAEKLYPEALPNAAENPLTYELKTLHLVMKRYRMTLHDYLELKNDYEKRDPMVGRLLFGQLLEAVVFLHKNKICHRDMKSDNILLDFDSEAEVPHLVLSD

SEQ ID NO: 154089 - protein, 99 aa, Heterodera glycines
  Coding regions on vcDNA: vcDNA=SeqID_80512; Strand=-; Position=1-300
MGMDKHLLFRLMCCCFTCAGWNAETATNVIKAVLAPFSHIFVHMRVAAPMEPTPVAEQAAEEGEEDGQKNGEDEADDEQGPVDPLGANWTKLLPCRKTN

SEQ ID NO: 154090 - protein, 189 aa, Heterodera glycines
  Coding regions on vcDNA: vcDNA=SeqID_80513; Strand=+; Position=1 -49,121-245,293-492,551-711
  Homolog annotation: Hit_ID=CAE60860.1; Match level="QueryCoverage =98%, HitCoverage=83%, E-value=2e-42, Identity=50%"; Hit description =Hypothetical protein CBG04571 [Caenorhabditis briggsae]
LRCARACCRSLEGENQGYFCCGYFCCEPDNVNVVESSGQITDFGQHKREERFAAVYAPGGGFQVDWSLFIVDWSLFIIGLILSIFLSILLSFFCCLLCNGCWLHRRRNPHMYENVGERGEDGFYHICCGFGIPTGTVFSTHPPQFSDGVYAPPSSLSSASRSRVRFNEGAAPKGVLKNGDFQQQQYPTP

SEQ ID NO: 154091 - protein, 69 aa, Heterodera glycines
  Coding regions on vcDNA: vcDNA=SeqID_80514; Strand=+; Position=1 -124,578-663
MAPPLDTAADQLRKLFISTRTRAVSQINEQLADFRRRGQPFAGGIPDFENIDRRTLSLITSIATLIKAF

SEQ ID NO: 154092 - protein, 155 aa, Heterodera glycines
  Coding regions on vcDNA: vcDNA=SeqID_80515; Strand=+; Position=1 -147,451-576,720-914
MDSGICTQASSHSAATAAAMAATPPAAAVASPAASATTAPPTRSQSIKKSPHSCLAGTSSTSCVELNAEAEERRLVELVEKFDMDWGSDLESILNLFILLNLIFLFHAKVDTEIPSLESLVSWEILKHLKPKEKKRQEVVNELYQTGKELRITGK

SEQ ID NO: 154093 - protein, 127 aa, Heterodera glycines
  Coding regions on vcDNA: vcDNA=SeqID_80516; Strand=+; Position=1-384
MGIDPNDQQKREIIKKFDAIKEKIREKGKLEIKNKNKIECKIGKLLGTSRHKIYKWKKELNLNKNKMMKKSFYEQKKKEFIERIDEFKSLYSQGKQKEFVNELGIDEKTFIKWKKELMPKYYKKYEN

SEQ ID NO: 154094 - protein, 16 aa, Heterodera glycines
  Coding regions on vcDNA: vcDNA=SeqID_80517; Strand=-; Position=1-49
EAIPEGFGLPINLGAS

SEQ ID NO: 154095 - protein, 193 aa, Heterodera glycines
  Coding regions on vcDNA: vcDNA=SeqID_80518; Strand=-; Position=1 -216,286-651
MDTTNAPTFTRPTTSKDKLVQYFERSLDNFLDGRYRAMERIPYLTEKEKQMQQQQNTKTDGIGMAQAAHNKTEEEHDEFMEGSGEELVELEENSVPSFSSSISGIPKQIPFIPKVPMDFIVPQEDQPTEIVSKLLELNAKKVEKKIDGMTKSVKSFGNRPKAKGAVLHGKSLAEGDGRMAKPTKQYFQVGDAS

SEQ ID NO: 154096 - protein, 108 aa, Heterodera glycines
  Coding regions on vcDNA: vcDNA=SeqID_80519; Strand=-; Position=1 -205,480-601
MLRLANKNAETETTENYAKQNDDGGGDGFANNAKENGAGQMAAPTMDKQRHGQQQQRGAAVDATATTDVDQMLPQLAAQCREQQTVQRTVVTEPCANCAFFQFWSLLF

SEQ ID NO: 154097 - protein, 297 aa, Heterodera glycines
  Coding regions on vcDNA: vcDNA=SeqID_80520; Strand=-; Position=1 -139,368-579,628-926,1003-1236
  Homolog annotation: Hit_ID=NP_509733.1; Match level="QueryCoverage =95%, HitCoverage=95%, E-value=3e-66, Identity=45%"; Hit description =adp atp (XK950) [Caenorhabditis elegans] emb|CAA89069.1| Hypothetical protein R07E3.4 [Caenorhabditis ele
VIGTQLSDFNQHALKGMAAGAFAAAISKTTVAPMDRVKLCLQARKNSSAHSLPYRGIVDCLRRLCADEGIRSLWRGNSAVIRCFPHNALNLAFRDWFRVAFLDGIECRKRPIRFVAGNVAANVAAGGAGAALTLVFCYPLDLARTRLAVDGVHRGLFHCFSVIRSREGTAGLYRGFLASLNFTFLSRAVFFGIFDSIRLTLAEERRQALSFAAIWSLAQFSIIVSSLVCYPLDTVRRRLMLEAGSEFKQYSTQWQCFSTVCRTEGVLSLYKGALSNSLRCTSGALILAIYYEVLKYI

SEQ ID NO: 154098 - protein, 45 aa, Heterodera glycines
  Coding regions on vcDNA: vcDNA=SeqID_80521; Strand=-; Position=1-136
MSTVPSTSSVIGTQLSDFNQHALKGMAAGAFAAAIFQTTVAPDGR

SEQ ID NO: 154099 - protein, 20 aa, Heterodera glycines
  Coding regions on vcDNA: vcDNA=SeqID_80522; Strand=+; Position=1 -35,631-659
KCSETHKILFTETALKRTKC

SEQ ID NO: 154100 - protein, 56 aa, Heterodera glycines
  Coding regions on vcDNA: vcDNA=SeqID_80523; Strand=-; Position=1-721
FINIFSESALKHTKFYLQVSLGTQMLSLSKREMNKNLKIFNCFLNERKTLGLTFFL

SEQ ID NO: 154101 - protein, 265 aa, Heterodera glycines
  Coding regions on vcDNA: vcDNA=SeqID_80524; Strand=-; Position=1 -207,402-530,583-700,823-946,1013-1091,1461-1564
  Homolog annotation: Hit_ID=NP_067456.1; Match level="QueryCoverage =92%, HitCoverage=41%, E-value=9e-46, Identity=40%"; Hit description =trehalase (brush-border membrane glycoprotein) [Mus musculus] gb|AAF61430.1| trehalase [Mus musculus] sp|
VICCAGNDWGERMLFLRDSKHFVDRPMKNDAKNLVEQFKTVFNVAEWKQFMVENERNPSGQFVQIYTPEDWVENPQNLKNIKDKNLKQWAIELNKMWKELSKKMPNDVKNDNQRHSLIYDNQRHSLIYLSDPFFVPGGRFREFRYWDSFWIARGLLASGMEKSVKNMCKNFAELVNRFGYVPAGGRIYYSKRSQPPFLTYLVYDYLVYDYFGATGDIEFLKEIMPTLEKVSQPKTANLTKTLIIGGQVLLIYYTQNSWGGRRAYR

SEQ ID NO: 154102 - protein, 242 aa, Heterodera glycines
  Coding regions on vcDNA: vcDNA=SeqID_80525; Strand=-; Position=1-729
MAMRYCEQLLNGNDHFKRKATDELLDSQLIRIKLTIKELPAELGTLRVQLEAKDLLAMPQSLVSLKKHCANIEHLLVNAAYCSIDRFQTARDRLLSFAEQLEKDGLEKKDEGISMIGEATEKFVVELKLAIFEAEFRHKIAAFADPCIYGEAFVKLSEQIANEFEDICYMCKKWKNATTKMNIQEQLSNFVSLARDQSVPLKQKFEQKFDEIFEKTKFDLEQLKRRYNTNQIAEKTEMESGL

SEQ ID NO: 154103 - protein, 96 aa, Heterodera glycines
  Coding regions on vcDNA: vcDNA=SeqID_80526; Strand=-; Position=1 -133,691-848
MPQVFKNWLFLGIIWQSIVFKYSIFFPAAPIGTAGLPPFPWTPKNRAEVPTQQTFVELAENLANLKELAENWQSEMSNGDSMVGSRTIRQWALIRQ

SEQ ID NO: 154104 - protein, 42 aa, Heterodera glycines
  Coding regions on vcDNA: vcDNA=SeqID_80527; Strand=+; Position=1 -8,534-654
MARSLKLHRRYHPLQLFNAIYQNENWQKQVLALYPAEYTQYQ

SEQ ID NO: 154105 - protein, 222 aa, Heterodera glycines
  Coding regions on vcDNA: vcDNA=SeqID_80528; Strand=+; Position=1 -220,267-455,985-1118,1194-1318
  Homolog annotation: Hit_ID=NP_505526.1; Match level="QueryCoverage =99%, HitCoverage=37%, E-value=7e-93, Identity=71%"; Hit description =zinc finger protein 277 (71.1 kD) (5K268) [Caenorhabditis elegans] emb|CAA94823.1| Hypothetical protein F
MICEFSTHLLTEHQIFIDGMDIIVDLKRYIEYWRQQFTKRNIAEIFPKICPKPEDDVFGKVGFYFLMDESVKEDYGLRQRLAMRRLEEALACQQREREDSVFSIQCIFCRYMARGNRSKIIHHLYTIHHLNLGSPDNLVFVTEYIEHLREKLLRNECIYCEKTFADRNVLMEHMRKKNHREFYIINYLELGKRWLDVLAEDFEDTMPTFVDSDDEEEEDSWH

SEQ ID NO: 154106 - protein, 434 aa, Heterodera glycines
  misc_feature (292)..(292): Xaa can be any naturally occurring amino acid
  Coding regions on vcDNA: vcDNA=SeqID_80529; Strand=+; Position=1 -57,104-292,859-1022,1068-1199,1246-1601,1657-1704,1756-1839,1930-1992
  Homolog annotation: Hit_ID=NP_505526.1; Match level="QueryCoverage =97%, HitCoverage=56%, E-value=1e-111, Identity=51%"; Hit description= zinc finger protein 277 (71.1 kD) (5K268) [Caenorhabditis elegans] emb|CAA94823.1| Hypothetical protein
DVFGKVGFYFLMDESVKEDYGLRQRLAMRRYGLRQRLAMRRLEEALACQQREREDSVFSIQCIFCRYMARGNRSKIIHHLYTIHHLNLGSPDNLVFVTEYIEHLREKLLRNECIYCEKTFADRNVLMEHMRKKNHREVNPKNNYYDKFYIINYLELGFYIINYLELGKRWLDVLAEDFEDTMPTFVDSDDEEEEDSWHEWQEDNADEGDLFAEDNADEGDLFAVCLFCPHAREKLEETIKHMNETHKFDLIGYIHDNSMDTYDRMKFVNFIRKRGILNSARVLSSSQFYMIXTFNTRTKDQQTMESKCVEIPDKEQWDNEENLVPLFGNDHLLWMLESWHLEQDHLLWMLESWHLEQEMAVTESVVDSPKINMGTLVEESEMAVTESVVDSPKINMGTLVEESKQNAVEGVIAVIAEDLPDLTGSVLANAELQQ

SEQ ID NO: 154107 - protein, 349 aa, Heterodera glycines
  Coding regions on vcDNA: vcDNA=SeqID_80530; Strand=+; Position=1 -243,294-481,1129-1251,1300-1431,1475-1836
  Homolog annotation: Hit_ID=CAE70814.1; Match level="QueryCoverage =57%, HitCoverage=62%, E-value=7e-47, Identity=51%"; Hit description =Hypothetical protein CBG17583 [Caenorhabditis briggsae]
MTTTRESSTEIADRYPFGYSTELSSNHESSICTAKRLRQRLQRQQSGQSGHSFLFWDDQIKRILCEGRRYTGESSEGSSLVGTPTESGRCFTFTAAQRIHRNGATNSTTTTNNNNSTSMDDQRKPSMNQNLSEMLLDVSDRKGPRSHSAAITSDICSVCSHLRVVSILDQTPLAIAVRTQSAEMINLLVSYGADVNSVDEDGNSPLMLAVRDSPLSWHCLHMLILFGAKIQQKNSRGICPLDLAPELRKIQETCVEALFQMACSRPNNASQNASPAALHGTESTQGHHQQGSSATGGNGTNGAAERTEERDANGTKQTAGAAASTQERLMRTAAMISATKQSRKAHLDA

SEQ ID NO: 154108 - protein, 18 aa, Heterodera glycines
  Coding regions on vcDNA: vcDNA=SeqID_80531; Strand=-; Position=1 -17,227-266
MGIFSRFELFTFKKAFYL

SEQ ID NO: 154109 - protein, 93 aa, Heterodera glycines
  Coding regions on vcDNA: vcDNA=SeqID_80532; Strand=-; Position=1 -21,454-714
MLFVSPKAEKGCILDGEENADADATNTDEDKCRLRLATVRALFATIGQYARKYGTTTTDESVAASGDQPTNDYGTLCTAFNACFGSVFLSLIF

SEQ ID NO: 154110 - protein, 206 aa, Heterodera glycines
  misc_feature (18)..(18): Xaa can be any naturally occurring amino acid
  Coding regions on vcDNA: vcDNA=SeqID_80533; Strand=-; Position=1 -268,444-797
  Homolog annotation: Hit_ID=AAS54408.1; Match level="QueryCoverage =81%, HitCoverage=32%, E-value=3e-30, Identity=42%"; Hit description =AGL082Wp [Ashbya gossypii ATCC 10895] ref|NP_986584.1| AGL082Wp [Eremothecium gossypii]
SILPRFSSKSLAIVELIXINQCQSEKDLALFRQLFRQFLEDPHKVNWQEIQPMAKEKQMPYEHLPKVEGSEERRAILERIAVIKLNGGLGTTMGCSGPKSLVQLRDGLTFLDFALQQHRILLNCADLRSPVPLLLMNSFNTDAQTKAFLWAQNANSVAAVKCFCQSKCPRIFADSLRPVPNSWDDRAEEGSVALVLFFVLTIFGFS

SEQ ID NO: 154111 - protein, 52 aa, Heterodera glycines
  Coding regions on vcDNA: vcDNA=SeqID_80534; Strand=+; Position=1 -148,408-418
MAKLIAVNCAKGKFCDGYCYHKHKKTKNKIWWKCELYQHGCKGWGYESNGIE

SEQ ID NO: 154112 - protein, 372 aa, Heterodera glycines
  Coding regions on vcDNA: vcDNA=SeqID_80535; Strand=-; Position=1 -156,280-449,511-666,711-1347
MDFEWAEKRETDFVNFVEQCVAEVGRKFDQICRWYMDSYLPAFDYIADTLKKSFQANEFGFLFFDFNFSKVTLDDLLIRAGNNLRLPRLLIRPTLNKFRIDCVRMVKPILYFPREWVGRSDHVTETLDIEHIDYISSDRTYAIAQTLKAAEQLAFHLLAYAEKNSNIVTSQECWLTSTNEGKKVIHSARSLPGTRKNSTSRNLLNVVTDNEQSEDEEERSKREKAAMELKALAGIETTNNDKEAKMEEQRDDEQMQRKETPCKGTENEGKRPPNCSEDKENNSPVLLLDFDDRSSAPGGSSSEERRTEENALKMNAANGEKQKVGTDFVQMFLLLLFSHLFSPPFVGLWGVFVLRKFLFVAMDSNAFDISFS

SEQ ID NO: 154113 - protein, 142 aa, Heterodera glycines
  Coding regions on vcDNA: vcDNA=SeqID_80536; Strand=-; Position=1 -28,77-477
MNFEFNASKDIHERLEDFLIYWTKIFSNEINDKEFGMEMEMYRINEFLKKIFGELFPQIEALKVSLKGELDLKGLVKKCEKLKFALEKAEEKQKQNEIGKMEMETKQQIEKAKEMVNNILEMLEEKKNSFAEEMAKEAPNSE

SEQ ID NO: 154114 - protein, 178 aa, Heterodera glycines
  Coding regions on vcDNA: vcDNA=SeqID_80537; Strand=-; Position=1-537
MADIVEIIMDNPEDRPFFTFKIVNDFLEKLFNFSTKEILMVDENPQKQKQFKCRAKKVLLKNVNFEKAISVILSREKAGQIKQLINSINNEQNYVKLAAIKNKEMHKTIEQKMKWEIDTLLFNLLFSFAVRLEALVHGKNEEGIIIVEEFGENSKDKIRAFFAVLKCFPMAEWENELM

SEQ ID NO: 154115 - protein, 53 aa, Heterodera glycines
  Coding regions on vcDNA: vcDNA=SeqID_80538; Strand=+; Position=1 -121,292-332
MESLKKQLLLQRELSRGDQFYMNPIDGKLVCRHDYEAGGKVSIWCRQIYQKFL

SEQ ID NO: 154116 - protein, 471 aa, Heterodera glycines
  Coding regions on vcDNA: vcDNA=SeqID_80539; Strand=+; Position=1 -315,362-385,517-613,707-763,814-903,960-1024,1124-1184,1228 -1283,1329-1434,1478-1513,1561-1583,1929-1977,2081-2250
  Homolog annotation: Hit_ID=NP_510091.1; Match level="QueryCoverage =100%, HitCoverage=99%, E-value=1e-107, Identity=47%"; Hit description=zinc transporter ZnT-8 family member (XN84) [Caenorhabditis elegans] emb|CAA92193.1| Hypothetical prote
VFSQFNFEFIFFSLSVQFRPNIFPSIRMVTAPSPPATRPSVSGSSNSSSDGFHCHADADAQNGASDQRRARTVLWMSVGVCFVFMICEVIGGVLANSLAIITDAAHLIITDAAHLLTDLASMLISLFSLYIASRPASQRMSFGWHRAEVVGAFISVVMIWVLTGILMYLALERMITSDYDIQAGIMAITMYLALERMITSDYDIQAGIMAITAAIGVGANLSMGLLLYLGGHSHLSMGLLLYLGGHSHSHSHHGHTHGTRRQTNINVRAAFVHVLGDLIQSVGVLFAGLLIYWKHVLGDLIQSVGVLFAGLLIYWKPNWHILDPPNWHILDPICTLLFSAIVLSTTIYIIRDALVVLLEGRPSTIDFRHVFDRPSTIDFRHVFDALEHIEGALEHIEGVKKVHDLRIWALTMDKVAISVHLEVESAADSQQILRATTLMLRRDFNVHESTIQIEGYQPETANCGQCVVPTK

SEQ ID NO: 154117 - protein, 103 aa, Heterodera glycines
  Coding regions on vcDNA: vcDNA=SeqID_80540; Strand=-; Position=1-312
MSSILTLLLSLSLLLFLLVLALSFGLFVLENRLNDGDESVFSIVLAEFCRFDCFLFFGPSNDDGDEEDDDDNDGDEDDDDDGGNDKAFLAIFDTKLGFPILSK

SEQ ID NO: 154118 - protein, 59 aa, Heterodera glycines
  Coding regions on vcDNA: vcDNA=SeqID_80541; Strand=+; Position=1 -105,980-1054
MKEITEKYKTVQLSGNETDNNDVWLNEDELAKYSEMGIAMNTYDYRMISRINFFVLMVF

SEQ ID NO: 154119 - protein, 135 aa, Heterodera glycines
  Coding regions on vcDNA: vcDNA=SeqID_80542; Strand=+; Position=1 -136,419-690
MFCLLHFTLFTALYVGALGGMCSSKKEKVHDPLPRYMQPTYSFSQKSNAAKSYQSTPEHGYKTPNHPRENLAKLRRTVARNNTIPMSGAKRGPLAASSSAGSYANSPLITHQSQQKNKYLQQRASDASPADRIYL

SEQ ID NO: 154120 - protein, 233 aa, Heterodera glycines
  Coding regions on vcDNA: vcDNA=SeqID_80543; Strand=+; Position=1 -228,830-997,2073-2378
MGKRPLQQRRQHEMNRSKSTRGMLQLEPTSPRYQQLLTPQQTPQHRAMIKVGWMGVEKEWKIIVMLESLISREKSRKRFETPPPQLPSPEVVFKQRNNQLRIEGGQHQQQPQSKRTLTRVNSMGRTQSYANEMKVKHRQRALPLPSSLSVVGAQIGDRMKQQQQKLQQNRQIAQLQIDSPRGMFDDKRILDEKTTEEKEELMDSLWEEFNDEKLISQMDNRPKAGNMKKSGSW

SEQ ID NO: 154121 - protein, 65 aa, Heterodera glycines
  Coding regions on vcDNA: vcDNA=SeqID_80544; Strand=-; Position=1-575
IILRFPKICGVLKNSCKFKNFYKQNLADYLFLLMESAWILFAKNPNIYYIYIYMCQKHQKYLLKS

SEQ ID NO: 154122 - protein, 45 aa, Heterodera glycines
  Coding regions on vcDNA: vcDNA=SeqID_80545; Strand=-; Position=1-136
DQLLSETDVHLDTLLAPPLERGLFYMSKFTLARKRWKQSPAENEK

SEQ ID NO: 154123 - protein, 314 aa, Heterodera glycines
  misc_feature (135)..(135): Xaa can be any naturally occurring amino acid
  misc_feature (203)..(203): Xaa can be any naturally occurring amino acid
  Coding regions on vcDNA: vcDNA=SeqID_80546; Strand=+; Position=1 -65,821-1706
  Homolog annotation: Hit_ID=XP_497341.1; Match level="QueryCoverage =99%, HitCoverage=57%, E-value=8e-28, Identity=32%"; Hit description =PREDICTED: similar to submaxillary apomucin [Homo sapiens]
HFTGPIKSLRVQSKSLCVQSIITGTNPPAFQSLGLILLHSITGTQPSSISITGTQSSGISITGSQIYGIPNTGTQFSSISITGTQFSCISINGTQPSSISITGTQFSSISITGTQSSSIPVTGTQFSCISITGSXPSSIPVTGTQFSGISITGTQSSSIPVTGTQFSCISITGSQLISITGTQSSSIPVTGTQFSCISITGSXPSSISITGTQFSSIPVTGTQFSSIPVAGTQFSSIPVAGTQPSSISITGTQPTSIPVAGTQPSSFITGTLSSSIPVTGTQFSGISITGTQFSSIPVAGTILQHSVAGTQPPA

SEQ ID NO: 154124 - protein, 287 aa, Heterodera glycines
  misc_feature (219)..(219): Xaa can be any naturally occurring amino acid
  Coding regions on vcDNA: vcDNA=SeqID_80547; Strand=+; Position=1-861
  Homolog annotation: Hit_ID=XP_318162.1; Match level="QueryCoverage =99%, HitCoverage=35%, E-value=2e-79, Identity=50%"; Hit description =ENSANGP00000020700 [Anopheles gambiae]
WDWGKECQGAFIKIKEILSSDLLLTHYDPKLEIIVAADASEHGIGAVISHRFPNGAIKAIEHASSSLTPAERNYSQIEKEGLALIFAVRKFHKMIYGRKFVLQTDHKPLLAIFGNKKGIRQMSANRLLRWSLMLLAYDFEIEYVNTTEFGQADALSRLIAKSTSPEEDRVIASMEFEKEAENFFINTLETMSLSSKDIISAGNEDETIKKVKKFVKDGXPNDKAIASETEEIKLFFRRKDDLSITKECLMYGERVVIPPKFRAKVLRMLHKGHPGIKRMKQLARNHV

SEQ ID NO: 154125 - protein, 599 aa, Heterodera glycines
  misc_feature (5)..(5): Xaa can be any naturally occurring amino acid
  misc_feature (193)..(193): Xaa can be any naturally occurring amino acid
  misc_feature (239)..(239): Xaa can be any naturally occurring amino acid
  misc_feature (586)..(586): Xaa can be any naturally occurring amino acid
  Coding regions on vcDNA: vcDNA=SeqID_80548; Strand=-; Position=1 -1768,2771-2819
  Homolog annotation: Hit_ID=XP_318550.1; Match level="QueryCoverage =96%, HitCoverage=59%, E-value=1e-144, Identity=46%"; Hit description= ENSANGP00000020240 [Anopheles gambiae]
SHSRXVVEKELVWGESLGIITKGEHLDWAAPILIVKNADGTARMCIDYSTGLNNALLDHQHPLPLPNDIFATLNGGIFSQVDLKDAYLQIELTAEAKKLCTVATHRGYYKFNRLPFGVKTAPGIFQSVMDKLLAGLEFATAYLDDIIIVSKSKEEHFQNLVFERIQSWGFRVKMDKCSFFQEQIKYLGQIIDXDGRRPDQGKIAAITNMPAPKDVPSLRTFLGMVNHYQQFVKKCDIRXPMDELLKKDKDWDWGKECQGAFIKIKEILSSDLLLTHYDPKLEIIVAADASEHGIGAVISHRFPNGAIKAIEHASSSLTPAERNYSQIEKEGLALIFAVRKFHKMIYGRKFVLQTDHKPLLAIFGNKKGIRQMSANRLLRWSLMLLAYDFEIEYVNTTEFGQADALSRLIAKSTSPEEDRVIASMEFEKEAENFFINTLETMSLSSKDIISAGNEDETIKKVKKFVKDDDKAIASETEEIKLFFRRKDDLSITKECLMYGERVVIPPKFRAKVLRMLHKGHPGIKRMKQLARNHVYWPKLDAEIEDFVRNCEPCQLAAKSSIKAELHSWPKASKPWQRIHILDFAPXKGRTMPFCLYAKA

SEQ ID NO: 154126 - protein, 31 aa, Heterodera glycines
  Coding regions on vcDNA: vcDNA=SeqID_80549; Strand=+; Position=1 -42,88-141
MLKFGKVQWKRNFGLKRFFLAIHVLVFHHSP

SEQ ID NO: 154127 - protein, 290 aa, Heterodera glycines
  Coding regions on vcDNA: vcDNA=SeqID_80550; Strand=+; Position=1 -703,745-914
  Homolog annotation: Hit_ID=NP_507780.1; Match level="QueryCoverage =90%, HitCoverage=19%, E-value=7e-15, Identity=25%"; Hit description =predicted CDS, DNA polymerase type B, organellar and viral family member (5T899) [Caenorhabditis elegans]
MNCTSLCHGCREVGVDYPCEAQQGYFKKCLHCNNTFYNKDCYERHLHKDLCTKFQRCEECGVVYNIKVHGSVGHKCGEKFCRLCKQFHIKENDQMNACMSCFIQPMKQQRIKPYRIIAYDFEATQDKKVENRFEHEVNFAAATIICTDCIINGDWNKSLQGKNCQICGPHRSITFSPFDYTETTVDQKIVTQEPLRKFVEWLLFDHNKKFPTVAFAHFGGRYDITLFIMEIINQGIHTPQIIKQGNRIYELKINDNGHCPLTILRDSYNLMPIKLSGLIKSFGLKIQVKK

SEQ ID NO: 154128 - protein, 345 aa, Heterodera glycines
  Coding regions on vcDNA: vcDNA=SeqID_80551; Strand=+; Position=1-1035
  Homolog annotation: Hit_ID=NP_001004509.1; Match level="QueryCoverage= 99%, HitCoverage=22%, E-value=4e-38, Identity=31%"; Hit description =si:busm1-180o5.3 [Danio rerio] emb|CAD60788.1| novel protein similar to DNA polymerases [Danio rerio]
MTIASACVKNYALNHLKPNSLAIVPEKGYTPQQNQSALSIKFLDWYSHINNVNIQTAHSRYGEYVFKREGQVYQVDGYIKGTNGKRDKIIEVNGCLWHGCEECFCNIDEETKMPNGKTLREIREREEKKHEILSRYVDLEVVWEHEINQKLKKNKQMREFFDNWRDRSPIKIRDAFHGGRTGPMKLLHTAKPGQKISYKDFTSLYPWTNFTTDYPLGHPKIISVPPNEQTVNWRTPTDNPYKGLLKVLLLPPNNNISVNVMPVKINDRLLFPTCEKCAKYFTKKHPNGLKDNDYSCPHFNPNDRAFVSTCTHLELNAALEAGYTVRKVFHVLQYDQWSDNVFKSY

SEQ ID NO: 154129 - protein, 37 aa, Heterodera glycines
  Coding regions on vcDNA: vcDNA=SeqID_80552; Strand=+; Position=1 -22,136-227
MPWKGRRTWVPEKLNFKQIILNSDFGIPFIFCILNFN

SEQ ID NO: 154130 - protein, 32 aa, Heterodera glycines
  Coding regions on vcDNA: vcDNA=SeqID_80553; Strand=-; Position=1 -3,325-420
MVFLRLYFYNRKKYKTMRAISLDERYQVKLEN

SEQ ID NO: 154131 - protein, 76 aa, Heterodera glycines
  Coding regions on vcDNA: vcDNA=SeqID_80554; Strand=-; Position=1 -98,280-412
MGNIIQPMEHTAKNCSDAYEMDSTRLGLCIFEMLFVLIPQYISINSLYSAAFVAPVQIFHDVSINVCVKALLNCVI

SEQ ID NO: 154132 - protein, 34 aa, Heterodera glycines
  Coding regions on vcDNA: vcDNA=SeqID_80555; Strand=+; Position=1-102
MICILTKLKIFLQSKENAIIQWIGYFKCAQAMPM

SEQ ID NO: 154133 - protein, 34 aa, Heterodera glycines
  Coding regions on vcDNA: vcDNA=SeqID_80556; Strand=-; Position=1-102
MVSHAVNGKKRQMKIESKCSSTLGNTGESQSQHN

SEQ ID NO: 154134 - protein, 45 aa, Heterodera glycines
  Coding regions on vcDNA: vcDNA=SeqID_80557; Strand=+; Position=1-137
MWDEHDASNKGRPSLCHHIWKAGKNGQQMAPFRPVYWSSTYVVLA

SEQ ID NO: 154135 - protein, 28 aa, Heterodera glycines
  Coding regions on vcDNA: vcDNA=SeqID_80558; Strand=+; Position=1-84
MAMIGLIPRQCKEMNTEPTSSIVPVYLK

SEQ ID NO: 154136 - protein, 150 aa, Heterodera glycines
  Coding regions on vcDNA: vcDNA=SeqID_80559; Strand=-; Position=1 -153,1204-1323,1365-1467,1513-1586
MVHKFIIVLAVLFFYWSTASATEYHRAVFEGCHYGNDSLAKFRHVNARNSPFVSAMMQWNSIAVEEQRPSFHETGHAVACWLDRHCTKIVIMTIEPAEGSQGETRINYRKLYTKNELTAYMKYFLGSTIAETLIFNNLNRNGAFSDLVAA

SEQ ID NO: 154137 - protein, 71 aa, Heterodera glycines
  Coding regions on vcDNA: vcDNA=SeqID_80560; Strand=+; Position=1-253
QGWAKLKNKKRNAKSEICETEKCEMKKKAKCEKPKYAKMRKAKCEKRNFFYNFLIVKIIKQKSLFKILFQI

SEQ ID NO: 154138 - protein, 23 aa, Heterodera glycines
  Coding regions on vcDNA: vcDNA=SeqID_80561; Strand=+; Position=1 -52,431-450
MVVIFHSFARLARPASANFVTFF

SEQ ID NO: 154139 - protein, 124 aa, Heterodera glycines
  Coding regions on vcDNA: vcDNA=SeqID_80562; Strand=+; Position=1 -171,282-478,568-576
TPKKEKHRFYARLYNKFLLQNNPIGKWRTKITLDKYLYSEWAENYFNNELKKSDEADQTNKVRKRQIIDELNSIWKCFEKYFWLNERKIRENFDQFMRKNRGKFSKMKEPIQICIEFSEIESIY

SEQ ID NO: 154140 - protein, 283 aa, Heterodera glycines
  Coding regions on vcDNA: vcDNA=SeqID_80563; Strand=-; Position=1 -186,231-383,427-939
MNSVLGKIIRMESVLIAYFSKPDKCPALLYDFFFVFSEQSFAIIHFLHHVLGLFNKTIDFFQKEKAILPELLLEMDKFRAKIERRKQERFYGADLAMEKVGECTREALEEQFQSFYTSVLAYLDKWHRIDRFPEKLQWVALASRKIPHDDALALARQIAPELTNDLFDDVSEANQILNSFPNDEFQKLTPEQKWNKLFEANLPHLLKLVSIVLSIPVSNAFVERVFSLCGSQWTDTRNLLQVETVKALVQTKANFDLSCPQMYQMLISNHKLLEKIGGWEKYF

SEQ ID NO: 154141 - protein, 1509 aa, Heterodera glycines
  Coding regions on vcDNA: vcDNA=SeqID_80564; Strand=+; Position=1 -4167,4618-4980
  Homolog annotation: Hit_ID=NP_498959.1; Match level="QueryCoverage =39%, HitCoverage=28%, E-value=4e-94, Identity=33%"; Hit description =zn-finger, CCHC type and RNA-directed DNA polymerase  and Integrase, catalytic domain containing protein
MKAKPMICLPDAPTSIWSLPVDPICPNWVPTQVPVPFALNIYRPNTVQYKTEATACSCILTRISRRRGFFGGTYEEISAFHSVVPTAICRKMAVDKDSPAGELYVNDETLMATNNSLEIGWGKWPSNLFWRTEEIDNCYVYKTIVFTRHGMEGLNTPIGECSNCFYKSGECQCIKISLIWTPDKTQLCPFVWLSKWSGEYASLIWTTESGDFALSFENTSSHSQPGCYAESGELIVSDQAFAVPVSDFQEMVEKAKGSGTRKTRETTEIGPVYSSQLAAQLTALSTKMAITTQRLFTETIRKICTSMQIMADQALTLSITNPSLLARFFLGNPFLSARLITEKLMEVKTCFPIYEGEVHFDWQNGHCFEFLPVTFYLYRQQKHGFIDPNTLIIHTKSKEVDCGNGRFIFMEIFGMIIRYDQKTGNVSQISTEGIREISRYGKIDIPEINLPFFKNKVLANFTELYSRENFKETVEGAKIIQEISRLSRVDSWNSPSEHKNRISGGIVSSGLFSFLRGGILSLNQLWVFGCCCYVTLTIIIQILLPSTIAQALQYLNLGGIFFRFFRFAWHIFFRGKRRGKKPRDEIEEGAYPVEKKTIQKKDSKNRKRLTRTHSVPLTERWPSPEQKPTIPVKKGLKVSVLAIIEWNTRCDETFKIEGFVYGKITRFQLDTGAHVSICSLRTAEKLGIKLLSPEVAGVIGISGEFAPVIGSGKIELELAGVKIITEVAVIDKEIGKGGAYDMLIGRNTFKKTPFYLDLQNGYLIKKGSNEIMECGTSQRKIENLEQHVGKSGNREAERNETEDRQLKSCLEQNKNAFSKHEYDLGTCKIMAPKILTTTELPERVKPYPVPEKYESELKKQIDKMLRAGVIKESHTPWVHNMVLVKKANGQLRPCVDFRPLNKVTIPDPYPLPRMEKVIFRVAGKKFYSSLDLASGFWQIPLDPESSYKCGIITPWGVYQMLKLPFGLCNAPSIFQRTMDKVLDDIKNVNVYIDDILIHSNTLEEHLESLDLVFNRLQKYGLKLKGDKCNFLQNKCHYLGHILSEAGYQPSLGNKEVIDKFPEPTNVKEVKRFLGMASFFRKFIPGFASIAHPLNKLTRGNGTEFVWGGAEKAAMDELKQHLLKAPCLRPPNYDLAFYLFTDASAIAYGGALMQTKDNNEMHAVSFWSRTLTPTESKLPPTHGELAAIVHAIQNFRAILYGAELIVLTDHRPLTFLFQKASTNPKLNRWLMALQEFEPKVIYIEGKANKVADALSRVPIPWENVETKLKEDVPYVLAIESSLNRQTFVKETKDDQIMSKVIAKINENWAEPIEKELEIYFKNRDKLYVEGGIIRKHPQGQFVVPKKLKVAILEQIHKAHFGIVRGKSKARRYVWWPGMSEDIENFVKECEEYRSSPCPILKGNSPAQMFLKREMRTSLDKIRISQVERDKGTPTGDPVRDKGAQNQQRQLPKYEPGDSVWMRDQQDKKWTPAILLEPIGERMWRLEMEGGGERTAHVEQIKARRMVAGRA

SEQ ID NO: 154142 - protein, 64 aa, Heterodera glycines
  Coding regions on vcDNA: vcDNA=SeqID_80565; Strand=-; Position=1-193
RIRICPAPSLCWICYWAKAKSNRRGNIRWLMAAALVEKIQERQQHPFRKEESGKPIKLEPFVVI

SEQ ID NO: 154143 - protein, 206 aa, Heterodera glycines
  Coding regions on vcDNA: vcDNA=SeqID_80566; Strand=-; Position=1 -172,288-376,525-884
MPIKKLSERSVAQNSSTEHLKTELNEANDEIALLRRTNGEQKGRNAKLEAELIKVEKAYNRERELRIKTEENLKRKELEAQATEERRLSEQRMSQLTYERLSRMGQSRNWHEEAGDDNFNCKHEKQIHASIDKWGGKVGIKTMPKRTDAIETLNELLNELWDKCERWEKRKEKAEEGKRKSGKRERKGWMSDQRKEGLIRGEGMDE

SEQ ID NO: 154144 - protein, 42 aa, Heterodera glycines
  Coding regions on vcDNA: vcDNA=SeqID_80567; Strand=-; Position=1 -23,158-263
MSCSYHYCQFLVKPGQIHLGNPSPGSGPGFLTGSSLCLLFDD

SEQ ID NO: 154145 - protein, 21 aa, Heterodera glycines
  Coding regions on vcDNA: vcDNA=SeqID_80568; Strand=-; Position=1-66
ANRASEGLSNDIKKVGLAYLA

SEQ ID NO: 154146 - protein, 50 aa, Heterodera glycines
  Coding regions on vcDNA: vcDNA=SeqID_80569; Strand=+; Position=1-188
SRRRQQPREYKRLPKFLIKFHFFKHFHHFTFSISEYLSEHIFSVSNSIFK

SEQ ID NO: 154147 - protein, 249 aa, Heterodera glycines
  Coding regions on vcDNA: vcDNA=SeqID_80570; Strand=+; Position=1-752
  Homolog annotation: Hit_ID=AAO53177.1; Match level="QueryCoverage =87%, HitCoverage=15%, E-value=3e-17, Identity=32%"; Hit description =similar to Dictyostelium discoideum (Slime mold). Adenylyl cyclase
QQTAPVQHPQQHVGAVRGSQTLPRIAQPARQGQNGTVQSSQLQRGAVPLPRVPTPQPQQQHQQQQQRQVVRTPQLQQQVGAVQGQVPRQAPQQQHEKLVGAVQLPRMTSQQQPSTGTVQGSQTLPRMAPKNQQQPQLQLGAVPLPRMASPQLQQNQREQQHVGAVQQPKMAMAAQQHMPQQVGAVQGNQQVPRMMAPQQQQQWQQQQEIGELGAENGTNRWEEWQECCVQLPAGNSVLGKCMAKMIIWV

SEQ ID NO: 154148 - protein, 188 aa, Heterodera glycines
  Coding regions on vcDNA: vcDNA=SeqID_80571; Strand=+; Position=1 -96,602-868,1804-2007
MGEPQAMFMQSRKDACAKLGAPNESYLCSKSQEKPPSMVPNSVSSPSISPPYANVTPTDDLQCTVPMPIASTVPTKCEEQQTASETMTTPAEQSAEEASIVENVKPTLPTVMVRAKPLTTTEEENMDIENLFSEQQNLPQSQSEDQPQVFDAPKRRFNKGFVETIKSSPSPGEGGIEALPIKHKLYWY

SEQ ID NO: 154149 - protein, 32 aa, Heterodera glycines
  Coding regions on vcDNA: vcDNA=SeqID_80572; Strand=+; Position=1 -21,72-149
MQSVPYMDELWQCILNKQHDWVLINRDAIFRF

SEQ ID NO: 154150 - protein, 203 aa, Heterodera glycines
  Coding regions on vcDNA: vcDNA=SeqID_80573; Strand=-; Position=1 -96,149-375,498-645,1639-1777
  Homolog annotation: Hit_ID=AAN08587.1; Match level="QueryCoverage =75%, HitCoverage=32%, E-value=1e-40, Identity=54%"; Hit description =putative esophageal gland cell secretory protein 21 [Meloidogyne incognita]
LWRHGDRSPTGTFRTDPNQEEVWPQGWGQLSPKGMAQHVILGRKLKARYIDQLHFVSERYLNKEIYIRSTDINRTLTSAISNMVGFYSKGMPGTDYPSERESQWWPHGFTPVAVHTIASYEDHIIPDIPDVPCPRQSKIHEIMQNTPEYRQLMDDNKAFYWPPNSPSFEEMTRNITGCETNSTLNRFVERSEIFKPVPSPDEY

SEQ ID NO: 154151 - protein, 58 aa, Heterodera glycines
  Coding regions on vcDNA: vcDNA=SeqID_80574; Strand=+; Position=1-175
MKISVIIIGLTIFETLFGTIFAGFFDCFFGRDSDERKPSTTNYRKPAPITTSSRWDMD

SEQ ID NO: 154152 - protein, 164 aa, Heterodera glycines
  Coding regions on vcDNA: vcDNA=SeqID_80575; Strand=+; Position=1 -354,673-815
LINQGRGAQHAFDQSLKSSTRKSPEYQSILDEWNKPKSNNNHNNNDIARQKTNVYNRRISRIDHGKSSKQLGQVYAEQRTATSRNRGKNVQGQRSKPLGQNYTGTPRRNPGKNVQSPEVKPQKDEYNLPSHALAGNGKSSRGKSKKHSQKQKIKEELYELSDYY

SEQ ID NO: 154153 - protein, 112 aa, Heterodera glycines
  Coding regions on vcDNA: vcDNA=SeqID_80576; Strand=-; Position=1-339
MSEINSLYEIYKFCGPGGNCAAKKTQFYHHIHNIVQIWREFEQVLLPDEEYERMAREKAHLVTKTEWPQQMDGEGMGNRDNWAREGFANGTNGHWDKQSMGNWSAVDYWPMG

SEQ ID NO: 154154 - protein, 91 aa, Heterodera glycines
  Coding regions on vcDNA: vcDNA=SeqID_80577; Strand=-; Position=1 -91,254-405,871-903
  Homolog annotation: Hit_ID=NP_499529.2; Match level="QueryCoverage =58%, HitCoverage=7%, E-value=4e-13, Identity=71%"; Hit description =ion transport protein (3M891) [Caenorhabditis elegans] emb|CAB03914.2| Hypothetical protein C24H11.8 [Caen
MALIAMCFKLMQDDVVQKARWLGQRIGIIGVHDEVGSEESDFEEEGIAMDGEDDFGIFGGVEDGDELVGADDDLLSVKTEQQNFSFSRQKN

SEQ ID NO: 154155 - protein, 280 aa, Heterodera glycines
  Coding regions on vcDNA: vcDNA=SeqID_80578; Strand=-; Position=1 -80,142-220,315-448,503-575,625-732,786-882,939-1015
  Homolog annotation: Hit_ID=AAM98044.2; Match level="QueryCoverage =90%, HitCoverage=12%, E-value=3e-49, Identity=45%"; Hit description =Uncoordinated protein 104, isoform b [Caenorhabditis elegans]
SEFIFRLTVVECSVKEYTDVFVSFNFLHRHDEAFSTEPSQRDCFLHRHDEAFSTEPSQRDCEGRTSHVTEFKAVVNSAFIHYLQHFPIIFEVFGHLTKVDEQSMFSGTTANNQCKMSKNLSNLQPSLVISTCKMSKNLSNLQPSLVISTPLKSKLSTIKRNSRANSVKSKYDSTIKRNSRANSVKSKYDLLIWFEICEFTSNGEYHPAVVDHVVDHANGLPTHGIFLLHQGIQRRIKITICHEKGDIRWRDCQEVKDIRWRDCQEVKGTLLITPSSFPPP

SEQ ID NO: 154156 - protein, 34 aa, Heterodera glycines
  Coding regions on vcDNA: vcDNA=SeqID_80579; Strand=-; Position=1 -66,231-269
MTQVQFTSNVNAIGAASVGCTTVNVVTNWPEKCV

SEQ ID NO: 154157 - protein, 20 aa, Heterodera glycines
  Coding regions on vcDNA: vcDNA=SeqID_80580; Strand=-; Position=1 -58,206-210
MLKMMPSSALTAADGHKKKN

SEQ ID NO: 154158 - protein, 112 aa, Heterodera glycines
  Coding regions on vcDNA: vcDNA=SeqID_80581; Strand=-; Position=1 -89,152-250,306-491
  Homolog annotation: Hit_ID=AAH77445.1; Match level="QueryCoverage =66%, HitCoverage=12%, E-value=4e-15, Identity=49%"; Hit description =LOC398357 protein [Xenopus laevis]
IVVIGFKPLHLLKDSHRMGAAVFVYPIESVISGSSALYRALLKRCMDKQLFVLVRYTHKTNTPPKLCALVPQSADRIPSGCVSSSIRMDGHSHQMHFLDTRARIFLRRLSFG

SEQ ID NO: 154159 - protein, 85 aa, Heterodera glycines
  Coding regions on vcDNA: vcDNA=SeqID_80582; Strand=+; Position=1-258
MEDGAAPPVGEHDVEEEGKADGAEVTEGSEQTPKLNGGTNLARSTKRMDHLPFANDQMPIEVEMKRGDQLQMDRQSGHLKKQIGN

SEQ ID NO: 154160 - protein, 58 aa, Heterodera glycines
  Coding regions on vcDNA: vcDNA=SeqID_80583; Strand=+; Position=1-190
EHWEKTLWEKERNLFDFRNSKHMTSSAHISRNGDLSSQLKFITIIFTSATSKFSLFYA

SEQ ID NO: 154161 - protein, 330 aa, Heterodera glycines
  Coding regions on vcDNA: vcDNA=SeqID_80584; Strand=-; Position=1 -39,173-202,259-342,391-470,539-639,680-720,762-798,842-885,941 -1001,1070-1263
  Homolog annotation: Hit_ID=NP_498590.2; Match level="QueryCoverage =98%, HitCoverage=97%, E-value=8e-75, Identity=48%"; Hit description =putative NADH oxidoreductase complex I subunit (28.0 kD) (3I312) [Caenorhabditis elegans] gb|AAD37863.1|
MQSVIQAYAEMPPVTRAYVTACVVTTLAVHLELVTPFHLYFVTTLAVHLELVTPFHLYFNWHLIIREWQFWRLLTSFCYLGSVFWRLLTSFCYLGSVGFSFLFNIVFTYRHCSMHCSMLEEGSFRGRTADFVFMFIFGAVFMVLSSIFVHLIFLGHAFTIMVHLIFLGHAFTIMLVYVWSRRNPLVYVWSRRNPFIGMNFFGIFSFSAPYLFIGMNFFGIFSFSAPYLPWVLMFFSLLPWVLMFFSLLLGQTVIVDIFGIACGHLYIACGHLYYFLEDVFPNQPGGFRVLETPRVLKWLFDPAPLPRVDPDQRPGGYEWGGQGDEDRLQT

SEQ ID NO: 154162 - protein, 500 aa, Heterodera glycines
  Coding regions on vcDNA: vcDNA=SeqID_80585; Strand=-; Position=1 -106,155-194,247-438,496-615,663-766,816-921,1199-1346,1398-1525,1568- 1638,1693-1842,1932-2020,2445-2564,2622-2750
  Homolog annotation: Hit_ID=NP_741220.1; Match level="QueryCoverage =100%, HitCoverage=84%, E-value=1e-136, Identity=47%"; Hit description=heat shock protein 75 (3I314) [Caenorhabditis elegans] gb|AAK29856.2| Hypothetical protein R151.7a [Cae
MSRDELVNLLGTIAKSGSKAFRADEKNAAAAEAIIGQFGVGFYSAFVVSEKVSVTTRKLGEEMGHIWSWNGGTHFTVEEKADADIGTKVELHLKAGEAEKFAVPQKVVDVINKYSYFVTAPIFVNGERINVTRALWTMAPSETTPEMHETFFKQLAKTHHPHLADDRPQYTIQYQTDSPINIRALFYVPTKRVSHLEFAADSQRDIAISLYNQRVLIKPNAKEKIRKTLTERCVRFFLSQLSKDRVKYNDFYMGYSMFFKEGVVTEQSNTTKEEIAQLLLFESSSFRSGTLTTLSEYVERMQSDQKNIYYIYAPSRQLAETSPYFELFKDKYEVLFLSDPADELVFLSMPQFRMKSLQSLEKWTKEEGLSIDSDKESSAELMRDSSKKEFLGWLRDSLGTVRVSDIKPSGRQSEHPFMMEHLVMLRPVLHVNLSHPVVAGLMRLKRQNAELATEIAIQVYENALCTAGLLKDTSKMVGRLNKIFAELLQLNAEKSQILTP

SEQ ID NO: 154163 - protein, 258 aa, Heterodera glycines
  Coding regions on vcDNA: vcDNA=SeqID_80586; Strand=-; Position=1 -438,816-1154
MKKELSFTYQISGHEPRYHSWTVFKSLVARDYDELMAKGTATTEFHDQPSSSSSILEMTKTASTTSTATPNVLINNNNSCSSSPLSVETVRPQQNRRHPPDIRNDAENGIVEQENAQFIEQLKTHCNILQPKRPKRQIKLVQDNHRPRNAVNLNNNNMQQFVPTTESFSSPSSSSAPNTAIELTLMNGELSMDSSATISQFHPIVLDNSPTKTLPEDVRNAYEQMLKENSVDYCRQFEQLANLHNDGSPIKTFEEIRR

SEQ ID NO: 154164 - protein, 269 aa, Heterodera glycines
  Coding regions on vcDNA: vcDNA=SeqID_80587; Strand=-; Position=1 -46,1956-2083,2129-2397,2459-2530,2597-2758,3080-3120
  Homolog annotation: Hit_ID=NP_498592.1; Match level="QueryCoverage =99%, HitCoverage=32%, E-value=3e-40, Identity=33%"; Hit description =serine/threonine rich protein (3I318) [Caenorhabditis elegans] gb|AAK29857.1| Hypothetical protein R151.8
KDCEDASDEKECTCEASDFTASSSKCTTNANSVETVDKTRRMYWTFDEQAVFYEALKLHGKDFDAISKFMHGKDFDAISKFMLKKKFNKDKDQVRNYYLNTFKVWKCKAQIEDVDWENIPRDARELFVLLNGFEWRKRLKGLSFDEKKFKQLVMEGVRFLKRKRKKFIVNLKTPYCPALLKYFPCERNCEIPQHLVVRLKPLRNCEIPQHLVVRLKPLRNQDREFVVASEQNPLLMVQINVNDKITSLFELLKCKWSVMRQQNEIKVSA

SEQ ID NO: 154165 - protein, 199 aa, Heterodera glycines
  misc_feature (17)..(17): Xaa can be any naturally occurring amino acid
  Coding regions on vcDNA: vcDNA=SeqID_80588; Strand=+; Position=1 -166,471-592,703-768,840-920,1430-1597
  Homolog annotation: Hit_ID=CAE66863.1; Match level="QueryCoverage =88%, HitCoverage=27%, E-value=2e-43, Identity=48%"; Hit description =Hypothetical protein CBG12237 [Caenorhabditis briggsae]
KLYILNAIKYSIKLLFXLNLNREPRLAQPIQLLTRLHVHVLNPVDAMRSFLDEGVLCFPYGALLDRALAMLGRIEDIVISSAEQINYDEVSSQLARRANVHYRQVVEPEAEKRMSEMYRLSAQQRLQRLDSFLVESSMSRVERESEKARNDMRWELEQLKDQNAQLKKENRELKHLCVRLDGRVDVLERKFKTMARLLQ

SEQ ID NO: 154166 - protein, 236 aa, Heterodera glycines
  Coding regions on vcDNA: vcDNA=SeqID_80589; Strand=-; Position=1 -372,656-835,1223-1381
  Homolog annotation: Hit_ID=CAE56543.1; Match level="QueryCoverage =50%, HitCoverage=15%, E-value=9e-12, Identity=37%"; Hit description =Hypothetical protein CBG24274 [Caenorhabditis briggsae]
MNSADETTAYGSKVGKLEAQIAKLVNDGIKVGMRLAELERKSKSIEHSKSDEFNEGKRNEMANYDEEMEGEEYGREQSEEYGKSGERRAKGGEAARAKAMEAGRLVDVLSPRFMSVTASKSRGKANFLSPSLFSLHTKGHGLERQMSLPNLMKEGVHLVDRDQNEWLNLIMEASGVNEQVDTVKHLLSSADDGYGTDDEIAKKVEKRYKREFDGLYLTKENVRSKWAKWTIVHSLI

SEQ ID NO: 154167 - protein, 99 aa, Heterodera glycines
  Coding regions on vcDNA: vcDNA=SeqID_80590; Strand=-; Position=1 -226,459-532
MAKCIVRLLNNEFEIELKNGKIVAGTKNLVKSENWVGQIRIESESAEENGQTEHQKKKAEKGHESNSAVEKETVNAQSQNLKLPKCGKGKQFLPETNGI

SEQ ID NO: 154168 - protein, 61 aa, Heterodera glycines
  Coding regions on vcDNA: vcDNA=SeqID_80591; Strand=+; Position=1 -140,474-519
MVLLLLLLLLLLLLRPIRSSDHGRIWACGCGGMRVKVEEREAEGRSRFNHPNLMGFGAPPK

SEQ ID NO: 154169 - protein, 433 aa, Heterodera glycines
  Coding regions on vcDNA: vcDNA=SeqID_80592; Strand=-; Position=1-1302
  Homolog annotation: Hit_ID=NP_920205.1; Match level="QueryCoverage =96%, HitCoverage=28%, E-value=4e-75, Identity=38%"; Hit description =putative DNA helicase homolog [Oryza sativa (japonica cultivar -group)] gb|AAP52492.1| putative DNA helica
MNEIVNKKVFREVIAWMYPVENQGRGLPHFHLLLTLAEQDKLINGEDVEKKGISARIPDKELEAELFDLVKRFMIHGPCGNLNPNCPCMEEFVDKNGMKGRKCSKGYPKVFQEETVVLENGLALYARPNDGRTVQVFANGRRHELDNRWVVPHNLYLLKMFKCHINLEKVNSVSSVKYLHKYVHKPPDRARLELEEKNDHDEVKEFIDARYVCPQEAVWRIFELPMYDRSHCIMSLPVHLQGEHICYFDENMEEEEIRERIANGSELMAYFELNKTNVLAKNLFYHQIPEKFCFKKGKWTERKTYFNTIGRMVKVSPAEPERYHLRLLLLNVKGACSYDDLKSVFDTNGNAKVCETFSAACLERGLIRNDEEWKRALEEAESFEMPWKLREFFALILVHCPAKPEELWNMFKDSLSEDFSRNFRKEVAYAKAL

SEQ ID NO: 154170 - protein, 117 aa, Heterodera glycines; identical to SEQ ID NO: 139181
  Coding regions on vcDNA: vcDNA=SeqID_80593; Strand=-; Position=1 -63,162-452

SEQ ID NO: 154171 - protein, 52 aa, Heterodera glycines
  Coding regions on vcDNA: vcDNA=SeqID_80594; Strand=-; Position=1-635
ILTTRDGLLEGRRCKAGTGNGLYPSPPPPHFISPIGLLPSRGALKRQRITSQ

SEQ ID NO: 154172 - protein, 40 aa, Heterodera glycines
  Coding regions on vcDNA: vcDNA=SeqID_80595; Strand=+; Position=1 -59,400-463
MNPVGFKFLDQGRSSDMKGSFGLKSKQISHRKTNQKKEKV

SEQ ID NO: 154173 - protein, 114 aa, Heterodera glycines
  Coding regions on vcDNA: vcDNA=SeqID_80596; Strand=+; Position=1 -84,196-326,372-500
MTAHGDKLAIVEPTGGVIVDSEDDYEHRVSVSVYTVNALSGDCCAPSLDWTCPIPLSPFSRLCWLNFTAVGNLATMDEGIKQTNQSLFFCSCGLKNALSVSIYPALMVASVFGF

SEQ ID NO: 154174 - protein, 93 aa, Heterodera glycines
  Coding regions on vcDNA: vcDNA=SeqID_80597; Strand=+; Position=1 -47,88-220,298-399
MKLFYKKVLRYNDVKSFLNMEQRSQTICGRIRALRMYTFGIELGIDDLANFVAHTTPPAQLRSTLALAFFDPTRQNKMAEFTFAQILAVTHSK

SEQ ID NO: 154175 - protein, 125 aa, Heterodera glycines
  Coding regions on vcDNA: vcDNA=SeqID_80598; Strand=+; Position=1 -13,1184-1548
MYPIFAQQSQPQPFAPVQDPSIRQHLVQILQQQQTQQHQFQLSPPLQRVNNPGLSINPVRMITSGQLIANRQQSQAQLQQQQQEHLLMDSPPAARSSSLHQRIIQHMQQQQLPQLAARLPTISVE

SEQ ID NO: 154176 - protein, 130 aa, Heterodera glycines
  Coding regions on vcDNA: vcDNA=SeqID_80599; Strand=-; Position=1 -277,319-434
MPPKRKNIYLESYEKEFRHIKKSRKGEEFALCVVCNDDINLLSIGKAAISHHQKTGKHQKAAKAANRSIPLQEFLPNTSAPSTEDRKVLAAEGTIAYHTAQHCQSFRSVDCLSSDGLLRTIFPDSTIAKK

SEQ ID NO: 154177 - protein, 39 aa, Heterodera glycines
  Coding regions on vcDNA: vcDNA=SeqID_80600; Strand=+; Position=1 -58,286-347
MAFRDIKNFRKSEFGGPKCHFVSRNYDLKMSELGIPCHL

SEQ ID NO: 154178 - protein, 51 aa, Heterodera glycines
  Coding regions on vcDNA: vcDNA=SeqID_80601; Strand=-; Position=1-200
NFFIWTSLFVTRNHYFGDFVTKIVKNHYFGVLSLFRHFLGKFLNKNAIKTE

SEQ ID NO: 154179 - protein, 227 aa, Heterodera glycines
  Coding regions on vcDNA: vcDNA=SeqID_80602; Strand=+; Position=1 -166,272-468,603-732,787-952
  Homolog annotation: Hit_ID=NP_495273.1; Match level="QueryCoverage =100%, HitCoverage=37%, E-value=1e-45, Identity=41%"; Hit description= TPR repeat containing protein (66.7 kD) (2G622) [Caenorhabditis elegans] gb|AAC46794.1| Hypothetical pro
EEEHAELCYAELLVIRALLTFFIDETLGGFIKGAFRIRMCYQSFKSAPPAVPLPSACPSSNPSLRRQFEAGIRAGFGLFNVMLSAMPTRVSALLQLVGFSGDRAKSTNSQEFQFPFTGLCCPSLLILFLISYQLFLAHLLDGCPPDLALCSQLLAPLVRQFPNGAVVLFLRGAVVLFLRARFHLVNGELNRAIQLNNRSIQSQNVYKQFQHICHWELVSANRISFFW

SEQ ID NO: 154180 - protein, 100 aa, Heterodera glycines
  Coding regions on vcDNA: vcDNA=SeqID_80603; Strand=-; Position=1-303
MANVLELFVDVLRLNGSVVQLNGSVQFAVDQMETGTKEKHNGTLTNEKKDNGQTNLEMETDIGELADQRCQKLGTQRQIGRTSVQQMGQEELVTDQEQNK

SEQ ID NO: 154181 - protein, 47 aa, Heterodera glycines
  Coding regions on vcDNA: vcDNA=SeqID_80604; Strand=-; Position=1 -138,372-377
MALNWTFRKECVIIFVMNLVNYVSLMMAMVHFLYSRRAKNRKRYCIS

SEQ ID NO: 154182 - protein, 923 aa, Heterodera glycines
  Coding regions on vcDNA: vcDNA=SeqID_80605; Strand=+; Position=1-2772
  Homolog annotation: Hit_ID=CAA82797.1; Match level="QueryCoverage =68%, HitCoverage=88%, E-value=5e-50, Identity=25%"; Hit description =gag protein [Ascaris lumbricoides]
MSGPIQKGIINALKALDNAKSATSLLLHPDPDLSNWENAINLEAQFDRVVKEIRTTEMQMDSLRDLSNAWIELLARLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLCNLLGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQAPRTPNQRSRRPNQPMALRDMTFIASSLDEGHRHQGYVSQQHTQQAKKHCQQMRNQVQSVKKGPPYPCIFCNSNHWHDECQNVDTLNQRISIVREKKLCFKCMKPNHRASNCARPSKCYHCKRRHPTALCRDQYKAENGINSPSTSCSEEKPNANDGKRSTVIEQQQMCNAIQSKETRALLMTTKATIFNPSRPSLSMMGTIFIDPGSHRSFISSSAAEQLDLNVLSTEECYLSSFGEREPKRYISDRVEIGILCPDQDRFIFNLNALKFLLNDLPVLQLNALDNDELQQKKLSLPNESRQPDILLGMDVWHQLNVQPIEQLPSGFTICQSKIGNIISGTGRIKLKQPSNISFVLMVNNDESPQSSKAAQRQKNIQQKEKDELRRHQRNKLLSSIATLRSRRKRESAPISSKSIVIDLSSDSDASGIEIIQNPVRDRQAKSPNEHSTAPMPMAVQRLTPTRKSSSVAMRPAFSSSKQPKGKAANPAQTSQTNELNRKMKALSPTASGSGANHHCVATLARSSDSTTVIDKGSQQNCLNMSSATISKTPCQQHSSEKTLN

SEQ ID NO: 154183 - protein, 163 aa, Heterodera glycines
  Coding regions on vcDNA: vcDNA=SeqID_80606; Strand=+; Position=1-492
MQLTARFRKQIHMSSTIEEVQQRMNHNRPQPRRSQQRGLRPTQAPKICQSGMAQYKQGRGIRLHPASSAMALTGPRRRLSEQPLQREQGHESSTSPGRERRPRKSQRHAPDRVSTIWKLKSTENSPFCRPPPSLTAQWLNLAIELFAKNHQARAENAHSPSLK

SEQ ID NO: 154184 - protein, 401 aa, Heterodera glycines
  Coding regions on vcDNA: vcDNA=SeqID_80607; Strand=+; Position=1-1206
MRQNSSPAMARTRIVMSEQNFGIAKEQYDDIVSTTTRWKRGIRPEQLASQLSASQVATSVALNQLYTRECQRNTRAANPTLQARRLLRQPNIQARWIGETTMEVFPCVNISLQDISYRPMNECRLYIPVTAHFPDRAIAAFLDPELRIISLTAQQASCNSYRFHHLQLRSNPNIWLRIDSRTGTARRMPKDYVHELYETTINQTNSNLELHPLIFHAWQLDNESDATRFPHINEFINSEQFKDKLEQHITARTEALGALKGGIEGFTMRWLKGLIDEAITWWIRVACVYSTFLMLRDIVLPCTLAYLLNPIRVTLHSLVGVRPHPTFRPTVSKPLGIEEGMPLREMPRTPKPPARRAEHRSMSPIKLDMIARTARYQQPLTQSHLDLTEDSPFGRPRRKEF

SEQ ID NO: 154185 - protein, 55 aa, Heterodera glycines
  Coding regions on vcDNA: vcDNA=SeqID_80608; Strand=-; Position=1 -8,831-990
MANEECPLLFQTLEVVDEPRGFLGISVSSFLATSRYWDFSLLHLDPIPYHVYSSL

SEQ ID NO: 154186 - protein, 48 aa, Heterodera glycines
  Coding regions on vcDNA: vcDNA=SeqID_80609; Strand=+; Position=1 -7,252-391
MKGNDSGTQGLVPAKNKFNSFNYGPRKNQFVYIFLAVLDYGLMINIFG

SEQ ID NO: 154187 - protein, 196 aa, Heterodera glycines
  Coding regions on vcDNA: vcDNA=SeqID_80610; Strand=+; Position=1-591
MKLHIIFSLLLFLIVLIKINYVEAKKEKLQQKSFDEIFGEKWEEKEEEKRNELKKREIIEKFYKIKEKIKQKGRKYSRKKWNKINLKIAKKLGTNCNYIYKWIKELGLNQKIHKCHKSKTDEEKLEIVQKFIAMKKEYKQIRKYSPKEWRQNYAEICKKIGVGRDIINKWKKQFGISKKRITEREIQKCMTRKLQK

SEQ ID NO: 154188 - protein, 61 aa, Heterodera glycines
  Coding regions on vcDNA: vcDNA=SeqID_80611; Strand=-; Position=1 -7,247-425
MNAIWTLALNAVVFLALMVHKRILAVEMFLTQHGIEIPKRPKYGLMKNAKAIGIQNKNSLN

SEQ ID NO: 154189 - protein, 283 aa, Heterodera glycines
  Coding regions on vcDNA: vcDNA=SeqID_80612; Strand=+; Position=1 -140,235-377,575-728,987-1153,1516-1763
  Homolog annotation: Hit_ID=NP_492459.1; Match level="QueryCoverage =99%, HitCoverage=54%, E-value=1e-104, Identity=61%"; Hit description= pyruvate kinase (65.1 kD) (1J753) [Caenorhabditis elegans] emb|CAB02983.1| Hypothetical protein F25H5.3b
DDAILCKVENGGKLGSRKGVNLPGTPVDLPAVSEKDIKDLRFGVEQGVDIIFASFIRNANGIQTIREVLGEAGKNIKIIAKIENQEGVDNVDEIIAASDGVMVARGDLGIEIPAQKVFLAQKMMIAKCNMAGKPVITATQMLESMICLEAETAFFHSRYFEELLQNTLSPTGPGETIASAAANAARRCRASAIIVLTTTGKSAQECSRFRMPIPVLAITRYEQVARQLQLCRGLFPLYYPHMERDTEWTEDVNKRIAYGIGVGKERGFIHNGDFVVIVTGWQA

SEQ ID NO: 154190 - protein, 249 aa, Heterodera glycines
  Coding regions on vcDNA: vcDNA=SeqID_80613; Strand=+; Position=1 -162,1088-1296,1348-1618,1675-1783
  Homolog annotation: Hit_ID=CAF89501.1; Match level="QueryCoverage =68%, HitCoverage=59%, E-value=1e-16, Identity=34%"; Hit description =unnamed protein product [Tetraodon nigroviridis]
SDWSVEELLVAQGMRCSLIRCVDTDQHSICLAKFACTSPTLSASANLTFAGVEGAIKRIFDVEDGLLWSSDTDNEKTSAFVDSVKKTLLEHFAVDSKLGLLDILYSPKFNKSRIAAFCKELAEVATGGDAFAVELFSDAGKALAQHLVAISRHCDDKMLRELPVLLVGSVFKSWHFMRLGFERCIKESNDAVTDLNRRINRVMLFQLECSASVGAAILSVKQTNDGKMDLCDLKGIQSKKLFDELQLYE

SEQ ID NO: 154191 - protein, 178 aa, Heterodera glycines
  Coding regions on vcDNA: vcDNA=SeqID_80614; Strand=+; Position=1 -231,289-386,448-589,650-715
  Homolog annotation: Hit_ID=NP_004514.2; Match level="QueryCoverage =93%, HitCoverage=15%, E-value=7e-37, Identity=47%"; Hit description =kinesin family member 11 [Homo sapiens] emb|CAI13671.1| OTTHUMP00000059575 [Homo sapiens] emb|CAH72288.1|
MITNFGSCSSVKHKVGPTTKRKNVQVVVRTRPLSEMERNDRCKNIVSCDSVSKVVSLKTNTCDKYSTGQRQFGVFDKVYGHESTQIQVYGDVVAPLMKEVLNGYNCTVFAYGQTGSGKTYTMEGRHDESGAFSWDSDPTSGIIPRALHQIFTELSNEDIDFTVSVSNIELFSDQIKER

SEQ ID NO: 154192 - protein, 108 aa, Heterodera glycines
  Coding regions on vcDNA: vcDNA=SeqID_80615; Strand=-; Position=1 -75,129-182,241-300,342-476
  Homolog annotation: Hit_ID=NP_501549.1; Match level="QueryCoverage =100%, HitCoverage=57%, E-value=1e-53, Identity=96%"; Hit description= vertebrate Rap GTPase homolog, RAS related protein (21.2 kD) (rap-1) [Caenorhabditis elegans] emb|CAA909
MRDYKIVVLGSGGVGKSALTVQFVQGIFVEKYDPTIEDSYRKQLEFDGQQCMLEILDTAGTEQFTAMRDLYMKNGQGFVLVYSITAQSTFNDLMDLRDQILRVKDTDD

SEQ ID NO: 154193 - protein, 35 aa, Heterodera glycines
  Coding regions on vcDNA: vcDNA=SeqID_80616; Strand=-; Position=1-108
HFRLFSPVRSLSLFVVYFAMDLIDFIPRVVEIGFF

SEQ ID NO: 154194 - protein, 138 aa, Heterodera glycines
  Coding regions on vcDNA: vcDNA=SeqID_80617; Strand=-; Position=1 -236,278-356,410-510
  Homolog annotation: Hit_ID=NP_495593.2; Match level="QueryCoverage =45%, HitCoverage=22%, E-value=4e-14, Identity=60%"; Hit description =phosphoglycerate/bisphosphoglycerate mutase (2H888) [Caenorhabditis elegans] gb|AAK31545.2| Hypothetical
MYRRVFCYSSAPLAGALGAYAGVTMANQNSPSTEKNTSEVQQKVAKQAVVKSGTHNSQPKDVQSLGTGEITRWDYNWDKRDPFSMVIGKGYEAADEEKKKEILAKFVPTATRNIFLIRHGQYELDSKTKELTALGIFE

SEQ ID NO: 154195 - protein, 136 aa, Heterodera glycines
  Coding regions on vcDNA: vcDNA=SeqID_80618; Strand=-; Position=1 -81,128-223,302-407,1226-1353
MPFFAPAGRSLQTLLFAFIIGILNNFYQAYSSYYSISAAKSLQNFLNVSYAARGVELSEGKLLWLWSFNLNSLYIGNILGTVFTSWLCEQFGRKSDSVDQKMTLAEIVKEKQQNEEKERPMLQMLRELFTQRHLRH

SEQ ID NO: 154196 - protein, 207 aa, Heterodera glycines
  Coding regions on vcDNA: vcDNA=SeqID_80619; Strand=+; Position=1 -104,297-480,611-769,837-1013
  Homolog annotation: Hit_ID=CAE57723.1; Match level="QueryCoverage =97%, HitCoverage=29%, E-value=3e-59, Identity=55%"; Hit description =Hypothetical protein CBG00733 [Caenorhabditis briggsae]
MSKELCYRCGKPVYPTDKVGPLKDGAFFHQGCFKWANDDREVYCRNHVPNATPHDPTLPLPPSPSNGVEPNACHQQQQMRRHRHNADAGLHDMKIAHAMKVTQAVKPYPKIKHGGAKYIVDYDTQTRLELLHRQDEDKLYQEFDEHRQKEIQQFEEETREEWEKALAEFARRYEQRHATAREKEQLLHDLTLRKERKLEVKRKNHRL

SEQ ID NO: 154197 - protein, 82 aa, Heterodera glycines
  Coding regions on vcDNA: vcDNA=SeqID_80620; Strand=+; Position=1 -83,560-725
  Homolog annotation: Hit_ID=NP_495697.2; Match level="QueryCoverage =67%, HitCoverage=7%, E-value=6e-11, Identity=56%"; Hit description =lim and Transglutaminase Domain (83.1 kD) (ltd-1) [Caenorhabditis elegans] gb|AAN09795.1| lim and transglu
MDSLIFHYNLRSFDTEDAELDGGLSLKRVTKPLTEMVANLHRNGMESRHLQKCVHCSLDDEEVVIELAFPDEGQYGLDIYTR

SEQ ID NO: 154198 - protein, 177 aa, Heterodera glycines
  Coding regions on vcDNA: vcDNA=SeqID_80621; Strand=-; Position=1 -87,139-585
  Homolog annotation: Hit_ID=CAE73547.1; Match level="QueryCoverage =89%, HitCoverage=27%, E-value=7e-19, Identity=34%"; Hit description =Hypothetical protein CBG21016 [Caenorhabditis briggsae]
MKMYNKLKLKFKSDTKGIVKTVDPKREEQTIALLGRFQTTLERTTVKDILFDKKVDMSDQKSREQIILATSEEQGKIDLDAADIQGDEWWDIGQRQTLEDHGHLLNHSFGFYLRMDHELVAPEDTSGVTKAKDANMKDSNMEWYPSDDPRNLLNVRRRTQGGTMPDLFKSAEPMALP

SEQ ID NO: 154199 - protein, 876 aa, Heterodera glycines
  Coding regions on vcDNA: vcDNA=SeqID_80622; Strand=-; Position=1-2630
  Homolog annotation: Hit_ID=CAA82797.1; Match level="QueryCoverage =72%, HitCoverage=88%, E-value=7e-51, Identity=25%"; Hit description =gag protein [Ascaris lumbricoides]
AQFDRVVKEIRTTEMQMDSLRDLSNAWIELLARLTGDNKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQALRTPNQRSRRPNQPMALRDMTFIASSLDEGHKHQGYVSQQHTQQAKKHCQQMRNQVQSLKKGPPYPCIFCNSNHWHDECQNVDTLNQRISIVREKKLCFKCMKPNHRASNCARPSKCYHCKRRHPTALCRDQYKAKNGINTPSTSCSEEKPNANDGKRSTVIEQQQMCNAIQRKETRALLMTTKATIFNPSRPSLSMMGTIFIDPGSHRSFISSSAAEQLDLNVLSTEECYLSSFGEREPKRYISDRVAIGILCPDQDRFIFNLNALKFLLNDLPVLQLNALDNDELQQKKLSLPNESRQPDILIGMDVWHQLNVQPIEQLPSGFTICQSKIGNIISGTGRIELKQPSNISFVLMVNNDESPQSSKAAQQKNIQQKEKDELRRHQRNKLLSNIATLRSRRKRESAPISSKSIVIDLSSDSDASGIEIIQNPVRDRQAKSPNEHSTAPIPMAVQRLTPTRKSSSVAKRPAFSSSKQTKGKAANPAQTSQTNELNRKMKALSPTASGSGANHHCVATLARSSDSTTVIDKGSQQNCLNMSSATISKTPCQQHSSEK

SEQ ID NO: 154200 - protein, 28 aa, Heterodera glycines
  Coding regions on vcDNA: vcDNA=SeqID_80623; Strand=+; Position=1-86
EAGPGREFPVIRGPGSRSRILKNSGPGP

SEQ ID NO: 154201 - protein, 79 aa, Heterodera glycines
  Coding regions on vcDNA: vcDNA=SeqID_80624; Strand=-; Position=1-240
KHFQLSFSIQMAFKLAFFFIAPVLCLSILMIGQMPCQTDAVAVHPAVRTAVRLANTKGGQIALGIVAPSALPGQSNKMT

SEQ ID NO: 154202 - protein, 329 aa, Heterodera glycines
  Coding regions on vcDNA: vcDNA=SeqID_80625; Strand=-; Position=1 -514,906-1381
  Homolog annotation: Hit_ID=EAL44122.1; Match level="QueryCoverage =94%, HitCoverage=60%, E-value=4e-13, Identity=22%"; Hit description =conserved hypothetical protein [Entamoeba histolytica HM-1:IMSS]
MIKKEEADKIAEDPGNVPKVIKTEEKADKITEKITESPPETLEEDEADFDQEDDKRKAAEGVDKIKLMVINEYDRMKNEYKKKKGIKDGKDRYKIEQKIAIELGSNRRKIYQWKREINRMMKKDEGDERPTKAEEQKENERRRELINKFDQTKKECQLRIGYWSEKRHKIEGRIANALGTTCNNIYEWKKEFSNKNNTRKRQQQNENEIKMSIVKKFEKITNKNENDNDNENRIKMECEIANKFGTTREQIYEWKREENLKMDEVSQSEKMRIVKAFDKMKKSKNQTENEIAMKLGTNRRKIYEWKREMRQKETGESGENELGKLGEQK

SEQ ID NO: 154203 - protein, 88 aa, Heterodera glycines
  Coding regions on vcDNA: vcDNA=SeqID_80626; Strand=-; Position=1 -147,412-531
MTKIKQFNIGIHVTDNTGKYKVKFDTDGEVTDCQYESPEMPTWTVQYITVLLTNDPQQLIKPEISCIPQKRCMKMRDVDDLLEKRTSG

SEQ ID NO: 154204 - protein, 180 aa, Heterodera glycines
  Coding regions on vcDNA: vcDNA=SeqID_80627; Strand=-; Position=1 -238,831-904,1335-1565
MGSMINETKKKNLVALFFFLTDCTTFSHCIKKKANLNIVASLDTVLNYGDEIWMEMIISETTKKFYIRLMHESVKPSTKIGDILLLLEFDLSKPDISCRNYLHANQNFSIGNNGTHKLNQYGQHFDLLINATAKHFEIRIDQVGFQLDCKYGIPKDFSKDERFIYPPWAVDKIQVKLEVL

SEQ ID NO: 154205 - protein, 97 aa, Heterodera glycines
  Coding regions on vcDNA: vcDNA=SeqID_80628; Strand=-; Position=1 -27,447-608,665-727,962-1003
MKFTSYSVEKAEPPETFNLYLTRLTDIKIIAQEGYQFSVTFNENKKTYSLPTIVPIWAVNFIRVKGEHIRLLDRPYLPPKTEKQIFMMSLKKVFCVL

SEQ ID NO: 154206 - protein, 48 aa, Heterodera glycines
  Coding regions on vcDNA: vcDNA=SeqID_80629; Strand=-; Position=1 -139,416-424
CFPTKSGPQIEYVSVQRIVAAGEQRMAAQASGFERAMGPANKPVVQNN

SEQ ID NO: 154207 - protein, 89 aa, Heterodera glycines
  Coding regions on vcDNA: vcDNA=SeqID_80630; Strand=-; Position=1 -104,494-658
MCYKNVLLFIVTTVAIFETSFGAENNATQPQKKQELTFEKTMEEMIISAKTGKFVRQCSCDEQEPCLKDILTDFQACFETCWEQKNSGK

SEQ ID NO: 154208 - protein, 36 aa, Heterodera glycines
  Coding regions on vcDNA: vcDNA=SeqID_80631; Strand=+; Position=1-110
MHFDDPLVGRLVHGFNWELAWPCPVGSMFFRPVSAG

SEQ ID NO: 154209 - protein, 45 aa, Heterodera glycines
  Coding regions on vcDNA: vcDNA=SeqID_80632; Strand=-; Position=1-137
LRGLSRALRAGFSIFVGLGRALRARFLNSLNSYGASRPFFSLLGR

SEQ ID NO: 154210 - protein, 120 aa, Heterodera glycines
  Coding regions on vcDNA: vcDNA=SeqID_80633; Strand=+; Position=1 -111,740-904,1637-1723
MLQFRDHITINGTITKNRPQIIILLLNEALESYNSGTNEEVEEHHLKSALTEGQNFHLKIIMRRRPMFHLEGFGKFMFGIETMPMWAIQYIRIEKEKLPREEGRLMDQLRRQLIGYDRAN

SEQ ID NO: 154211 - protein, 150 aa, Heterodera glycines
  Coding regions on vcDNA: vcDNA=SeqID_80634; Strand=+; Position=1 -411,503-544
MVAVFKKRPSTYLRHVLDVVVPAGHGHRHSVPDGTSLPLLLLPVHVCLVAVLTVPFGHLLVRWLGKMLLRPKLSSLLLLTISSGSGGGTKHLTKNTTPATAATRTNKPKLLGITKSGAEDDNWGKVTQSDPKDNRLKTSEKKLELFSGLC

SEQ ID NO: 154212 - protein, 543 aa, Heterodera glycines
  Coding regions on vcDNA: vcDNA=SeqID_80635; Strand=-; Position=1 -757,821-1137,1193-1750
MKSLVKMSPLACFEYNGHSFTFFEDSESGETTIFRGHQHKIVQRLSKHGRVVFDHLSGRLFLIDKYQRRISEIELEYLEHWWLRKNQSSAHTILKSNFVAFLPPDKSDFTLVDNHVFVIRDQRIYKFHIGEYAKGNRALTFVTNSNDVRFNYLIYKPKDQNVSRGVFAHLRMSDAWMPISYLFNLFLIVLCTYILKQLRRVNQKSPLNVSDSADYYSSPFIDDAYSSQHQQLLNIPYETATSSDQSGGARSRKKLLSFYIIVTIYLPAYCMQRAIRYLIDSYGLSSVDDLYTCLKEEIKSGPEGGNCLYPNPLCAVDCVHVANADHPNQPVHIDGSLELIADVELYSTCYPKRKFEGIERTSVCGAEGPEDLSGRLAAVSFTPLRTSAQQQQQQQQQQHGPDRGRVGFGQLLERRRTRKRDCNLVRVLCRFNNCGPYRLTKQLQKRRTENLAYLSQLDIETVHLRRNIKIIPDALCPNGANQVFAYRGFLGITVQQHLYTRHRVMLKYPSLPCVVQFGGGHHRDIFPIELLRVASAEIQSERG

SEQ ID NO: 154213 - protein, 301 aa, Heterodera glycines
  Coding regions on vcDNA: vcDNA=SeqID_80636; Strand=-; Position=1-906
MVMVPESEYLALINLLKGNSAVSPPLGDPLQGEKTLLDVQIQKNLVDPKTNAEIKMKRHSWLYKRRHQLKDIIENKPQKVIVESGSVTAPNVAPYMGIQKQQTPSHVSTPHRNSASIQSIGAVSKSNTDVEEDTDFSTASDQFEPAADAATTSSKKTPHQKTPTVSLRTSPKNFPKMMGIIGKDHKKFGVNASSGEILTNFNKPVSGSHFTESLKHLTGQREDVPRGHRFFIQRISKDPEMMKLLQKIPQTGEGRRRSTVKKMGKKKLVLVNMMNSSSIKTAGLHRTEPKRKFKPELWARL

SEQ ID NO: 154214 - protein, 138 aa, Heterodera glycines
  Coding regions on vcDNA: vcDNA=SeqID_80637; Strand=-; Position=1 -228,337-525
MLIAPPPVKILYCYSEMNDSVIGLMKQGIETYNGVPTQTLVQSMPKPLLLILDDLMLSVNNDFLDLLFTRGSHNWDVRTVGSQLFPKRLNYFMEAYNDATSEPFSYLVINMHPNAPESERLTTKIFPDEQREVYLPIE

SEQ ID NO: 154215 - protein, 264 aa, Heterodera glycines
  Coding regions on vcDNA: vcDNA=SeqID_80638; Strand=+; Position=1 -474,518-838
  Homolog annotation: Hit_ID=NP_001004509.1; Match level="QueryCoverage= 97%, HitCoverage=17%, E-value=3e-38, Identity=34%"; Hit description =si:busm1-180o5.3 [Danio rerio] emb|CAD60788.1| novel protein similar to DNA polymerases [Danio rerio]
MMDGLLKVKVIPPKILLYPLLPLHIDDMLLFPNCWACAKRAKNEFVMTKDVKKCNHRPAQRAFLGTFTSIELRKALELGYRIVGFYRAYHFEQFDSQLFKGYVRMFLKIKVEASGWPAEVKSEEEKRAFLKMYKAKYDINLDYDKIGLNPGLRMIAKLGLNSLWGKFSMRNTLSNTEIVGSMERWMELGRDNTIEFGRPVKISEEISRVVYRKKEEFIREHKVSNIVLSLWTTSAARIKLYEYMEQVYREEGSKLLYCDTGGQE

SEQ ID NO: 154216 - protein, 114 aa, Heterodera glycines
  Coding regions on vcDNA: vcDNA=SeqID_80639; Strand=+; Position=1-345
MTREYADSEILEFVSAGPKQYALKLRRKKDGVIWHKTKIRGMTLDRRNEFKYELFKEMVLDYKEGVKKVFHYPEKIGPTNDFRVLSKNVQKEYTPVQKKGIIDDHFNVLPFGYY

SEQ ID NO: 154217 - protein, 72 aa, Heterodera glycines
  Coding regions on vcDNA: vcDNA=SeqID_80640; Strand=+; Position=1 -102,328-444
MQTIAGIKNFEIVDGVRVFVVRARIENVTEAEYRDEVKSLAGAVCTMKVGARVKEFGGKKGIYYSLIDIVSL

SEQ ID NO: 154218 - protein, 101 aa, Heterodera glycines
  Coding regions on vcDNA: vcDNA=SeqID_80641; Strand=+; Position=1 -102,142-261,508-591
MQTIAGIKNFEIVDGGRVFVVRARIENVMQAEYRACTLCRKGACSCGAEKKMTPYLKVSVADDTGILENVAFFGFGSCWSERKVVAFQKKKKSNLPVPEEL

SEQ ID NO: 154219 - protein, 155 aa, Heterodera glycines
  Coding regions on vcDNA: vcDNA=SeqID_80642; Strand=+; Position=1-468
MNFHKSEKANAILLEAAKRETERAWKDVVALEEEVSDFAKSSRETLNRAIKSREKAPYANGVREFYIKISDSIWEIFTILDKINVESEKAEAVWRELEKCKDFELATKFEEKSINALTEAHRLHFESRRVHNKIRAYESRLQNIVWEFIGLRGEI

SEQ ID NO: 154220 - protein, 118 aa, Heterodera glycines
  Coding regions on vcDNA: vcDNA=SeqID_80643; Strand=-; Position=1 -83,269-542
MRRSEKGRSAFPCPRENGRKWKLAEKFRSNPSEPLDTNAMAQKFLMQFANTLFTVNQEFPMEYVQQKRGTGRRKLPPGKVNLMDSIRMATTYTLKLVVERMEGAVNLNTAPEEVLIFN

SEQ ID NO: 154221 - protein, 29 aa, Heterodera glycines
  Coding regions on vcDNA: vcDNA=SeqID_80644; Strand=-; Position=1 -66,900-923
MTYLLSICPQQFIETHGTARNTVRHADLN

SEQ ID NO: 154222 - protein, 177 aa, Heterodera glycines
  Coding regions on vcDNA: vcDNA=SeqID_80645; Strand=-; Position=1 -240,349-642
MKCTASFRKSKENELKSVVGYCEEHCDSESAFICPFNFMKNETKQRPTDGDDPSVFRILSTVSAIGRVKLSELPLLCSSQAQNSSKSVADYQKLTRQLILSGLLRMCLQFNSFMKCTAFVSLSFKGYQQMEVTKQIELAEFEKRALEMNLAAHNLSDLQFQLTEESAAFDELESDEL

SEQ ID NO: 154223 - protein, 39 aa, Heterodera glycines
  Coding regions on vcDNA: vcDNA=SeqID_80646; Strand=+; Position=1 -80,711-750
MPEPFPMSDKRPWTVCLKFDLDLGITRAIPQFHRLVPNK

SEQ ID NO: 154224 - protein, 264 aa, Heterodera glycines
  Coding regions on vcDNA: vcDNA=SeqID_80647; Strand=-; Position=1 -236,287-555,691-776,848-984,1067-1135
  Homolog annotation: Hit_ID=AAF26076.1; Match level="QueryCoverage =55%, HitCoverage=22%, E-value=6e-21, Identity=42%"; Hit description =putative DNA helicase [Arabidopsis thaliana]
QRCNCGDFAINFTYSGPNDEIEEWHCNIDIFIDRNLILIFFNGKTTIPCAVFDAERMARDVYINRIPTFKLLYVTPERAVKNRQFLKYLRYLHRMNLLARFVVDEAHCVTQWGNSFRPDFLQLGDLMKKFRENAEKKVPIMALTASTSEGDCRKAFQYLGMDCESALWPNLNYRVIPKSKSNFKQTVHGLLSDIGNEMNVKRPLLCSETLRNRIFPVYPRDSKDFTKTSGWMGAFVCSVPLPRLEWALTKGTFVSSFTAQCRDH

SEQ ID NO: 154225 - protein, 86 aa, Heterodera glycines
  Coding regions on vcDNA: vcDNA=SeqID_80648; Strand=+; Position=1-261
MPLTVEEEDAKLALTADDLRVQMTDGMVGCIGRISMDGTELPKTGQGFRMFNAAIGCEERTLGPCLRWTNGRKGKKTDKFQNYDEK

SEQ ID NO: 154226 - protein, 166 aa, Heterodera glycines
  Coding regions on vcDNA: vcDNA=SeqID_80649; Strand=+; Position=1 -66,365-578,652-872
MPIGERKNTAEEDKMKGVELAKIDRACSAAADTQKQKATSSKKGTANKTTRDDGRSDGKGKDEGKSTDYLTMKPVHRAKPFRLIPKASRGGGGENPPPPPMHRTPLLNMRGRRSNGTNMEHYDSPSDALDYADGYEENNDGEQDNGRGEERRGGGEEEEKEKTSKR

SEQ ID NO: 154227 - protein, 127 aa, Heterodera glycines
  Coding regions on vcDNA: vcDNA=SeqID_80650; Strand=+; Position=1 -120,327-500,587-676
MGFFNFLLVIIVLSNVCICKGKNNVEFMLLPSLVGDFKYRVSVQFDNEKFVVNYGNKQPKTKSELVQLYFGTEALKAEIYTFHIEMVDTKHIVGFSIWPNNYSKQLIADEITKKPFRYFWELFPSGN

SEQ ID NO: 154228 - protein, 296 aa, Heterodera glycines
  Coding regions on vcDNA: vcDNA=SeqID_80651; Strand=+; Position=1 -294,404-559,612-680,973-1038,1226-1306,1379-1456,1503-1649
FGGPGLLQEGISVTNGGTHRIYFPNYFYLNISPKISAKTDKFYWVEVNCHDASREAEKYSTYTQKSALIVLNCAQNCAEYEILVRKLDKKCLTNAMKKKLNLYNEKAKKGQIAVKILNGEEYEFVFQQASPFLKRVSDNSNNQRNTNKQQKLDIKIYEKPINNTEEINEQQQEKFVQVFTFMKNEMSNMRKQDEKKFEEIIKKMKELQKQIEESTTNKNEAENSSLSQITAANVSNETVAIVKLEYEKKFELMSVEMGQLKEQITSMKHQIGQNESNFVRTIEEIKRFMEEQFKDE

SEQ ID NO: 154229 - protein, 269 aa, Heterodera glycines
  Coding regions on vcDNA: vcDNA=SeqID_80652; Strand=+; Position=1 -54,89-158,548-1233
MSSLAPFNELNIITGDRRQNLLKVRQLIAKIERERAKNEAVNHTEKLLIGFLDPMTMIVKENSEIQTCNEGQFKTLLLNNKLIKINQLTGKYTFIGEPTIYKIDQKIWGEENLPIFPLQIFKQLILTNLTNKQIDMLEMLHAFRTSRIIDNRPNEDRKIWNSNQFQAFTFQNLITEIDWWKYVIRSVVLVIIINWVYKIYKWKQKIMIRKEIEKRNSQNFQQQTGAIQIPLAALKQRFVGGVSAPTTDAAEMPENAERIKCQKQKRRRK

SEQ ID NO: 154230 - protein, 63 aa, Heterodera glycines
  Coding regions on vcDNA: vcDNA=SeqID_80653; Strand=-; Position=1-271
RDVPRFRFSHFAFRIIRIFWRFAFRFLARNATFTPLRIGLNSHKIFQNFTYKLANFQGKPVYK

SEQ ID NO: 154231 - protein, 180 aa, Heterodera glycines
  Coding regions on vcDNA: vcDNA=SeqID_80654; Strand=+; Position=1 -66,433-654,700-954
MNVTPMPFETESDGFFIQEHVSEYSFLGYLNGMKSLTSVIFLLLSLLVNLSTLIAYRRSKKVHQQNSQNGSDVIEKKLLIYALLTFAGHAFVSVFLIIMGTGVFYDYPSIVYTQYPWINDLCTLVLSSWMLLFTSSIFRHQFVKDFCPKCIWPMPTNTFQTPVTHLTQQNQNDCRLFEKP

SEQ ID NO: 154232 - protein, 50 aa, Heterodera glycines
  Coding regions on vcDNA: vcDNA=SeqID_80655; Strand=-; Position=1-151
MSKVSCQDNNNWLAAFSKPLFTTGSDAYMPLKDFGFNPNSLETDLWAKRQ

SEQ ID NO: 154233 - protein, 84 aa, Heterodera glycines
  Coding regions on vcDNA: vcDNA=SeqID_80656; Strand=+; Position=1-255
MRRFVNSAKCQRFVNSMIRQLDDSSTQPKCDDSSTQPNVNDSSTQPKCDDSSTQPNVNDSSTQPKCDDSSTHPKIVLKSSFKSF

SEQ ID NO: 154234 - protein, 107 aa, Heterodera glycines
  Coding regions on vcDNA: vcDNA=SeqID_80657; Strand=+; Position=1 -51,993-1233,1550-1581
MEVPTVGEDHEDLEEDAVGMLIVEGQNLRNLVRRLSPDKISSVVRLLTAHFAVGRDFGLQFVNPNAFTPAQLAIRQINALINNIDHSNGTAVANAGHFLHELVNAFE

SEQ ID NO: 154235 - protein, 130 aa, Heterodera glycines
  Coding regions on vcDNA: vcDNA=SeqID_80658; Strand=-; Position=1 -164,333-453,897-1004
MCRARQNPIPIKSPIPIMAKNPINCDSDYDYPIPIMAQNPINCDSDYDSDSAHPCGQKNTFFYGRRTGRNEKPRANRPCSRDQPSGCPCVFMFGRIIYAFKSQVGDENWNNFVAQIPEPLKQRLGTQYQL

SEQ ID NO: 154236 - protein, 20 aa, Heterodera glycines
  Coding regions on vcDNA: vcDNA=SeqID_80659; Strand=+; Position=1-7,85- 140
MKKSRTSRKVSCFFDFGLQD

SEQ ID NO: 154237 - protein, 673 aa, Heterodera glycines
  Coding regions on vcDNA: vcDNA=SeqID_80660; Strand=-; Position=1 -117,159-719,764-1025,1071-1389,1433-1988,2032-2208,2881-2910
  Homolog annotation: Hit_ID=NP_507780.1; Match level="QueryCoverage =87%, HitCoverage=44%, E-value=2e-61, Identity=28%"; Hit description =predicted CDS, DNA polymerase type B, organellar and viral family member (5T899) [Caenorhabditis elegans]
MNNIMRQRDAAIELLHNCGIDINEYSYGVEQLPNVQKYWDEIYPGKYRVVAFEKSADPRKSIRVLWKAPMGREKVVPIFLENGHWDGLKNYVCFFNRGRKFCIDCECFFDKDVKHTFDCRARCYYCNRVGGMPCEKESGVKIECPKCHRYFYNWECYNYHQGHQTCKLWKRCVICDKTYLFNTKKGHECGETYCQLCSVSHDPKRGCYIMPIEEKEEKDVYRIVVWDSETSQDSIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPYYYNKKENYGIRLEHLPPMEDYSPGSMNKDKFIKFEKWYNENKETPFYLDDELKNYCRNDTEILLLSIIEFRRILINDITKGFDPLPRSCTNAGVAMNIFKAMFLLTEQLSIVPEKGYERCDRASVMAIKYLEWRSQRDGIEIRHAGNGREVKIGNYKLDGFIGNEGARDKCIEVMGCYIHGCLNCYDPAAELIGGRTAQELNDETQERLVELRKTLDVEEVWGCQIEKELKKDEEMRGFFDDRGNEKGPIDPRMAYAGGRTGPMKLFAKSDEKKKISVYDINLPSLSPKI

SEQ ID NO: 154238 - protein, 24 aa, Heterodera glycines
  Coding regions on vcDNA: vcDNA=SeqID_80661; Strand=-; Position=1-74
MSFKRVNSFQPTVPLAKKWDFRSI

SEQ ID NO: 154239 - protein, 28 aa, Heterodera glycines
  Coding regions on vcDNA: vcDNA=SeqID_80662; Strand=-; Position=1 -14,621-693
MCILRNWGTFEEEYLNGEIFGRKEKQTV

SEQ ID NO: 154240 - protein, 71 aa, Heterodera glycines
  Coding regions on vcDNA: vcDNA=SeqID_80663; Strand=-; Position=1 -155,252-312
  Homolog annotation: Hit_ID=NP_500641.1; Match level="QueryCoverage =91%, HitCoverage=11%, E-value=8e-16, Identity=58%"; Hit description =solute carrier family 23 member 1 (4F535) [Caenorhabditis elegans] gb|AAK39264.1| Hypothetical protein R1
MVSLSVLVSIPFLISDEVCPGRDRDQLRVRLIAATFVTCGIGTILQTAFGMRLALLQGVAFAYIPSVGVKP

SEQ ID NO: 154241 - protein, 203 aa, Heterodera glycines
  Coding regions on vcDNA: vcDNA=SeqID_80664; Strand=-; Position=1 -263,609-738,892-1110
  Homolog annotation: Hit_ID=NP_496426.1; Match level="QueryCoverage =93%, HitCoverage=45%, E-value=1e-49, Identity=50%"; Hit description =phosphatidylinositol glycan class M (2L639) [Caenorhabditis elegans] emb|CAA90090.1| Hypothetical protein
TKNASNLAFFQISLASFALSVAFCFALYGHPFLNAAFLYHLSRVDIRHNFSPYFLPLYLVRDSPFTQLIGLIAFVPQIVCICVFALWYSDDLPFCWFLTTFAFVSFNKVSTSQYFVWYLCFVPLLFTRLKFSWQMWLKLFALWLFGQAFWLLPAYLYEFRGWATLNWVWFASLTFLGINTFLIIQFVRNYSPEEERMVEVDRQ

SEQ ID NO: 154242 - protein, 49 aa, Heterodera glycines
  Coding regions on vcDNA: vcDNA=SeqID_80665; Strand=+; Position=1 -116,339-372
MKKALQFYRSADKGHRSLSCMKSHFRFIKTESELKMLRSLLNSMQYVLC

SEQ ID NO: 154243 - protein, 221 aa, Heterodera glycines
  Coding regions on vcDNA: vcDNA=SeqID_80666; Strand=-; Position=1 -216,743-856,939-1274
  Homolog annotation: Hit_ID=CAE67478.1; Match level="QueryCoverage =98%, HitCoverage=70%, E-value=3e-59, Identity=47%"; Hit description =Hypothetical protein CBG12982 [Caenorhabditis briggsae]
MGQQRAEEEGRRLPPFDHHSVCRAYLLGCCPRDLLSDTRLESMMSCRKLHEPAHKGEFNRAQEKKDLFYDIEAFEELDDAIRIVDADIRRLQEKVKRDAEQNMDISEQQRTQKVFEMNEKIGTALVQVEALGNEGRIAESIELSKEVDELKRKKRELESEMRNMNPAMMQRLRVCEACGAQLNIMDHESRLQDHYGGKMHLGMVEIRDRFAEMKARVLSTQ

SEQ ID NO: 154244 - protein, 43 aa, Heterodera glycines
  Coding regions on vcDNA: vcDNA=SeqID_80667; Strand=+; Position=1 -66,495-560
MGGRHANLDTLRKIECVCAFEMKNIPRHGTKSAPFLVPPCQNR

SEQ ID NO: 154245 - protein, 47 aa, Heterodera glycines
  Coding regions on vcDNA: vcDNA=SeqID_80668; Strand=+; Position=1 -125,654-672
MPCHSLEKRCVNGQRLMPCYAKHVPSVVELQACGGMGTAFWRLKENT

SEQ ID NO: 154246 - protein, 258 aa, Heterodera glycines
  Coding regions on vcDNA: vcDNA=SeqID_80669; Strand=+; Position=1 -90,1373-2056
MGKKECGIIFSTQVSTSPTRSEDSVVTVKTIRNKGRVFNVDHGFRSNVCTRTETPVYNLPPPPPPPQLKPKGNERGTDEQTTQKFFESITAATTGLDVPQKKHGEANEFFDALTAATMGMEVDENKEKKALPQPQSNASDFFSPISAATMGISGDHLKPKPKLRQHLPSASDFFSPISAATMGISGDHLKPKPKPRQHQPKASDFFSPISAATMGMSGEQKKDEPNSNQQKKDIPEFASAISAATMGMSNYELQQQLP

SEQ ID NO: 154247 - protein, 74 aa, Heterodera glycines
  Coding regions on vcDNA: vcDNA=SeqID_80670; Strand=-; Position=1-224
ASDFFSPISAATMGISGDHLKPKPKLRQHLPSASDFFSPISAATMGISGDHLKPKPKPRQHQPKASDFFSPISA

SEQ ID NO: 154248 - protein, 254 aa, Heterodera glycines
  Coding regions on vcDNA: vcDNA=SeqID_80671; Strand=-; Position=1 -144,191-811
  Homolog annotation: Hit_ID=CAE56414.1; Match level="QueryCoverage =99%, HitCoverage=60%, E-value=8e-27, Identity=31%"; Hit description =Hypothetical protein CBG24106 [Caenorhabditis briggsae]
MTDQGKEFTAAPVQRFFNEKEVQHHCMHTSPQWHAGIAERAIRSIKVVERLYRYFTHRGTQCWTGVIQHLVSALNASPHRALSGLRPRDVNFANAEQIRRQQLESSKHVRGRNPRPPRFNAGDRVRIEKHKHVFKKGYLPRFTDEVFTVAEVRDSRTPTTYKLRDDTGELLTGWFYAQDLCLVLPPPAPPQRPTQQGAEASAAAAAAAVVGPVYDIERVLKRRRQGRNGVEHCLIKWKGYSAAHNSWIPATSII

SEQ ID NO: 154249 - protein, 293 aa, Heterodera glycines
  Coding regions on vcDNA: vcDNA=SeqID_80672; Strand=-; Position=1-879
MKHTTRMLLVPEELYRSLLARSSAPVADASSARGGLPQHTTPIEHTAKRMARAAHSGGVTQSTDGVSPASKQQHLLNDDKRLIHYQQEFKRFKKLLEDEQERPAPVRLTQLPTDEASKGLLRDALSEAARTIQQQQQPQPKQPAPHQQQQQSSHSDSSPMRQPPRRRQRPAKRSPRTTSVSTDGAEASRFPSSSSAASLLTRTDNGGRGGAETTEREDSPNDDRPQNMAAVGPARKGQREEADVQLHPSTSTATAAPAAAVAAALRDTEQRKRQAIDYALRNAGTLGIGDGQQ

SEQ ID NO: 154250 - protein, 17 aa, Heterodera glycines
  Coding regions on vcDNA: vcDNA=SeqID_80673; Strand=+; Position=1-53
GLADENFQKPHSASKKA

SEQ ID NO: 154251 - protein, 105 aa, Heterodera glycines
  Coding regions on vcDNA: vcDNA=SeqID_80674; Strand=-; Position=1-330
PGLKCPAQAKIFFYFREKIEIFPKKIPVDRARKTMFWKWSPFFWENSLKNHKIKKPENRFLGLTRKILKIFEILKSGKIELSKLYNKSAGATSLRSNPNELFAWY

SEQ ID NO: 154252 - protein, 277 aa, Heterodera glycines
  Coding regions on vcDNA: vcDNA=SeqID_80675; Strand=-; Position=1 -169,340-1004
  Homolog annotation: Hit_ID=XP_522969.1; Match level="QueryCoverage =94%, HitCoverage=86%, E-value=2e-31, Identity=33%"; Hit description =PREDICTED: similar to putative protein family member (XC187) [Pan troglodytes]
MQWKPEVRTKVIRRGAKVIRRGTTVIKGGTTVIIRGATVIRRGATVIRRGTKVIKRGITVIKSGTKVIQRGISVIKRRTKVIRRGAKVLRRGTKVIQKRTKVIQRGTSVIKKRTKVIKGGTKVIKRGTKMIKRGTKVIQRGISVIKKRTKVIRRGAKVIRRGTKVIQKRTKVIQRGTSVIKKRTKVIKGGTKVIKRGTKIIKRGTKVIQRGISVIKGGTKVIKRGIKVIKRGTTVIRRGTTVIKRGIKVIKRGTTVIRRGTPWLGEVLPLGKRYNMV

SEQ ID NO: 154253 - protein, 56 aa, Heterodera glycines; identical to SEQ ID NO: 141389
  Coding regions on vcDNA: vcDNA=SeqID_80676; Strand=-; Position=1-597

SEQ ID NO: 154254 - protein, 38 aa, Heterodera glycines
  Coding regions on vcDNA: vcDNA=SeqID_80677; Strand=-; Position=1 -106,222-232
MLKTFVLRLDRVYRSRVMDSYSHCMGCYCYCTDSLELF

SEQ ID NO: 154255 - protein, 214 aa, Heterodera glycines
  Coding regions on vcDNA: vcDNA=SeqID_80678; Strand=+; Position=1 -562,661-743
  Homolog annotation: Hit_ID=AAO53177.1; Match level="QueryCoverage =91%, HitCoverage=13%, E-value=2e-33, Identity=40%"; Hit description =similar to Dictyostelium discoideum (Slime mold). Adenylyl cyclase
MHTKNKFSPVYSNPSYPFNSNNLYNGYNPSNNNNAYNPYNNGYNPYNNVNNPNNNGYNPYSNGFNPSNNRYNQYNNGYNPYSNGYNPINSGYNPMNNGYNPSSNGYSPINSGYNPINNGYNPYSNGYNSGYNPMNNYNQYSNGYNPYSNGYNGGYNPMNNGYNQYSNGYNPYSNGYLNNNGYNQNSNDCFTASMVQDQRACSAMQRTCSNPVGN

SEQ ID NO: 154256 - protein, 144 aa, Heterodera glycines
  Coding regions on vcDNA: vcDNA=SeqID_80679; Strand=+; Position=1 -137,1435-1729
MAAEAAQNGDDADKTATGRTDNPETTTKTMEGQAEEQEMEDDTEQRTTTKTVMSGGQQRQQLAGQSSVVAGDSDDGGEEDNDNCTTTTTTPTYINTSSCSIILDDHQQQQQQSDAEEQDEEDGAENDGGGNAEENAQNGDGGEE

SEQ ID NO: 154257 - protein, 109 aa, Heterodera glycines
  Coding regions on vcDNA: vcDNA=SeqID_80680; Strand=-; Position=1 -37,72-364
MCIIISYDDDQHAKTVGIRIGTVLVIQKLNFQNAKISIFTIHTFMVPNRVLPAADRPAELAQFVVKLYWTLKMDAMVAANIFHIVTGQQKLNVTDSEVQVDHLKEQPTN

SEQ ID NO: 154258 - protein, 176 aa, Heterodera glycines
  Coding regions on vcDNA: vcDNA=SeqID_80681; Strand=+; Position=1 -53,222-434,704-788,962-1139
MALLVSRATVLFASSYTVVYNCQPWSTVGGEECGKVYGIATEEDHPMRGPGRVFLLTMLSSGAVQLLSCSSDLAQPFQLIATTNHFPYKIRQMAFADDRLLILTDDGFFGTIDLTLQMINLNFAVRDIQFLLASDNVEDVGGDHRIHFEGPIQFDDKLGQFSWTVSSWQNPVGHHE

SEQ ID NO: 154259 - protein, 63 aa, Heterodera glycines
  Coding regions on vcDNA: vcDNA=SeqID_80682; Strand=+; Position=1-6,74- 153,410-515
MPPVAVFFRGYLRDGNACTEHVIYNIILCFFLWVPGMVHAFWYCFSDMFSGPKKEGAGYSKNA

SEQ ID NO: 154260 - protein, 43 aa, Heterodera glycines
  Coding regions on vcDNA: vcDNA=SeqID_80683; Strand=+; Position=1 -48,383-466
MQNNRASEGLSNDTNNFDIVYEANLHVDDLFRHNQEFLMCHFY

SEQ ID NO: 154261 - protein, 30 aa, Heterodera glycines
  Coding regions on vcDNA: vcDNA=SeqID_80684; Strand=-; Position=1-168
ADPQNVQPTKCPSLEFEFFIIQTGLRLGKG

SEQ ID NO: 154262 - protein, 203 aa, Heterodera glycines
  Coding regions on vcDNA: vcDNA=SeqID_80685; Strand=-; Position=1 -342,386-654
MANRRSFLTGTFTLKGVKAFNSENDFVLRGTVANKENGQSAAAAPLKALSERKRPKRLPKNLQMNNDVDGRLSEKQTDNLQLLAPEAMRSMKEFFWRLLIEGRYNKLMKMTREIAFIGSDRHNSQNKLNEQHFLSLATFALAFARHSHISCQNVYATFSVEFFHMVTSYMTNCFELMKADRHSIRKYAFYARHAIRNFKEMMI

SEQ ID NO: 154263 - protein, 231 aa, Heterodera glycines
  Coding regions on vcDNA: vcDNA=SeqID_80686; Strand=-; Position=1 -165,441-542,628-954,1123-1221
MEMPTETKEREREMPEVEIGGECFGTARGAAPVATKTTESPQKLGIQMGEEWRNHFSITTSMPNSIKELFSARNNEIINSANDGSDLFGTTELRLELVKIQPELSHSFIESLIQLLPDPECLVNVQIVHQNKMPKEMDFECTYETPNNAKNSGQSLKVQEKSPARGKKSSSLVDNCCKLLLDLVDESGAVGVSEEELKERMSVHNFDVEMVQQQLNKLVETADVVICGIDE

SEQ ID NO: 154264 - protein, 172 aa, Heterodera glycines
  Coding regions on vcDNA: vcDNA=SeqID_80687; Strand=+; Position=1 -456,758-820
MGISCSSAAGTSVPVTKVTPVTGSSNGSSDGGGGTTPLQRIPGIASALAAAVVAVQQQHHNNNNVPPWPSGTPPNNATHPSLDTPPIRQPLAQRIFSPAVSNSSSLSMSSGSSKSSSGVSSATSNALLQSPGSSGTTMMTGLNNSDVGKEFRLRSTLFPYVRRILLKKIRRT

SEQ ID NO: 154265 - protein, 227 aa, Heterodera glycines
  Coding regions on vcDNA: vcDNA=SeqID_80688; Strand=+; Position=1 -503,568-748
SLSAEPSSQRKRHSSTGSPISVQSLDEGIETKTERDKGGNQKPRQIKQTRKSNEVARLLNDLTAGNCTDELKKEGTNESKNGKKRARLEELNNQKEGNETKEKEFDHESGPGQKHFGRDKCDQKERHGTEIDNDYFLEEKMAGKYLKMKSQKTNEQTLFLGKWVGQNGSWQYMAERSQKLASQGSKPNVRGDGTDSTPTKKDGRTGVEKGQKNLQSQFAKIERKRPL

SEQ ID NO: 154266 - protein, 339 aa, Heterodera glycines
  Coding regions on vcDNA: vcDNA=SeqID_80689; Strand=-; Position=1 -201,261-476,552-711,987-1058,1106-1161,1213-1403,1448-1569
  Homolog annotation: Hit_ID=NP_494930.3; Match level="QueryCoverage =88%, HitCoverage=43%, E-value=8e-69, Identity=48%"; Hit description =putative protein of eukaryotic origin (84.8 kD) (2F343) [Caenorhabditis elegans] gb|AAK31510.3| Hypotheti
VSSFGGTDEQQQQQFQCDEVEEELMLMMKLNGHKNGVGPSSESATVYEQILNGKNGRRVENEPEVYSGKTGLDLPTIHLDKFETEVKACHTGPDGGLTKVSEDFEKARNSFEVQVQPIRQRAIATMAKLDDEEFSLSSLDEDETTEAVLPPSGRSRKGKRRAKNSLSRTPNDSLDILDSIDSKKNPEKTTTPPILALADGVNWGEGARLAARCAIRGAIEQLNLAIERDSFKTTNDVFHCLLGSFHAAHALILQEGGALTTLCVALVAPVRASSSFVLCACNVGDSLCFVFDDKNGVREVTLASHDIGQMRDMRDAGGALGPVDGRNPQLQNLTCSMTI

SEQ ID NO: 154267 - protein, 89 aa, Heterodera glycines
  Coding regions on vcDNA: vcDNA=SeqID_80690; Strand=-; Position=1 -104,234-399
MARTTTTTESIGTEDEANREFVQSLRIKALQHLQRSLESLSSLTANSLMLNEALQPSEETPNEDEEEKSWEEKEREEEEEETEQQNVPN

SEQ ID NO: 154268 - protein, 180 aa, Heterodera glycines
  misc_feature (35)..(36): Xaa can be any naturally occurring amino acid
  Coding regions on vcDNA: vcDNA=SeqID_80691; Strand=-; Position=1 -249,311-430,690-854
  Homolog annotation: Hit_ID=EAL33309.1; Match level="QueryCoverage =75%, HitCoverage=8%, E-value=6e-45, Identity=63%"; Hit description =GA20452-PA [Drosophila pseudoobscura]
TINARFASTVTTNGIAPSEQQQLNTTKAKERHKGXXGEVFLFPNDTIFAEGQPVWLIGWFPIIFELSCIINRCKLDVRTRSLTVLFVLFELIKTYGGTFGADAWSDLFRVIFRIFDFGKISELGNEKNEWMVTTCNHALYAIVDVFSQYYASLGTLMLPEVYRQLFWCVQQGNELLARSA

SEQ ID NO: 154269 - protein, 156 aa, Heterodera glycines
  Coding regions on vcDNA: vcDNA=SeqID_80692; Strand=-; Position=1 -348,397-519
MNLQAHASAPNPVPVRQAIADARGNIPIEVRMQQGTSASAMSRTYRNYIAREKVERGDDLLDLADISQIVIPERLQNQLLLDRIVDQQRMFVFASPFSRNLLEQYGNHVAVDGTFKCAPAHFTQIYTISVLIDKVAVPCIYGILNSKSENTYANVS

SEQ ID NO: 154270 - protein, 120 aa, Heterodera glycines
  Coding regions on vcDNA: vcDNA=SeqID_80693; Strand=-; Position=1 -63,1530-1572,2073-2329
MAQPTQYHGKLMHSLASIPKAIIVDFFYQITLFTAVLVICARRELISARKRDNNKIHATNSNNLSEDDVKPTKSGGFRHSLERKFNAFKDIYICLVSVPNSKQKQMDIPFTGLIRSKINP

SEQ ID NO: 154271 - protein, 128 aa, Heterodera glycines
  Coding regions on vcDNA: vcDNA=SeqID_80694; Strand=+; Position=1 -56,917-1124,1250-1372
MRECWISVPVIQNIFDEGGRNLCSFTNLQQKTNQQKDETQRKFHLLRNQATAFGIDAKECINFPWYCVGWAICVPGCNPPKAISLNSEANSATSVPSLWTSKIVRSAPFTSKSNQMPTTSIRFVQTPV

SEQ ID NO: 154272 - protein, 40 aa, Heterodera glycines
  Coding regions on vcDNA: vcDNA=SeqID_80695; Strand=+; Position=1-120
LLILLDILPRFEHQQVGQLEKALWNGRKCSLFRLGNNHTF

SEQ ID NO: 154273 - protein, 33 aa, Heterodera glycines
  Coding regions on vcDNA: vcDNA=SeqID_80696; Strand=-; Position=1-103
CCMLERGSQLTSNTTFNELKEISFKIAFVFTIT

SEQ ID NO: 154274 - protein, 118 aa, Heterodera glycines
  Coding regions on vcDNA: vcDNA=SeqID_80697; Strand=+; Position=1-357
MPPPHPLPSTPQHPHRYGGLHTIFEDTVEQKAGHEKDVRQQKEQRSHTSSAATVNTEAMVREAHRVTSQLAAAIPEPMRSAVTSSVAIPILVSAAQSGGGRKEATQHNSEEEEEKERN

SEQ ID NO: 154275 - protein, 87 aa, Heterodera glycines
  Coding regions on vcDNA: vcDNA=SeqID_80698; Strand=+; Position=1-266
  Homolog annotation: Hit_ID=CAE56395.1; Match level="QueryCoverage =95%, HitCoverage=10%, E-value=2e-10, Identity=43%"; Hit description =Hypothetical protein CBG24082 [Caenorhabditis briggsae]
YRPNYSDHVYTVDEARSTNPQHYLLKDYYGTKLKRKFYLPELTKVQVDENTMYRIEKKYKERVRDGKREMLVKFIGFRKNIGSQMKK

SEQ ID NO: 154276 - protein, 364 aa, Heterodera glycines
  Coding regions on vcDNA: vcDNA=SeqID_80699; Strand=-; Position=1 -64,321-516,562-727,777-893,944-1064,1114-1544
  Homolog annotation: Hit_ID=NP_507780.1; Match level="QueryCoverage =84%, HitCoverage=18%, E-value=4e-22, Identity=28%"; Hit description =predicted CDS, DNA polymerase type B, organellar and viral family member (5T899) [Caenorhabditis elegans]
MYPRGLIDPEYNCDHFEDSERASGYPASCTEAGISEEESARRKQEHIDKAKEKAQVPLEADRIKHNPGLRYLSKLCLNSLWGRFALRNRLTKTEIVECHAELAKLLNDSKIEVSSIDQLTEKFWMVCYKAKDEHVVEHSTSNVAIALWTTSAARIHLLESLKKVYGPAPGVERFDTRILYMDTDSIFYDYLTRLGDPLPGGEQLGELADEYPNHTIMEFICAGPKAYGLWLRNNATGEDEYKLKVRGITLDSDACERITFEKMKDMVQNKLGQPDNNVRFNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 154277 - protein, 123 aa, Heterodera glycines
  Coding regions on vcDNA: vcDNA=SeqID_80700; Strand=-; Position=1-372
MMERLDEDKNLAIESNGKGNNSKNVPFTPFKRCYGMGCPSCFPDDAQLWGGGETAGALRARDAKRTRDIAREFEVEVIWECHLNAMLEDNPAMKAYFDNCPDSGPIDFHDAFFGGTFFHLIFN

SEQ ID NO: 154278 - protein, 115 aa, Heterodera glycines
  Coding regions on vcDNA: vcDNA=SeqID_80701; Strand=+; Position=1 -147,211-255,445-599
  Homolog annotation: Hit_ID=NP_510253.1; Match level="QueryCoverage =100%, HitCoverage=11%, E-value=3e-37, Identity=63%"; Hit description= synapses of Amphids Defective SAD-1, serine/threonine kinase regulating presynaptic vesicle clustering (
MASLQVDGSMLETSCGQCILLNIFFIVPIIQKHFPKKGSPHYACPEVIRGEKYDGRKADVWSCGDDNLRNLLEKVKKGLFHIPHFVPADCQTLLRSMIEVDPAKRISLQEVLKHP

SEQ ID NO: 154279 - protein, 214 aa, Heterodera glycines
  Coding regions on vcDNA: vcDNA=SeqID_80702; Strand=+; Position=1 -27,107-238,287-330,377-538,788-1005
  Homolog annotation: Hit_ID=CAE63138.1; Match level="QueryCoverage =77%, HitCoverage=15%, E-value=4e-39, Identity=55%"; Hit description =Hypothetical protein CBG07440 [Caenorhabditis briggsae]
EMPVAQVVTHIIPNEENIDPDVFRHMTNLGCFKDKEKLVTELLSPKHNTEKIVYFLLLDRKRRRPAKVYFLLLDRKRRRPAKEDELEVVEDELEVVHRGSALNIIDPPRKRIDQTKPRFPLSARRADGSPMNARRNRWAKIKLSRQSSLSGSPECSPHPSPRPFFGEGWQQQHKFDIFNDLNYQQIVSASYNNSINCAAALLLPRTITQMSRQL

SEQ ID NO: 154280 - protein, 38 aa, Heterodera glycines
  Coding regions on vcDNA: vcDNA=SeqID_80703; Strand=+; Position=1 -73,991-1034
MSNVLCITVVVSAMIAGSSSISLHAEILWRDIKPWSKW

SEQ ID NO: 154281 - protein, 105 aa, Heterodera glycines
  Coding regions on vcDNA: vcDNA=SeqID_80704; Strand=-; Position=1 -251,523-590
VAAHLHYSIDKLIFVPINPNGNEKLVKLIDFDRAQIIRICNNSEPCNEIEEEPAIMADTTTVIHSTLDIGKYSSPEIFVGNKQLSVKADIWSRGISVYEAILVAK

SEQ ID NO: 154282 - protein, 200 aa, Heterodera glycines
  Coding regions on vcDNA: vcDNA=SeqID_80705; Strand=-; Position=1 -204,248-438,809-993,1102-1124
MGFMLSIFIFVLLKTLKFSSPFITNCNGFVTENMLPFEEFISTKNDGHEHNIWKTVFSIDSKPSADGQVFGGYMNEEKVSRNAQNFVEKCVAIKIAINRIQEQQIINGVQVLEEIQKIEESKRKHIIGLIDYGTLTSRPAETENAYSVLIMELGGISLREQLGRRLHFEMPMEEVELIKEIKRMAQPLKELHQEQNIFIK

SEQ ID NO: 154283 - protein, 97 aa, Heterodera glycines; identical to SEQ ID NO: 146978
  Coding regions on vcDNA: vcDNA=SeqID_80706; Strand=-; Position=1 -175,337-455

SEQ ID NO: 154284 - protein, 56 aa, Heterodera glycines
  Coding regions on vcDNA: vcDNA=SeqID_80707; Strand=-; Position=1 -22,1023-1170
MGGGWGGEECPVAWMGRGLALHAKPRVGPCPIVSAGHFRVPRGAMDRTDQNANRSE

SEQ ID NO: 154285 - protein, 214 aa, Heterodera glycines
  Coding regions on vcDNA: vcDNA=SeqID_80708; Strand=-; Position=1 -206,394-484,654-676,1312-1636
  Homolog annotation: Hit_ID=NP_065811.1; Match level="QueryCoverage =50%, HitCoverage=8%, E-value=3e-09, Identity=30%"; Hit description =HECT, C2 and WW domain containing E3 ubiquitin protein ligase 2 [Homo sapiens]
MLRFANDMDLVMAISILEQYNRQSEGVERLGGRQRTNGGGSDAILEQKLAQFHQCLERAGHGKGPGRIRFRLRRDHLMNDAFEKVLTVGAEQLKKCQMMVTFDCEDGPLRLDDLRDLDPQLWHSLCWLRDHPIGGAAEEEKEEENEVTDQPTTLALAFCVTEEVAGEVNDGKRRKKATIETIANRLAFVQTLGEMPKKCMGLDWNTWNRLMDDI

SEQ ID NO: 154286 - protein, 253 aa, Heterodera glycines
  Coding regions on vcDNA: vcDNA=SeqID_80709; Strand=-; Position=1 -68,373-520,552-663,728-859,908-1041,1130-1174,1636-1758
MIWPAQMAVTLIPTIAISAFVLRKPELLEHWRSDGRRICGKHFHSVIDAKHELLLENIGMFLITIKNLFKLNSADRRVMVTIRRLDFPCNRETCSSYVEVKAKQDKVATGARLCCAGVPAAIYADIGAEVVIILSVDDANQRNHTGFDIEYKSISSLAQFEVPSVRSFFSTKYIPIYVVFKFKPSFSNANNANRGTILPAPKIANNTIQWPNMPNIASSPNNTVQAPSMVIAEFSLIKLTIFSKRLLRQFPTI

SEQ ID NO: 154287 - protein, 131 aa, Heterodera glycines
  Coding regions on vcDNA: vcDNA=SeqID_80710; Strand=+; Position=1 -351,391-437
ADHLENKLKSVDNKTDSIYQWLDNAIGVMCSYKFEFQMDENVQQMRTNLCEQKSIEKAAEILQKTTGKSEYVIDLSIFKTFIQKTQNFTSFIKDQNIKNLRKFVGYFGAAIKKCYAVPSVDSRKVKGQTGF

SEQ ID NO: 154288 - protein, 67 aa, Heterodera glycines
  Coding regions on vcDNA: vcDNA=SeqID_80711; Strand=-; Position=1 -104,146-242
MTVTFNTEFRLIEWVPMLEEVAREFGCITPLPNLGSHRDYRVSGCLMIRTLTSLNRLYIFDAEDCIE

SEQ ID NO: 154289 - protein, 527 aa, Heterodera glycines
  misc_feature (479)..(479): Xaa can be any naturally occurring amino acid
  misc_feature (483)..(483): Xaa can be any naturally occurring amino acid
  Coding regions on vcDNA: vcDNA=SeqID_80712; Strand=-; Position=1 -1515,1586-1663
  Homolog annotation: Hit_ID=NP_498506.1; Match level="QueryCoverage =95%, HitCoverage=84%, E-value=2e-88, Identity=36%"; Hit description =RNA-directed DNA polymerase family member (3I9) [Caenorhabditis elegans] gb|AAA21080.1| Hypothetical prot
FTVNNYSLDFDTSFSSPTINDVEFNIISVGKVLKTLPNRNNTSPDGITFRLLKNCSLSFTPFVTEIFRLTLDTGKLPTIWKQSIIIPLHKQGEKSNPMNYRPIALTCSLCKIMEKFIFWAISDFLLKNNLFSEHQFGFIKGRSTTTQLISTLENWYDGIYNKNIDCVYIDFRKAFDVIPHNLLLYKVHRIGIRGKILNWISDFLSNRTFRVRVDNTLSSEYKMSSGVPQGSVLGPLLFLIYINDLRELIPKQISIKLYADAVKLYSVHKTKNDRIAMHHALNILSDWSKKWYIKISIDKTFIIYFGKNNPREQYKINDNAICEVKTIRDLGILIDNKFTFSEHISKITRNAYYRMRLLFRVIKSKKIAIWKNIYVSYIRPLLEYAPESWNPQLKSHIIKIEKCQKYFTRIAFRKCCLPYIPYDQRLQFFKLATLEKRRKIFDLLTTYKILRGFTHLDPNSLFKRTNLNTRNKSFLVICXITIXKISKSFVNRSVKAWNALNKTKKLLTFEAFLTLTSILFSYKFFVI

SEQ ID NO: 154290 - protein, 18 aa, Heterodera glycines
  Coding regions on vcDNA: vcDNA=SeqID_80713; Strand=-; Position=1-56
PYRDRDLSFSKSGTGNRD

SEQ ID NO: 154291 - protein, 150 aa, Heterodera glycines
  Coding regions on vcDNA: vcDNA=SeqID_80714; Strand=+; Position=1 -26,525-650,787-924,1136-1224,1309-1379
  Homolog annotation: Hit_ID=CAE70799.1; Match level="QueryCoverage =88%, HitCoverage=30%, E-value=4e-42, Identity=63%"; Hit description =Hypothetical protein CBG17559 [Caenorhabditis briggsae]
ISVTQPYSCQISFYNILGGKDYVVKAQVLAGGRGKGKFDSGLQGGVQIVFSPNEVREKASQMIGYHLVTKQTTAEGRLCQAVLVSKRLFTRKEYYFSITLDRSTAGPILIGSSKGGVNIEEVISRFQISLIYANLKISVSITIAEKREIE

SEQ ID NO: 154292 - protein, 56 aa, Heterodera glycines
  Coding regions on vcDNA: vcDNA=SeqID_80715; Strand=-; Position=1 -143,1259-1286
MVLLGEDQQPSLFLLLGPNGWVQQQQMPCDGSAAPRNRFLAPLNKGTSWAISKNVK

SEQ ID NO: 154293 - protein, 51 aa, Heterodera glycines
  Coding regions on vcDNA: vcDNA=SeqID_80716; Strand=-; Position=1-159
LHVIAEKIRDQFPNVDRLIAKRKPSLSKRLTESKNLEMYLIHMQFQPLNLK

SEQ ID NO: 154294 - protein, 77 aa, Heterodera glycines
  Coding regions on vcDNA: vcDNA=SeqID_80717; Strand=+; Position=1 -149,1189-1275
VHNGRGINLGATTGEGVESKQYLEIDTNVWNGMNDNDQIVFHVRTPHSVTKCDKATVRELRQTDQPKDFADQTIRTV

SEQ ID NO: 154295 - protein, 94 aa, Heterodera glycines
  Coding regions on vcDNA: vcDNA=SeqID_80718; Strand=-; Position=1 -128,185-341
  Homolog annotation: Hit_ID=AAD43137.1; Match level="QueryCoverage =50%, HitCoverage=15%, E-value=2e-12, Identity=68%"; Hit description =protein phosphatase 4 catalytic subunit [Dictyostelium discoideum] gb|AAO52019.1| similar to Dictyostelium
MSSNIVSVNENDAIGDSLPRATIRTELGVAAGGIGMRIADIDRQIEVLMRCECLTEQEVKVLCSKAREIILQEGNVQRIDAPVTVPFSFSGLSH

SEQ ID NO: 154296 - protein, 303 aa, Heterodera glycines
  Coding regions on vcDNA: vcDNA=SeqID_80719; Strand=+; Position=1 -553,623-802,871-1049
  Homolog annotation: Hit_ID=AAA98076.1; Match level="QueryCoverage =98%, HitCoverage=71%, E-value=5e-17, Identity=24%"; Hit description =nuclear protein
MSAESPTTSQRRARSRKTKKRAVSAGETKPLRRSARIAAQKAAKEKAAKVTFSDSIPPPSSLIHFPFFQQKARDGSTASTKSAGRGRPSRSPKKSGPKSRRSPAGRGGGRSQTPRKKKQPMKKAPGPSSRTPGRRVKKPPTKKSPAPRRAKTSTKKRGRPAKKAEQAEPSDSGTAADSDRDDSEHSEESATETKKKPTRKTAGGRANKQTKSRGRKTTKKTDQEEERADSGSEAEAAGSPRDSEHSEESASGTKKKPTRKSAAAGRSTKQKASRGGRAGNKKAQEERSESPTESGSDREEDEE

SEQ ID NO: 154297 - protein, 253 aa, Heterodera glycines
  Coding regions on vcDNA: vcDNA=SeqID_80720; Strand=-; Position=1 -600,2633-2791
MDDLTLVPTFFNQPSASGEQMNVKNDHTVTAEGEEVTVIEATEPPKYKKRQKQTKQIKAQKLKPLKRQKSSKEDQNKRNALENGKRNMPAVGQQNAIQSAIVPQNMPPIGNAIGISLQSVIVSQNVPPIGNAIGIRPANAVVHSFLAAPTEKQFNTTNQRERYRIEPIGKASTAEKAAEKGTIGTEEQRQSALFVTFSVMENNAQRTDRETLLFWINIAKTQIIEEQQQQQQQQQQQQQQQQQQQQQNEWQKM

SEQ ID NO: 154298 - protein, 16 aa, Heterodera glycines
  Coding regions on vcDNA: vcDNA=SeqID_80721; Strand=+; Position=1 -33,207-224
MSLHILSRKYKSIAIS

SEQ ID NO: 154299 - protein, 87 aa, Heterodera glycines
  Coding regions on vcDNA: vcDNA=SeqID_80722; Strand=-; Position=1 -39,660-884
  Homolog annotation: Hit_ID=CAC28360.1; Match level="QueryCoverage =88%, HitCoverage=4%, E-value=2e-11, Identity=48%"; Hit description =myosin heavy chain [Toxocara canis]
SKIKVHKKQIEEAEEVSAMNTQKFRQIQSHLGESEERADEPENSLMRVRSKIRVNAAPNAFGTMRAASSSALMRAASGAMIMNGQSK

SEQ ID NO: 154300 - protein, 109 aa, Heterodera glycines
  Coding regions on vcDNA: vcDNA=SeqID_80723; Strand=-; Position=1 -165,373-537
  Homolog annotation: Hit_ID=CAG08303.1; Match level="QueryCoverage =90%, HitCoverage=18%, E-value=2e-12, Identity=34%"; Hit description =unnamed protein product [Tetraodon nigroviridis]
MAAEPNYDLVKERIKDFLHEFYIEDEEGCKVFKYRDQISQIAHRQQIALYIEQDDPAVIDALDAFIFQRLYMDKMLKIARGEMNAREDDPSKAYPPELLRRLYGTFNKR

SEQ ID NO: 154301 - protein, 64 aa, Heterodera glycines
  Coding regions on vcDNA: vcDNA=SeqID_80724; Strand=+; Position=1-194
MEELYKKYELKLDEIQRGIAEQLTYMCDGTIFNSQILKFHFFKNASGNRCASAPSTRAQLTITI

SEQ ID NO: 154302 - protein, 463 aa, Heterodera glycines
  Coding regions on vcDNA: vcDNA=SeqID_80725; Strand=+; Position=1 -290,349-920,962-1153,1196-1291,1340-1581
  Homolog annotation: Hit_ID=NP_001004509.1; Match level="QueryCoverage= 90%, HitCoverage=29%, E-value=1e-51, Identity=31%"; Hit description =si:busm1-180o5.3 [Danio rerio] emb|CAD60788.1| novel protein similar to DNA polymerases [Danio rerio]
MLLPSGKTAGQVRERDSKRMEFLREKVNRVDVYWECEIHRMLERSKEMRKAFEDYVDDGPLVIRDAFMGGLTGPLKLLRKAGPGEKISYYDFTSLYPFTTCYPIGTPKVHVLNQEVEWRSAADNPYPLALLKVWVVPPRRVDVPVLPVKVGERLCFPLCITCAKEHPTGGVDNDYHCEHSDRQRGWVSTCTSIELNEALDEGYLVTKVFRVLEYEQSDDKLFRPYIAEFMAQKIQASGFDNSIRGNAEKEQQFVRECAEQFDITIDPTKMAVNKGKRSLAKLCLNNLWGRFSLNNFGLAQTLITDDPATLAEYLDNKSIKVTSIDELDEQHILITYLQKKDWVDEHSCSNIVISLWTTSAARLVLLKAMQKVVRSPGSDLLYTDTDSLILVHPEERCPLKTGPHLGQFTDEYPDHDIVEFCSGGAKQVHFQFIFVYFSILPRFSMVFVCDARARRREPNWNMC

SEQ ID NO: 154303 - protein, 134 aa, Heterodera glycines
  Coding regions on vcDNA: vcDNA=SeqID_80726; Strand=-; Position=1-405
MTKTFFVTGISAQGAAFLPAYGQLRNPFNINVAAHFYARHRIKLHFPYAPCIIERFSGGGEDRHYPMELLELIDDNMDMDINNNEHWLGRLFTEIDDKQSSSNSSDTTMRLVFEGDMDEDIGRNECSQSTVPLY

SEQ ID NO: 154304 - protein, 50 aa, Heterodera glycines
  Coding regions on vcDNA: vcDNA=SeqID_80727; Strand=+; Position=1 -58,170-267
LHRIAEKIRDQFPNVDRLIAKTKAVFVKAPYRVKKFGNISHMQFQPINLK

SEQ ID NO: 154305 - protein, 111 aa, Heterodera glycines
  Coding regions on vcDNA: vcDNA=SeqID_80728; Strand=-; Position=1 -3,320-607,885-929
MRCCLFSVAVVLIVALLLLDVAMCKKHHNKRNNKIANNKHKNSSSSSADSSSSCSSESDEDASKLAEFLTDEGRQKRRFRAKSRVAKCNQRSGGHWQASKEHLFLSNDFKD

SEQ ID NO: 154306 - protein, 263 aa, Heterodera glycines
  Coding regions on vcDNA: vcDNA=SeqID_80729; Strand=+; Position=1 -81,123-833
MFNFGSAVIYFIILQHFSFSISNANSLANDNLLIAFMKGHQKIQISEYSKQKYEAHLGIVYYMRTNWKCDKIWKKFDEFELKQCQKYRKYLNILYEFLYKKYIGIPSVKPKFALKNEKFEFDSPIINVINCLAKISQFYFNSKWSDHYDHILSNLFFYHFDIILLNEKRMNYEEKFEIEPKMPVNEMILKLAIYTANECQESVDEIIQQNFKENMNKMLKNAEEKAKEGFSSWRNNAVNYDKHKIILRLKFDDSNTWVGIQLK

SEQ ID NO: 154307 - protein, 51 aa, Heterodera glycines
  Coding regions on vcDNA: vcDNA=SeqID_80730; Strand=+; Position=1 -47,98-204
MVSYQEHCTGTAMGDKDAVELRTCTLLTDCNNCLLQKGCGWCESSQVKDGK

SEQ ID NO: 154308 - protein, 49 aa, Heterodera glycines
  Coding regions on vcDNA: vcDNA=SeqID_80731; Strand=+; Position=1 -119,200-230
MFEFGLGIRNRSEMDVWHISDQFSPKQAFTRKRPAPILLSLLPRSKPTL

SEQ ID NO: 154309 - protein, 33 aa, Heterodera glycines
  Coding regions on vcDNA: vcDNA=SeqID_80732; Strand=+; Position=1-100
MDSNLLPLSLYYLTKTTEPHMQIFIVKGAHFWE

SEQ ID NO: 154310 - protein, 48 aa, Heterodera glycines
  Coding regions on vcDNA: vcDNA=SeqID_80733; Strand=+; Position=1 -109,527-564
MCTTDSNLLPLSLYYLAKTTEPHMQIFIVKGAHFWEVIQPFFGLYIIS

SEQ ID NO: 154311 - protein, 26 aa, Heterodera glycines
  Coding regions on vcDNA: vcDNA=SeqID_80734; Strand=-; Position=1-80
IYTPFQKTRCVPINRECQRKTLSFFL

SEQ ID NO: 154312 - protein, 341 aa, Heterodera glycines
  Coding regions on vcDNA: vcDNA=SeqID_80735; Strand=+; Position=1 -11,73-258,398-950,1195-1470
MNRRWICGDVWMDILPSFDRPQLGLKMALLSDRFDVLVDKHFDGKSELTIWRMIRVGKDEGPKAKLYIDHSVIEFIRVNKQIWDISGTNLGLSIAYIQQIWDVFVREIWPVFATNIRHLGFRSGNDLDNLCRLISPTILTDLNHLNSIGFNYLLPDVIADDGPNATSAGQALFKWLHAPTTDGRPKELNCNGYLVSQDLEWINNFKEVVLARCYVIIKIHQKGNRPFWCRTTYHFYLPTKLNILQANRGRSFLRATTSVSYNVRITFYKTTTPIEPFELVNERTNEKLTFMKKDGGGELLNAWLLKRCPIIVGERAAAVQKDDNLDHLNGVHFSLYGDCIG

SEQ ID NO: 154313 - protein, 181 aa, Heterodera glycines
  Coding regions on vcDNA: vcDNA=SeqID_80736; Strand=+; Position=1 -28,104-309,559-699,761-832,2258-2356
  Homolog annotation: Hit_ID=NP_495773.1; Match level="QueryCoverage =32%, HitCoverage=5%, E-value=5e-18, Identity=61%"; Hit description =golgi apparatus protein 1 (131.7 kD) (2I714) [Caenorhabditis elegans] emb|CAA91405.1| Hypothetical protein
MLSEQAGLMGRDYKDHRCQHEMMTHRQMMVQEFLMSPEIVMGCAQQIDKYCSPQGDIESNGKSAHCLMAHSQEKDEEKLKFFTAFVDQQLNDACGQEVVTVDNWHKSANKLRGQDDKVAADPGPQGDIEPEGKTVHSLMAHEQEEDVKKWWDNEQNKYVQPNLKYQPFDFQCLNESIGMLM

SEQ ID NO: 154314 - protein, 146 aa, Heterodera glycines
  Coding regions on vcDNA: vcDNA=SeqID_80737; Strand=-; Position=1 -212,381-450,838-996
MYQNLTLIVEHKLVVSHVAAVNENHTWKGGHLGIRTNAIRTIKIFYKIKLTISIGPSKRLCHCTNCLCTTFCKGAKATKEIQIQLRDLSHKQFKDNWAELRGLYINLMNPMDTRQYSYVEFKYIDLAENLEGIQWFNMVETEDDGF

SEQ ID NO: 154315 - protein, 59 aa, Heterodera glycines
  Coding regions on vcDNA: vcDNA=SeqID_80738; Strand=+; Position=1-177
ICFQKKLGNFLIFSFFSCKGAKATKEIQIQLRDLSHKQFKVRFLGTKQNANLQNAIKGS

SEQ ID NO: 154316 - protein, 119 aa, Heterodera glycines
  Coding regions on vcDNA: vcDNA=SeqID_80739; Strand=-; Position=1 -123,489-521,1807-1912,1956-2053
MNRKIMYTDRIRTPPPQKMTQNPQSHRDSEVLTMSKLKSDHSLNSLKHTKPEGPACGDPFYEFAKHCAMVKFYENKSPKKWIAENNPDSLLVLIDGCVVCDEEGSSGTLANPKDQQIEA

SEQ ID NO: 154317 - protein, 61 aa, Heterodera glycines
  Coding regions on vcDNA: vcDNA=SeqID_80740; Strand=+; Position=1 -16,64-129,185-232,687-742
MDKAENKEIVKKLSELMELIKLKRVEKVKGLKEKFVELLEKDEVLYPSKKTSVSKNFHFAY

SEQ ID NO: 154318 - protein, 395 aa, Heterodera glycines
  Coding regions on vcDNA: vcDNA=SeqID_80741; Strand=+; Position=1 -1038,1068-1217
MRAQPTNVVQQQQNPPPTNQAMAQHNPQQEVIRQPTGLSGIEYAMILDRLHDIKGNEGSDSILNFFKKFSQYTSEWPNKKLIESLEAKLSGRAERAYNAALATEPFAYENIKRNILQQLEETDCREMSAFDDLMNGVYRKSGENLDDLANRISNLVRRAYPGLTQNLSDDYSIKHLIRSLNNPELALSLELHRRSEMSFDEFVALTSRAETTQRAAKRANTERFKPNNGRIFQQPQQSGRDFGSGFKSPITQSPVVCYNCNEPGHVSRNCNKAFHPNRGESSTPAQQNQQWAQNSAATGANRVFLNSKNGTSPVVRSQNFLKQNCIRMEEEVRTDATVGGVMLERKQRPNRTRANGGKADYGENGNGGTCYFGDTNNCNVGRWSSNFFDRRQILL

SEQ ID NO: 154319 - protein, 70 aa, Heterodera glycines
  Coding regions on vcDNA: vcDNA=SeqID_80742; Strand=+; Position=1-213
MNEVKCQSVAILECLKSQPKDMSDREFLPLGQLISEFDNIFAIHEEELTQTDMVEHSIDTGNAKPIKAKR

SEQ ID NO: 154320 - protein, 244 aa, Heterodera glycines
  Coding regions on vcDNA: vcDNA=SeqID_80743; Strand=+; Position=1 -180,291-392,446-487,672-803,850-1128
  Homolog annotation: Hit_ID=CAE70921.1; Match level="QueryCoverage =43%, HitCoverage=11%, E-value=6e-12, Identity=33%"; Hit description =Hypothetical protein CBG17720 [Caenorhabditis briggsae]
GEEVQTWHGQCPRGRIRRQPCPKGDHGRIVDDAQEGHSGDIDGAGRDRGQLRQIKQLTGGPAKQDICHPEHFKAKVLWMLRKLKANRERPPSLIFIIRDGLDEGKVDNVEERLPDAAQPRNVCNPQPGSAVDRKLTRSGVLNLYVQAHHPVRGTAKIPEFIFPCNEVCATKEELEAFINGLCHSWQIVKAATSLPVPVYQAHELAKRGRSNYMELRRYSSRKNQIDPSQKEWRPNEFHGVLTDK

SEQ ID NO: 154321 - protein, 279 aa, Heterodera glycines
  Coding regions on vcDNA: vcDNA=SeqID_80744; Strand=-; Position=1 -140,222-472,631-732,784-942,996-1067,1184-1301
  Homolog annotation: Hit_ID=CAE70749.1; Match level="QueryCoverage =60%, HitCoverage=22%, E-value=5e-15, Identity=31%"; Hit description =Hypothetical protein CBG17495 [Caenorhabditis briggsae]
VHIERGDRTNSSLSEEDGQSNHNGNDLAKQQQQNVHNVKLENEVIQNRQLAAAATEPAKIVANGHNSSATMNNDDLSPDLDVHGNKLASSVGRTQSDSSKSSLRTVNSSLLSNRAEGILGKLIGGKHTKKKKRKSLLSSAGRIQIGLKYDGDRFKLIVSVIAAKDLSPIEKEGHADPYVTLRLMPSANGHPATTKVQKGRKHTEMVPNSLDPQFNQNFEFDIHCSDFPNFKLHLAVKDGINYGLLHSTPTFGVAEVPLHNFDPLKPIVSQWLDLSSPQR

SEQ ID NO: 154322 - protein, 94 aa, Heterodera glycines
  Coding regions on vcDNA: vcDNA=SeqID_80745; Strand=-; Position=1 -81,935-1138
MVRINNSPHLAWYGMAIILLAAVVVLQDPAESCIKIKFAGPVAGLEFKIFYRTGSGRINPANPVNPVFSKICRIADWDPAKSCAGSCPAPVSSI

SEQ ID NO: 154323 - protein, 113 aa, Heterodera glycines
  Coding regions on vcDNA: vcDNA=SeqID_80746; Strand=-; Position=1 -114,555-782
MSIIRLYISFNWMDLSQFIVCINKRSYLLRSGFKYRYEINLSIRVGNEQFLENGNVLVIEDETEIFEHDIDDVLSEHNYAKRTRFLTDVNVASQASLNSDIGVAGPSRISDSQ

SEQ ID NO: 154324 - protein, 119 aa, Heterodera glycines
  Coding regions on vcDNA: vcDNA=SeqID_80747; Strand=-; Position=1 -285,864-938
  Homolog annotation: Hit_ID=NP_494302.1; Match level="QueryCoverage =83%, HitCoverage=7%, E-value=1e-10, Identity=39%"; Hit description =predicted CDS, putative protein of ancient origin (2C878) [Caenorhabditis elegans] gb|AAB95006.1| Hypothet
MMMKEEEDEEAERARTENREPAEIKLLFETGKQLDRRLGYNVPRANEVAAVYVPGADGEVPNAKIVIRERGKELKILNSTDMMVTPMTYPLFIRVGSHHPCSVSKDGYANLQGNSGENS

SEQ ID NO: 154325 - protein, 256 aa, Heterodera glycines
  Coding regions on vcDNA: vcDNA=SeqID_80748; Strand=-; Position=1 -178,1097-1292,1345-1421,2399-2641,2725-2800
AECVELFLQFLLDHPRHRQQNAKRAHHLTELFLRCVHSSHTMRYQLGHDAITTILKSDEHPNFLPTAIAQINRFLEENLVECETVGDAHNQHESSDANVQHEEQMVDQKSDGNRKRHGTDEANFASLQGFFCFHKCLAFAFAGRFSSVNSRKTIMEEEEDESDIEEFADHSNASASVTSDGPSSSSADGKALAERKKVMKIRAKIVDALLTLITTFSHLDERQSIVLISENHATLFGGFGLKKFVEFDPDLDPGMD

SEQ ID NO: 154326 - protein, 98 aa, Heterodera glycines
  misc_feature (86)..(86): Xaa can be any naturally occurring amino acid
  misc_feature (88)..(88): Xaa can be any naturally occurring amino acid
  Coding regions on vcDNA: vcDNA=SeqID_80749; Strand=-; Position=1 -51,103-155,279-312,365-476,539-582
  Homolog annotation: Hit_ID=NP_502296.1; Match level="QueryCoverage =100%, HitCoverage=20%, E-value=3e-19, Identity=46%"; Hit description= HCV NS3-transactivated protein 1 like, possibly N-myristoylated (53.1 kD) (4M871) [Caenorhabditis elegan
WFASRMKGIDFETGQQILCPSQFALVGSGSDEQLGGYARHQTVFKSKGLDGVAEELSMEMHRIGARNFGRDDRIGTVNGKSLLAPXLXEPLVCWLNTL

SEQ ID NO: 154327 - protein, 78 aa, Heterodera glycines
  Coding regions on vcDNA: vcDNA=SeqID_80750; Strand=-; Position=1-236
  Homolog annotation: Hit_ID=CAE71408.1; Match level="QueryCoverage =78%, HitCoverage=7%, E-value=1e-22, Identity=72%"; Hit description =Hypothetical protein CBG18318 [Caenorhabditis briggsae]
TVITVPKSFKNLKLAFSCPTCSEMLSKDQSHFVERHQCIRFFARVYGYNPLVFSQFRADSVLFKTRVPHNHQKCFRYV

SEQ ID NO: 154328 - protein, 74 aa, Heterodera glycines
  Coding regions on vcDNA: vcDNA=SeqID_80751; Strand=+; Position=1 -152,442-514
MAKSLILAPNFIGPWLTGEQLIGHATSPVLFPGPYRLNLWLNYFSQKFLIGQLHPMGTDHLDGQEDDAQQQIDA

SEQ ID NO: 154329 - protein, 135 aa, Heterodera glycines
  Coding regions on vcDNA: vcDNA=SeqID_80752; Strand=+; Position=1 -183,234-285,336-415,473-563
  Homolog annotation: Hit_ID=NP_996160.1; Match level="QueryCoverage =94%, HitCoverage=6%, E-value=5e-15, Identity=33%"; Hit description =CG17603-PB, isoform B [Drosophila melanogaster] gb|AAS65116.1| CG17603-PB, isoform B [Drosophila melanogas
ELLCAENLDELLSSEKQKPTNEDDDESAPPWRFGPAQMWYDRFGVPANPSNFDYGLKRRGTALSKRSTDDGTMPLPSEDDRNFLPVHFLHWEDDIIIDPEQAREKLVKELSSVKLPRCGWIPTPYTRSYKAFIAA

SEQ ID NO: 154330 - protein, 299 aa, Heterodera glycines
  Coding regions on vcDNA: vcDNA=SeqID_80753; Strand=+; Position=1 -138,441-559,616-982,1027-1301
MTSTESPHQQQFLRLPLFCNNNRLRHQSAHKSSNNNSTRAQGREYCVEMRPNDRLGQSASAGPLLAGCWRNSSSSVTTEGGVATQQGTFTADPLARVGAAISGKKAVSGVPIEGKQQPKKRGRPKTNCQTQQLPLVSANATTKSVQQKQKNNQRTEQRAVDIAKNQPKHHKLALGNHLTLTTLNESAKTSKSKQIITVQVEHITEVFETEQKKRKYQKRTPNIDPLTGARKVRKKGSGRKSKKELAAKAANGGGVFGTDGRWVLTEAQPAKSDANSIPNHKMEEFDNSHQPSQNEAPEL

SEQ ID NO: 154331 - protein, 204 aa, Heterodera glycines
  Coding regions on vcDNA: vcDNA=SeqID_80754; Strand=+; Position=1 -147,208-369,470-774
MDSSESAVRAPRNRSYNPQHLTVPKHLDERCVDRLSADIFCSLFNSYDEFKKTTNSMRLLPVACAYFDASQRLLSSLRTSLRGFSLYHALQKSDQPTIKEKNMDEILVEESDRWFFGDGLVGIEEAETEWDDDAEGEREERLSRAFFAKLDKEYQNIVRRQCWDDDEQNEAKGDNFQPKMAHQLLLQLDVAQTLDLVLHNVEND

SEQ ID NO: 154332 - protein, 35 aa, Heterodera glycines
  Coding regions on vcDNA: vcDNA=SeqID_80755; Strand=-; Position=1 -47,443-503
MRRADDGTADEQCDRRPTKNLCLKNDFFCSLVPSF

SEQ ID NO: 154333 - protein, 22 aa, Heterodera glycines
  Coding regions on vcDNA: vcDNA=SeqID_80756; Strand=-; Position=1-68
MHWRRRRVRRADDGTADEQCDR

SEQ ID NO: 154334 - protein, 34 aa, Heterodera glycines
  Coding regions on vcDNA: vcDNA=SeqID_80757; Strand=-; Position=1-104
LGTRQCQTKLLLTPNSAFSVNFCALIQNLHWKMP

SEQ ID NO: 154335 - protein, 224 aa, Heterodera glycines
  misc_feature (104)..(104): Xaa can be any naturally occurring amino acid
  Coding regions on vcDNA: vcDNA=SeqID_80758; Strand=+; Position=1 -116,164-301,381-496,753-859,942-1080
  Homolog annotation: Hit_ID=CAE68635.1; Match level="QueryCoverage =98%, HitCoverage=84%, E-value=2e-49, Identity=44%"; Hit description =Hypothetical protein CBG14525 [Caenorhabditis briggsae]
IGISANIQSFQSASVHGPQFTWGLGLAFGVYISAQISGGHLNPAISLVGHLNPAISLVQLANGSISLVRFALYIFAQLFAAFLGSAVAFLGHFDSVMRSHSFVXYISDHLTAQLFATFPSPNLSIWGSVADQIALTFGTNGGFAINPARDLGPRLFMLCLGLGWEVFSNNNFYFWVPLNNNFYFWVPLAVPFVGALVGHWLYKILIGVHGLQELIEISGAKYPR

SEQ ID NO: 154336 - protein, 271 aa, Heterodera glycines
  Coding regions on vcDNA: vcDNA=SeqID_80759; Strand=+; Position=1 -49,94-285,340-525,584-727,771-860
  Homolog annotation: Hit_ID=NP_741472.1; Match level="QueryCoverage =87%, HitCoverage=39%, E-value=1e-70, Identity=61%"; Hit description =GLP 618 12970 14472 like (4J465) [Caenorhabditis elegans] gb|AAL06035.1| Hypothetical protein H23L24.3a [
DMKDTVKEGGRVNKFPGMSELAKKVSLTMSELAKKVSLTVAIQSMRELFPDEYAFYPQSWVLPAQLDKFKNHCTDQRDADKGQCFIVKPDEGAQGTGIYLAQGTGIYLINSHDQLKSTTTRQLVQEYVTDPYLLPDDLKFDLRVYAVIKSINPLSIYVAREGMARFCTEMARFCTEKYVRPCPENFDKFYAHLTNYSLNKENNAYMHSNSLREQLRGSKRLLSTVFHQMERKGVRTRRLWKGSKRLLSTVFHQMERKGVRTRRLWKDVKLI

SEQ ID NO: 154337 - protein, 64 aa, Heterodera glycines
  Coding regions on vcDNA: vcDNA=SeqID_80760; Strand=-; Position=1 -73,248-369
MGVTCKILSSWGWSSGPDENAIWNGIFGLDLISHEQLYSSNFSAYHLNPIRGAELVGIECEIQD

SEQ ID NO: 154338 - protein, 35 aa, Heterodera glycines
  Coding regions on vcDNA: vcDNA=SeqID_80761; Strand=+; Position=1-107
MKAQLQNDALLFRYRAICKGVPKLAKARISIPFRS

SEQ ID NO: 154339 - protein, 151 aa, Heterodera glycines
  Coding regions on vcDNA: vcDNA=SeqID_80762; Strand=+; Position=1 -360,669-764
MISLSSVKGFFTSSTPLVAALSQPSISSSPASTRYGVNTPKSSSAASSSTYGTTQNYGGGAAAALCNGGGGGPLPSPAGTPGGGGSRQQQQQQHHYVVQQQTNAGGAGCDGNGRYHPQQQPSPQFKAKPNKIYNILQNFPFKMSIKWFYLL

SEQ ID NO: 154340 - protein, 208 aa, Heterodera glycines
  Coding regions on vcDNA: vcDNA=SeqID_80763; Strand=-; Position=1-627
MVEPIEGTDREEEGANDHSDMTLPSEFDENGGNGGAVRSLRSDTETNEESAVDEQFRKQKGMPRGETEAPENAEATDVPESPNSGTTSAAKGAQKKHPILILLNNIEGMPKPSDPRKSKGIRNAAQNNQQMDEEGPSLTDWEINVGRAAPTGDVPLVTLPKFATEYKQNNDNTTKGGEEQEKEGERTAQKSPNDAGQQQQQSGIGTLL

SEQ ID NO: 154341 - protein, 204 aa, Heterodera glycines
  Coding regions on vcDNA: vcDNA=SeqID_80764; Strand=+; Position=1-615
  Homolog annotation: Hit_ID=XP_319741.1; Match level="QueryCoverage =74%, HitCoverage=35%, E-value=1e-17, Identity=32%"; Hit description =ENSANGP00000006515 [Anopheles gambiae]
MVRQPQMRMLLPTLLTIDCFEPSDDRSISDWLERFNFAIDCAAPQLADQAKVKLLMTKLSEVAFSQFSKSCLPKKVIDFDYSQTEERLKIAFSRPQSIWIDRYECMRASKSEDESFRPFINRHMRLLRDSQFEKLNEEQFSCLMLLTALKSPKDAELRKRILSKLAANGDLVEYDGVVEYLQMYQSTIAEAKVVEQQPMGSRKT

SEQ ID NO: 154342 - protein, 172 aa, Heterodera glycines
  Coding regions on vcDNA: vcDNA=SeqID_80765; Strand=-; Position=1-760
  Homolog annotation: Hit_ID=XP_319741.1; Match level="QueryCoverage =75%, HitCoverage=30%, E-value=1e-16, Identity=35%"; Hit description =ENSANGP00000006515 [Anopheles gambiae]
ERFNFAIDCAAPQLADQAKVKLLMTKLSEVAFSQFSKSCLPKKVIDFDYSQTEERLKIAFSRPQSIWIDRYECMRASKSEDESFRPFINRHMRLLRDSQFEKLNEEQFSCLMLLTALKSPKDAELRKRILSKLAANGDLVEYDGVVEYLQMYQSTIAEAKVVEQQPMGSRKT

SEQ ID NO: 154343 - protein, 100 aa, Heterodera glycines
  Coding regions on vcDNA: vcDNA=SeqID_80766; Strand=+; Position=1-303
MCAKHQAWLKKNGGKKEKAVNNVRVGGVFLVKSENETKKGIIDVPIDVNGIKVDFIADFGTERTVLCEDTVRQIGTLKLSRCQEPAQYGKRYKNADRGCG

SEQ ID NO: 154344 - protein, 69 aa, Heterodera glycines
  Coding regions on vcDNA: vcDNA=SeqID_80767; Strand=+; Position=1-210
MPPIKHANNDEDDEDAGGHRRANVQLAKHDRVANVQPMEVQAGHWGGQTPVHHFGINKQGANGRRALLS

SEQ ID NO: 154345 - protein, 169 aa, Heterodera glycines
  Coding regions on vcDNA: vcDNA=SeqID_80768; Strand=-; Position=1 -169,249-454,566-700
LVIPFYLPMKKGVKFAFKKILVQPKDWFRAWILKLFSTANFVLNDGDEKMKQKANDGKVPITDLSEIEPSINVPNFEESLNENLGTTIKKMSNIVEKKKANSNEKAFKKVAQMLKDLFINFGLKKSGENTNTKKSNRRRRKRGIELGAGINAYIEAGKILNYEKFSKFS

SEQ ID NO: 154346 - protein, 177 aa, Heterodera glycines
  Coding regions on vcDNA: vcDNA=SeqID_80769; Strand=-; Position=1 -204,471-754,803-848
MPSLLSTVFANFSPNAPLIWPSERRMIAFRISFFTTFGQCSEKTFMACDCPPDFSTVCVNSSPQFSMIAFASASSPANFIISVWFPSSFAASIVPFVLTNELTREQLTLKKINNSHRFLFVRCPIVRDESKWTKWEKEAIDLRIYNQCNLHIEINKDDYICKGLLDEIPGPSDQQQK

SEQ ID NO: 154347 - protein, 83 aa, Heterodera glycines
  Coding regions on vcDNA: vcDNA=SeqID_80770; Strand=+; Position=1 -65,883-1069
MTQWGRALLIGACLGNQSRVNREDSVDEQLARHHAGARLVNAPEQIRHACLAVIVPRQIPFPPIVKGEALKAFQFLAINQAIS

SEQ ID NO: 154348 - protein, 202 aa, Heterodera glycines
  Coding regions on vcDNA: vcDNA=SeqID_80771; Strand=-; Position=1 -155,448-618,662-802,1061-1180
  Homolog annotation: Hit_ID=NP_492996.1; Match level="QueryCoverage =90%, HitCoverage=4%, E-value=2e-44, Identity=47%"; Hit description =VAB-10B protein family member, Variable ABnormal morphology VAB-10 (vab-10) [Caenorhabditis elegans]
GTVPLRSSLGTIDKKRTRRKSDTLHDNWKRLWTDLVQYEQKLNERKAHLQELERLKGFTFDDWRERYLAWNDHGKARVSDLFRRIDKSGTGMVPRKLFIDGILASSTLFCSMCFFLFCSMCFFPEFPTSALEMARVADEFDKGDGLIVSREFMNALRFDPKKRRYEPKTETERIHEEIARETARCTCAHRFPIQHISSDKDR

SEQ ID NO: 154349 - protein, 99 aa, Heterodera glycines
  Coding regions on vcDNA: vcDNA=SeqID_80772; Strand=-; Position=1 -39,160-288,1396-1527
MEQANTRRENVEKVRERARKILDTNVGDAHELAELERKLIILNDQWDRLNDGTTQRRLEEIRQHEQMLDELMGFVEEKQGQLELMRDCSDEGQLSRLST

SEQ ID NO: 154350 - protein, 91 aa, Heterodera glycines
  Coding regions on vcDNA: vcDNA=SeqID_80773; Strand=-; Position=1 -125,189-339
MPLYVLCNSFYSVQQSFDVLCTPADMPLIYAFTKSNFKYNTNVMEMADKLLCKAVKPFSRLKLSTEEFVLIRAIIFSHMGQLINEMPKLLD

SEQ ID NO: 154351 - protein, 168 aa, Heterodera glycines
  Coding regions on vcDNA: vcDNA=SeqID_80774; Strand=-; Position=1 -128,210-276,412-723
MIEPDSAESVPVKCCVCSEKCKFHSGVKCCEGVFIKILKKEQSLQTFFSSLNFVDEGILLQKCRRNFFYKDSTCKRCRLKKCFTVGMNPRRVCVNNVNNEQILAYIQRIKRLMTSTNSAAAIAPSSAEIGMELSTETSATNGPLKCHIPNSVITNHGQIKTKLRRLAL

SEQ ID NO: 154352 - protein, 25 aa, Heterodera glycines
  Coding regions on vcDNA: vcDNA=SeqID_80775; Strand=+; Position=1-75
SKWGFEPRRKIMKGRKFNHYTTCAC

SEQ ID NO: 154353 - protein, 655 aa, Heterodera glycines
  Coding regions on vcDNA: vcDNA=SeqID_80776; Strand=-; Position=1-1966
  Homolog annotation: Hit_ID=XP_320889.1; Match level="QueryCoverage =96%, HitCoverage=75%, E-value=1e-100, Identity=33%"; Hit description= ENSANGP00000012033 [Anopheles gambiae] ref|XP_313651.1| ENSANGP00000013044 [Anopheles gambiae] ref|XP_31
MDPQQLQQLLNALQQMVTNAAPQNAAPENLSNANLASSIDARLSAFHYNPEVGTTFESWFKRFGKLIEDDGSTLPETSKVRLLLGKLGEEEYSKYRDTISPTQPDQVNWNDTISHLKQLFAETRSLFVRRYECFKIRQQPGQDVSSLIAQINASCENADLSLTKEQLKCIILVIALSDEHHDLRQKALKMLEDAQKNGTNISLKKIEEELRAIQIVKESALSLVNPPIVTNAINTRPRQWTDPAQRQSGTNQRQHKNANTSGKPTRGRPTLPCGSCGKSDHWRSDCTFKDATCLKCNKKGHISTVCRQNKTKAPPNSHRSFHTVKVDTHCLHVGTTQGRWWKLIILINGRQTSMNGDTGAQATIISLQTWRELGEPELTPSDIDAKNCNDQPFALLGKFICTVQFSDKTPQTLIAYVSGEVGHNLLGLPWIEALEIIPRQILFPSSKSADQATMIENFSAVKPPNKTINDVSTLKAALQKDFPEVFEEGLGHCSKAKAHLILRSDAKPVFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDDKSKQLCAINTHRGLFQCQRLPFGVKSAPAIFQHLMDQICAGIP

SEQ ID NO: 154354 - protein, 130 aa, Heterodera glycines
  Coding regions on vcDNA: vcDNA=SeqID_80777; Strand=+; Position=1-391
MPLSLHSPSATGRHNRRQSWRRRRSPMCHCRRCAMTDESPMPLNSQTAAIGERSPMAAFVAAAAEIRRSVPGKRCAGSPMAQPCRRTLRTWTHRRCWGRLLQKQGMSGAVEGVLPYGYRIDIKNALPCGT

SEQ ID NO: 154355 - protein, 35 aa, Heterodera glycines
  Coding regions on vcDNA: vcDNA=SeqID_80778; Strand=-; Position=1-106
VCVDDADGLLAAIRGGADRVELCSALEVGGLTPTP

SEQ ID NO: 154356 - protein, 179 aa, Heterodera glycines
  Coding regions on vcDNA: vcDNA=SeqID_80779; Strand=+; Position=1 -154,1585-1823,2446-2592
MSGKKGADWYDESDRDKMNMLDACASGMVAEVERYLNGGVDMEEEDDDGVTGLSHDTLVKLYKQFLMSGKGMDNLKKELANKRETGEIGGGKAPLGERKSSAGIALAKLVLNDSGNGGGGMPSPASVAGGGSWMVRGDTLRPMIFGDNVPHSKSAEESAEVNGLYMAAQWNAEKLFKNV

SEQ ID NO: 154357 - protein, 68 aa, Heterodera glycines
  Coding regions on vcDNA: vcDNA=SeqID_80780; Strand=-; Position=1 -72,185-319
MDTILAERKRAKLQHNGHSYMFHKLAATNVNQARCVTSLAFLPIGDLTPGIIALDMALPDELNPVLDW

SEQ ID NO: 154358 - protein, 472 aa, Heterodera glycines
  Coding regions on vcDNA: vcDNA=SeqID_80781; Strand=-; Position=1 -371,412-581,625-747,790-970,1085-1224,1282-1716
KKMDTILTKRNRAKLQHNVYSYIFHMLSADGEVRFWSCEHHHTKDIRCKGRLHTDLNNNALREVGSHQCEPSAARMEAQRVITGIKRRAVQTMEPPATIRSLALQNVVTPVLAQLPTKQATKQIIRRVRREIDAPPPVPNTLTDLIIPDAYKMYSRTDEQSEQFLLADSGVYQENGREQRILIFGRESNGRWAHEMKECFADGTFSITPMPFQQVYAILARRNRWVIPVCYCMLSNKTHTTYERMFRMLVAVWPDFNPDSVSMDFETAAITALNVVFPFTERYQNDPTFAEMARCVTSLAFLPIGDLTPGIIALDMALPDELTPVLDWFIMNYTGRLKNDGSRTRPRFDPNTWSVYTRTMQVDDRTNNHSEAANRRLQCSFACSHPSIWHFIDLLRKDQKLSDDDFAKCSTGQDPPQKAKKYRDADRRILTMVQNYLPLNNGDTNIFLIHQPFNHHFIITFLIGISRNYEMR

SEQ ID NO: 154359 - protein, 77 aa, Heterodera glycines
  Coding regions on vcDNA: vcDNA=SeqID_80782; Strand=-; Position=1 -33,301-501
MLKNGQNRCKKEFSRSLNTVIAQLKKENSNATICSILYNHQHWTALKNTTNLLDLILEPRGKLMLTNASFECQDANL

SEQ ID NO: 154360 - protein, 72 aa, Heterodera glycines
  Coding regions on vcDNA: vcDNA=SeqID_80783; Strand=-; Position=1 -88,365-495
MYQETDVFPNLQHESLFSLFFRDTLPNTIVGPIAHQSVQCRHRCQRGQTESRTDHRGESISEQRHRKALLMG

SEQ ID NO: 154361 - protein, 45 aa, Heterodera glycines
  Coding regions on vcDNA: vcDNA=SeqID_80784; Strand=+; Position=1-136
MRRATAQARKGAGKISRAVTVAPTAPESIAIQTPTAKLFAALHTR

SEQ ID NO: 154362 - protein, 55 aa, Heterodera glycines
  Coding regions on vcDNA: vcDNA=SeqID_80785; Strand=-; Position=1 -132,366-401
MEPPASAQNFYVPEKCDFGTDPQWCGDYVQQYVKWFEQYGSRGKIFLSDKTYQID

SEQ ID NO: 154363 - protein, 126 aa, Heterodera glycines
  Coding regions on vcDNA: vcDNA=SeqID_80786; Strand=-; Position=1 -133,198-445
MGGYGNKFGPSLGYGGYTNPLMMMDAGRLGGGGGYGYGPYNRGYAGIGVSGFNNPYGMYYNNGYGAAPSLPYAAYWPQSPALQYPMGGAAAQLQYSASQNPYSTAYWGGFLSPLKAKTTKKRMLLE

SEQ ID NO: 154364 - protein, 234 aa, Heterodera glycines
  Coding regions on vcDNA: vcDNA=SeqID_80787; Strand=-; Position=1 -291,709-1122
MANSKIRKNELTVKIIPSLVEDDAHTYHMLAYCTGKRGLIYTENGCSKGIQLPTAKNNWRHVFDEVAKLEFNDTQQCVAYNIHIWLKLKEDQHWVSWPTSYNSEIENNLLNHRVLFGNHFYLTISPEMDSNSEHFYSIQVYCEEKTVENQQHQQMVDGKTGPTNSDKNWPMNDENDKYNFKTYTKRSTMVVFNSEARQCTDSNTYRIKVWAVHKQLLYFNVKNLAFFWEPIKFL

SEQ ID NO: 154365 - protein, 254 aa, Heterodera glycines
  misc_feature (3)..(3): Xaa can be any naturally occurring amino acid
  misc_feature (25)..(25): Xaa can be any naturally occurring amino acid
  misc_feature (28)..(28): Xaa can be any naturally occurring amino acid
  misc_feature (247)..(247): Xaa can be any naturally occurring amino acid
  Coding regions on vcDNA: vcDNA=SeqID_80788; Strand=+; Position=1 -141,1051-1104,1358-1495,1591-1676,1876-2062,2339-2475
  Homolog annotation: Hit_ID=NP_609397.2; Match level="QueryCoverage =90%, HitCoverage=29%, E-value=5e-42, Identity=40%"; Hit description =CG5355-PA [Drosophila melanogaster] gb|AAF52942.2| CG5355-PA [Drosophila melanogaster] gb|AAV36957.1| LP0
LFXLNSFMFSKLLLLLEKSTLANNXIIXKKISIISRGMHSLILIYLLYPSARRNESVVERICGQKVMDPYRWMEDPDRPETKQFVAEMNDLSRPFLEKAFFRAQFRNKLVMLFDQKAYGLFDQKAYGCITKHGDYYYYAYSEGTQKQSAIYRQRTLSGEKEFLDPNQFSPDGTAAIVQSAFTRDGQIMAYTVAEKGSDLSTIRARKLKKGNDLPDKIRNVKQSSLAWMPNNKGIFYSVNTNYNNKNXIFVLLYY

SEQ ID NO: 154366 - protein, 74 aa, Heterodera glycines
  Coding regions on vcDNA: vcDNA=SeqID_80789; Strand=+; Position=1 -87,366-503
MADGATIVKFVKKIRHSDEWRGVNLTGVTVPVFIISRNDTKRDGSNPALLYGYGGFKSVYLGISISHHGNKLLN

SEQ ID NO: 154367 - protein, 111 aa, Heterodera glycines
  Coding regions on vcDNA: vcDNA=SeqID_80790; Strand=+; Position=1 -98,769-937,996-1064
  Homolog annotation: Hit_ID=CAG11079.1; Match level="QueryCoverage =97%, HitCoverage=17%, E-value=4e-25, Identity=46%"; Hit description =unnamed protein product [Tetraodon nigroviridis]
MDMLRFHKFTVGSYWMNEYGDPEKPEEFEYIYKTADHDDRVVPSHTLKYAAQLYHYLKKPEVKLTQRKPVIVRVETDAGHGAGKPRDKVIDELTDIMSFLQRVIQLKWYDD

SEQ ID NO: 154368 - protein, 91 aa, Heterodera glycines
  Coding regions on vcDNA: vcDNA=SeqID_80791; Strand=-; Position=1 -119,1595-1751
MELGDFSVVIPTSSAVVMFCSAVVIPTSSAVVISPSSECQNQGDAVLTEYDQKFVNSLRLNVQEGRDFGYILVVLANQHKDVLSGLQQKSD

SEQ ID NO: 154369 - protein, 93 aa, Heterodera glycines
  Coding regions on vcDNA: vcDNA=SeqID_80792; Strand=+; Position=1-282
MIGNDALLPSRRKLSYFPFFLRILLINVILIMIITKNKPNCRLLAFGGWGDHNGGGCGDHNGGAEHNDGGGCGDHNTKITQLHTEEKNIFSMP

SEQ ID NO: 154370 - protein, 176 aa, Heterodera glycines
  Coding regions on vcDNA: vcDNA=SeqID_80793; Strand=-; Position=1 -321,485-568,1226-1351
MAIFPTNALAVFTLLFFAYNIQIGFIHGEGWGEHIKFIFSQFHHGGGGHHHGSEEHQHDGGQQNGPTNGGGKNKTVAEKFKTSKLVPDILPLPPPKFLYVEYPKDVKHNGAFWLVANVPGNDMLWGDQATGGYFASFVLDSMSPTLPIKNNLDNLLLAISLPQHTKTRTSDIDEGH

SEQ ID NO: 154371 - protein, 316 aa, Heterodera glycines
  Coding regions on vcDNA: vcDNA=SeqID_80794; Strand=-; Position=1 -657,1902-2193
MLIAFVRNDRQMQISEYSKQKYEAHLGIVYFMRKNWQCDKIANEFEEHERAECQKYRKYLDILYEYLFREYAGIPTVRPKFVFKYGIEIEGPIIYAMNCLVRISRFYFIPWPNFGEYKLNEFFGVQFEPKLLNEEKLNYGVKFENQPKMPINEIILQLAIDTANEWEINESLDGIIQPKMNKKFEENLEEMFSAWKIYEINDDKHKIIVDSKFDDKWAWSEDALVSEFVKGLTTKFENFFKMVKEYANFGIFEIEKLHEHMTHKYEAFLGLVYLMRENWQCAEIGEELKEYEREECQKYRKYLDILYEYLFRLYAE

SEQ ID NO: 154372 - protein, 68 aa, Heterodera glycines
  Coding regions on vcDNA: vcDNA=SeqID_80795; Strand=+; Position=1 -73,490-623
MFLPTILWAHIQSQIGKKVDRTRNGKKKTLFPLDFLYPCVKYHSFPRTSGKRDICNFHGVMPKSKDVL

SEQ ID NO: 154373 - protein, 78 aa, Heterodera glycines
  Coding regions on vcDNA: vcDNA=SeqID_80796; Strand=-; Position=1 -31,558-763
MIDQSEGMIKIYFECLARSEKYGRGGRRTADRGRWGYGRIGRGNGNNAKEWAQEERLSQRHRYSTSLSIGFTVPPYCI

SEQ ID NO: 154374 - protein, 81 aa, Heterodera glycines
  Coding regions on vcDNA: vcDNA=SeqID_80797; Strand=+; Position=1-289
TGRSGTNCATTGARTAPFATAETTTAHFCWTRRTKRRRTTNRRSGTDGRSEGRKCHHSMRNAILLSLGRRKKKFAKYGHRK

SEQ ID NO: 154375 - protein, 210 aa, Heterodera glycines
  Coding regions on vcDNA: vcDNA=SeqID_80798; Strand=+; Position=1 -192,258-354,433-642,693-827
  Homolog annotation: Hit_ID=CAE73419.1; Match level="QueryCoverage =98%, HitCoverage=20%, E-value=2e-89, Identity=72%"; Hit description =Hypothetical protein CBG20862 [Caenorhabditis briggsae]
YECSEEIITISAMLSVNAAVFYRPKAMVIHADTARKGFWSSSGDHLTLLNVYNKWRETNFSMQWCIENFVQHRTMKRARDIRDQLEGLLERVEIEPKSSSDTMAILKTITAGYFHNLATLDKGGQYKTVKHRHTVQVHPNSCLFEDRLRWVIYYELVFTSKEFMREIIECDPKWISEVAPHYYQQTQLEDSVNKKMPKQMGKAKSELVGS

SEQ ID NO: 154376 - protein, 221 aa, Heterodera glycines
  Coding regions on vcDNA: vcDNA=SeqID_80799; Strand=+; Position=1 -129,180-347,394-666
  Homolog annotation: Hit_ID=NP_496872.1; Match level="QueryCoverage =90%, HitCoverage=9%, E-value=1e-32, Identity=38%"; Hit description =RNA polymerase I (2N962) [Caenorhabditis elegans] emb|CAB07687.2| Hypothetical protein Y48E1A.1 [Caenorhab
VDLSVRPNRFMQFGGIQFKCFNPSEVPKISVLEVTQTNTFDEAGFPVRGGLYDPLLGTSENNHEAGFPVRGGLYDPLLGTSENNHCETCGMQGTHCPGHFGHIRLTVPVFNPLFYSFTLNMMKGTCIHCHMMKGTCIHCHRFTCNSNSVAAKVVIAKLRAFRFGVPEVLDRVESGLKAKFEKRDELLTERIDLIGESVFLREINAFIAELKGVSNADQLQK

SEQ ID NO: 154377 - protein, 232 aa, Heterodera glycines
  Coding regions on vcDNA: vcDNA=SeqID_80800; Strand=+; Position=1 -63,125-318,395-540,1403-1547,1589-1738
  Homolog annotation: Hit_ID=AAC72366.2; Match level="QueryCoverage =63%, HitCoverage=12%, E-value=5e-57, Identity=72%"; Hit description =guanylyl cyclase [Heterodera glycines]
MLNAANVPTVTMTVNISKGVLNLDRLYTSEASLWVNWGGVRPLTTPLCGYNGTQCGQNATVYILIGSAVILMLLIVAMLGIGYALREKMREKERLMRECLIPFGELRNLKELQSTEELKKETEKSMRSMQSSHSGSDRHSPIIHRCPRPFVLRKLSDQRPMASENQRLWTEHDQRESADAEEKPFVDGARTFARKQSDGHKRGRCVQFCNYLCGDGEQRDGLEWDGEGRRRG

SEQ ID NO: 154378 - protein, 202 aa, Heterodera glycines
  Coding regions on vcDNA: vcDNA=SeqID_80801; Strand=+; Position=1 -332,790-928,985-1122
MLFCMVLLFLGPFYIAKLQQQRNIRRFVAELEQRLVESEAEIAALCSEKRELAKRVGHMANKLDTERVQNASAMESVRRDRQLLVEENERERALHAVMRDKFDELKRKFDTIAKTVLDKQSELEQMTKMNTELSQQLHEQAEALERHRTELETATKMVAERDTELKGSECELAKCREENTKLDELRQQMVHLLEEFGANLGK

SEQ ID NO: 154379 - protein, 54 aa, Heterodera glycines
  Coding regions on vcDNA: vcDNA=SeqID_80802; Strand=+; Position=1-385
ELLVLFDSSMCLLLICKISKIFVKFQKSYGQNELKNPVIRTFFALIFLCINKNF

SEQ ID NO: 154380 - protein, 65 aa, Heterodera glycines
  Coding regions on vcDNA: vcDNA=SeqID_80803; Strand=+; Position=1 -88,1094-1203
MVAVVAMVAVVAVLVVVAVLVEVVTVQVVHGPTLKRTMSALEVAALTLGAVPSVEAGRPLGTIMV

SEQ ID NO: 154381 - protein, 41 aa, Heterodera glycines
  Coding regions on vcDNA: vcDNA=SeqID_80804; Strand=+; Position=1 -35,173-263
MTILEKMLMDTSIVVAMFVLAIVVLSLVLGVMKIVAHQKTN

SEQ ID NO: 154382 - protein, 431 aa, Heterodera glycines
  misc_feature (208)..(208): Xaa can be any naturally occurring amino acid
  Coding regions on vcDNA: vcDNA=SeqID_80805; Strand=-; Position=1 -258,474-1080,1134-1247,1301-1421,1464-1583
  Homolog annotation: Hit_ID=CAE70611.1; Match level="QueryCoverage =93%, HitCoverage=53%, E-value=9e-61, Identity=35%"; Hit description =Hypothetical protein CBG17294 [Caenorhabditis briggsae]
PHFLLSRIQSLVTPRNFQCEVRGMMDTEHLLERCTVLLNVTETLLEDIVMKSEWVVQLFELHSLKNGRKSRFITGQQRTIHQQLKSFSRPSHRPPHFPWLLSCSIEHISRARVSFARLAIPTNFGVGLTNVRFVVLVVAPLQIKETKSAAEIARTFASLLADPLLYHELATTATERQFVAKIRLRAYELTNEKMLKMRSKGKRYSINXYEKKTFRKTAQNWYPGRGLIGDFRRRLPFYKSDFLDGIADTRAFQKTISSAAFLYFIVLPMAIALGMLNEEHTHGKITVSKAILGQWIGGLVFGLFVSKAILGQWIGGLVFGLFGGQLFLVLLTSPPISLYITVSHSHSLGCDFFQLYAGIGTWCCFYLVLFAFFEVSNVMKHAKRSLEEMFSMSLEEMFSMFIACTLAIESAKNAFASLGRAFLPHCPPNGH

SEQ ID NO: 154383 - protein, 125 aa, Heterodera glycines
  Coding regions on vcDNA: vcDNA=SeqID_80806; Strand=-; Position=1 -66,264-575
MFSCLKYCLCCIIVFLLLALLAEETHIRKENNQPKNGSKYHHEQFTKEASRGKTVQPQFKKDEVFNNATEQQQNEEDEQYSNTTVQQRNLNLEYNNSLGDGQIDNFSIIHSYDMYEFDLVIVDAD

SEQ ID NO: 154384 - protein, 389 aa, Heterodera glycines
  Coding regions on vcDNA: vcDNA=SeqID_80807; Strand=-; Position=1 -135,202-303,347-432,475-583,635-727,764-832,880-973,1021-1105,1184 -1216,1260-1287
  Homolog annotation: Hit_ID=CAE63458.1; Match level="QueryCoverage =99%, HitCoverage=31%, E-value=5e-79, Identity=47%"; Hit description =Hypothetical protein CBG07921 [Caenorhabditis briggsae]
CVSRLRTDPTNGLSSAEASRRLGFSGFNEFELNEKVSLFGKYLEQFKNPLICLLLASAIVSVFKNPLICLLLASAIVSVLVKQFDDALSIAVAVLIVVTVGFVQEVVTVGFVQEYRSEKTLEKLNRLVPPTAHCIRDGRSIRDGRSVTFYARELVPGDLVLLNAGDRVPADVRVIESVQLQLDESSFTGSVQLQLDESSFTGENEARQKVAAALPENAAKGGSIEHMDNIGGSIEHMDNIAFMGTLVCAGWGKGIVIGTGPNSKGIVIGTGPNSKFGEVFMMMQSEESPKTPLQNSMDQLGKQLSLYSFGVIGLIFLLGLSMDQLGKQLSLYSFGVIGLIFLLGLIQGRDMLEMFTIGVDMLEMFTIGVSLAVAAIPEGSLAVAAIPEG

SEQ ID NO: 154385 - protein, 206 aa, Heterodera glycines
  Coding regions on vcDNA: vcDNA=SeqID_80808; Strand=-; Position=1 -58,443-515,842-1022,1336-1413,1514-1744
MYFHFKPIIPQKSLEIKFVVGFCLFFEEMANTFKIYEFQSFFGRQNEKPKRKEQKMDEGTTENNNNRKSGAKKRKQKQKQQSVVAEVTEPHNKQSETEEAEKEKSKNGDSEKDGKKVNEASKPIPCQSISHQKDSTVNNTKINNRCCAFFGFTGGTGFLRSLFRTGLGEGAHLLVGQNSKARGAAGSNGTTMIPAMDIQEASLARC

SEQ ID NO: 154386 - protein, 109 aa, Heterodera glycines
  Coding regions on vcDNA: vcDNA=SeqID_80809; Strand=+; Position=1-330
  Homolog annotation: Hit_ID=AAS07044.1; Match level="QueryCoverage =89%, HitCoverage=19%, E-value=8e-13, Identity=40%"; Hit description =plus agglutinin [Chlamydomonas reinhardtii]
MGILYGSHKKRESFSPQPHGHLPITRPPAPSAPNPMAFPITSPPAPWDLPITRPPAPSSPNPMAFPITSPPTPWDLPITSPPAPWDLPITRPPAPSSPNPMGTCPSPDP

SEQ ID NO: 154387 - protein, 15 aa, Heterodera glycines
  Coding regions on vcDNA: vcDNA=SeqID_80810; Strand=-; Position=1-46
MPMRLGADGARGLVM

SEQ ID NO: 154388 - protein, 152 aa, Heterodera glycines
  Coding regions on vcDNA: vcDNA=SeqID_80811; Strand=-; Position=1-459
MSFQNTPKEVRRARNTRHFFKATPDKGKCLEKIESHVNERAKFGIREHVTSFYFKCPPNEDAENNFRIIIDKLIHEAKEKEPAQGWKTERISLNLYCAALSDPVMIPVRPLHQVTSDVVLNEFMHRQQSFGDVNLMDERISVIVTTFAYPLK

SEQ ID NO: 154389 - protein, 114 aa, Heterodera glycines
  Coding regions on vcDNA: vcDNA=SeqID_80812; Strand=-; Position=1-345
MTREYSDSEILEYVSAGPKQYALKLRRKKDGEIWEKTKIRGFTLNRSNKMRYEEFKEMVLGYQEGVKKVFRYPEKIGPTRDSRILSRDVKKEYGPVQRKGIVDENFNVLPFGYY

SEQ ID NO: 154390 - protein, 163 aa, Heterodera glycines
  misc_feature (47)..(47): Xaa can be any naturally occurring amino acid
  misc_feature (95)..(95): Xaa can be any naturally occurring amino acid
  misc_feature (156)..(156): Xaa can be any naturally occurring amino acid
  Coding regions on vcDNA: vcDNA=SeqID_80813; Strand=+; Position=1 -289,2246-2362,3127-3214
  Homolog annotation: Hit_ID=CAB76380.1; Match level="QueryCoverage =92%, HitCoverage=31%, E-value=4e-27, Identity=42%"; Hit description =gamma tubulin [Hordeum vulgare subsp. vulgare]
NSGQKWVPRALLVDLEPRVLSDICNHEANSYSELFDMDNFYQGPTGXGAGNNWARGYYPGGHIVDDIMELMEAESERADHLEGFAMCHSILGGGXTGQSQRAQQKSADRYSPPFSFRFMLFPPSSTTVAVVHPPFYQSLSLTCDELSAICALCIPXQLSSKIV

SEQ ID NO: 154391 - protein, 215 aa, Heterodera glycines
  misc_feature (1)..(1): Xaa can be any naturally occurring amino acid
  Coding regions on vcDNA: vcDNA=SeqID_80814; Strand=-; Position=1 -69,120-230,276-631
  Homolog annotation: Hit_ID=CAE58477.1; Match level="QueryCoverage =96%, HitCoverage=34%, E-value=2e-37, Identity=41%"; Hit description =Hypothetical protein CBG01619 [Caenorhabditis briggsae]
XRTLMTIVTEYKVHRSLKARRMLFESQSRRRSVVALEELFESQSRRRSVVALEELREKVSRTVAIFIAIKFLIFRSLPIFFDIYESFYGIESFGIILSIRSLPIFFDIYESFYGIESFGIILSILVRLSDFGVVLNSATNSLAYFGKTEFFANRLRVKLLREKQRRKWSALIKHYNSNFSLVFLQAVSACLVACPSPIIERSSSKSSKGTYVPCP

SEQ ID NO: 154392 - protein, 261 aa, Heterodera glycines
  Coding regions on vcDNA: vcDNA=SeqID_80815; Strand=-; Position=1 -93,145-675,736-897
MAEHSEDKLDETERIFEIARVMWKAIKKHDKNAVGIVPRLRFIGLVLWHLAVRQSPLIDQQQQHNGAPLLVFTAKMRPNIDPHDPTEWQTMLWHFDQNLANAAMDAEDGQREANEGGIEDGKGEGEEEEEQNDGEEIKLLRELGEKVGQGRAQFGDRERHAELGKKFSLLKKSTSNDGAAHGMVNFCVIYRPFLVFGSQSVDILLFIRGLLEGHFNAKTMDEYLENGKQIETNSYLLTTHLSLRMMTIQLLTVGKHFGYKF

SEQ ID NO: 154393 - protein, 178 aa, Heterodera glycines
  Coding regions on vcDNA: vcDNA=SeqID_80816; Strand=+; Position=1 -150,733-835,1373-1470,1743-1928
MNSSFLFVIMLVLRICGEQNVANRRYITAVHEGAHVLALWRSRYGDKVESVTVERTATTFGRTMFWAKRWYTPDQLFSRLIASIAGEEAEIMFFNQGPPPEGLKTDQTEMDDVALTWIHHFYENSHDVAPFVVPVRYRTTAQGRLMMAQLIAKARRTFREAFGTEESRQCLRMVNFNN

SEQ ID NO: 154394 - protein, 399 aa, Heterodera glycines
  Coding regions on vcDNA: vcDNA=SeqID_80817; Strand=+; Position=1-1198
  Homolog annotation: Hit_ID=NP_508324.1; Match level="QueryCoverage =88%, HitCoverage=14%, E-value=9e-23, Identity=23%"; Hit description =predicted CDS, peptidase family A16 and RNA-directed DNA polymerase and Integrase, catalytic domain and Z
MTFISIIVLALINKINCAAEVAIIQATSEDCIRKTNGSICRIKGTAEMTILPAGQKISLALKNQYSQTIGLLKIKLNSLTLNCVQETVAWLRDYGIKVKSARRCPTMGTCKKGKCANIRTSKNIEELKEYWDYPGNSYCMEGERVWGSKCALPSFGINECFFYKIIAIPITPTVWKQVRCLNWDYEIKAEIELKSENKSVKKELTLYPGITEEWNEFSFTPQGVTPPISPLLSDYFFISQKDIIYAGKEVKTKLICKNQINASNFECDLQKDVCRECWINSTKEEPLIQCECEDYLIEDLEPKLPFTNDKLNLRSDGSKILSETSYTPIQLLVRVENLKIVAEIDGNICKAKQIGQLSGCYECQTGGVLNYTCWTNWGESIAEIRCPGGLIFLAKCKKE

SEQ ID NO: 154395 - protein, 301 aa, Heterodera glycines
  Coding regions on vcDNA: vcDNA=SeqID_80818; Strand=+; Position=1-906
  Homolog annotation: Hit_ID=AAG35598.1; Match level="QueryCoverage =69%, HitCoverage=81%, E-value=2e-20, Identity=41%"; Hit description =secalin precursor [Secale cereale]
MENGKNNCDISEMVMSTGLPNGFQLDGLNWAQVHQCIPPPSLFYPNPKIMRTAIVQPQLLAQQPQPLAQQPQPLTQQPQPLTQQPQPLTQQPQQLPQQQSQQLPQQPQQLPQQQSQQLPQQPHQLQLQPQQSVQQPQQLVQQPQQLVQQPQQLPQQEVPQLLQRVLYSVQPPLPSQQRHHRPLFGRENRFTSRRIGPNRSHPYTIRLPATAQQPFREAQEVQPSLINWPWDTPPNLNVPFEIRRVLLRRLAQEREHAFGLAGAVHQWNPPMAILLLALESFYSSLLAMAVNEDGGSVSAQH

SEQ ID NO: 154396 - protein, 144 aa, Heterodera glycines
  Coding regions on vcDNA: vcDNA=SeqID_80819; Strand=-; Position=1 -231,314-517
  Homolog annotation: Hit_ID=CAE59009.1; Match level="QueryCoverage =86%, HitCoverage=26%, E-value=5e-21, Identity=46%"; Hit description =Hypothetical protein CBG02285 [Caenorhabditis briggsae]
MGNEHSNRSKGHPSSSSSKKDSPATRLQKALPSALKFGSNDLSSSALRRLLEQSKKSRSLQLKGAGIKRVPSGIVEEVHSLLRILELSSNKLRELPSTIGTFSMLKQLYIANNRLTNLPDEIGCLKTLELLDVSGLPFFCFPIE

SEQ ID NO: 154397 - protein, 127 aa, Heterodera glycines
  Coding regions on vcDNA: vcDNA=SeqID_80820; Strand=+; Position=1 -124,384-645
FAKDQTTNDDEGCQVISDEERAIVNNRVFFVDGPKQMWYQSAVSRSAQSPLLPSASSSSLSSLQQASTDSTQGTFATSGQQQHGTLANKSNTMLAMEMIQKSSIIFYPTNSNYGNQLLPGFPRFLAD

SEQ ID NO: 154398 - protein, 86 aa, Heterodera glycines
  Coding regions on vcDNA: vcDNA=SeqID_80821; Strand=+; Position=1 -106,608-762
MFTNSLYVGGSSEAIFAENGTDKGQKRHGAGKEAERKYCRQMPKIGFFRIGPNVMKGTSDSFSYLNGHFSFGHKPKKYDVPSPSMA

SEQ ID NO: 154399 - protein, 48 aa, Heterodera glycines
  Coding regions on vcDNA: vcDNA=SeqID_80822; Strand=-; Position=1 -92,315-369
MPYQISMTEKERIGAYFLAKDKEEYKQCEDAQKLSKNNFYSLIAVANE

SEQ ID NO: 154400 - protein, 47 aa, Heterodera glycines
  Coding regions on vcDNA: vcDNA=SeqID_80823; Strand=+; Position=1-324
KFTILEFCHYFFTISTFFGKFFNKNAIKPKNTPLRIYKKKSKSTPKK

SEQ ID NO: 154401 - protein, 89 aa, Heterodera glycines
  Coding regions on vcDNA: vcDNA=SeqID_80824; Strand=-; Position=1-270
MTTTVLITILLITVIGIHFCLANHSQSEDYEHLRQFFKQLNGHGPSSNSSSANSDAYVNNSVVPNVILWCILLFALVALVIIVRLFDQI

SEQ ID NO: 154402 - protein, 33 aa, Heterodera glycines
  Coding regions on vcDNA: vcDNA=SeqID_80825; Strand=-; Position=1 -7,330-424
MKAKFWVWLIDQFQIDKKRSNGESENAFDVVIN

SEQ ID NO: 154403 - protein, 76 aa, Heterodera glycines
  Coding regions on vcDNA: vcDNA=SeqID_80826; Strand=+; Position=1-231
MNGDLIGYLNEMESMESPQVRKSKSSPTIAEVNGGKAVEKTQQTQQGKGALNKLNHGHGRQRNSNSEKGPSPSGQN

SEQ ID NO: 154404 - protein, 38 aa, Heterodera glycines
  Coding regions on vcDNA: vcDNA=SeqID_80827; Strand=+; Position=1 -68,327-375
MVSDATDGEQQQQKRKKKRKRGSPSVHLLFSVALNKQP

SEQ ID NO: 154405 - protein, 376 aa, Heterodera glycines
  Coding regions on vcDNA: vcDNA=SeqID_80828; Strand=-; Position=1 -93,155-260,311-458,503-709,751-797,841-942,986-1113,1171-1234
  Homolog annotation: Hit_ID=NP_509083.1; Match level="QueryCoverage =99%, HitCoverage=70%, E-value=1e-107, Identity=56%"; Hit description= fumarylacetoacetate hydrolase (46.0 kD) (XH66) [Caenorhabditis elegans] gb|AAK39259.1| Hypothetical prot
GDYTDFYSSIYHATNVGTMFRGKDNALMENWKWLPVAYKWLPVAYHGRASSIVVSGTAVNRPWGQVKAEDGSFPNFVTSRLMDFELEMPNFVTSRLMDFELEMAFFVGGPENALGTPIPIEKTEEHIFGMVLMNDWSARDIQKWEYVPLRDIQKWEYVPLGPFLGKSFATTISPWVVTMEALRPFVVDNPSQNPSPFAHLNHSDPYSFNIDLTVEIKPEGSDRSVPEGSDRSVPICRTNFRHLYWTLKQQLAHHTSNGCNHLYWTLKQQLAHHTSNGCNVRVGDLMGSGTLSGPTPDSFGCLLETPDSFGCLLELSWKGTNAVKLGESGETRKFLKDGDEVIISGVAPTGEIRIGPTGEIRIGFGECRGKLLPAIK

SEQ ID NO: 154406 - protein, 54 aa, Heterodera glycines
  Coding regions on vcDNA: vcDNA=SeqID_80829; Strand=+; Position=1 -93,161-232
MNACLFCLIPTVAKLVEERGGLAVSSEWVIQAIVTGSLPDLGEPGGEKFRYDFV

SEQ ID NO: 154407 - protein, 113 aa, Heterodera glycines
  Coding regions on vcDNA: vcDNA=SeqID_80830; Strand=+; Position=1 -300,376-419
APQPDTDAEKPQPSEEGPSTSEATAQDNDGQPSSTPTPVTPLEMDVPSVEMMGIGVSFPSTPAYEDQQIQPMPSTSTARCDVVATPSTSKGDGGFGLDDGWPLLSSRHTREDR

SEQ ID NO: 154408 - protein, 382 aa, Heterodera glycines
  Coding regions on vcDNA: vcDNA=SeqID_80831; Strand=-; Position=1 -484,642-1303,3001-3021
  Homolog annotation: Hit_ID=XP_497341.1; Match level="QueryCoverage =99%, HitCoverage=58%, E-value=1e-44, Identity=28%"; Hit description =PREDICTED: similar to submaxillary apomucin [Homo sapiens]
SPGLSFYDSITVNHSPAFITGTQPSSISITGTQPSSISITGTQPSSISITGTQPSSIPVTGTQHTSISITGTQFSRTSITGTQHTSISITGTQFSRTSITGTQFLCISITGTQDTSISITGTQFSRTSITGTLFSCVSITRIQFLCIPITGTHSPAFQSLGLNPTSIPITGTQFSIIPIPGTQSTSIPVTGTLFSCIPITGTQLSDIPVTGTQFSSIPITGTQLTIIPIAGTTSPDSSVSQSSRLNSAAFQSLGLNSLAFQSQGLKSPGLITGTLFSCVSITRTQFLCIPIAVTHSPAFQSLGLNSLAFQSLGPTGPSASIIETQFCDIPITGTQFCDIPITGTQLTSIPITGTQFSIIPIPGTQSPSIPITGTQSLCGEFL

SEQ ID NO: 154409 - protein, 114 aa, Heterodera glycines
  Coding regions on vcDNA: vcDNA=SeqID_80832; Strand=-; Position=1 -81,211-474
MCSTGQYTNSECHNTQSTVPDSKLNPQNSDNDKQVSLTNPYKGISPSPPALDTPAHRPNRTGLSLEPTSEFKVQRLGLLTPLRPAIIAWLIARIIPFTCGEPLAPTTTPIFIHV

SEQ ID NO: 154410 - protein, 49 aa, Heterodera glycines
  Coding regions on vcDNA: vcDNA=SeqID_80833; Strand=-; Position=1 -9,377-517
MFQAWNETWVGSALGFLKPEIHGITDDLKTVRYPGDEKFPTYLVDLKKS

SEQ ID NO: 154411 - protein, 83 aa, Heterodera glycines
  Coding regions on vcDNA: vcDNA=SeqID_80834; Strand=-; Position=1 -63,345-459,1056-1129
  Homolog annotation: Hit_ID=CAA74206.1; Match level="QueryCoverage =72%, HitCoverage=17%, E-value=2e-12, Identity=55%"; Hit description =serine proteinase [Heterodera glycines]
MISQPLLLLVGAVLHHIVRTTGDSGSGLMKNNNNIWVQVGVSSQTTCYPTDPTRTEGLTGQFAPIDCAWIEKATNGEVKCKNN

SEQ ID NO: 154412 - protein, 195 aa, Heterodera glycines
  Coding regions on vcDNA: vcDNA=SeqID_80835; Strand=-; Position=1 -168,222-288,408-488,752-945,1467-1544
  Homolog annotation: Hit_ID=CAA74206.1; Match level="QueryCoverage =84%, HitCoverage=44%, E-value=6e-33, Identity=47%"; Hit description =serine proteinase [Heterodera glycines]
MLANLSLPMVLLAFYSINSKLLIVSCQQSSNFSECGISDFEPQLANVSKMAIGTNHVYKGQEVGDDKALPWIVRLIFGKSYCSGTIIGPRHILTALHCTEHNVAENQIVIAYGSANLKQQQQLTGVAAVKLHPKGTDAQRNQINDAKADKNVIIKAQRVQPNPYDMAIIELKNPLAFTANARPIWFMEIWLPNKF

SEQ ID NO: 154413 - protein, 56 aa, Heterodera glycines
  Coding regions on vcDNA: vcDNA=SeqID_80836; Strand=-; Position=1 -50,334-454
MISPEILRQNNIVALERQKGVNGDEAKAQEQWNELTVERHKTYYLQIILLYDGYSS

SEQ ID NO: 154414 - protein, 170 aa, Heterodera glycines
  Coding regions on vcDNA: vcDNA=SeqID_80837; Strand=+; Position=1 -45,782-952,1181-1358,1616-1734
MLFKKSSIFDERSSALFASVSQVLACLHPFDSFIFSPILRWFEQCVVGQFFGQIHSDLLKMLINFLEMIQFRGGHKTGKLMADGLFCHVHSELESIKNDTHFANSSNYFLRFKSLNQKFLLKKFKYVKKLNYPGNGRCRFLPMVITDYLLSHWDLSTVIGHPSPIVLFPT

SEQ ID NO: 154415 - protein, 156 aa, Heterodera glycines
  Coding regions on vcDNA: vcDNA=SeqID_80838; Strand=+; Position=1-471
MAQQFDKKHGAKRVEFNIGDKVQFVNYRDGKTLWLFGEVVTKKGLIFGIRSPQIANRIVTRHANAMRLTQALGTDQTWPNFDEEPKKNKSPVRAPQIQRNVTPTPPAERTHDQFEQNEEQEQNQQQTPVLRRSERVPKRVRFLSPSMTGQRHNIRQ

SEQ ID NO: 154416 - protein, 46 aa, Heterodera glycines
  Coding regions on vcDNA: vcDNA=SeqID_80839; Strand=-; Position=1-142
RAVREVIFTGNRETRPRNDPGKRYENRDPKNPRNFSTRESRTEKSK

SEQ ID NO: 154417 - protein, 59 aa, Heterodera glycines
  Coding regions on vcDNA: vcDNA=SeqID_80840; Strand=-; Position=1-179
MDDEEMGTNPNDQMSEYYNENNTKSDQNKKAEPNDQQKREIIQKFEAIKEKLKQKGKYQ

SEQ ID NO: 154418 - protein, 90 aa, Heterodera glycines
  Coding regions on vcDNA: vcDNA=SeqID_80841; Strand=+; Position=1 -51,194-260,770-924
MRGKRTHRMYLPFLIVFGIGLVFMIFYGGADIFVKMNENEIGSYFFSWFLTLALNVWLYSIVLRAYFFMKRQNQNMNGAERNQKFENIAL

SEQ ID NO: 154419 - protein, 265 aa, Heterodera glycines
  Coding regions on vcDNA: vcDNA=SeqID_80842; Strand=+; Position=1 -177,551-673,879-988,1036-1423
  Homolog annotation: Hit_ID=AAC59744.2; Match level="QueryCoverage =100%, HitCoverage=49%, E-value=2e-56, Identity=51%"; Hit description= kinesin-related protein XKIF2 [Xenopus laevis]
MIRDYQSQLIYRPLSLEDEVMDNRICVCVRKRPLGKRELASREVEVITVPNRDHVIVHQDCSNGIYAMTAHDVFAMLHSPEYANQKLTLSCSFFEIYGSKVLKLIKLGSDQRTAGQTSANSNSSRSHAVFQIILRKWEKERDNLYGKISLIDLAGNERGADTISSDRQTRLEGAEINKSLLALKECIRAMGQDEGQHIPFRGSKLTLILRDSFIGQNAKTCMVRRNAQKLGIGLSFIYILQQIAMVSPGISSVENSMNTLRYADR

SEQ ID NO: 154420 - protein, 101 aa, Heterodera glycines
  Coding regions on vcDNA: vcDNA=SeqID_80843; Strand=+; Position=1 -157,210-358
AWTSLVAAFSQQTLHCAKVGGENAAESPRGAAGRRLREAHSTASCVRFACTRSQLALLLPSPRSLYVSLRPFEFATHFHRFFHFRRASRISLSDSEDTKTV

SEQ ID NO: 154421 - protein, 235 aa, Heterodera glycines
  Coding regions on vcDNA: vcDNA=SeqID_80844; Strand=+; Position=1 -174,437-970
MWTVLEKYFRSLRDRDCPKFLRQIFDDELTPRSEEWKVVVCVMCFAFDQFNQLNVISQQFYEDAYAYLCKWSRQFSEMDEVIGDWVIFESEPTSEKVRKAYRHFCGASTADEMNDLFAEIAELKQTLKELEGERFNRKNVDEKWPAIFKNPNFVLLKSLVSAILSIFPSNAFCESVFSVLKNIKTDERNSIGIPLLNSLISIKFNSKISCLNVHNYFLSLPNLLKQVKSGDKYVV

SEQ ID NO: 154422 - protein, 370 aa, Heterodera glycines
  Coding regions on vcDNA: vcDNA=SeqID_80845; Strand=+; Position=1-1113
  Homolog annotation: Hit_ID=NP_502799.1; Match level="QueryCoverage =90%, HitCoverage=52%, E-value=9e-11, Identity=22%"; Hit description =putative nuclear protein, with 2 coiled coil-4 domains (4P607) [Caenorhabditis elegans] emb|CAB16521.1| H
MGKRHQCPYSSLFTRHEFKTAGGLGNKINEAFTHHYKIKKQRGKREAKAEDTKDSKIDVAKRAAERAGRDVERHLNHINNVSSSIQTKLSTLREVNPQILEEPDIKVWFDKMVEKGTEIQTYRNELKSFQEEVDKAKNTTLEHVEKNDLKEAKKSADVAKGIAKQAKSKYSSTLEEYNDKSEKGYIGIVNRLNEALGEHIKRKDIENRQVSEAEKGPQKRERLANEDVQFQYDSIDQKFIVYLSAAVSHIDLSKHLAYVLGFKNTRLFHAEEANYMPDLTGGVRQLYIYAPNLIENTIIGNQMAPLLRIVNVVNDPGSISEVIYSTEYFHRLQSKRISEITIEIHTPFGEFVKFHWGSCILTLHFKKSIF

SEQ ID NO: 154423 - protein, 20 aa, Heterodera glycines
  Coding regions on vcDNA: vcDNA=SeqID_80846; Strand=+; Position=1 -21,72-113
MKDLEKLLFLVANKTSVTNP

SEQ ID NO: 154424 - protein, 213 aa, Heterodera glycines
  misc_feature (10)..(10): Xaa can be any naturally occurring amino acid
  misc_feature (99)..(99): Xaa can be any naturally occurring amino acid
  misc_feature (186)..(186): Xaa can be any naturally occurring amino acid
  misc_feature (189)..(189): Xaa can be any naturally occurring amino acid
  Coding regions on vcDNA: vcDNA=SeqID_80847; Strand=+; Position=1 -133,270-430,833-1183
  Homolog annotation: Hit_ID=XP_509302.1; Match level="QueryCoverage =72%, HitCoverage=33%, E-value=2e-32, Identity=42%"; Hit description =PREDICTED: similar to transmembrane protein 16D; transmembrane protein 16D (eight membrane-spanning domai
FCEWLLDAAXISDFNPRIKKRIEPETYFCQPFVAQHFERWVVNHPETFFTRADRARMVHDLLIRARYDRGESINKLRFGIDKLLRNRTYTAAFPLHENXIKKRNASILNGNDRQLLYESWVKMKNVFKYQPLDLIRTYFGTKIGFYFAWLGYYTRCLWPVSVLGILFVLYGLFTIPSDTPRQVLAXGSXVVLQKIRVLSRLKILPYRDLDPGF

SEQ ID NO: 154425 - protein, 31 aa, Heterodera glycines
  Coding regions on vcDNA: vcDNA=SeqID_80848; Strand=-; Position=1-201
LRLRCLPPINFAFKKILNNHDGKKRILKNIN

SEQ ID NO: 154426 - protein, 92 aa, Heterodera glycines
  Coding regions on vcDNA: vcDNA=SeqID_80849; Strand=+; Position=1 -71,285-492
  Homolog annotation: Hit_ID=NP_727578.2; Match level="QueryCoverage =88%, HitCoverage=7%, E-value=9e-14, Identity=49%"; Hit description =CG10353-PB, isoform B [Drosophila melanogaster] gb|AAN09305.2| CG10353-PB, isoform B [Drosophila melanogas
FYSKLALKLTEWECPRTQSEFDNSYTFKVFLFQFVNFYSSLFYIAFIKGKFTSPSHVNRGINADRTELRFGYIRKLLLNIIIQIFMFRKSVF

SEQ ID NO: 154427 - protein, 99 aa, Heterodera glycines
  Coding regions on vcDNA: vcDNA=SeqID_80850; Strand=-; Position=1 -20,66-345
  Homolog annotation: Hit_ID=AAL78214.1; Match level="QueryCoverage =93%, HitCoverage=49%, E-value=1e-10, Identity=33%"; Hit description =putative esophageal gland cell protein Hgg-20 [Heterodera glycines]
MSSDNEIFICSDCGLLVFDFLAPSQLGLEIALISRRFDCIVNEHFKTRKWKLGKMQICHEIGENGTKQMQIVNSDGNPLPIPQNPLPNKVIGFRRIHIM

SEQ ID NO: 154428 - protein, 15 aa, Heterodera glycines
  Coding regions on vcDNA: vcDNA=SeqID_80851; Strand=-; Position=1 -22,424-449
MRKNGQNVSQNFGKS

SEQ ID NO: 154429 - protein, 111 aa, Heterodera glycines
  Coding regions on vcDNA: vcDNA=SeqID_80852; Strand=-; Position=1 -36,160-400,461-521
GGSTIERGGPDVWNTSIEPFELVNDRTKEKLTFEKMPRYGAADEDGCEFTERLLLKRCPISEKATAVQWENWDANLNKVTIFLWADINKSIGPLSPPTEEENEEADESNEK

SEQ ID NO: 154430 - protein, 100 aa, Heterodera glycines
  Coding regions on vcDNA: vcDNA=SeqID_80853; Strand=-; Position=1-303
MANQNAFINSFTFHFSRLSWAMEAPSSVAVDDASFDYSAGGDELANKSTPRRRRGYIPYSTIYERQKGGYWVPGLQVEATIVHVERDVSSSYHILNPFMC

SEQ ID NO: 154431 - protein, 149 aa, Heterodera glycines
  Coding regions on vcDNA: vcDNA=SeqID_80854; Strand=-; Position=1-451
PPPTTVVRVNQTVPGLGAAVRPDLLAVDEQNKTALIIDVAMPFENRYQAFERCRQGKRQKYEDLAEHYRAIGFDVLLEAFIVGPLGGWDPHNEFVLNKMKIGQHYRQLMRRLMVSDAIRWSRDIYVEHLTGVAQFRDDDVEGVRGEAPN

SEQ ID NO: 154432 - protein, 21 aa, Heterodera glycines
  Coding regions on vcDNA: vcDNA=SeqID_80855; Strand=-; Position=1 -58,118-125
MGHENGRGGVGGRLAECFAAL

SEQ ID NO: 154433 - protein, 130 aa, Heterodera glycines
  Coding regions on vcDNA: vcDNA=SeqID_80856; Strand=-; Position=1 -29,536-899
MPKLSFSNWRFPSDVLTEKELLGVYQFNSHPFLYLRGVPGLYSLDFPSHGRISDWNKAKSNRRRTLALEIEKVSEFAGESVGRSRFSDAVEINGFEWKIEAEITKGIDEKKYLGFYLLCDAKEGPILIMF

SEQ ID NO: 154434 - protein, 50 aa, Heterodera glycines
  Coding regions on vcDNA: vcDNA=SeqID_80857; Strand=-; Position=1-150
MFWRLNCLAAILFALCCTSSTFWLGSDTTDEQNKAPHVDHHTLTETQQYE

SEQ ID NO: 154435 - protein, 94 aa, Heterodera glycines
  Coding regions on vcDNA: vcDNA=SeqID_80858; Strand=-; Position=1 -143,256-276,579-698
  Homolog annotation: Hit_ID=NP_508960.2; Match level="QueryCoverage =48%, HitCoverage=7%, E-value=2e-10, Identity=69%"; Hit description =abnormal CATecholamine distribution CAT-1, abnormal catecholamine distribution protein 1 (cat-1) [Caenorha
MTDRQQKAMAAFRVQKQLERHQALTEENVHVGLMFGSKALVQLLANPLIGPLTNKLRNHVSVHAAVRLWHFLLHSLARPFFARRRFRLYQHFRN

SEQ ID NO: 154436 - protein, 37 aa, Heterodera glycines
  Coding regions on vcDNA: vcDNA=SeqID_80859; Strand=-; Position=1-111
MAAWLDAFVQKYRSNRRVLLCIVYVALFLDNMLLTTV

SEQ ID NO: 154437 - protein, 132 aa, Heterodera glycines
  Coding regions on vcDNA: vcDNA=SeqID_80860; Strand=-; Position=1-399
MEVEQDKPPKPSQKEQLNSDASEFAASLSAATTGLDLGQTAVPKEQPNKADASGFFSAVSAATMGISSEQQQQTTTKKEKEQTDHEILDEFLESVSAATTNMDVSQKRKPKKKVKKDMEDEEMTAIASITRK

SEQ ID NO: 154438 - protein, 181 aa, Heterodera glycines
  Coding regions on vcDNA: vcDNA=SeqID_80861; Strand=-; Position=1 -291,335-587
MSINLHDKKSLMDNILPVVEINQTNNGITVSSERIAIPRTVQFDILGKCRECKATECETEWCVSKEGVTIWCTRFKISPRFVPFDVIYDLPGYTFFKIRNKGRVFNVDHGFRSNACTQTPTPVYHLPPPPPPPQLPKRKQESHQDAEQRVAHQFFDSVSAATTGLDIARHQTRQGDGKEFF

SEQ ID NO: 154439 - protein, 58 aa, Heterodera glycines
  Coding regions on vcDNA: vcDNA=SeqID_80862; Strand=+; Position=1 -78,125-223
MARQSTILPIYKRQSRRQQQHFHFDNVLVFDGGSRRQFQLSWFCIALIVILFVAWFIW

SEQ ID NO: 154440 - protein, 23 aa, Heterodera glycines
  Coding regions on vcDNA: vcDNA=SeqID_80863; Strand=+; Position=1 -20,82-133
MLLIIVRKENYFNWVSIIFLEEL

SEQ ID NO: 154441 - protein, 51 aa, Heterodera glycines
  Coding regions on vcDNA: vcDNA=SeqID_80864; Strand=-; Position=1 -104,454-505
MEAVHNETPSGMPTHKRTIKVNKILFDYCLTNKSRTRFTMRINHKRINFLN

SEQ ID NO: 154442 - protein, 386 aa, Heterodera glycines
  Coding regions on vcDNA: vcDNA=SeqID_80865; Strand=-; Position=1 -291,335-1204
MSINLHDKKSLMDNILPVVEINQTNNGITVSSERIAIPRTVQFDILGKCRECKSTECETEWCVSKEGVTIWCTRFKISPRFVPFDVIYDLPGYTFFKIRNKGRVFNVDHGFRSNACTQTPTPVYHLPPPPPPPQLPKRKQESHQDAEQRVSHQFFNSVSAATTGLVIASHQTRQGDGKEFFGAVSAATMGMDIEQKNEKPKLRQQRADASDFFSPISAATMGMTAEYLKPKPKPRQQPVDASNFFSPISAATMGMEVEQDKPPKPSQKEQLNSDASEFAASLSAATTGLDLGQTAVPKEQPNKADASGFFSAVSAATMGISSEQQQQTTTKKEKEQTDHEILDEFLESVSAATTNMDVSQKRKPKKKVKKDMEDEEMTAIASITRK

SEQ ID NO: 154443 - protein, 254 aa, Heterodera glycines
  Coding regions on vcDNA: vcDNA=SeqID_80866; Strand=+; Position=1 -69,772-909,960-1082,1241-1411,1633-1828
  Homolog annotation: Hit_ID=NP_502573.1; Match level="QueryCoverage =98%, HitCoverage=49%, E-value=2e-45, Identity=37%"; Hit description =ferredoxin NADP+ reductase (51.1 kD) (4O141) [Caenorhabditis elegans] emb|CAB60604.1| Hypothetical protei
AIGRALSLALSLRDAMAGSVKLDFGPNIAVIGSGPSGLYVCARLLQRSRCRIDVFDKAQAPYGLIFYGVAPDHFDMKKSMNNFERMFNDYGVAPDHFDMKKSMNNFERMFNDNRDRIELFCNVDIGRDFSYGELCDSYEAVVLAYGANRARRMSIPNENAANCLSGSAFVSWWEIKKGTSKHSTCGQSVVIIGNGNVAIDCARILLSDPDVRLAGTDITEKALRALRQSRVRRVRVLGRRGPQNFVLNQARVKG

SEQ ID NO: 154444 - protein, 257 aa, Heterodera glycines
  Coding regions on vcDNA: vcDNA=SeqID_80867; Strand=+; Position=1 -209,995-1107,1339-1554,1635-1693,1979-2086,2516-2586
  Homolog annotation: Hit_ID=NP_493169.1; Match level="QueryCoverage =43%, HitCoverage=27%, E-value=3e-19, Identity=38%"; Hit description =endonuclease/exonuclease/phosphatase family (1N85) [Caenorhabditis elegans] pir||T25386 hypothetical prot
STKQPKNDDANYAVESQKQKVRASSSIEISDSSSSGVQNSDEKRYLKQYLFLNFVTKRLKIINQIVKKKVWSERMFLQVAHEINEIFSHSHYFHSGFTGSGTCVLSSGDWFGGKIVGMVEIMVEQYRVAFYTTHLHAEYNPENGLCNIQNEAAVVQISLRLLLNYDFLMSQFIRHTSRGCGRRLHGQRLDYVMYRSGKTELNLVECVNCFNKIPGSELNFSDHIGVSATFSFVKGLTIEMKALKETKNSIKKLLRSL

SEQ ID NO: 154445 - protein, 106 aa, Heterodera glycines
  Coding regions on vcDNA: vcDNA=SeqID_80868; Strand=-; Position=1-320
MQRNFLSALFLLLFVLLYVHQTLAGGCASSISLNKIKKKKKQQSSTAEEEETVHTPRNRANAEHGNVSDIGTGPAGNVGMASTSADTRLNEEESPLRKTGKISKDR

SEQ ID NO: 154446 - protein, 73 aa, Heterodera glycines
  Coding regions on vcDNA: vcDNA=SeqID_80869; Strand=-; Position=1-222
MEAAARAKLGTKKPAMMARKTTTTMAVMTRKPMGMKRLTLKKNHSQQQQQTAMVAVVVAQQCCPALALPCWTE

SEQ ID NO: 154447 - protein, 43 aa, Heterodera glycines
  Coding regions on vcDNA: vcDNA=SeqID_80870; Strand=+; Position=1-129
VWPVCFVTTAIRSAKCRSTRFCFHQRSAQCHVPDWPSWTCANG

SEQ ID NO: 154448 - protein, 28 aa, Heterodera glycines
  Coding regions on vcDNA: vcDNA=SeqID_80871; Strand=-; Position=1-84
MANPKSISQNHIMPFHDYLFSEAEKTRS

SEQ ID NO: 154449 - protein, 35 aa, Heterodera glycines
  Coding regions on vcDNA: vcDNA=SeqID_80872; Strand=+; Position=1-143
TLFLLFCLRSLSSSRSNYAISLKGISIRTARIIQI

SEQ ID NO: 154450 - protein, 104 aa, Heterodera glycines
  Coding regions on vcDNA: vcDNA=SeqID_80873; Strand=-; Position=1 -27,572-811,963-1012
  Homolog annotation: Hit_ID=AAB61596.1; Match level="QueryCoverage =99%, HitCoverage=43%, E-value=6e-43, Identity=76%"; Hit description =galectin [Globodera rostochiensis]
SAVHTVENPPMPFRWPIEYGMQTGAELIMTGATYNGQQKQFVVNLNGRGDDVVLHVNPRFKFLEDTIVLNNRSYAGWQKEERHRNKWHIGEEFDLRKIMGHPDF

SEQ ID NO: 154451 - protein, 189 aa, Heterodera glycines
  Coding regions on vcDNA: vcDNA=SeqID_80874; Strand=-; Position=1 -160,235-288,707-813,891-1032,1089-1127,1180-1236,1284-1292
  Homolog annotation: Hit_ID=CAE61462.1; Match level="QueryCoverage =94%, HitCoverage=69%, E-value=6e-67, Identity=56%"; Hit description =Hypothetical protein CBG05354 [Caenorhabditis briggsae]
MNSTPTNVTAARRTKRQAGYEAGGGSGAATNVAVDAYGTSCDSCCLPGPQGPPGAPGRPGRPGKPGAPGLPEWQVVLCVYMIITLKPIKLSGNPGRPPMQACEPITPPPCKPCPQGPPGPQGPSGPPGDPGTPGMPGSPGRDAQPGEPGPKGPPGPPGEPGLPGPPGDPGVPAFSEPLLPGEPGPPGDP

SEQ ID NO: 154452 - protein, 43 aa, Heterodera glycines
  Coding regions on vcDNA: vcDNA=SeqID_80875; Strand=-; Position=1-3,33- 160
MFSDYFSLSAQFKELLFDSWLIVYFFSMFGLCVQFVYRFLVLN

SEQ ID NO: 154453 - protein, 72 aa, Heterodera glycines
  Coding regions on vcDNA: vcDNA=SeqID_80876; Strand=+; Position=1 -53,807-972
MKEMLINVTCNLFAKSTVHKKAFMKLRFGFFELKNRNSESDGSKPEPKIISFNDLDNKLTDFLQIWILRKIN

SEQ ID NO: 154454 - protein, 76 aa, Heterodera glycines
  Coding regions on vcDNA: vcDNA=SeqID_80877; Strand=-; Position=1-231
MRIFCILILIIFTCFSNQSIFFLNLSPPSPQHFFLSILAVFETAALFTPVALMPTAGDKADEDEAPLLAADRMAEE

SEQ ID NO: 154455 - protein, 243 aa, Heterodera glycines
  Coding regions on vcDNA: vcDNA=SeqID_80878; Strand=+; Position=1 -237,388-504,612-660,769-849,891-967,1075-1183,1230-1289
  Homolog annotation: Hit_ID=NP_497725.1; Match level="QueryCoverage =60%, HitCoverage=23%, E-value=3e-46, Identity=62%"; Hit description =general substrate transporter family member (3E602) [Caenorhabditis elegans] pir||T23658 hypothetical pro
MIKIRGWSVSSLLDDHSSAIRSAANSGASSSSALSPAVGINATGVKSAAVSKTAKIDRKKCCGDGGDKFRKKMDWLEKQRATHQFLLAKMVSMNIVSPTAAGPKLPKHKPKLGKFIYLLAFIAVIGGFLFGYDTGIVSAAMLYVPKNSDLKPMSNAWIGLIVSITPGMAGVGALLAGKASDIFGRRKMIILSTIIFTFGAIVCAIGVSKWILLAGRIFLGIAIGFASMIVPIYVSESSPAHIR

SEQ ID NO: 154456 - protein, 42 aa, Heterodera glycines
  Coding regions on vcDNA: vcDNA=SeqID_80879; Strand=-; Position=1 -48,594-674
MQIWYHCKAHKKCYPMSMKVNAILKLVCSDGFYRPYEKDLSH

SEQ ID NO: 154457 - protein, 17 aa, Heterodera glycines
  Coding regions on vcDNA: vcDNA=SeqID_80880; Strand=+; Position=1 -12,117-158
MAKTGGNEVHPLEMAGL

SEQ ID NO: 154458 - protein, 58 aa, Heterodera glycines
  Coding regions on vcDNA: vcDNA=SeqID_80881; Strand=-; Position=1-176
MTIAETRKMPGFRPGWPKSLGSRLGMRKSRDLDLDGKIPRVVDWRKVIYALINILSLL

SEQ ID NO: 154459 - protein, 101 aa, Heterodera glycines
  Coding regions on vcDNA: vcDNA=SeqID_80882; Strand=+; Position=1-306
MPIYSILAALCNGIDYNPQNQQQHNWTYEGSQSPSPVGPFADGSTDFSLFANMSQPWHSQSDSQTEPPKPTDSYAEVAAKPPTVANTRYNSIIYMDMRFTR

SEQ ID NO: 154460 - protein, 134 aa, Heterodera glycines
  Coding regions on vcDNA: vcDNA=SeqID_80883; Strand=+; Position=1 -361,695-738
MPLASVEPKKKSPTVGDEDEKAATDNLQKSQICHFWEAHKSGKSRTKCQNGANCKFAHGEKELKKIVPPYFKNHLCKVSAPFGIINNVRVQHWSSGKCLNGEGCHFAHGPEQLRKVGLTKGYHVFYATYVKIYM

SEQ ID NO: 154461 - protein, 759 aa, Heterodera glycines
  Coding regions on vcDNA: vcDNA=SeqID_80884; Strand=-; Position=1-2280
  Homolog annotation: Hit_ID=BAB64297.1; Match level="QueryCoverage =66%, HitCoverage=4%, E-value=5e-11, Identity=22%"; Hit description=I- connectin [Procambarus clarkii]
MGHTMKRLTENLWTTERPSKVEYAWIGERCETTVNDFIEKGQGGILDFYLVTSFGHNFNPYNGWEEGQKWTFIWEIPEPSEAYWATHFPVGDFVAEVTENAIVLESEQSVFYFEKEKGDEREGIVGVPDEAYKMSNDVFILIHTPSPQKAREKRETKQKSEPQRKERPAKQEVFLKIRPGQNSKFENLDPASRPKSNWTRTTLSPKRNTTELIILSTPVPQSTSTVGSTTKVTMAIPTKIITSTVPTTIRPKTEVKKPIFEKIQIKNEQKTQSVYKAVGKKVEQLVATTTKAPFTTTKKSKIENTLKKATPKPKIVGLKSTTQKVLSTVRPSTNKVVNELFPKSVTTPSTILAVKSANNSKNFSKHVLGKKPEVELKKATTASLFPKTIKHTEPTMNVTEIPALMTPIPPTTQKIVEKVELPKEKVENKSDSIKAEKKNEKLLIPSTAITVVKKIEDEKVREVSEKTVKNKKSEEEYSQEVEAEVIESLANDGNEMEEFENSFEDESDEEVSVELSDEIEIFDMDRRKRTTVTTPDARWIKKVEKSKVRNKAGQENKNLNTRVNYALYRLNEEKRRQYDHIYKQACENTKFQLQLAKAVLQINPNEGVRKIFNRDDLVARWKGDNLEVGFCAPVTPEKIFWDRKMGNDCYEWIPIFAENTTFFIRPGTRELSIIGKRMECTEMEKTNNMNNATQKEIVQRLTENLGNIKPKYRNIQNPLVLRAGALFESDSLRLEEAMREYRSKMNNLPLSIVESCSET

SEQ ID NO: 154462 - protein, 124 aa, Heterodera glycines
  Coding regions on vcDNA: vcDNA=SeqID_80885; Strand=-; Position=1-375
MKKQLYKLRNEQESKIISQGQNSVNKFIRNKLSKFFEIPTLIDNAGNMFSSNVQKCKILAEIFQKSFLRKSIVNGPQTQSTQNKIKLSDIELNAGIIWNILRRLPRRNSTSPDNVPYILLKNCA

SEQ ID NO: 154463 - protein, 100 aa, Heterodera glycines
  Coding regions on vcDNA: vcDNA=SeqID_80886; Strand=-; Position=1 -186,865-969,1209-1220
MITEAIINSEQLKEKSTRAVIEKLPEAMDQQAVVEQFAEQCGVKDKLSPDIHRHPRTRPEGGNTKKLLKFISDQSDSENTIFCGDFNIPNILWDENKKRF

SEQ ID NO: 154464 - protein, 192 aa, Heterodera glycines
  Coding regions on vcDNA: vcDNA=SeqID_80887; Strand=-; Position=1 -25,724-847,1131-1260,1305-1427,1511-1647
  Homolog annotation: Hit_ID=CAE62536.1; Match level="QueryCoverage =97%, HitCoverage=23%, E-value=2e-45, Identity=52%"; Hit description =Hypothetical protein CBG06645 [Caenorhabditis briggsae]
SYVCKGGGDFRSNYLFNDKIANIEKCDALLLVGTNPRYEAPVLNARIRKTYLYSDIEIGLIGANVDLTYDYTYLGPNSSVLDDLLNGKSSFSKKLENAKHPMIVKLENAKHPMIVVGAQAFQGENSSSLLQKLHQLAEKLRSTSQPKPKVLNLLHEFAGHVAAFDLGFRPFNELNSEVKRSIKLLYLLGSDE

SEQ ID NO: 154465 - protein, 87 aa, Heterodera glycines
  Coding regions on vcDNA: vcDNA=SeqID_80888; Strand=-; Position=1-646
IIFIQKIFFWVFGAVPLNRCAQIYGETESFGNSFPIVCTLILRWIFAPHNCLSTPNGHLKKSIYFCFRGSPPEPMRPDLWGDRILRE

SEQ ID NO: 154466 - protein, 48 aa, Heterodera glycines
  Coding regions on vcDNA: vcDNA=SeqID_80889; Strand=+; Position=1 -111,1175-1210
MHFTAIVDAFSTNSQCWPSPDRSLQRRAVFRPEKMKIYTNCKDEAKGN

SEQ ID NO: 154467 - protein, 134 aa, Heterodera glycines
  Coding regions on vcDNA: vcDNA=SeqID_80890; Strand=+; Position=1 -105,212-329,699-760,811-930
  Homolog annotation: Hit_ID=P48817; Match level="QueryCoverage=94%, HitCoverage=88%, E-value=3e-24, Identity=42%"; Hit description =Nucleoside diphosphate kinase (NDK) (NDP kinase) gb|AAA90988.1| nucleoside diphosphate kinase pir||JC4359 nucl
MERTFICLRPTNPSPVGRVIARFESNGLKLIAMKMINATRNQATEHYKEYRDRPFFNKLINYITSGPVVAMVWEGIDSVKKSLHLLESACFYNLRNMDECRDIVRHGSCNVQDAQRKINIWFSPNELRINSTSR

SEQ ID NO: 154468 - protein, 54 aa, Heterodera glycines
  Coding regions on vcDNA: vcDNA=SeqID_80891; Strand=-; Position=1-320
ELLVLFDSSMCLLLICKISKILVKFQKSYGQKELKNPVIRTFFALIFLCINKNF

SEQ ID NO: 154469 - protein, 240 aa, Heterodera glycines
  Coding regions on vcDNA: vcDNA=SeqID_80892; Strand=+; Position=1 -88,316-413,536-737,796-1130
  Homolog annotation: Hit_ID=CAE64395.1; Match level="QueryCoverage =48%, HitCoverage=32%, E-value=7e-25, Identity=56%"; Hit description =Hypothetical protein CBG09085 [Caenorhabditis briggsae]
MAELAAKNLMAAKGATESARRSNGGTNANDELESVFEKAHYPDVVQREELANKTQLAEDRIQAKNGKNVGKKHNYGRVSEKKKAKRIEPPKRYGLYGAMVRHQLPLPDTITKCVGNPDDPQESAAPWLLGMHKKSMEAAVQFDQIGDHQDIDEMGEELKAMVVGGVGTKCGAGALMEFSEDEKFPKEEQRNCSGQGHEKKRRPHGKYGGKGMPTANNDSTLETQLGGGDSRQYIFGISGQ

SEQ ID NO: 154470 - protein, 69 aa, Heterodera glycines
  Coding regions on vcDNA: vcDNA=SeqID_80893; Strand=+; Position=1 -33,96-269
MALCVAIYDKHDALLYLRLKDRMSASPLEVQRFLHSSCDIVADKMNSPGNKATQQENFLGALLLSDRFR

SEQ ID NO: 154471 - protein, 81 aa, Heterodera glycines
  Coding regions on vcDNA: vcDNA=SeqID_80894; Strand=+; Position=1 -63,197-379
MSKPGGIVRIKNVSDFVEPSQKCILPLRQNGEGQKAVVGKRLVGIHAKSVPSAATAKRVKVTLDDCLVCSGCVTTGEVEFF

SEQ ID NO: 154472 - protein, 67 aa, Heterodera glycines
  Coding regions on vcDNA: vcDNA=SeqID_80895; Strand=+; Position=1 -161,283-398
  Homolog annotation: Hit_ID=CAE73775.1; Match level="QueryCoverage =94%, HitCoverage=46%, E-value=1e-09, Identity=45%"; Hit description =Hypothetical protein CBG21319 [Caenorhabditis briggsae]
LSDNTGTKFLLVIDAEEGTLKDHEIRLFFKNIHTKYCSAISNPFYSFGSTLQSSKIDAVVNELLASF

SEQ ID NO: 154473 - protein, 390 aa, Heterodera glycines
  Coding regions on vcDNA: vcDNA=SeqID_80896; Strand=+; Position=1 -622,925-1202,1422-1691
  Homolog annotation: Hit_ID=AAO32448.1; Match level="QueryCoverage =30%, HitCoverage=36%, E-value=5e-16, Identity=44%"; Hit description =MNN4 [Saccharomyces bayanus]
MGCMEMHFCRVDSHIECLYNGGAILRMCDECNGEQLCNAKEGAKLAHHSPSLAAFLRDRLQPVVGQQQWLQQQQAAHGIHQAAANAMQYQRVHPAPKAAAAVAAFFPPHAGSVQQLQPPAAGGSVLTQQPAAAHALSQAQAVQKQQHANGGAKGLQHPAHGSNILLHSASGSKHLRPRLRCFVGSEGQLQLVTCSQSELCTSSLCDTDGELTEVKFCGVPQFCTMTNDLCKRFNRGISLNCSQCDTDSCNGNSAFALASLVNHTFRDIMAAKINTLTALNGTKVSKKTEDDKKSNDTTPNETKMNARQKKKEEEEIKKKFEEIKKREEEELKKRKAEKERKAKEKEEAEKKEKEEKKEEKKNREKVKGNEKDKKEGEKRAEEPCRESVLQ

SEQ ID NO: 154474 - protein, 83 aa, Heterodera glycines
  Coding regions on vcDNA: vcDNA=SeqID_80897; Strand=-; Position=1 -67,120-217,690-776
  Homolog annotation: Hit_ID=AAG23825.1; Match level="QueryCoverage =66%, HitCoverage=4%, E-value=7e-15, Identity=76%"; Hit description =guanylyl cyclase [Heterodera glycines]
MPRFCLFGDSVNTASRMETSSSANKIHSSKETRNLLLENSNCGYIIESRGEMIIKQSWIGKDNKIHLKQFMLSPKTQNKAHEK

SEQ ID NO: 154475 - protein, 246 aa, Heterodera glycines
  misc_feature (22)..(22): Xaa can be any naturally occurring amino acid
  misc_feature (79)..(79): Xaa can be any naturally occurring amino acid
  Coding regions on vcDNA: vcDNA=SeqID_80898; Strand=-; Position=1 -255,592-726,821-1003,1626-1794
  Homolog annotation: Hit_ID=CAB55818.2; Match level="QueryCoverage =93%, HitCoverage=60%, E-value=2e-32, Identity=37%"; Hit description =hypothetical protein [Ixodes ricinus]
SRPTSLDQFTRKFKIQNALIIXNVLFNFSLVLVNAVYFKGNWAERFNAKYTKKKTFFVDQQNKKEVAQKNDWKDSSQSXKLSLSLQLLGMPYKGGEVFMFVLLPKDRFGLAKLLANLDGKRLLELTKKRFIPPSFQVVLPKFKLESTLQLEQSLASMGMANAFSDSADFDGIAEGDSLKISDVVQKAFIEVNEQGTEATAATGIRLVPLINAKNSPARFIADRPFFAVVVNSDPLPFLAQFSMDNL

SEQ ID NO: 154476 - protein, 94 aa, Heterodera glycines
  Coding regions on vcDNA: vcDNA=SeqID_80899; Strand=-; Position=1 -224,266-324
YPMASLRSHLKNHHQPKLKELEEKDKAAESLKNNEANPRQPTLKRIFATSSPVIKKIARAESATSSQLTIEKTFSQWTPDGEMTKKIDKAINDL

SEQ ID NO: 154477 - protein, 33 aa, Heterodera glycines
  Coding regions on vcDNA: vcDNA=SeqID_80900; Strand=-; Position=1-101
MITALAFVPIQHLTAAITALNDVVGQALEGILG

SEQ ID NO: 154478 - protein, 44 aa, Heterodera glycines
  Coding regions on vcDNA: vcDNA=SeqID_80901; Strand=-; Position=1-137
RQIALSLSHYDDSTVNDAQIAEAMGKAWQEQADAELARRLADQL

SEQ ID NO: 154479 - protein, 55 aa, Heterodera glycines
  Coding regions on vcDNA: vcDNA=SeqID_80902; Strand=+; Position=1 -25,341-483
MEIKMAKNTGIDACPCFISSKQIGHSSFVAVLCFVGAVTTAFFNFFHIFGAVPAV

SEQ ID NO: 154480 - protein, 106 aa, Heterodera glycines
  Coding regions on vcDNA: vcDNA=SeqID_80903; Strand=+; Position=1-321
MAAIAAHKKPWRKLVATALHEGIHCGAVYLGGCSKRDNICRAMAKAYGKKVTPQFDALRKIVEKAFPFVKPHLDVYECKRKILNTIYKEIVYRGAPPATTAVVWWW

SEQ ID NO: 154481 - protein, 336 aa, Heterodera glycines
  Coding regions on vcDNA: vcDNA=SeqID_80904; Strand=-; Position=1 -204,245-682,724-1002,1042-1131
MPPPSLAPRRTSSRLSHTPSLFSTPVSSRPSFLPITSQCASRHSSHFGYGCGAKSARHLPEYYDSLKNEQISCPKCNALLLPSEAKGPTAFSKCCAKGRVSLMERFNDLQKRPSSIMALFNNNDTTNIRWHSHLTQHSMAYNDSLAFGCVRIQRDPKLQNSFRIVKCNNMIRYVLWDFNAPKDDLPQLHGQLFTIPPEHARLRLDEIAKEKHLDENLLNYLHAVLREHHPYRKIYLTAAQTFKALNEDEKVNFKMLVVDTNKKGEERCVKTNCQNDDQLCSQERQISEIHPGRINVETVAGSKLVAQFFLDSGANVPPSHEYDIILRGKHGTGQHI

SEQ ID NO: 154482 - protein, 308 aa, Heterodera glycines
  Coding regions on vcDNA: vcDNA=SeqID_80905; Strand=+; Position=1 -317,842-1452
YKCKELESETVPVWAPIFKSKLSEKHLVYLGRKLSLDSSQMGQVGLWFGNDRMANESELSHRLRILSTNSEFDKLKAVKTFMELFLMQNSHIGILVVRHPLTFSAEVMRENELFISVSNLLEANMNTSSNAVRWLEFYFIFGKTFSYFKQIYNDEVLKTKIQNLWEFFTKVLKKVQEEQQTLSVNEMTNSIFQILSQLENNFGTRKLGQKSEDLFKKYAQHLSAFYKENESFRKKFDRNKLGRENIKKIFQLIDQSQRIMPRKFWELFDNAKNEFHAKSSSYLACPSGSEIWEKPTNSSEDSSECNYN

SEQ ID NO: 154483 - protein, 281 aa, Heterodera glycines
  Coding regions on vcDNA: vcDNA=SeqID_80906; Strand=+; Position=1 -102,160-249,308-388,446-526,586-676,733-813,871-1101,1155-1229,1481 -1494
  Homolog annotation: Hit_ID=EAL47359.1; Match level="QueryCoverage =50%, HitCoverage=25%, E-value=9e-09, Identity=31%"; Hit description =hypothetical protein 106.t00024 [Entamoeba histolytica HM-1:IMSS]
MFPDDDGYESEDDEILLPPPPIPPQLGHPPPNVPAVRVQPMHVGQQRLPLRDLPQFEDHPQNVPVIRVQPMPQPLPLRDLPQIFHPPPNVPAIRVQPMQQPVAMRAVPQFFHPPPNAPEIGVGPIHDGQQPLPLRALPQFAQPPPTCAGRSGPTSSTTDTTERRAAICQPTTKCAGNSCPTDASTVAAERHAANSPSTAKCDFNLDQIVVAFSQSLGVSSGNSCSTNSTGIRRTAICPSAAKLTVSSTRKRSGNPTTATTAPAERCATIRPPTAKRTEIRC

SEQ ID NO: 154484 - protein, 104 aa, Heterodera glycines
  Coding regions on vcDNA: vcDNA=SeqID_80907; Strand=+; Position=1 -105,179-388
  Homolog annotation: Hit_ID=AAP41028.1; Match level="QueryCoverage =100%, HitCoverage=25%, E-value=4e-54, Identity=100%"; Hit description=arginine kinase [Heterodera glycines]
MSSVSKFITNKGPFIAVGMGVVGMGYFGYYKFWRSSREIAMSYKQEDESDGYTVKRIEEAYKTLQEAKDCKSLLKKHFTADVKDKLKYKKTKLGASLFDVIRSG

SEQ ID NO: 154485 - protein, 490 aa, Heterodera glycines
  Coding regions on vcDNA: vcDNA=SeqID_80908; Strand=+; Position=1 -223,314-430,482-591,657-856,1055-1314,1359-1563,1624-1775,1884-1986
  Homolog annotation: Hit_ID=NP_496307.1; Match level="QueryCoverage =98%, HitCoverage=92%, E-value=4e-76, Identity=35%"; Hit description =diphthamide biosynthesis-like protein 2 (2K992) [Caenorhabditis elegans] emb|CAA86761.1| Hypothetical pro
SVASIDLDTFFEVDRICSWILSNKFQRTALQLPDELLEHSFHLVEAVERRVESAGTWEEQRGRLYVLADTSYRSCCLCCLDEIAAEHVACDSIVHFGDACLSARSSSIPALYIFCRLEKFVEQLEKFVEQFRIEFSEFGTEKQWDDCLLLCEAAYTHIQNSLGSAISRISLGSAISRILPPSVRLFNFEVSEPNSPSSSRRQVPVGFVIDQCSEKKRHCFLLFVGSTDSPLLPIWISFNLSFLFATLSSISDKSQSFSSTLTNRMLLRRLYLIERLRDARTVGLVVGAVALRGCREAVARVRKLCEMAGKKLYVMYIGKLNEAKLSNFGIDVEVLNEAKLSNFGIDVEVFVLLSCPFGIILDGTKFCRPILSVFEAEMALDPAQSNWLAEMRWTSDIERISMDKSKKEGKSKKEGTDEDVGLMSLTSGNIRRCYGPTNADEEKNNGIGPTTGGTSNTKQWQQLSDGVTERQCPCELKQGMDGIATRYANE

SEQ ID NO: 154486 - protein, 135 aa, Heterodera glycines
  Coding regions on vcDNA: vcDNA=SeqID_80909; Strand=+; Position=1 -109,179-279,417-614
  Homolog annotation: Hit_ID=XP_310153.1; Match level="QueryCoverage =100%, HitCoverage=15%, E-value=1e-63, Identity=82%"; Hit description= ENSANGP00000019991 [Anopheles gambiae]
MRGLAVFISDIRNCKSKEAELKRINKELANIRSKFKGDKTLDGYQKKKYVCKLLFIFLLGHDIDFGHMEAGYLFISVLINLNSDLMKLIIQSIKNDLQSRNPVHVNLALQCIANIGSRDMCEAFAHDLPKLLTSG

SEQ ID NO: 154487 - protein, 82 aa, Heterodera glycines
  Coding regions on vcDNA: vcDNA=SeqID_80910; Strand=+; Position=1 -96,686-838
MAQRLAKIVDDFLPEDIDRANGRLIISVTKQRVNIRNVMRGAQSLFPQSLERLGRLYRAGYYDAMLYLLRKGCFEREVGSEI

SEQ ID NO: 154488 - protein, 26 aa, Heterodera glycines
  Coding regions on vcDNA: vcDNA=SeqID_80911; Strand=-; Position=1-137
IQSLNYNIKRMILQLHWERKSDEIGK

SEQ ID NO: 154489 - protein, 36 aa, Heterodera glycines
  Coding regions on vcDNA: vcDNA=SeqID_80912; Strand=-; Position=1 -20,134-224
MAHSTESTDWSAYERKQWAMKDKREEDNGNAGQLEG

SEQ ID NO: 154490 - protein, 26 aa, Heterodera glycines
  Coding regions on vcDNA: vcDNA=SeqID_80913; Strand=+; Position=1 -70,894-904
MTQSELKILYSLRQQAYQANIAAEEI

SEQ ID NO: 154491 - protein, 90 aa, Heterodera glycines
  Coding regions on vcDNA: vcDNA=SeqID_80914; Strand=+; Position=1 -171,424-525
MRQSINNLTNSQVSTNTPAQRGAMTSKGDSKTDKPKDKKEATSKGGSSSTKNAPNAMVTANAPAQGEGPSSEGGSTKKPITDKSNYMSQP

SEQ ID NO: 154492 - protein, 158 aa, Heterodera glycines
  Coding regions on vcDNA: vcDNA=SeqID_80915; Strand=-; Position=1 -57,343-501,630-750,858-941,1005-1060
  Homolog annotation: Hit_ID=CAE61975.1; Match level="QueryCoverage =87%, HitCoverage=43%, E-value=3e-26, Identity=44%"; Hit description =Hypothetical protein CBG05979 [Caenorhabditis briggsae]
ISPVAITLLRDESNEHTLLPGERLDQTVRREVAEEVGIECWDVRPLDGSQTWPLPAGSLMVPFVATANMGDEIQASISELEYAKWFSRQEVAEALRRSEEDPLLIKLYRHLSESGKDPETRIQLRYIPPQGAIAHHIIKVELASTRVLIASKKSILLF

SEQ ID NO: 154493 - protein, 141 aa, Heterodera glycines
  Coding regions on vcDNA: vcDNA=SeqID_80916; Strand=+; Position=1 -225,2156-2356
MKPKCHTNANEMAPNSKLANLWPSTDCVHRICPFLFLLLFALLLLQQHMHTEQLEQRLSRLEQRCKNVVELLEEPSDDVFTIENAQQLRRTLRSLYDDRRRQRDGGGTRHHQNRHHHHNQQQRTAAATTTACMCPHGNYGN

SEQ ID NO: 154494 - protein, 292 aa, Heterodera glycines
  Coding regions on vcDNA: vcDNA=SeqID_80917; Strand=+; Position=1 -46,96-598,667-996
MSISRIASSHSSIEIAPKKSVEAIENQIIKRKSEINLENELDGQSATNSNISPNFKCPLNEYLAAVVDYNGFYFNVPAKTIAKLAMNLIFAVLSSQNWSAKQQQNSDQPIFDGILTFDHFSVIRQNEFEFGAEELAGNLKIEFNKMVEMVKDPRERTLPPEQRPKQQIIWLKDVLFMSPEQIKDKRSTTTGKDLVWFVGLLLYRMLFNNKHPMDNWEPKRRLDMEFMAKMGFSKLKQFNCMYKTDDFVTGDFGIVPLKPKSRWIWMPESGRDETGEMALVEERIGMEQVAAN

SEQ ID NO: 154495 - protein, 81 aa, Heterodera glycines
  Coding regions on vcDNA: vcDNA=SeqID_80918; Strand=-; Position=1-246
MITQQQQQNQEVQAVQQEQQILMGNEMKMDNSKNGETREEEGNSIEEGGETEEKERKRKNSAQKGGENEAEKRKEQQQIGT

SEQ ID NO: 154496 - protein, 191 aa, Heterodera glycines
  Coding regions on vcDNA: vcDNA=SeqID_80919; Strand=-; Position=1 -447,1068-1197
YIDHSVIAFLRSNHQIFDKRGTYLHLRIPSSHTMEEQPILDVFVREIWPIFSTNIRCLGFSCGDHLDNLRSLISPTILTDLNQLNSIDSFDLLPAAIDADFDGPNSTISAGQALSKWLHSPRKAGQPKRFRFCRNLKDFYWVNSFKEVWPLSPPPEEEDEAGQSSEKGASSADKMSDGQKNKYSDQPQKKK

SEQ ID NO: 154497 - protein, 82 aa, Heterodera glycines
  Coding regions on vcDNA: vcDNA=SeqID_80920; Strand=+; Position=1 -129,553-633,724-762
IFPNLSTSEEMSVLIARIAELNRAKTMEPSVASFEVFGQDGYGMNDDQFSLEEEEGKEQQEDRKTPTKDVSEDHLKAILERI

SEQ ID NO: 154498 - protein, 42 aa, Heterodera glycines
  Coding regions on vcDNA: vcDNA=SeqID_80921; Strand=-; Position=1-130
QATATMCDNLKWRDAQEGISAFITRPKRQPQWTHTDQRVIKD

SEQ ID NO: 154499 - protein, 17 aa, Heterodera glycines
  Coding regions on vcDNA: vcDNA=SeqID_80922; Strand=-; Position=1 -28,158-183
MVVSGGLLEVFHGFNLH

SEQ ID NO: 154500 - protein, 144 aa, Heterodera glycines
  Coding regions on vcDNA: vcDNA=SeqID_80923; Strand=-; Position=1 -240,1374-1467,2022-2122
  Homolog annotation: Hit_ID=NP_502246.1; Match level="QueryCoverage =49%, HitCoverage=25%, E-value=5e-15, Identity=52%"; Hit description =enoyl CoA hydratase (4M616C) [Caenorhabditis elegans] emb|CAB01180.1| Hypothetical protein F38H4.8 [Caeno
MSQAFGHQLLHRFRRPALFALSSSKFCPLFRATAAFATDGAATKQPTASAAAQHQHQQVEQQQPSTTKTEWHLGNRVARLTAESGTEMHRKVFNKCLELMTFIRQMQLPVIAEVDGLVAAAGTQLVAACDIVIASGRASFNVAG

SEQ ID NO: 154501 - protein, 123 aa, Heterodera glycines
  Coding regions on vcDNA: vcDNA=SeqID_80924; Strand=+; Position=1 -88,133-416
MICCSNLHPDIRILDANNLMDLKFRVHYKWLISRDLFQFGPGPRLDFCEMDCKNPVSIKSKKSSVALDFGIKSYFFVAINQVEDLITKSNVKSTATFDFLIFVSIQITVMVNEKSFQIYREKS

SEQ ID NO: 154502 - protein, 37 aa, Heterodera glycines
  Coding regions on vcDNA: vcDNA=SeqID_80925; Strand=+; Position=1-118
QKGGPFCFAKFFKIKNHDNFLSGVLKVANHESDMYFD

SEQ ID NO: 154503 - protein, 610 aa, Heterodera glycines
  Coding regions on vcDNA: vcDNA=SeqID_80926; Strand=+; Position=1-1833
  Homolog annotation: Hit_ID=XP_318550.1; Match level="QueryCoverage =93%, HitCoverage=56%, E-value=1e-141, Identity=46%"; Hit description= ENSANGP00000020240 [Anopheles gambiae]
MRLELSVADTEAPSIMGLDWIIPFERATQQPIATTLEQQSLIVNSVQPTNDPVKLEGQIKASFPKVFQPGLGHCVKTKATLHLKQNVKPVFCRARPVPHGVQAAVDEELDRLLDSGVLKPIDFSRWAAPVLAVRKKSGNVRICIDFSTGLNDALELNRHPLPRTEDIFHALRGAKVFSQLDLRDAYLQVELDESSKQLVGINTHRGLFQYQRLPFGIKSAPSIFQKAMDQLTSGIPGVFAYLDDIIIASADHSQHVAALIELFSRIQDYGFRVQLDKCHFLKAELKFLGHVVSSDGLKPDPARSDAIRNMPSPHDIGTLRSFLGALNYYGRFVKEMRDLRAPLDLLLKKDTPWFWGPDQQKAFDQAKQVLQSDLLLTQYDPSLPIIVAADASQCGIGATISHVFPNGVERVIEHASRTLTPAERNYAQIEREALSLIFAVQKFHRMIYGRNFTLLTDHKPLLAIFGNKNGIPIYTASRLQRWALILSNYDFTIKYVKSANFGQADVLSRLISEHRTDEEVIVAHTSDNDVDSTEEVEYALLVNLEQLPVDAKEVSELTTSDDLLQQVAQFVRSGWPNMFNFDRKPSHCSCAASSTCTQRLCTLLILALCE

SEQ ID NO: 154504 - protein, 48 aa, Heterodera glycines
  Coding regions on vcDNA: vcDNA=SeqID_80927; Strand=-; Position=1 -101,1054-1099
MEEQEEETERVEAEEEEVMEAEEEETESVVGMERKLEKQDFKINQKKF

SEQ ID NO: 154505 - protein, 68 aa, Heterodera glycines
  Coding regions on vcDNA: vcDNA=SeqID_80928; Strand=-; Position=1 -57,241-387
MQEHLGNRNEWLLLDVCFLRKEALYSLNSAWHKYLRTGERMNSDDGGDDQNEEEESEEEEERDEEEER

SEQ ID NO: 154506 - protein, 142 aa, Heterodera glycines
  Coding regions on vcDNA: vcDNA=SeqID_80929; Strand=-; Position=1 -124,587-657,746-826,1384-1536
MAKRKANASEELRVLKARIVELELECMEQTNVSEAFEQSRNVEVIDDGVQIVEIQGQIEADPQQKKFRENISKMKEELSNTEQLCMITQLKNKLLQSKLKHHELMEEQNELQAKVAKMVDHHQQQQKKKQGRKEGEQGQYGR

SEQ ID NO: 154507 - protein, 110 aa, Heterodera glycines
  Coding regions on vcDNA: vcDNA=SeqID_80930; Strand=-; Position=1 -206,576-702
MALINVVLFNSRASPSASVVGEEGPPIVQFGAARRPGKCRPGNKQQQQHNGNDEQPPPPPSAPAAATSSRSARFTKTLSIKTFFHNQKNFFIKKLKIDFYTIFKITKFGY

SEQ ID NO: 154508 - protein, 29 aa, Heterodera glycines
  Coding regions on vcDNA: vcDNA=SeqID_80931; Strand=-; Position=1 -82,221-228
MFAVGSRIQMHAKRRQSVAVGIGGMPKKV

SEQ ID NO: 154509 - protein, 164 aa, Heterodera glycines
  Coding regions on vcDNA: vcDNA=SeqID_80932; Strand=-; Position=1 -250,301-543
  Homolog annotation: Hit_ID=NP_506146.1; Match level="QueryCoverage =87%, HitCoverage=43%, E-value=8e-58, Identity=71%"; Hit description =putative protein, with 2 coiled coil-4 domains (5N52) [Caenorhabditis elegans] emb|CAB02877.1| Hypothetic
MQRIFLVSLALFPLSHAFLFGGLVGGSSCCCPPPCPPPCCGGGGGGGCGGGCGGGGGGCGGGCGGGGGGCGGGGGGPIIVNCGGGSQGGGCGGGGGCGGGGGCGGGGGCGGGGGCGGGGGCGGGGGCGGGGGCGGGGGCGGGGGCGGGGGCGGGCGGGGGCGGG

SEQ ID NO: 154510 - protein, 20 aa, Heterodera glycines
  Coding regions on vcDNA: vcDNA=SeqID_80933; Strand=-; Position=1-62
MFSEEGSAEIIRRKYLGNGK

SEQ ID NO: 154511 - protein, 90 aa, Heterodera glycines
  Coding regions on vcDNA: vcDNA=SeqID_80934; Strand=-; Position=1 -141,440-571
MTKRTDHRLDSMKVNSNCKTGQKQSVDIQMAIELLRGPKIVPIALPPRRFKATDAIGPNAEQSRGDDQRKGKQRDQKAQKTFRERSVQLK

SEQ ID NO: 154512 - protein, 449 aa, Heterodera glycines
  Coding regions on vcDNA: vcDNA=SeqID_80935; Strand=-; Position=1-1347
  Homolog annotation: Hit_ID=NP_500013.1; Match level="QueryCoverage =91%, HitCoverage=23%, E-value=4e-44, Identity=35%"; Hit description =predicted CDS, polyprotein family member (4B673) [Caenorhabditis elegans] gb|AAC02594.1| Hypothetical pro
LNSGKQYPLIVRLLIPKINSSQEKSLIDTGASISVAPKLMAKLWGCTLYPTSVSVISASGHTFTLKEKGTVIFSIGNYSVEGIIHFVDDFKFKTHFYKALIGCDILGKLPAFTFDYPNKKFQIGDYITPLGIQQNNCLINNLRIQASNSIILPPNRGMIVQANIDTSIDLNKPIFIHSLDERLNNISFGLIPVIAAPFRGTVKMFIINPSAMPFQLYKGQHLAYADEVRQISNGVMTDSSEKVMSMSPMMDIVIDPNFKIDFSKSSVTGSDLEKLKILCEEFHDIFSHSQYDLGSFTEGEHEIVTTTNEPMSAKPRRTPYRYRAELQKHIDQLLKSGVMVESDTPWVTPFVIVQKKDGGIRPCLDFRQLNDITVPDHYPLPRMDAIMERVANCHFYSSLDLSSGYLQIKLSPEASRKCGVITEDNVYQMTHMPFGLKNATAAFSRAMAQ

SEQ ID NO: 154513 - protein, 258 aa, Heterodera glycines
  Coding regions on vcDNA: vcDNA=SeqID_80936; Strand=-; Position=1 -144,757-1386
MSYAFRHVAASTCELMGETHRWAETALLTDPTALARMLFTNYKLIAKRIYLGEGRLGQLLLGNRGARLAQNVVQSQSQNIVCNPITSPSADETPDIQFVPVNRIASSTNDLNSLRRERKNATICESVLMLRVYPNQEKIGFTSVCLDLSITRIKVNGIELVSVIDSASQTSIAPLRILGSLRVPEFNMMEVCVKLRPFGMDPEKAADNAPEGKTVAWVLFSKGGVILGEAPLLFINNAFFEKEGFDLIIGADLIDQMV

SEQ ID NO: 154514 - protein, 459 aa, Heterodera glycines
  Coding regions on vcDNA: vcDNA=SeqID_80937; Strand=+; Position=1 -512,802-1394,1442-1716
  Homolog annotation: Hit_ID=AAA93301.1; Match level="QueryCoverage =60%, HitCoverage=74%, E-value=1e-41, Identity=35%"; Hit description =HASI
MRKEHKERPVRVQLSNGAQLLNKTVETGVQVRPGPDEPKDKSVMVTDEDEEEEIEVPKFLTPTSQTQGSSRSPRTNKKAAKQQKLIEKKDHLLAIIMSDPQRFGATDRVKIINPKTGREFIDSDLAWSIERLVDPRPENAPSPRGTKELKRKLAQNPLASSLLNRLFVGSGLFTGSDVQADLADFQALSRKNSGYRYLLLAVDVLSRRMFGTPVKSKRPTDMKRAFEELFEQMPRVPDTLYTDRGLEFVANPLKEFYADKGIQKFETSSKKKAAMAERAIRTVKTRLYKYFSANNTSVWVDVLPKFLSAINNSVCRATGLRPNEISDTNAREVWKRVYGEGLAQLDKTPKIRAGEAVRIPEPKHIFEKGYIPNYSDHVYTVDETRSTNPQHYLLKDYYGTKLKRKFYLPELTKVQVDENTMYRIEKKYKERVRDGKREVLVKFIGFPEKYWVKNDEINE

SEQ ID NO: 154515 - protein, 418 aa, Heterodera glycines
  Coding regions on vcDNA: vcDNA=SeqID_80938; Strand=-; Position=1 -64,109-270,319-514,559-724,775-891,942-1062,1112-1542
  Homolog annotation: Hit_ID=NP_001004509.1; Match level="QueryCoverage= 87%, HitCoverage=24%, E-value=4e-28, Identity=28%"; Hit description =si:busm1-180o5.3 [Danio rerio] emb|CAD60788.1| novel protein similar to DNA polymerases [Danio rerio]
MYPRGLIDPEYNCDHFEDSERGFSTTVTHIELEAALRSWYKVTHVYRAYIWPLACDWSNGLFHSYLLKFLKMKFEASGYPASCTEAGISEEESERRKQDHSDKAKQKAHVHLEADRIKHNPGLRYLSKLCLNSLWGRFALRNRLTKTEIVECHAELAKLLNDSKIEVSSIDQLTEKFWMVCYKAKDEHVVEHSTSNVAIALWTTSAARIHLLESLKKVYGPAPGVERYDTRILYMDTDSIFYDYLTRLGDPLPGGEQLGELADEYPNHTIMEFICAGPKAYGLWLRNNATGEDEYKLKLRGITLDSDACERITFEKMKEMVQNKLGQPDNNVRFNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 154516 - protein, 490 aa, Heterodera glycines
  Coding regions on vcDNA: vcDNA=SeqID_80939; Strand=-; Position=1 -141,184-330,380-571,616-1021,1070-1211,1259-1361,1410-1572,1622-1800
  Homolog annotation: Hit_ID=NP_507780.1; Match level="QueryCoverage =97%, HitCoverage=29%, E-value=4e-32, Identity=27%"; Hit description =predicted CDS, DNA polymerase type B, organellar and viral family member (5T899) [Caenorhabditis elegans]
MPFHQQTQHTAKCKWKCHNCLRVGSAFRGNCVQGNDNFFQTCLGCNKTFKSRDCYEHHAKCTNCRVKRDNEEEIVGKSICMSSKKCVDCGVIYRMADQDKKKGHVCGHKFCKICLGFHAPRDCYIPYRPKVKKEKRFVFFDFECTTDFKPDPQLMRFKHQVNFCFAHVTCTRCIEKGVWDQELEKACALCGRFRTYAWSPFEFWHTDVECRKVVEDPLAAFTKWLLNFETEVLGMEPGAKKRRKRKNAENTDGEAMECEEEEDAVDEDAENNWMLGYEEAGEKPESVTTYAYAHAGSRYDHVLIYGEMLRMGVRPELIRQVNHLLEMKARKTGVYTTTVFRDSYKLIPIKLANFVKTFGLEIEGVENKKYFPHKFNKAENYGTVLDTLPPIENYYPGGLFPAERAKFEQWYDENRETGFELSEVIADYCKTDVQILAHGMVKMRQLFLSETRHDITDSVTIPSGCMKYWVQLAHHDKERVAIIPHLGYEK

SEQ ID NO: 154517 - protein, 103 aa, Heterodera glycines
  Coding regions on vcDNA: vcDNA=SeqID_80940; Strand=-; Position=1 -132,192-371
MSQYSDNSLPSTLDGPYSPVGDDGTELMDEAPPLDEVMKRLPISVVPSDNNERKAQKEPSITRELEAELFNGDGFTCLSATQVEAGRFKGVVVNNTSYKIIII

SEQ ID NO: 154518 - protein, 142 aa, Heterodera glycines
  Coding regions on vcDNA: vcDNA=SeqID_80941; Strand=+; Position=1 -101,257-584
MARAHLAALKWLALSWPYTPPTPMGGYRNPDKMDYIDHFVIAFLRSNQQIFDKRGTNLELWIYSAHSSDDQPIWDVFVREIWPIFASNIRHLRFIDGDGLDNLRRRTSPTILTDLKLLNSIYSFGLLPDPISDFDGPNATAG

SEQ ID NO: 154519 - protein, 40 aa, Heterodera glycines
  Coding regions on vcDNA: vcDNA=SeqID_80942; Strand=+; Position=1 -76,338-384
MSQKTVDDTSSWWYYFIRTDEPHVKLIFINIATFNLFRKI

SEQ ID NO: 154520 - protein, 419 aa, Heterodera glycines
  Coding regions on vcDNA: vcDNA=SeqID_80943; Strand=+; Position=1-1260
  Homolog annotation: Hit_ID=CAA82797.1; Match level="QueryCoverage =38%, HitCoverage=24%, E-value=2e-09, Identity=31%"; Hit description =gag protein [Ascaris lumbricoides]
MERGLQEAIQIFQGHFEIGMAATGAEPAGHQDFFYDILTAPLPAATKELQLRNHPTPAELLQIADEHIGDLRTMRRALEDEEEAIARSRLSGSFGTNNSHPVGDDPPPLENRNMEEWERSFQVAAKRWKNDGQGVPQHNRRPMGRVAIPVMSYLDGIFQRRAKVPSVASMRVTNTAREWINRNRDEMGAFPPATAHRPALMQPKIEKHQAHVNDDYRERQTYPIRRHARDEGEHDRKHGRDEITGMTTFETRLQPAIFSEKPEDWTTFWAYFKRAVDDKPIPGFEKQLHLLRCLKEGSPARRAVEVYPPSDGNYPVVVQLLKERFGDTDDLQRAIRARLLHLAPAKDNVNSLTTMIDEFERCVCQLEQLGANVDDDSFGPLLEAKLPVRLLTELRIRESMMGSKWSVRDFRRALSAQVR

SEQ ID NO: 154521 - protein, 115 aa, Heterodera glycines
  Coding regions on vcDNA: vcDNA=SeqID_80944; Strand=-; Position=1 -215,644-776
MLSLGLPSANSIIGRTFRALFWIVAVNVSLCYFFLIKPYISSPITAWFFNVFAAILLNIGSASIGPILYFTSTDYRLAFQKELKKAIKLMTKQNRVTPKHNTPILLVSTNRILNN

SEQ ID NO: 154522 - protein, 35 aa, Heterodera glycines
  Coding regions on vcDNA: vcDNA=SeqID_80945; Strand=+; Position=1 -15,337-429
MVNFGSCSLAILQVELQTGCVSLSRNFSLDNALLQ

SEQ ID NO: 154523 - protein, 129 aa, Heterodera glycines
  Coding regions on vcDNA: vcDNA=SeqID_80946; Strand=-; Position=1 -245,666-810
MIDASLFQGIGGAKIADTKIIPSLHLYPGGYNQQKSRWVDKSDIDDLAKAGRSLIIGEFGSLPPQNGGSDWAGIVSYAKSKGKKSEKFPLICKLTFDAEQINLLDQHDQITPSWRSESDKFYLHVNKAL

SEQ ID NO: 154524 - protein, 79 aa, Heterodera glycines
  Coding regions on vcDNA: vcDNA=SeqID_80947; Strand=-; Position=1 -3,234-289,414-591
  Homolog annotation: Hit_ID=CAE62158.1; Match level="QueryCoverage =74%, HitCoverage=0%, E-value=3e-11, Identity=59%"; Hit description =Hypothetical protein CBG06205 [Caenorhabditis briggsae]
MNKIIRQFCPFVIIQYLMLHKYQVYVVEETRDTFVVPLNSQHANEKENATFECEVNDKDIDVKWFYDGAEIGMDGRHFK

SEQ ID NO: 154525 - protein, 117 aa, Heterodera glycines
  Coding regions on vcDNA: vcDNA=SeqID_80948; Strand=+; Position=1-354
MKIKIIFSILFFINAIDNIYAGKINEEKSFDEIFGQRWDEKLEENGENENDQNGRIIGQTDGQNETNYDENIAQRLFAEQFDQIFDDNSEVHDEQSVLLSTNCDELEQAPVKFVIIL

SEQ ID NO: 154526 - protein, 113 aa, Heterodera glycines
  Coding regions on vcDNA: vcDNA=SeqID_80949; Strand=-; Position=1 -84,378-479,1668-1821
  Homolog annotation: Hit_ID=NP_491158.1; Match level="QueryCoverage =37%, HitCoverage=12%, E-value=4e-13, Identity=85%"; Hit description =calponin (1D991) [Caenorhabditis elegans] pir||T33160 hypothetical protein K03E5.2 - Caenorhabditis elega
MFRLSGLEKVYFEADFGDRRSRSPRPDEVMVNERGEMVVDAQSLVVIENPEQNTAGMETVNDLMTNFGTPRDVKGKHLKRIWELEFPEEAADYQQPTAPVNAAPQQQQQAAQV

SEQ ID NO: 154527 - protein, 44 aa, Heterodera glycines
  misc_feature (30)..(30): Xaa can be any naturally occurring amino acid
  misc_feature (39)..(39): Xaa can be any naturally occurring amino acid
  Coding regions on vcDNA: vcDNA=SeqID_80950; Strand=+; Position=1-133
NPNSTKRKLRIDQKQKKNEESRLQADQPNXNDFFISCKXIQLSS

SEQ ID NO: 154528 - protein, 243 aa, Heterodera glycines
  Coding regions on vcDNA: vcDNA=SeqID_80951; Strand=+; Position=1 -81,284-439,609-727,780-864,967-1056,1122-1275
  Homolog annotation: Hit_ID=CAE62894.1; Match level="QueryCoverage =96%, HitCoverage=76%, E-value=1e-68, Identity=57%"; Hit description =Hypothetical protein CBG07082 [Caenorhabditis briggsae]
ILYRVYGFFQQIKICICIFLPEYNPNFHLSYGISVVHQLERGDLGPDGSTGGRAQGAAPSGDEAAIIVHGVSNKITRFNGIINALRARGIEAYGTTWGDGGTTPVGLVELKCAYVKQIRSMIISMIIAVREYTGKKVDVIAYSMGSPLARKAIAILGGICVDTRELLGVPLTEHVDTFLSVAGANNGAALCVLPANNGAALCVLPVPLGTCNRKNGLHCESEFLADVNSRRNYEGAATFSIFS

SEQ ID NO: 154529 - protein, 63 aa, Heterodera glycines
  Coding regions on vcDNA: vcDNA=SeqID_80952; Strand=-; Position=1 -85,453-559
MALLTVNYRGTTFQRIVYRDDYTLWELLSDVGGVLGLYFGLTIIAVYELVVFALLVDRKNARK

SEQ ID NO: 154530 - protein, 75 aa, Heterodera glycines
  Coding regions on vcDNA: vcDNA=SeqID_80953; Strand=-; Position=1 -85,161-303
MGETKKQRRMLGEENGNGAAIIGRKQFHQLVRVGKATQRPSEQRMDGTICQIFGSKQRRATFGGFYEAKSKIKIV

SEQ ID NO: 154531 - protein, 69 aa, Heterodera glycines
  Coding regions on vcDNA: vcDNA=SeqID_80954; Strand=-; Position=1 -63,423-569
MGPICDAICRLWTGSVGSILKLVLRQKLSRWSKWLNIFTLPATTLLQMWPKNHRKLFQSNLSIRWMSRS

SEQ ID NO: 154532 - protein, 133 aa, Heterodera glycines
  Coding regions on vcDNA: vcDNA=SeqID_80955; Strand=+; Position=1 -273,484-612
MRPISREREREIIQFLKIAFLIIQIEIEAEKKKVEQKPFDEIFGEQWEEKCNDQNGNDQKKREIVEKFNKIKEKTKQKERKCSIKEWSKIEKIGVGHTVIEKWKKQFGMSEKRITKKEKMEKAKMYFQMKKYF

SEQ ID NO: 154533 - protein, 254 aa, Heterodera glycines
  Coding regions on vcDNA: vcDNA=SeqID_80956; Strand=-; Position=1-765
MFVRTPPLTWQENFGGEQQLRNRLLPATRNTGNSVVIVVDEIEQNERTAMNVPVVSSSSSVNKRNVRENGLGETNERFLSNNFDLGVSNLNTAGLVPTYSPAHESNPVSLLHGIGRRVGGHGNAIGSARNDVQYTQSRLDGAHPVFVRQMAVHSQLTALRQSANHRSGIATNSAEHLALNARTENILCHNNPQQQMENFQQNFGRQTFRGVENFEPGNRNYVCDGRNANAELNKPALAIILDASRLYFKIFEPL

SEQ ID NO: 154534 - protein, 494 aa, Heterodera glycines
  misc_feature (225)..(225): Xaa can be any naturally occurring amino acid
  Coding regions on vcDNA: vcDNA=SeqID_80957; Strand=+; Position=1 -48,263-1712
  Homolog annotation: Hit_ID=DAA04499.1; Match level="QueryCoverage =99%, HitCoverage=35%, E-value=2e-90, Identity=39%"; Hit description =TPA: pol polyprotein [Schistosoma mansoni]
KIFGLSQQLELERTRKDSEKQSLLELVSQFKSIFAVSDSQLTQTTLIQHEIETGIAAPVRSKMRPVPYAYREKVAEMLKDYLERDLIRPSYSPWASPVIVPKRDGSLRFCVDYRAVNSITRKDSFPLPNIDILLLLGGKKFFTTLDFMSGYWQIRMKPESVEKTAFITEFGLHEFVVMPGLSNAVATFQRFMNRLFEGMINKFLFVYIDDVLIASESLESHLEHXKCVFERIEKRLKIELSKCQFSAEELPFLGHTLTRNGIKMNEEKIQPVKNLPVPKTKKELQSLLGFFTYYRKFIYSVGTIAAPLFRLLKKETKFEIGEMEKNAIDKLKEKILSDVVLYFPNFEAAKNDPLRNFIIMTDASKIGISAILSQQNEKGRIRPIYFASRQCNKFERYAPTELEALAIRFGHQFITMIPTRVITDHKSLIECLKVKRKPEMQVDKWILELKKFTLKVEYQPGKKNMIADVLSRTFETKECETLEIAAPEDIADWD

SEQ ID NO: 154535 - protein, 292 aa, Heterodera glycines
  Coding regions on vcDNA: vcDNA=SeqID_80958; Strand=-; Position=1 -57,107-266,314-466,510-628,677-948,993-1110
  Homolog annotation: Hit_ID=AAO49799.1; Match level="QueryCoverage =100%, HitCoverage=100%, E-value=1e-153, Identity=78%"; Hit description=arginine kinase [Heterodera glycines]
MAVPQEVIDKIEAGYKKLQAAADCKSLLKKYLTKDVVDACKDKRTKLGATFLDVIQSGVANLDSGVGVYAPDAEAYTLFKPLFDPIINDYHGGFGPSSKQPATEENCVDMESKVTAVFEQLKSDAELGGTYYPLQGMCRYWPTGRGIFHNAKKTFLVWVNEEDHLRIISMQNGGNVGQVLERLIKGVKAIESKVPFSRDDRLGWLTFCPTNLGTTVRASVHIRLPKISAKPEFKSICDGLKLQIRGIHGEHSESAGGVYDIRNKARLGLTEFEAVKQMYDGVKHLIELEKKA

SEQ ID NO: 154536 - protein, 361 aa, Heterodera glycines
  Coding regions on vcDNA: vcDNA=SeqID_80959; Strand=+; Position=1 -47,108-383,434-860,1064-1350,1411-1459
  Homolog annotation: Hit_ID=AAL78214.1; Match level="QueryCoverage =40%, HitCoverage=77%, E-value=1e-11, Identity=30%"; Hit description =putative esophageal gland cell protein Hgg-20 [Heterodera glycines]
MSDRRKEVEKKMEKAIFISGDGWLKVFDLLPPSQLGLEIATISHRFNTYVDDHFKTRKWALKFIQIRREFGKKGKKKLELAALDGEKLPIPKKPMPKKVVGFEAISIRFIDQNALTFLHRFRRLFAASPIVFAIGSTSDRILILILELIWPMFAKNIDSMHLMADTFFRLRLFESSFLNKCPSLRIVKFCDDDNFFIKFPADDHAAASDGQVVAKWLFTALPDNVPPKMLKCSLDKDDGFLESDIEDLKEAFAEASSAVNFIFVVRFPPSFAKSVVPFSLINELTREQLALKSTPNSRLFVFVRSPIERVASEWTKWENEAIGWDFLAQSNRIDIYMYHEDQIGDGILNTMIGPINRKKKK

SEQ ID NO: 154537 - protein, 126 aa, Heterodera glycines
  Coding regions on vcDNA: vcDNA=SeqID_80960; Strand=-; Position=1 -34,468-704,905-1014
MQNIAVKHQTKRGYQLTCASGEPNVSIDNRRCAETRLDREPSRPGTPQSILGPVLRNAPRQRPPEPKLLLPNRPIRKNPVECSLIFVKSIRIVRSDDADSMSFFHAMIWWCHDNSYIVTKATRTID

SEQ ID NO: 154538 - protein, 141 aa, Heterodera glycines
  Coding regions on vcDNA: vcDNA=SeqID_80961; Strand=+; Position=1 -141,190-388,739-825
  Homolog annotation: Hit_ID=NP_491890.2; Match level="QueryCoverage =97%, HitCoverage=32%, E-value=9e-44, Identity=48%"; Hit description =trehalase (66.9 kD) (tre-1) [Caenorhabditis elegans] gb|AAB96724.2| Trehalase protein 1 [Caenorhabditis e
FNSMLYYVVSLLSQIYCNGPILQAVQEAHLFPDSKYFVDMPLKQDPVSTLRDFYELGDSVKEVSVLEAFVEAHFEAPGQELIEVYPDDWAPYPNGFQHIDDYRLKRWALHLHRFWILKGLLFSEMYDTAKGVILNLIFMVD

SEQ ID NO: 154539 - protein, 18 aa, Heterodera glycines
  Coding regions on vcDNA: vcDNA=SeqID_80962; Strand=-; Position=1 -12,64-108
MIILRYFNYPLVKSALFI

SEQ ID NO: 154540 - protein, 95 aa, Heterodera glycines
  Coding regions on vcDNA: vcDNA=SeqID_80963; Strand=+; Position=1 -117,268-426,1027-1038
MSGSLSVGYPSVVRSPNVGSPNVGCPNGGSPSCKSPKSRQFCASSKGSDRPMWSRVKLIASPHITSNCFAKTWPLFATCFWMTSNFSRECLDERY

SEQ ID NO: 154541 - protein, 34 aa, Heterodera glycines
  Coding regions on vcDNA: vcDNA=SeqID_80964; Strand=-; Position=1 -78,291-317
MQRISNPKNNFYLVALKKFWKPEAFRFIFLCIIF

SEQ ID NO: 154542 - protein, 69 aa, Heterodera glycines
  Coding regions on vcDNA: vcDNA=SeqID_80965; Strand=+; Position=1 -3,507-713
MCPKFKKWWDEQFGEWLRVNSFYTHLNCQKRGLNLANKNFFYPFLGPVINPSVSGQSNPSVDNPSVTNP

SEQ ID NO: 154543 - protein, 142 aa, Heterodera glycines
  Coding regions on vcDNA: vcDNA=SeqID_80966; Strand=-; Position=1 -114,427-557,612-680,942-1058
TIILEHIAKLEFYGHTNKKKLGTFKATSVAQIDVKTEGDLIKANLTLPTLVLTDIGTDIKSGMTQDGLDSLTGLVKDKVPESANKKLAKGCKLDLPPGVGGLPIRILKPEVNFVAHAVHLKSNFELYSTDGSSPLGASEPCE

SEQ ID NO: 154544 - protein, 234 aa, Heterodera glycines
  Coding regions on vcDNA: vcDNA=SeqID_80967; Strand=-; Position=1-705
  Homolog annotation: Hit_ID=AAN87269.1; Match level="QueryCoverage =58%, HitCoverage=5%, E-value=2e-09, Identity=32%"; Hit description =ORF [Drosophila melanogaster]
MSDIYVERIETAKYAIELYLDKPLPILPQGVLTSQQRHNLICDQREWKEVADEIQTQVDEIKAARALYNQEASTLHGDEKTEFQRQYRASVNANDLQNLLRRANHKLADTRTLKGNIDRLLQDGPGGTARRNIALPKLNLKEFDGSNWDDFWPLFESTIHADADLDYVQKMSYLDSLLRGEAKKVIQGLLPFSRDNYDLSVSLLKDKYGKNENLIRDLHNQLARLSILSLLETT

SEQ ID NO: 154545 - protein, 401 aa, Heterodera glycines
  Coding regions on vcDNA: vcDNA=SeqID_80968; Strand=+; Position=1 -441,541-844,895-1355
MPEVREPKFNFGFNSAGTLIEVVKSLGQIWAFFFDKQLRKRFGTYWKCMSELSNYKRKPKLANEREIVEILETNALRLYQHYEYLFNNSETATLSPNSKLENLFRTLRKVFDKNLEEMWSKMEMIKSSLNELNVEISEMPFYDIDKAIKDSAFLTFIIDRNNLKIFSMILSAKTFFNVFGSVHKINVGTYPENVVGYLAQEYEAYLGIVHLLREKWQCANVLHEQKKCETFRDYLDILYEFLFHMYYEGQNLAMEQNKCAVRPNFVLGNETKILSLIELLKKLGRISAFFFSPKYSMTFAHKWEVFVHYNSELKLVIDQQLENERTQQCPTLVKSIKHMKIRSQKRKPTMDLSTMAQIRGNFVNLLAICAETVKRMNLKDVFGEYDNNWDWLFSNKDQLTV

SEQ ID NO: 154546 - protein, 200 aa, Heterodera glycines
  Coding regions on vcDNA: vcDNA=SeqID_80969; Strand=-; Position=1 -228,527-723,1204-1381
MSLNRFCAICCSQMYRCHWSHKISKYLLAIILLFALAISAPILWHSVCFRLSEVRTPFEEGQHKIVGLVFMEISTQQIYYNITKMFAICHLAFLLFAYPLMCRRVRQMNLKQRSHRVEVRMCYAIILLSIANLLFAIYLITWEILSRGHAELSPIAEWILLMIVDFYDLNSPYGLIITSKIIRKYTLPFCLLMRRNEINI

SEQ ID NO: 154547 - protein, 27 aa, Heterodera glycines
  Coding regions on vcDNA: vcDNA=SeqID_80970; Strand=+; Position=1-3,78- 158
MRVFGVANHESSIHFAQFRTPDSIDCR

SEQ ID NO: 154548 - protein, 135 aa, Heterodera glycines
  Coding regions on vcDNA: vcDNA=SeqID_80971; Strand=+; Position=1 -66,107-261,413-475,660-783
  Homolog annotation: Hit_ID=AAO33475.1; Match level="QueryCoverage =70%, HitCoverage=73%, E-value=1e-45, Identity=88%"; Hit description =gland-specific protein g5d08 [Heterodera glycines]
MDGPTKAKGAAPPNAAGPMGLLHLLNGNEKGKAPSGESKPILGQKPSVERQKRDVLGHAGGYVGGWDHPIDSTLDWVKSQWNDANWLADVVNRNGLVGVIKNFHTLLDSFAVKQKRQKSLTDEITGNRFGPAVGL

SEQ ID NO: 154549 - protein, 197 aa, Heterodera glycines
  Coding regions on vcDNA: vcDNA=SeqID_80972; Strand=-; Position=1 -166,237-315,494-757,1120-1204
MSSDESTTSSASAVSVQLREVPIKDFNDVLPVLQKTLNQLEHPFIKKAEEISGMEPLLHHFLSCAARVDVLPWQFVSLYSYHGIHPVARLLVRVRRVLPVGPSLWLYQWLPSAAVRAFEDRLSALLGPSANLWRSQHVREAYPQMDCHDERIGQDEEDVVIEETTYHCVMSAVRNWSKWVSDSWSASPKTTYKCLYV

SEQ ID NO: 154550 - protein, 315 aa, Heterodera glycines
  Coding regions on vcDNA: vcDNA=SeqID_80973; Strand=-; Position=1 -561,664-823,894-1120
  Homolog annotation: Hit_ID=CAE59237.1; Match level="QueryCoverage =60%, HitCoverage=19%, E-value=3e-11, Identity=30%"; Hit description =Hypothetical protein CBG02561 [Caenorhabditis briggsae]
MWCPVSMFLQPVPLRSSAMRWRCVAQCRCSSSRCRCGLLRCGGDALPSVDVPPAGAAAVFCDAVAMRCPVSMFLQPVPLRSSAMRCPVSMFLQPVPLRSSAMRWRCGAQCRCSSSRCRCGLLRCGGDAVPSVDVPPAGAAAVFCDAVPSVDVPPAGAAAVFCDAVPSADVPPAGAAAVFCDAVPSADNTEEPQMPAGQEGAEASAKPTGQSAAPGGTSAVGQLPAEASKKSLAPAGTGSAVPSAYAAPGTGTAMSTTSQKSAAPAGGASALSTASQKSAAGGTVSQKSAAPAGGASALGTASQKSAAGGAASQKA

SEQ ID NO: 154551 - protein, 83 aa, Heterodera glycines
  Coding regions on vcDNA: vcDNA=SeqID_80974; Strand=-; Position=1 -62,128-317
MFGTLRFIATLFAVTALFLDDALAFGPRAFLKRQAPPSAEMAPPKAAMDQQVAMELQQQQKHFERFVMEPQRVVPFVPSPATA

SEQ ID NO: 154552 - protein, 154 aa, Heterodera glycines
  Coding regions on vcDNA: vcDNA=SeqID_80975; Strand=+; Position=1 -15,166-615
MSLNQRLSCNNGAGLTASFAPTPYGQSPPDQNQAMLAVPMAIRPTSGAPPTMIQYGTTTAMYFNAPAQQHQMMVSSSGTSSSAEQQQAAAVHAYQQQQQQHHHEQQMLYATGTMAGGSQQQQQPQQQQHFFPPQGGPSGAAHPGKSSLIPNSNI

SEQ ID NO: 154553 - protein, 69 aa, Heterodera glycines
  Coding regions on vcDNA: vcDNA=SeqID_80976; Strand=-; Position=1-310
LGKFNVIEIHRRTTIYDHSSAADLYLLREIPPSIIQHIIVRLSASKALQIFMCGPSLNFSSVFNCSDWR

SEQ ID NO: 154554 - protein, 156 aa, Heterodera glycines
  Coding regions on vcDNA: vcDNA=SeqID_80977; Strand=-; Position=1 -74,412-582,679-779,1075-1197
MLRAGSSASTSSRLSKEEIDEILDSPYETRYTYSDSAAYKPHIGSHDYVHPRLCRRFPATQIPRSASPPFLTYPTGTWQNYWRRPDQWTWTQLFFYAVQFFAIFAYTVVQYALVRVYYAFRYLTTRAAWYAIKYTILWPILAPYNAAVSYYNKGGF

SEQ ID NO: 154555 - protein, 122 aa, Heterodera glycines
  Coding regions on vcDNA: vcDNA=SeqID_80978; Strand=-; Position=1 -67,292-479,697-810
LTDDKRQQQQKRINNREQYNDMMSSSSSSGCWTPAQLISSDEWSKWTVNEADLSIRPCPKTVQLSLRLPNGQMERIRMWKAAPLNAVFSMLLAKGHNYSSNNYQLVLDYPRREFVLCPQVAN

SEQ ID NO: 154556 - protein, 347 aa, Heterodera glycines
  Coding regions on vcDNA: vcDNA=SeqID_80979; Strand=-; Position=1 -245,674-923,1061-1155,1312-1486,1779-2057
  Homolog annotation: Hit_ID=XP_418191.1; Match level="QueryCoverage =92%, HitCoverage=41%, E-value=3e-17, Identity=24%"; Hit description =PREDICTED: similar to phosphatidylinositol-4-phosphate 5-kinase, type I, gamma; phosphatidylinositol-4-ph
MGTFKLRFCAPYMFTALRAVFDHPPVITSEDLIRSIAEKPLKLMPNPAQSGASFLRTNDAQFFIKSADQNEIKFFHTFTDRIVFPQNFPKIHYKFDLKGASINRKELKFGTSDEAQHKTCRDLDFFRFNSEDKNGTMAEGLFRHGICIGREKHEELVQLLEDDTWFLKAHNIMDYSLLMAVHFVGKQKLPDEWLDELPFGVFHGKCNNCKNPFRNVYENDQKLLISIGIIDTLQTYDYPRELEDIYKSSMSIFRKKPNSVKHPSVYRNRFLEAILTVFLRPNCISSPENDEIIHEKREYKAESQSKEFILKAMAEKSDQTQQKLISPSRKQLERRKQQEKILEDLRN

SEQ ID NO: 154557 - protein, 15 aa, Heterodera glycines
  Coding regions on vcDNA: vcDNA=SeqID_80980; Strand=+; Position=1 -14,1434-1467
MSIFGCEISHGAWFI

SEQ ID NO: 154558 - protein, 96 aa, Heterodera glycines
  Coding regions on vcDNA: vcDNA=SeqID_80981; Strand=+; Position=1-291
MTNEFKQKRKYSTKEWQQNYAEICKKIGVGYETIKKWKKQFGISSKRITKNEKMEKMNIYWQTKIENPKMSEKEIAKMLKIDRNSISNWKKQVEME

SEQ ID NO: 154559 - protein, 233 aa, Heterodera glycines
  Coding regions on vcDNA: vcDNA=SeqID_80982; Strand=+; Position=1-702
MKFRLLYLTILFFVIEINQIKIENKKLPQKSFDEIFGEKWEEKEGKQRNELKKREIIRTFNKIKEKIKEKGRKYPRKEWNKIDQKIAKKLGTNRNYIQKWIKELGLNQKRHKSHKSKTDEEKRQIIQKFIEMKNEFKQKRNYSRKEWRQNYAEICKKIGVGYDTISKWKKQFGISCKITEKEKMEKMKKYWKIKSENPKMSDKEIAKILQIDRRTISKWKKQFGGEILEDLNG

SEQ ID NO: 154560 - protein, 35 aa, Heterodera glycines
  Coding regions on vcDNA: vcDNA=SeqID_80983; Strand=-; Position=1 -24,548-631
MAGQADVQYSSASEAMAYWRSTPNPESGFKDFSKF

SEQ ID NO: 154561 - protein, 185 aa, Heterodera glycines
  Coding regions on vcDNA: vcDNA=SeqID_80984; Strand=+; Position=1-558
MQSENVPPKPLQNEAEKLEKQLLKAKEKKRSEEKITEAVGKMMDELKSSIKEEIKVAAEDLWAKTEPLLKEQKRVTAAMVESLDEFMAGKNGIDEEEGTCPAPASDQRSEGTVEKSSSVEDGEPAQALPPQNPGQGPKEQINRAPLGKRGRGYAMGGHGPRGQWKNGGQKTQKRVGYLVRQLERE

SEQ ID NO: 154562 - protein, 347 aa, Heterodera glycines
  Coding regions on vcDNA: vcDNA=SeqID_80985; Strand=+; Position=1-1042
MSNQNCSNSQSGENEIGSDFDPVFFTAEENGNFANILNRMRLFESAVCRQFRRLEYELAEINGMFQKSNENLRGGKLEQSMADLEDREELDHFQMEEKVIKIEGRIDTVGLSLKSLEKFTKVRFNKIIEKMKSEMAKMTEDIDILRKRVEFLEMEEVSDENLWAENGHSFEHEQFLNEDPPNSGENCEIMISDPFLGGIAPLESYDGNPSISFSRWSSKFEDMLSLYPQLTEAQKLSRLRILLIGQARAELESMEPQPENLASALNYLRQKFENENTRSIARQALSICKQAPVERVYESANRLNEAIRTALAGEGEDVIRKRLEEFVERLTPDLQFEVKAGRPTNYS

SEQ ID NO: 154563 - protein, 30 aa, Heterodera glycines
  Coding regions on vcDNA: vcDNA=SeqID_80986; Strand=+; Position=1-91
PSGLVFRILIFKKAHFSIFGLGPKRPRGPK

SEQ ID NO: 154564 - protein, 128 aa, Heterodera glycines
  Coding regions on vcDNA: vcDNA=SeqID_80987; Strand=-; Position=1 -79,318-341,692-843,2990-3118
MGLSPETQSGKDPNLTTDQWGDQKQGSIARLAFDAADEAEKDAKLWELANPEHFRVDKSYKGPTISLPLRSAHVETMLEYFKQNKAPVGHCCGQRIVCGPWRRVGQDGSGLSAADPTESSQSVSRTVP

SEQ ID NO: 154565 - protein, 60 aa, Heterodera glycines
  Coding regions on vcDNA: vcDNA=SeqID_80988; Strand=+; Position=1 -139,265-308
MPQCPPGMCADALQFDSLKLEFRRPKKVQKSEIGMPTHLWCAHLLIDKKYINGFFSLEKL

SEQ ID NO: 154566 - protein, 150 aa, Heterodera glycines
  Coding regions on vcDNA: vcDNA=SeqID_80989; Strand=+; Position=1 -42,550-726,790-1020
  Homolog annotation: Hit_ID=NP_491350.1; Match level="QueryCoverage =74%, HitCoverage=27%, E-value=3e-24, Identity=49%"; Hit description =GDP-mannose pyrophosphorylase (43.3 kD) (1E875) [Caenorhabditis elegans] gb|AAF60648.1| Hypothetical prot
MTTITPQQKPILKAQLENLHEIFIVGFYPAEQFANFISDCEKKYRRVPIRYIQENCPLGTAGGLLQYKDILIDRKPPDALFVLNADACGEFPFLEMVQELNQKTEAKCLILTTEATREQSVNYGSVAIQIWLFRTRQKWYHRKLTKRQTD

SEQ ID NO: 154567 - protein, 78 aa, Heterodera glycines
  Coding regions on vcDNA: vcDNA=SeqID_80990; Strand=-; Position=1 -169,429-496
MWTDWTNLATWTLNGRRMAATAIGWTTKLALLQWQFYHLSLTNLAKIINLNKFKIPGVMITNWTLDLSYYLANYAFIY

SEQ ID NO: 154568 - protein, 68 aa, Heterodera glycines
  Coding regions on vcDNA: vcDNA=SeqID_80991; Strand=-; Position=1 -168,231-269
MFEVWPKAESGQLLDFVMGRRCETKAQIGVINERSGRRKKQKWKKKQKRTNDSHSKFNSLLMSSIRNK

SEQ ID NO: 154569 - protein, 214 aa, Heterodera glycines
  Coding regions on vcDNA: vcDNA=SeqID_80992; Strand=+; Position=1 -169,465-544,994-1158,1229-1364,2019-2054,2096-2154
  Homolog annotation: Hit_ID=CAE60636.1; Match level="QueryCoverage =68%, HitCoverage=46%, E-value=3e-36, Identity=59%"; Hit description =Hypothetical protein CBG04280 [Caenorhabditis briggsae]
MAVIRPFLLFLPFLLFSPSAAFVDDPNLCLRLTSAAHDEIQELPGLSFRPNFKHYSGFLKTTSKNLFHYWFVTSENKPCQDPLTAAENYEAVKQFFNKFPLFRSNPTFITGESYAGIYVPMLVAKIVDGQAEFPINLEGMAIGNGFVNAPLDTDTLARFAYAHGLVEESKWNQIAKQCCGGCLGQPLVDYLNKDQALIRSLFLYKVLLLELCKN

SEQ ID NO: 154570 - protein, 102 aa, Heterodera glycines
  Coding regions on vcDNA: vcDNA=SeqID_80993; Strand=-; Position=1 -38,96-177,227-235,462-498,648-725,770-831
  Homolog annotation: Hit_ID=NP_502690.1; Match level="QueryCoverage =90%, HitCoverage=64%, E-value=3e-10, Identity=34%"; Hit description =putative cytoplasmic protein (4O808) [Caenorhabditis elegans] emb|CAA19482.1| Hypothetical protein Y37A1B
RNILERRVTFASGCFITYTDRDVNQFTQPYQVLNTTFAYEATEGGREVFACEFYQDATVRSPLYTPYTNIYIKRTSECKKSALGSQALETAEPDERTFKRKM

SEQ ID NO: 154571 - protein, 312 aa, Heterodera glycines
  Coding regions on vcDNA: vcDNA=SeqID_80994; Strand=-; Position=1 -113,164-318,460-499,548-732,792-994,1117-1215
  Homolog annotation: Hit_ID=BAA36711.1; Match level="QueryCoverage =100%, HitCoverage=40%, E-value=2e-38, Identity=32%"; Hit description= DEAD-Box Protein [Ciona intestinalis]
SFNDCGFDPAILRNIQRRNYSRPTQVQKAVIPLIQQTGDLVAHAHTGTGKSAAFLLPLITGDLVAHAHTGTGKSAAFLLPLINEVQQMRNAGNTQHNGDSPYSVVVAPTRELVKQLYEDACTFSAGTSVDVALAYGDIPTSVDVALAYGDIPMGVSINNVRKGCDLLVATVGRLFHYAREHIIKLDKLRFFVLDETDKFFEQSKSVGIKKCKEQSKSVGIKKCKNSEGFPARTLMFSATIDREVQEIANSFLTDGYYFVSVGEINQAVGTVNQTVLKVNWKEKKHLKRNVIKGVTYETEKTIVFINGRRECD

SEQ ID NO: 154572 - protein, 205 aa, Heterodera glycines
  Coding regions on vcDNA: vcDNA=SeqID_80995; Strand=-; Position=1-618
MGQPNAAPPADAGEEDENACPPQLDAEETMDRPILSIPKRLLEMALTAITAHSKKQKGADASATLCPRPAPSLPSSVCFSSSSSSSNISDDPSSNERKRRNGQTDGGAERPLRKRRRVRSRIGPRRKHRGQRQKGRDAERHNGEGEEQQHIDNGTAPLRMALISVPKEAEANLEDQKRQKKRNRKGQSIAAKHKRQNPSGFGRFK

SEQ ID NO: 154573 - protein, 57 aa, Heterodera glycines
  Coding regions on vcDNA: vcDNA=SeqID_80996; Strand=+; Position=1-173
MEMELNPDPSRVQWEVDLLMVRAELAWRKQTTTKNGNPPIRSDQRSIIGFYSILPNW

SEQ ID NO: 154574 - protein, 24 aa, Heterodera glycines
  Coding regions on vcDNA: vcDNA=SeqID_80997; Strand=+; Position=1 -58,113-129
MLKCHGRTETRRGMLGTMPQFVKK

SEQ ID NO: 154575 - protein, 236 aa, Heterodera glycines
  misc_feature (2)..(2): Xaa can be any naturally occurring amino acid
  Coding regions on vcDNA: vcDNA=SeqID_80998; Strand=-; Position=1 -63,252-282,335-415,581-652,710-832,1043-1093,1349-1543
  Homolog annotation: Hit_ID=CAE57914.1; Match level="QueryCoverage =99%, HitCoverage=60%, E-value=4e-73, Identity=59%"; Hit description =Hypothetical protein CBG00965 [Caenorhabditis briggsae]
KXRAKKSVYKQTSGLCNCRHEMRTQQLGMGRFQMFQVRVCDECPNVKLGRFQMFQVRVCDECPNVKLEAQTKNLEVEVEVGADNGQEVRFIGEGEPHIEGDPGDLIFKVRVEPGDPGDLIFKVRVEPHKLFERRGDDLYTNVTISLQHALSGFEMDIDHLDGHKVHIVRDKITWPGARIRKKDEGMPSMTNNQERGILYITFDVEFPRGELTAEQKALLAELLAQGDHVPRVYNGL

SEQ ID NO: 154576 - protein, 242 aa, Heterodera glycines
  misc_feature (34)..(34): Xaa can be any naturally occurring amino acid
  Coding regions on vcDNA: vcDNA=SeqID_80999; Strand=-; Position=1 -129,297-356,409-479,621-789,908-990,1174-1204,1264-1355
  Homolog annotation: Hit_ID=CAE57914.1; Match level="QueryCoverage =88%, HitCoverage=48%, E-value=2e-59, Identity=55%"; Hit description =Hypothetical protein CBG00965 [Caenorhabditis briggsae]
LIKFKIDHFAYSAKKCIQVQEKSQAYRVFFFHSXKNIRYLKKIFRKMARQHHPDKNPDSKLANEKFQELGEAISVLGNAEKEKFQELGEAISVLGNAEKRKVYDRHGEEGVRKMGDGDAFGGHDPFSSFFGDFFGHGSQEQDEETPRGADVVVDLYVTLEEVYKGKFVEMTRKKSVYKQTSGTRECNCRHEMRTQQLGMGRFQMFQVRVCDGRFQMFQVRVCDECPNVKLEAQTKNLEVHFK

SEQ ID NO: 154577 - protein, 48 aa, Heterodera glycines
  Coding regions on vcDNA: vcDNA=SeqID_81000; Strand=-; Position=1-144
SGTGNFGQNRDRDLPGPEKPGPGPRFFFGTGTGTNREILKIQKNFKKF

SEQ ID NO: 154578 - protein, 32 aa, Heterodera glycines
  Coding regions on vcDNA: vcDNA=SeqID_81001; Strand=-; Position=1 -87,393-404
MLNHCGRNLNETSNINLETEMKRMIVNVPRIH

SEQ ID NO: 154579 - protein, 97 aa, Heterodera glycines
  Coding regions on vcDNA: vcDNA=SeqID_81002; Strand=+; Position=1 -63,398-628
MSLIVGRIDKVLGMIYACNFGGPPIVQSTPLVPPPLGISQNYARHSQAPTMALPSPIFGHHFPSFGPMPTVSSRARVFWGVHSESALKRTKFYVQVK

SEQ ID NO: 154580 - protein, 59 aa, Heterodera glycines
  Coding regions on vcDNA: vcDNA=SeqID_81003; Strand=-; Position=1 -113,165-231
MHIYVCVLNFGLLSPSLLGFGLFCTKLMLDRYWNMLLRNISPKEFFSNAAFHPFHTNKD

SEQ ID NO: 154581 - protein, 26 aa, Heterodera glycines
  Coding regions on vcDNA: vcDNA=SeqID_81004; Strand=-; Position=1 -42,269-307
MPKFAGDLEIALDTKISFARKAKSEF

SEQ ID NO: 154582 - protein, 243 aa, Heterodera glycines
  Coding regions on vcDNA: vcDNA=SeqID_81005; Strand=+; Position=1 -276,329-782
  Homolog annotation: Hit_ID=AAL78214.1; Match level="QueryCoverage =79%, HitCoverage=94%, E-value=7e-09, Identity=26%"; Hit description =putative esophageal gland cell protein Hgg-20 [Heterodera glycines]
WVCNDVWMDILPLFDHAQLGLKLALISPRFDVLVDAHFNGKSELTIWRQITIQKFKGPKAKLSEWIDDKWVAFPLPDRPLPNKIRFRNLRIEKPDHSVLAFLRANQQIFEKATNLCLSVSSCFHDCLSLFVDNNVQPIWDVFACEIWPIFAPNIRRFNFRDGDHLDNLRRRISPTILTDLNNLSAITSGRLFPDGIADDGPNATAGQALAKWLHTPRNDGQPKRLRCGGGYMSKTEFVNIFKE

SEQ ID NO: 154583 - protein, 500 aa, Heterodera glycines
  Coding regions on vcDNA: vcDNA=SeqID_81006; Strand=+; Position=1 -316,362-540,592-1599
  Homolog annotation: Hit_ID=AAG00554.1; Match level="QueryCoverage =90%, HitCoverage=76%, E-value=2e-33, Identity=26%"; Hit description =retinitis pigmentosa GTPase regulator-like protein [Takifugu rubripes]
MGAFADRRLAANFGEILSINGGTKIRSRIQFDRRIKSEDIDEEEEQKYKLRATGYRKCRAAVAEDGGGAVAVLNPLSMHLLKVTGGALPQQNAEQNGETCEESLEYLRETLNLSRSLKFEIPDKSPLNRSLTMNGRIPIWRREAEPKADNEPKQQRKMANGEKRMRVKAEKRRERNRGEEPTQRRVRAKRRNAKEGSEGHRKRNGRRKKKEVEEERNGTREKDEKEAEKEKEEANNNKEIGEEERNETTGEEEKGRAKADDGEEKNEGAVLDEEEEKQETAEEKSNTSSMAEEDGGGKERNGARLEEEEEEEKESSSKNGTEKERKETIGEARMEEKEEEENRETAEEKSNGTSRQKVNDGDTAEEEDEGGKERNEGRLEEEEMSSKNETEEKSNGTFMAAEDGGRKERNEGRLEEEEEENSKNETEEMKGQEEKQEMNGKDKSEEGTMTKRKMANDCPKPIRVSKRKRNISPEFNLNDLLYEDYRTKFGDAIPRDVYRH

SEQ ID NO: 154584 - protein, 112 aa, Heterodera glycines
  Coding regions on vcDNA: vcDNA=SeqID_81007; Strand=+; Position=1 -94,826-959,1398-1505
MVKMCVQPLLPIVAFISFAFAPPHVGPSSADDRCVRPLAVVRFPGDQLHAQRGDEGEAAANDHFGRIGRGHGPIHGVTALKSRCELHLINCVEIPLIDRFLLIDRYGLDNLK

SEQ ID NO: 154585 - protein, 60 aa, Heterodera glycines
  Coding regions on vcDNA: vcDNA=SeqID_81008; Strand=+; Position=1 -46,759-788,880-986
MLHKNAINCFIKIKKVKKARLQGTIEDFPCLCDVKITKCEVNNQSLSKAIQPQWEQEFVL

SEQ ID NO: 154586 - protein, 83 aa, Heterodera glycines
  Coding regions on vcDNA: vcDNA=SeqID_81009; Strand=-; Position=1-252
MEDELSLEVPAAVADADLSLEVPEEWSDDDLVFAPDPLADADLSLEVPEEWSDDDLVFAVPDALADADCFEAEVVFFEVLTEP

SEQ ID NO: 154587 - protein, 48 aa, Heterodera glycines
  Coding regions on vcDNA: vcDNA=SeqID_81010; Strand=-; Position=1 -53,452-545
MVYKMQKTTILYDLYPLRLPIQNISNAIIASVVLHNLALKNAFAVSRR

SEQ ID NO: 154588 - protein, 17 aa, Heterodera glycines
  Coding regions on vcDNA: vcDNA=SeqID_81011; Strand=-; Position=1-66
HKHLFDLFYHIHNLIKI

SEQ ID NO: 154589 - protein, 72 aa, Heterodera glycines
  Coding regions on vcDNA: vcDNA=SeqID_81012; Strand=+; Position=1 -68,1241-1391
MTWAWNERVTMLLLLILLVLMCHFAIVLKASPIPTAIFIGKFTVRFLNGTKNDKATKAEWTTESNFQKEGGL

SEQ ID NO: 154590 - protein, 142 aa, Heterodera glycines
  Coding regions on vcDNA: vcDNA=SeqID_81013; Strand=-; Position=1 -116,644-956
MPKLRMPQLQTTISLTLSAGGFGLTKSTNLPLSAKLFLETLFATSFKKRNFFNALAYATPYWFNTNEFDKRAHTTGGRTASATLNAGGSQAIGKKVQTERTPIQMYHWCTEITPGGRPSTPSFNVGDPHEIGEEMHIRRAQI

SEQ ID NO: 154591 - protein, 232 aa, Heterodera glycines
  Coding regions on vcDNA: vcDNA=SeqID_81014; Strand=+; Position=1-699
MSLLDQFTNLFNCSAYDVSNRLLSDAERTKALVLCNHKLLTTMYKDRNGLNHTFTCTGLSAEGAESLLAYGKLREPFNISVAAHYYARHRIMLSHPKAPCAIERTTLSHRGGQRTTVLKFYPLELVRFSSYCAIPSRSPHMNTYVDYADYYADDDDDELSDTTLLRDNTNGDNGDDDDSDGPLMVLPSNNLPPMCSLRLEYWKVSDDGEWARDEVWVADDELDKLRTILHNL

SEQ ID NO: 154592 - protein, 602 aa, Heterodera glycines
  Coding regions on vcDNA: vcDNA=SeqID_81015; Strand=-; Position=1 -694,756-1870
  Homolog annotation: Hit_ID=NP_001004509.1; Match level="QueryCoverage= 94%, HitCoverage=43%, E-value=1e-34, Identity=26%"; Hit description =si:busm1-180o5.3 [Danio rerio] emb|CAD60788.1| novel protein similar to DNA polymerases [Danio rerio]
MKERVEEEEEEDAGGIELGDNGNGGIDITWDALTIASASMKHFRLNHLRSDQLAIVPESGYDTANNQSLLALKFMEWYAEENGLQIQTAHSSGGEHRIGRYTVDGYIHETDSVIEVNGCCWHAHDHQRHRFKADTVMPSGKTAARIREDDARRMAFIRSQIRGTVSIFWECDIEERLRREPDMRQAFSSYRNSGPINLRDCYHGGRVGPQRLHYQVPEGWRMRYFDVRSSTEGGVSASYRCTHSDEQRGWVSTVTSIELAEALRNGYRCTAYYRSIEWTQEQWSERVFRGYVAEFMTMKTHASGFPEEVGNGEEEREKFITECEERFGMVIDPARMQHNKAKRTIAKLCNNSLWGRFSLRNGLSKTVVTDSPSELRAYLDNPQLEVSSVDPLNEQCVLITYTAKKEWTDEHDCSNIVLSLWTTSAARLHLLKLMKRVVRAENTELIYTDTDSVCFAHREEDGCPLDIGPHLGDLSDEWPDHELLEFVSGGCKQYALRMRHRQTGKEQTVVKVRGITLSGDACRLLHFDTFKRAVLRYAKGPKEYDGNNTDDEVILIDNPNFLRPNIRTGSVHSVALTKRYRPVVTKGIVSPNDTRVLNFGFV

SEQ ID NO: 154593 - protein, 80 aa, Heterodera glycines
  Coding regions on vcDNA: vcDNA=SeqID_81016; Strand=+; Position=1 -39,267-470
MMRIYHRCSHRLIGQQIGERHQIIGAISQRLFEQRMAKESAEQMQMGGVEKAKRGKGKGEGTVEPNEEEGAEQLKKGDTN

SEQ ID NO: 154594 - protein, 119 aa, Heterodera glycines
  Coding regions on vcDNA: vcDNA=SeqID_81017; Strand=-; Position=1 -138,499-639,694-774
MGSGDARVVLDGLHFANGVQLHPDKVSVLVSECSMARIQRSVQLLIVVPEQYLFPLMELVAKKYGFVMELALDGHVLRTYQDPTGSDVPDVSQAIDDASHIYLGSFHSDFIALIPKKSK

SEQ ID NO: 154595 - protein, 126 aa, Heterodera glycines
  Coding regions on vcDNA: vcDNA=SeqID_81018; Strand=-; Position=1-381
  Homolog annotation: Hit_ID=NP_700900.1; Match level="QueryCoverage =78%, HitCoverage=38%, E-value=3e-09, Identity=32%"; Hit description =hypothetical protein PF11_0035 [Plasmodium falciparum 3D7] gb|AAN35624.1| hypothetical protein [Plasmodiu
MPKAPPHSFYTPTRTCQTGKMPSDGREREEKEKFEARRRGRKKRKGMKIAVGKEERRKRKRGKGKIRSKKEGEKEEEKDENSSGEGGETEEKERKRKNSTEEGGGERGGRENEAEKREEQQQIDTF

SEQ ID NO: 154596 - protein, 33 aa, Heterodera glycines
  Coding regions on vcDNA: vcDNA=SeqID_81019; Strand=-; Position=1-103
LNFLIFLFLAANIFYSNLSVWSDVRQTEKIFKI

SEQ ID NO: 154597 - protein, 177 aa, Heterodera glycines
  Coding regions on vcDNA: vcDNA=SeqID_81020; Strand=-; Position=1 -130,733-965,1387-1557
MVLLHSSSLSISIAILLLLMPTMLQSCHPTDNTAAAGTTAPRRSTTNVPTLTTASTAATTGGGGTAACTTCSPSALRLLSVPEAVASGLLQATATTTPTNTAGTNAAGCATLTPNCDAGQVVSIHVILANGDTDFGNYDSGSLPLECNSNGKWVVPAGRQHAGNVVDGYSCVTSATG

SEQ ID NO: 154598 - protein, 212 aa, Heterodera glycines
  Coding regions on vcDNA: vcDNA=SeqID_81021; Strand=+; Position=1 -180,306-544,865-1084
MDNQMFDADNKKEFEINNNGMENESQRWLCANLNYASVGTALLKGTPNRDSALLVQALRQQITKAGSMTAGEANLSKMISNDIFMLRNKKQVDGFEEFSFGAREKARKIRFQLYLYEEELINYGEFGIFMLNAENEHLFVPFCPCFWFPPNNPRPISLPLILVVPICFLPFPPPLSSVAHPPLVLVLAFHHQYPHLWICLRQEKGANLMSPN

SEQ ID NO: 154599 - protein, 138 aa, Heterodera glycines
  Coding regions on vcDNA: vcDNA=SeqID_81022; Strand=+; Position=1 -232,525-709
MMMGQGAGTVAPGITTMAKASVTNPLGQSSGPSSQQATITKQIDRAKSLVATGNVKGMDRVSMMRSALKVCDIGRSRASDPRPEWKIKLDEQAEKINQCINRQKQQGEEGDGEGKVPPNSEPTKADDGQQPKRRSRWT

SEQ ID NO: 154600 - protein, 110 aa, Heterodera glycines
  Coding regions on vcDNA: vcDNA=SeqID_81023; Strand=+; Position=1 -222,284-395
  Homolog annotation: Hit_ID=XP_314540.1; Match level="QueryCoverage =92%, HitCoverage=25%, E-value=3e-33, Identity=63%"; Hit description =ENSANGP00000016313 [Anopheles gambiae]
RIPGVLTKSSLMLGLGEADAEVEEAMRDLRLVGVEALTLGQYMQPTKRHLAVSEWVSPAKFDRWRELGDRLGFVYTASGPLVRSSYRAGEFFLKNVIETRRIKENGGGIG

SEQ ID NO: 154601 - protein, 74 aa, Heterodera glycines
  Coding regions on vcDNA: vcDNA=SeqID_81024; Strand=+; Position=1-229
RDSNVPLRPKIFSISGKKSKIFRKKYQSIELEKLCFGSGLRFSAKNSLKILKIQKPKNRFLGLARKILKIFQNF

SEQ ID NO: 154602 - protein, 28 aa, Heterodera glycines
  Coding regions on vcDNA: vcDNA=SeqID_81025; Strand=+; Position=1-87
KIELPKLYNKSAGTPSLSSNPGELFAWY

SEQ ID NO: 154603 - protein, 500 aa, Heterodera glycines
  Coding regions on vcDNA: vcDNA=SeqID_81026; Strand=-; Position=1-1500
MIIVRSPKNTRQRTVNLGVQPLSGDNDQQRGQQIVENPVNLAANPNVNEGNRRNSVSSANTSVLDANEIRRRLKMTENANNAADGRNGQQQVHREEVLLNDHGNNLLANANLGENVEKSFVQPLVNDQPQQIQQNFENELRQNVIVGEQRVATSTPYIEMQQLRQQNIERRNISPLRSPFEQNFRENVVVNPNVIVNPTRNENRGPNLHFSDRIDVPPNPNARLQVFREQHVEIDRHYSSAFHAPVPMRQTCHGQIQQAAYMEQHGAHQPMLLQQQNMRGVMHHQQPMAGRNEYFPEYYGGRHLYPDGREQPNSGNNELKIGNLEYVLTMDRLPELNGNEGTDKMKSFFKKFSNATEEWPEKKRIKALESKVNGRAERAFNAALNTQPYRFDSIRRAMQQQLEDTDCREMSAFDELMSGVKRKSNESLDALADRIQSLVSRAYPGLTQNLCDDYAIRHLIRALSNPDLSLTLGMSRRPEMSYDEFVALAARAESIQRAPK

SEQ ID NO: 154604 - protein, 136 aa, Heterodera glycines
  Coding regions on vcDNA: vcDNA=SeqID_81027; Strand=-; Position=1-411
MIIVRSPKNTRQRTVNLGVQPLSGDTDQQRGQQIVENPVNLAANPNVNEGNRRNSVSSANTSVLDANEIRRRLKMTENANNAADGRNGQQQVHREEVFLNDHGNNLLANANLGENVEKSFVQPLVNDQPQQIQMII

SEQ ID NO: 154605 - protein, 101 aa, Heterodera glycines
  Coding regions on vcDNA: vcDNA=SeqID_81028; Strand=+; Position=1 -104,1314-1386,1512-1640
MRLIVDDFFDQQVRQFSTELRLGNAFLFLGGAPSGPFSNRVLLSSTLLHWLTKAMANRMFKHLAIYPIHVPQMLKCLKCLPSTVAKILANCQPGNRPPGVP

SEQ ID NO: 154606 - protein, 34 aa, Heterodera glycines
  Coding regions on vcDNA: vcDNA=SeqID_81029; Strand=-; Position=1 -57,766-813
MDNEYSHIFYCTCTTAVDLNYNYTNGQCLTKILK

SEQ ID NO: 154607 - protein, 113 aa, Heterodera glycines
  Coding regions on vcDNA: vcDNA=SeqID_81030; Strand=-; Position=1 -119,369-578,1653-1665
MNYSARNYLMNVLITSTEEKLWKKDNKYSKFDNSTYRHLSVQIENINYTNIYSFTCHSHVLFTVPIHGLMHGHGRDSRLIHDHLDDSSNIEWQCSRVNSLSQFTGKFTFGNLD

SEQ ID NO: 154608 - protein, 127 aa, Heterodera glycines
  Coding regions on vcDNA: vcDNA=SeqID_81031; Strand=+; Position=1 -106,147-249,925-1096
MGPALAQTPAKALFFATLTQHCQRCNDFELKALQSEHCRPTGYFDVYTCPAVAEYKVDNGTKSHHTIIYKPCLTMSRDQESDSFYMFCMASMASAVLSALYVRWRRELIERRAFGSSAHSYARLATA

SEQ ID NO: 154609 - protein, 673 aa, Heterodera glycines
  Coding regions on vcDNA: vcDNA=SeqID_81032; Strand=+; Position=1 -518,559-1046,1086-1281,1328-1864,1909-2192
  Homolog annotation: Hit_ID=NP_507780.1; Match level="QueryCoverage =57%, HitCoverage=27%, E-value=8e-28, Identity=25%"; Hit description =predicted CDS, DNA polymerase type B, organellar and viral family member (5T899) [Caenorhabditis elegans]
ELLREPYNELSLPKKAPKDYIKKLDSEIEHVPKFKLVKNKSRFIIKDIPADPEALLMGVFQHCMDEAIIDSRQSGVEPTHLGCIVSSQNLSSDIWIPIWQLTPDTINTILNRFNDVAQSKKQDGVTLWGEPFTVTVTTLNRNALPAKRQLKGGAARKLAPVHHNIHPNCLIKIQNFDDDNYCLFYAIQATLVRSIGDLDRRRFHDYVNGNSEMRGKLKNDALEMMNAVNAPAGQPNYDAEVYVPRIVDWWNGEKFVGQWKFKTFLFGSAGHYKPLFKYGPEDYVVPIILYFEEGHFNGVQKSGNLFGKPYCLSCEKTYDRPKRHIVNCKARCIKCSQMGPIFPCKPNNGFRQKCKDCNKLFFNNSCYQYHLSSEFCKMSKECKYCGVVWDLRNNTQNGREGHKCNERWCENCQIFHEFKRGCFIRPLELSPKNEARGWRLVIFDLETMQHEPVDPQIPERRKHQVNFVTAKVACPDCISNGQWKESLLGKKCNICGYHRTITFSQMPFNGTTVDRQVIDRHPLVSFVKWILYNLPKQYDTIAYSHFGGRFDMVLVFRELFMEGLNPSMIKNGNRLLEMKVKSRKKLNPNISFRDSWNLVPGPLASLVPMFGLDVQDKPFFPHLANRPENYGCQIFPTKSNYLAGGMNPEKRKEFDIWYAQNQNQPFLLDEALA

SEQ ID NO: 154610 - protein, 159 aa, Heterodera glycines
  Coding regions on vcDNA: vcDNA=SeqID_81033; Strand=-; Position=1 -202,862-1139
MARQQQSTASSCSSSSMCCCNALAKMHESFVAKFRVIRPQANLITLDGDNNNDIILHEEADEDEAIAQPCTSSAGQQPRPIGGGTADELQQEAEDNESVLLNGAESPTPGAGTLGYEILAEDSKTPAPFYEMMSESELNVRDGHSSFCFKYKFCDNFLV

SEQ ID NO: 154611 - protein, 225 aa, Heterodera glycines
  Coding regions on vcDNA: vcDNA=SeqID_81034; Strand=+; Position=1 -72,112-365,417-547,595-635,710-888
  Homolog annotation: Hit_ID=CAE72537.1; Match level="QueryCoverage =99%, HitCoverage=45%, E-value=5e-36, Identity=35%"; Hit description =Hypothetical protein CBG19719 [Caenorhabditis briggsae]
MEALGAIILDCKKPPKILQKEADDLSNKLEMRHFPANPKEVQMARKQIMHEMFEENPALLYQWEDTKQRPTLSRMFDKEAQKRLAATRYNWKPLKFDTKEAAVVYALSRFGGYFAEMRRVFSEFDRNGFEPETVLDYGSGSGAAFWAAFERWGNKVREYSLMDQDYGKNYTGAGEMITQNVFFRKDLFPSPQHTYDLVILHRTLIEIQSEEERMELIEKLWKRTK

SEQ ID NO: 154612 - protein, 128 aa, Heterodera glycines
  Coding regions on vcDNA: vcDNA=SeqID_81035; Strand=-; Position=1 -94,656-905,1034-1076
MNTWCPCSCQFDGCQPHPDEWNQYQQDPTGQICKDRHSQCERWANFHKTRHASHISAHHIFNRWHSSNYPRNIMPKYNVSSSSGECARNAHWMAQNCAKSCGHCRAAIGTSRKCSLMMPKDYEMPIIN

SEQ ID NO: 154613 - protein, 138 aa, Heterodera glycines
  Coding regions on vcDNA: vcDNA=SeqID_81036; Strand=-; Position=1 -78,565-660,961-1041,1297-1369,1432-1520
  Homolog annotation: Hit_ID=NP_491709.1; Match level="QueryCoverage =77%, HitCoverage=16%, E-value=8e-21, Identity=43%"; Hit description =tyrosinase family member (82.2 kD) (1G477) [Caenorhabditis elegans] gb|AAB52481.1| Hypothetical protein C
MWSSMFMGTTNDFGQIVNGEFANWITPINGGCTLPNLNPANMIEIIHSDVHTWVGGDMIWEQWRLKWQSRAQRETQFPPDSQIVPCSGSENYRLSAIMRPFQDPVVLNRDGLSNAYTDNLYTYAPRPSCNGAGQCGSP

SEQ ID NO: 154614 - protein, 47 aa, Heterodera glycines
  Coding regions on vcDNA: vcDNA=SeqID_81037; Strand=-; Position=1 -73,115-185
MFNQLLPIPFGAQHESMSYRRANSPFKTDAAFAQFAKMVTSLAFVPL

SEQ ID NO: 154615 - protein, 427 aa, Heterodera glycines
  Coding regions on vcDNA: vcDNA=SeqID_81038; Strand=+; Position=1-1281
  Homolog annotation: Hit_ID=XP_319741.1; Match level="QueryCoverage =86%, HitCoverage=83%, E-value=4e-40, Identity=27%"; Hit description =ENSANGP00000006515 [Anopheles gambiae]
MDAQQLQQILDAALKKSAEVFAAALNIQNQNPNPGSSTTASLAASINVHLEKFNYNPEVGQTYDAWLNRYGKIVQQDGASLPEQSKVQLLVGKLDEEEYKRYVDSIAPKATEQFNWLETVANLKKIFGETRSLFLRRFDCFQIRQCQNQDLSSLLALINSSCENAELDLKKEELKCMILIISLRDEFSDLKQRCLQRMEEARTNGKSITLQELGEECKKYQILKESTLALSTKQYNANAIRAKPQQVKDKADATKQYAKPKAVPKPYESKHKLPNRPCQSCGSTNHWRSDCGHRDAKCPKCGKIGHLGKVCRSNSSIRHIQTVNTTERHAQINTVIIDLNCMEIKADHPKWWKILIKVNGADYPMHVDSGAQITLFTIQTWIQMGKPPLTSANIRVKNCNDQTFAINGQFMCKVQYMDRPPMKLLAY

SEQ ID NO: 154616 - protein, 580 aa, Heterodera glycines
  Coding regions on vcDNA: vcDNA=SeqID_81039; Strand=-; Position=1-1740
  Homolog annotation: Hit_ID=CAA82797.1; Match level="QueryCoverage =30%, HitCoverage=25%, E-value=2e-10, Identity=31%"; Hit description =gag protein [Ascaris lumbricoides]
MQQFEFENGSESNMDPANEGHHRNGAQHDENVQDGDGPVASTNEEQQKVARVNEATRGSNMATGVATNQQGMLPFPSRNLRSVSIPVRTARDRIERASGTLAARIAEAREVIDQDLTEGEAGYQAARLLAMERGLKEATQIFQGHFEIGMAAAGAEPAGHQDFFYDLLTAPLPAATKELQLRNHPTPAELLQIADEHIGDLRTMRQALEDEEEAIARSRLSGSFGTNNSHPVGDDPPPLENRNMEEWERSFQGAAKRWQNDGQGVPQHNRRPMGRVATPVMSNLDGIFQRRAKVPSVASMRVTNPAREWINRNRDEMGAFPPATAHRLALMQPKIEKQQTHVNDDYRERQTYPIRRHARDEGEHDRKHGRDEITEMTTFETVRLQPPTFSGKPEDWTTFWAYFKRAVDDKPIPGFEKQLHLLRCLKEGSPARRAVEVYPPSDGNYPVVVHLLKERFGDTDDLQRAIRARLLHLPPAKDSVNSLTTMIDEFERCVCQLEQLGANVDDDSFGPLLEAKLPVRVLTELRIRESMMGSKWAVREFRRAVSAQVRCMRSAESALAAMKDPEEGTDHKTERDQTGW

SEQ ID NO: 154617 - protein, 28 aa, Heterodera glycines
  Coding regions on vcDNA: vcDNA=SeqID_81040; Strand=+; Position=1 -31,687-742
MGQRNGQNVNESALKRTKFYLHVNKALL

SEQ ID NO: 154618 - protein, 1110 aa, Heterodera glycines
  Coding regions on vcDNA: vcDNA=SeqID_81041; Strand=-; Position=1-3332
  Homolog annotation: Hit_ID=CAA82797.1; Match level="QueryCoverage =50%, HitCoverage=72%, E-value=5e-14, Identity=21%"; Hit description =gag protein [Ascaris lumbricoides]
MERGLQEAIQIFQGHFEIGMAATGAEPAGHQDFFYDILTAPLPAATKELQLRNHPTPAELLQIADEHIGDLRTMRQALENEEEAIARSRLSGSFGTNNSHPVGDDPPPLENRNMEEWERSFQVAAKQWQNDGQGVPQHNRRPMGRVATPVMSNLDGIFQRRAKVPSVASMRVTNPAREWINRNRDEMGAFPTATAHRPALMQPKIEKQQAHVNDDYRERQTYPIRRHARDEGEHDRKHGKDEITGMTTFETVRLQPPTFSGKPEDWTTFWAYFKRAVDDKPIPGFEKQLHLLRCLKEGSPARRAVEVYPPSDGNYPVVVQLLKERFGDTDDLQRAIRARLLHLAPAKDNVNSLTTMIDEFERCVCQLEQLGANVDDDSFGPLLEAKLPVRVLTELRIRESMMGSKWSVREFRRAVAAQVRCMRSAESALAAMKDPEVRTDHKTERDQTGLEVQAGREPFQRAFMVRDSQPTRAQSNGTRSEERYGTNARFARRSITHANENESSGGNWPRVASNGPIATTEIWNCSLCLRSGHRPSKCQAYPTAQARRKRLIEQKRCLRCMSSNHLFKQCQRVNRCNACRKDDHHWLLCWKSISGGQSRSFTEHERRAKNHATLISGMDRPTHFTAVRDEQNNRDEFDMNAGEQRAFTTFGSRLPAQQMICRVIAAAEEGEDECQTTLLLDPGSHVDGADTELIQQLGPQPIDKRPLTVQVFGGKKQRIRSATYRLRLKRTDGKWESIEVSEVPQICTPIKTELIESGATPDSEPRTVTQTTQPQIMIGIRKFWDYVIGFRKIESGAHVIDTVFGQVLCGEGTQASSGVTPAASILTTMPCGNIHQTRTNKRQQIGEVRRNWKRKRKSRKNNSRGIVSRDRHNSPAEFGPDRSGANEVITSREEPIGEMDPKQRKWPIGRIVETKGASEHNRNAMIRIANGRTRRRPIKKIWPLKEARPKTGETDDRADEAVHERHEEETRAAKTQSETRDRNKPSATRREERNETKRNGKSAEKRGREVEDVQPDKKANRQIRDDNSRGNGPHYSDEKYGSATTTEKSAVFEKAAEVPSAAQSKAGNSARPHSAQRHEKKYLGDSSMAPSLLNVPTKFQPNSTISEGGD

SEQ ID NO: 154619 - protein, 311 aa, Heterodera glycines
  Coding regions on vcDNA: vcDNA=SeqID_81042; Strand=+; Position=1 -192,603-919,963-1094,1162-1200,1245-1381,1595-1710
  Homolog annotation: Hit_ID=CAE74692.1; Match level="QueryCoverage =31%, HitCoverage=7%, E-value=9e-16, Identity=46%"; Hit description =Hypothetical protein CBG22506 [Caenorhabditis briggsae]
LILLAAAVISLVLSFYKPPNREEINAISSSHLATTTPNSAEDEQSSGITEQHAGWIEGAAILIAEKQFRGLQSKIETEHKFSVIRDGRAMDIVISEVGKEGHSSETHCLSVIHFVFDCRWRHRPGEIRRPFAHRWHFAPKQRPQNRRVHADGRVGSHPKTPRDGSDPFVRHSCDGRQRKDGGHGGGHALANGHYNVGDGPWVCTSIRSSGVCWDVQCHEKCQPKRTTFERQFVEVRRQWPNDFRRFVRRCAAAKRRGDDGTRGGGGQFEEQIVWGPEEKKHFEAKDIANFVDFIIIGVTVLVIAVPEGLPL

SEQ ID NO: 154620 - protein, 191 aa, Heterodera glycines
  Coding regions on vcDNA: vcDNA=SeqID_81043; Strand=-; Position=1 -128,488-699,1736-1968
MDEEILLLNNAKQLEEEEIQQQYVAQLNERIEQFRATKRKLKIEINQLINKAESNEPFTFAVYIHIKMNERHNPRALHELLINWERTKRCEWNCDQLRLWVRNHSTNEDKGITNLFNEVHPLHIHAKLNHTNEQLARDVKHLLMVDAAFDREARDECQKMAFEVPLRNWAAIAQQMDDDEIKAYVVQPLNS

SEQ ID NO: 154621 - protein, 227 aa, Heterodera glycines
  Coding regions on vcDNA: vcDNA=SeqID_81044; Strand=+; Position=1 -54,317-466,528-681,756-869,920-984,1236-1382
MEQLAAFWAQSLNSQSMETKLTRTRCDLMGKECEPTRELLRKIRKISKCCSPSNAAGPCICKLPKPDPSEFAAPPHHYNWNESPSLKYGNSQSEDPLDWTGDVLYTEEQAQRLHDRYKSACAQCYPPEKKKWRRKRQAQPNLSKWTKFPIAIRFNRTLGEPTPPQFIDAVEQGIKFIMLPGTVCHEFLHAIGLNHEQQRDDARKYSKLNPEERNVVLKIINLWTYNN

SEQ ID NO: 154622 - protein, 201 aa, Heterodera glycines
  Coding regions on vcDNA: vcDNA=SeqID_81045; Strand=+; Position=1-606
MKLCQIFILIIFLIVLININYVGSEKKKLRQKTFDEIFGEKWEEKEENQRNELKKREIIRTFNKIKEKIKQKGRKYSTKEWAKINSKIAKKLGTNRQYIYKWIKEFGLQKKKCYKLRTDEEKTEIVQKFIEMKNRYKQKRKFSEKEWKQNYAEICKKIGVGYGTIKKWKKQFGIHCIITEKEKNGKNEYLLANKNRKSENE

SEQ ID NO: 154623 - protein, 253 aa, Heterodera glycines
  Coding regions on vcDNA: vcDNA=SeqID_81046; Strand=+; Position=1 -152,194-378,473-859,943-980
EEHKEFANVTKTYFASLHAFVLLTDLNYEEFALKLHFQIQNSQEKFAEYYTNLKSKCDNWTIDKWQNKMERIGEKIVDKSSKEKCREFAVKLDEQRNRSQNEQSENIEPPKQTSFHRTSFKRSVKTSKIFADQRILRNRLISPLDAQFRAELFQFLDSLFLPNLLPFPNKFVAGPGDLALLDPSLSVEFDRCFSDCEQSDEIKQLDIVNVYQLLVSHDSLYYTFPLSTLQEAFCLLAKPIEVGTHRSCQIAAQ

SEQ ID NO: 154624 - protein, 78 aa, Heterodera glycines
  Coding regions on vcDNA: vcDNA=SeqID_81047; Strand=-; Position=1-237
MAKLNCPILTVDSAEMAFLLNQHCPFQSRAFSPPGTALKWATQILIVVDNDYSVNDVRSGATNINDVHSERIAKTRQH

SEQ ID NO: 154625 - protein, 106 aa, Heterodera glycines
  Coding regions on vcDNA: vcDNA=SeqID_81048; Strand=+; Position=1 -105,432-516,698-828
MLKFQRSASKNTTTDSPTISRRSLPDRRSSFVSSQIGENSPCNWHSALQMERNISQNQLRKLTLNRLLQKDRQIEAKLIAGTHFFALTWPFAWTVVEKVFYPYFRK

SEQ ID NO: 154626 - protein, 55 aa, Heterodera glycines
  Coding regions on vcDNA: vcDNA=SeqID_81049; Strand=-; Position=1-165
MASVTDRFLMNWKGIPLGFGLVTSTTFHIFNNRWLRNRFNANAFESKETKIAEQM

SEQ ID NO: 154627 - protein, 352 aa, Heterodera glycines
  Coding regions on vcDNA: vcDNA=SeqID_81050; Strand=-; Position=1 -79,127-186,652-1012,1065-1501,1554-1672
MPTIPFSTPIQSFLDSNSPFDEITVAVPSDLRKSSSVVDPFRRKVPNHQKGGYHRFSHRSRLMHGSGHSLSADGRTVALPLLDKVRSPLPSLGFLLIPIFCQGYPTVHRPLLISDSLSAVAHQHHGKAPGFGASNPFFGADELNLGGITEFGDQQLEKDATHSIGRRSIVSSSIVDLSQLREEAFAPRFHGTSLNRRRKLVSDGTLTAETLRMRHKQRSRKRRNRTSDDVLNENDGEKDEGMTSKSSGVSSQNPQIFTVPLLNGSFASSLPPYDSSSAFESDGTQSSKEGNGEGDEAEDESEGSLDEEQLSESDRMGRSSPKTLQKCSSAALLFFDPIPSLKALLDHCCAMV

SEQ ID NO: 154628 - protein, 83 aa, Heterodera glycines
  Coding regions on vcDNA: vcDNA=SeqID_81051; Strand=-; Position=1-251
  Homolog annotation: Hit_ID=EAL49477.1; Match level="QueryCoverage =96%, HitCoverage=5%, E-value=5e-10, Identity=42%"; Hit description =hypothetical protein 42.t00003 [Entamoeba histolytica HM-1:IMSS]
MERKIKERERGEEDDEEEEGRENKMIWREKETKKEEEKEEKEEGKERKRSREEKKVRGTERDEEDEQQERRVCEKARERKEWK

SEQ ID NO: 154629 - protein, 77 aa, Heterodera glycines
  Coding regions on vcDNA: vcDNA=SeqID_81052; Strand=-; Position=1 -120,384-497
MLQKVLGYISKVRVTSTYNFWSHSQEVFVHVTKDFPLVNWFYLAFKDVNPSWSLIGCALIYGITPHLESFSIHLSLL

SEQ ID NO: 154630 - protein, 19 aa, Heterodera glycines
  Coding regions on vcDNA: vcDNA=SeqID_81053; Strand=+; Position=1 -33,156-182
MLPALRLRPDNDNPYKDIF

SEQ ID NO: 154631 - protein, 18 aa, Heterodera glycines
  Coding regions on vcDNA: vcDNA=SeqID_81054; Strand=-; Position=1 -14,288-330
MRNTGENEIQKASNFVTL

SEQ ID NO: 154632 - protein, 353 aa, Heterodera glycines
  Coding regions on vcDNA: vcDNA=SeqID_81055; Strand=-; Position=1 -157,671-856,924-1038,1257-1521,2227-2373,2414-2605
  Homolog annotation: Hit_ID=CAE66278.1; Match level="QueryCoverage =81%, HitCoverage=39%, E-value=4e-71, Identity=41%"; Hit description =Hypothetical protein CBG11523 [Caenorhabditis briggsae]
MPQFPFLILSSFLFPLLFCSVFSAIGPNARVDCAPKFGEGKSDCLARGCLWDGGLLFADQFIQIATYLPTDLVYGFGENAHQQLKHDFSKYTTWGMFTRDEAPNPLVENVENLYGVHPFYLALEPSGKAHGVLILNSNPQEITTGPAPHLVYRTIGGQLDLFFFPGPSPELVVRQYHQFIGRPYLPPYWAFGYQFCRYGYKDLNDLKATIGRIQAAVIPLDVVFVDIDHMEQYMDFTVGQQVPFDGIWIDMNEPSSFGTNEKPSAQSHNLQPLQCPLSGTDSQFDKPTYETINVYQYGSVLSEKTLCMSAMTMRGQQRMFNTHNLYGWSQMVATRKALGEIGQNICEKVKYEI

SEQ ID NO: 154633 - protein, 63 aa, Heterodera glycines
  Coding regions on vcDNA: vcDNA=SeqID_81056; Strand=+; Position=1 -73,758-876
MAIPETKAAATGDWPSWWNGPANVVLNMFLKRNHYAEYGSFPKLYHGRVLNLFLFCVLRGILV

SEQ ID NO: 154634 - protein, 639 aa, Heterodera glycines
  misc_feature (203)..(203): Xaa can be any naturally occurring amino acid
  Coding regions on vcDNA: vcDNA=SeqID_81057; Strand=-; Position=1 -219,274-488,543-1954,2871-2905
  Homolog annotation: Hit_ID=NP_500227.1; Match level="QueryCoverage =99%, HitCoverage=60%, E-value=2e-78, Identity=31%"; Hit description =predicted CDS, reverse transcriptase like family member (4D351) [Caenorhabditis elegans] gb|AAK68554.1| H
EPTRECNFLDLITNNIIKDISVGPPFSLSDHNTVKFDLRLNVFPCRKFKHFNFKKASYLEINAILSSTDWAFLHFLIAFLHFLISKYVPLTVSNSKHNFPDHIKKIMFIVDNFGKTLKKKKLEKFIETSKKLEYEIKKYLTNRENKFFKNTKIPPLKNSENKNTKIPPLKNSENKIVSEKAKSNLLAEQFYSVFTDQNSCFMXSHPKNIDFFTMTLNEIYLALNKLENNNNTSIDSIPNIFLKNCKENLVYPLFHIFCFSMMTGQVPNIWKKSIIYPVPKIPNPINPVDFRPISLLCSISKILEENITQKITNFVETNNVLPNCQHGFRRKHSVTTQLLEVIDDFSLALENKKSIDVIYFDLAKAFDTVPHERLVSKLKNVGINGTLLKWLQNYLQNRTFFVRVGSAFSDEFPCLSGVPQGSNLGPLLFLIYISDLPNFCKTENVEIKLFADDLKAYSILSKNTISPLHSFINKFRNYCELNGLKIAPNKCLVSHLGPKNPNECYLINNIPILKNEEGEPVRDLGIYFSNNLKWEKHIEFITKKAIRTSFALLKSLKTKSPKILINIFNVYCRSILEFGSPIFNPYMKKDIDALENVQKTFLRIVFRRNNKRMIYPGITNFFNSLNKNKVQSLEFLLTE

SEQ ID NO: 154635 - protein, 173 aa, Heterodera glycines
  Coding regions on vcDNA: vcDNA=SeqID_81058; Strand=-; Position=1 -10,133-644
MSNSSDLPPKPSKYQCHWMERLSDAVALVQKERKRSLVLIGLPEAVAEKPSERAKEDAETVAEVLDALDVEVCPQMVYRMGRRIDDKRKGPRLVKVVLPATTFQRFALAQWGRNRTELKQRVGWQRLLVRPSLTKEELAAERETREQRRMNYEESKKNEMVTTRRGGTMEKNF

SEQ ID NO: 154636 - protein, 667 aa, Heterodera glycines
  Coding regions on vcDNA: vcDNA=SeqID_81059; Strand=+; Position=1-2003
  Homolog annotation: Hit_ID=S60004; Match level="QueryCoverage=67%, HitCoverage=32%, E-value=5e-44, Identity=28%"; Hit description =hypothetical protein - common roundworm retrotransposon R4 (fragment) gb|AAA97394.1| reverse transcriptase cod
MEKVLISNPLELSSVHNCACDLTPKDLFRSVGPGTNGQRGKGVGEHRCPTSDCAGKDPPQRGLQKGNLSCKRWTPSEEKAVFEEWSRLEAQTRLDGSAARGSCAINKRQFLVHWDGVKESRSSAEGVPTYPERSERAYFERIRLLRKKRGWEWDCANDRIVTGQPEVPGRGSRTRVIAAKADLSVRRKLVKGKCITPPHRDGTEDQESDDEEVAITVPVDIIQVEEPECTGVTEGQIPGDPTGNPEKEAAGEPAQRSVPISGIISDGERKYLKVRFWSAYKKAQGSVGNRPALKIEPSKVNRAQWEVLDSCVAAVLKRRETSKGCRGCILRTLNVAVYAAGQVLAEGDRERRQAIRRQSMEWLLRQKSEISNIRRHIGWITDELKRRRTGKNPTLRQLRNFQWLQRRYQVLGKPVRETRDLETQREKLVVRLHMALDRVSVTTRRSERTQQRLLPMRRKLEEPMGDSKLDPAQAREFWAGLIGKRKEFERIPELEDWAEETKSKVPSDQTLDEDRKDLFAWKKILGKARPLKAPGPDGVPNLLWKRLPSANQALFKWLMGIKRKQLRVPNWFTRGRVVLLPKGGDPMDPANYRPIACLNTQYKLVTGMVTAWISDHLTKHSILPSEQRALVAGTWGCTHAMVIDRVITSYAKASGIPLYVGFVDFRK

SEQ ID NO: 154637 - protein, 64 aa, Heterodera glycines; identical to SEQ ID NO: 131646
  Coding regions on vcDNA: vcDNA=SeqID_81060; Strand=-; Position=1 -84,394-504

SEQ ID NO: 154638 - protein, 97 aa, Heterodera glycines
  Coding regions on vcDNA: vcDNA=SeqID_81061; Strand=+; Position=1 -93,517-717
MKRRSCKSGVDDQCVGPPIESRPCNDEQCPTECVSASLLGTMPMLQFVQLALVLNIVNANYEAVPSGPNGNHGRHVQRVAVPVNRYNIYWTILPCYS

SEQ ID NO: 154639 - protein, 154 aa, Heterodera glycines
  Coding regions on vcDNA: vcDNA=SeqID_81062; Strand=+; Position=1 -221,447-690
  Homolog annotation: Hit_ID=NP_509195.1; Match level="QueryCoverage =79%, HitCoverage=24%, E-value=3e-19, Identity=36%"; Hit description =hemicentin (XH708) [Caenorhabditis elegans] gb|AAK68232.1| Hypothetical protein C36B7.5b [Caenorhabditis
MTGGGNEVAPSYNQLCHKVRRRQCRNAASKDECQGGDVERLLCNTQLCPAWTTWTEWSACSNSCGTGGTQSRKRECRYAGELSNECTGAAKDEKQCKQLEACPSWAEWGEWCAYDVTQKPQKKTNLPLLKSNQNFNSRYHSIALRVFYSLAKFH

SEQ ID NO: 154640 - protein, 159 aa, Heterodera glycines
  Coding regions on vcDNA: vcDNA=SeqID_81063; Strand=-; Position=1 -61,246-664
MLAQQTQKRHHQQQVQQQKQAIVPDFFATSSGGDTKTNISIFMNKGERKKQKYAWRALEELHRMRVSPLLYAQRLLCKDGKLLIRKNEIKSGILTPVDKPLDIWGQTYIGYRTQLIFIFGMRIVLCETVMKKGTKNWENPTQRLAKGKYQQQIKLPNQF

SEQ ID NO: 154641 - protein, 104 aa, Heterodera glycines
  Coding regions on vcDNA: vcDNA=SeqID_81064; Strand=-; Position=1-537
FYGIIRPLRGRLLSLRTGASRPFFNFFGDIRPLRGLMTVASRPFFKNIRPLRGLRTSASRPFHNFIKNIRPLRGLITGASRQFLILLRTFGRFAASRRSLRARF

SEQ ID NO: 154642 - protein, 53 aa, Heterodera glycines
  Coding regions on vcDNA: vcDNA=SeqID_81065; Strand=-; Position=1-271
KNTQKNNVTPSGSEPAPSPLKMMPQNPQSHRDSEVLTMSKVKSDHVFVISVIK

SEQ ID NO: 154643 - protein, 105 aa, Heterodera glycines
  Coding regions on vcDNA: vcDNA=SeqID_81066; Strand=+; Position=1-318
MLSEDDEDKVEDELDEAISAQHHHHNQQLNAAQQKHNNGTMTTAVAPKLSQCRHDGTKLFVQNHQANTVEDEDDYDYDDDDDEDYEDRIIVEPMFRCCVQCMKLI

SEQ ID NO: 154644 - protein, 289 aa, Heterodera glycines
  misc_feature (14)..(14): Xaa can be any naturally occurring amino acid
  misc_feature (21)..(21): Xaa can be any naturally occurring amino acid
  Coding regions on vcDNA: vcDNA=SeqID_81067; Strand=+; Position=1 -168,537-605,830-924,973-1032,1690-1791,2247-2332,3302-3423,3487 -3544,3744-3781
  Homolog annotation: Hit_ID=CAE75218.1; Match level="QueryCoverage =98%, HitCoverage=40%, E-value=3e-95, Identity=58%"; Hit description =Hypothetical protein CBG23167 [Caenorhabditis briggsae]
FKNNFGVWYFALNXFNFFFSXVPKAKKRLSVHSILVERDEWSSWADFIMSCVGYAIGLGNVWRFPYLCYQNGGGAFLIPYIIAILFCGVPLFILETSWGQLVSVGGLGMFKICPIFKGVGIAAVVMAFWGLGMFKICPIFKGVGIAAVVMAFWLNIYYIVVLSWAMSYLFHSLRMDSNVPWRTCDNYWNSPRCRSEYTPVLCESNRTIAGYFMLRILTDDHLNEYRKQFFIGPKVNFTICTEADLSVRSPVKEFWDHRHRVLGISEGIEHVGFKKFNVLFFQNLLKIIP

SEQ ID NO: 154645 - protein, 15 aa, Heterodera glycines
  Coding regions on vcDNA: vcDNA=SeqID_81068; Strand=+; Position=1-4,38- 81
MNIFWNQWVRVQCFE

SEQ ID NO: 154646 - protein, 185 aa, Heterodera glycines
  Coding regions on vcDNA: vcDNA=SeqID_81069; Strand=+; Position=1-557
MKRSSNTQASSSFKKSQTNKCIRKIDQFTSKSIKHHFIRSKSKFVIDEIDKCTDPAAELRSCVHHSIEEAILDGQNILGGANKVGIIISSELLDQGDIILPITPITSNVVDAVFNQFCKVEQSKAKYVSLYGAPFVVTVTVLNTDGLPRRRTTKGNAPPIHSSQSHIFKINNNDNYCLFYALELM

SEQ ID NO: 154647 - protein, 27 aa, Heterodera glycines
  Coding regions on vcDNA: vcDNA=SeqID_81070; Strand=-; Position=1-82
FRLFIKNFGSRNSDPKNVGNRKSYRAI

SEQ ID NO: 154648 - protein, 68 aa, Heterodera glycines
  Coding regions on vcDNA: vcDNA=SeqID_81071; Strand=+; Position=1-207
MTLKRGAECEIKQIIAKIWGRDTFKATPQLALEKSRVRIRVKWGNREKAASNRENAATRQCHQIISSG

SEQ ID NO: 154649 - protein, 21 aa, Heterodera glycines
  Coding regions on vcDNA: vcDNA=SeqID_81072; Strand=+; Position=1-64
ITGVSIIAVLFLVFLMPSQNL

SEQ ID NO: 154650 - protein, 39 aa, Heterodera glycines
  Coding regions on vcDNA: vcDNA=SeqID_81073; Strand=-; Position=1-117
KFPGWSRSRTKIEVPVPASQVPASPGPGFAQNSRSRRTL

SEQ ID NO: 154651 - protein, 177 aa, Heterodera glycines
  Coding regions on vcDNA: vcDNA=SeqID_81074; Strand=-; Position=1 -52,109-219,291-494,537-703
  Homolog annotation: Hit_ID=CAE60844.1; Match level="QueryCoverage =90%, HitCoverage=77%, E-value=7e-19, Identity=34%"; Hit description =Hypothetical protein CBG04553 [Caenorhabditis briggsae]
MKLLIVLLCVSAIYARSLQKRGQNSYGDEAGAKAGGAEGAAGAAGGEAAAPAPSEAAPAAEAAAPAPAPAEQPAAEQPAPAPAAEPAKQQASGYRRKRNQNSYGDEAKAAGGGAEGGAAAGGEAAAPAPAAGGGGGGEAAAAPAAEAAAPAPAEQPAAEQPAPAPAAEPAKQQASGY

SEQ ID NO: 154652 - protein, 699 aa, Heterodera glycines
  Coding regions on vcDNA: vcDNA=SeqID_81075; Strand=-; Position=1-2100
  Homolog annotation: Hit_ID=XP_320889.1; Match level="QueryCoverage =89%, HitCoverage=77%, E-value=2e-91, Identity=32%"; Hit description =ENSANGP00000012033 [Anopheles gambiae] ref|XP_313651.1| ENSANGP00000013044 [Anopheles gambiae] ref|XP_314
MDAQQLQQLLNALQQMVTNAAPQNATPANLSNANLASSIDARLSTFHYNPEVGTTFECWFKRYGKLIEDDGSTLPEASKVRLLLGKLGEEEYNKYRDTISPTQPDQVNWNDTISHLKSLFAETRSLFVRRYECFKIRQQQGQDISSLIAQINALCENADLSLTKEQLKCIILVIALNDEHHDLRQKALKMLEDAQKNGTNISLKKIEEELRTIQLVKESALSLVNPPIATNAIRTRPRQWTDPAQRQSGGSNQRQTPNANSSGKPTRGQPTLPCGSCGKTDHWRSDCTFKGATCFKCNKKGHISTICRSKKTKAPPNNHRSFHTVKVDANCLHVGTTQGRWWKLCILINGRQTSMNGDTGAQATIISLQTWQELGSPDLSPADIDAKNCNDQPFALLGKFIFTVQFSDKPPQTLIAYVSGEVGHNLLGLPWIEALEVIPRQILFPSSKSADQATKVIDNFSAVKPPNKSINDVSTLKAALQNDFPEVFEEGLGHCSKAKAHLILRSDAKPVFCRARPIPHGAMEAVNAELDRLLQIGAIKPIDCIDFSTGLNNALELNRHPLPRPDDIYASLNGAKFFSNLDLRDAYLQMEMDEESKQLCAINTHRGLFQCQRLPFGVKSAPAIFQHLMDQICAGIPGVFAYLDDGLIATKTLDQHISALYTFWAHKRVRSSHPTGQMQIFAARTFVPWAYCVSKRHSS

SEQ ID NO: 154653 - protein, 243 aa, Heterodera glycines
  Coding regions on vcDNA: vcDNA=SeqID_81076; Strand=+; Position=1 -21,66-175,238-387,431-588,803-1018,1530-1606
MSDLRMEASNDVIIPVNVAIRIFSFVSRDDLENCKLTCKSWKDVIDYADNRKNSELQLRHIDAICLSTNSEFSIKIYYNQTIREFYYKKYFADREIDEIEVKKVRHLTSQFDEKKYVFPCGEHLPIRQSHSFVFPAVDIFHQHRCKMVRPTVYQDHVNYTRKLFTPPLSFYERLQRMLKKCKIRLVIFHAFTFTDFFVEKMREFASDAFSRVVFLSLHYNYQQQIPPVEFIYSRIIWGRSLFI

SEQ ID NO: 154654 - protein, 106 aa, Heterodera glycines
  Coding regions on vcDNA: vcDNA=SeqID_81077; Strand=-; Position=1 -193,240-322
  Homolog annotation: Hit_ID=NP_496446.2; Match level="QueryCoverage =100%, HitCoverage=15%, E-value=4e-25, Identity=50%"; Hit description= kinesin-like protein (67.9 kD) (klp-17C) [Caenorhabditis elegans] dbj|BAA92262.1| kinesin like protein [
ISFAVSFLAGGLAIGYLLGWRTAASKLARCNTRVQLSKDKVVDTVELEDIGEKKAYCRCWQSKKFPLCDGSHNEHNKKFPLCDGSHNEHNKKTGDNVGPLIVQKAK

SEQ ID NO: 154655 - protein, 259 aa, Heterodera glycines
  Coding regions on vcDNA: vcDNA=SeqID_81078; Strand=-; Position=1 -52,96-223,320-688,840-951,1088-1206
  Homolog annotation: Hit_ID=EAL23807.1; Match level="QueryCoverage =95%, HitCoverage=86%, E-value=5e-16, Identity=25%"; Hit description =HUS1 checkpoint homolog (S. pombe) [Homo sapiens] gb|AAV38289.1| HUS1 checkpoint homolog (S. pombe) [Homo
MRFVAVIGDGKAVDIFVKVAAVVSKLCRKRAVVRITPNEFSFVNVYNVREGMHVDFRIHKDNLFNSWSFDGLSLDNNAIFFELSTDDFVRSLHSRATQIKLKMTKKDGVPHLRVELSANSLVNEIPIVLVVLRQWPDFNPPNMGISQLAVALPNVKTLVSYYWMKMNKWAHIYLQLEMDHNFKIFRANNRGEFNIIGYADQAKVAVYAQGLHNQSISGAEGLSQTAPQPEHFFNVTLDIRNFHAFLSALHALASRLTMS

SEQ ID NO: 154656 - protein, 313 aa, Heterodera glycines
  Coding regions on vcDNA: vcDNA=SeqID_81079; Strand=-; Position=1 -84,246-486,617-804,994-1314,2049-2156
  Homolog annotation: Hit_ID=NP_496448.1; Match level="QueryCoverage =54%, HitCoverage=75%, E-value=9e-57, Identity=56%"; Hit description =methyltransferase-like 1 (2L762) [Caenorhabditis elegans] emb|CAA91400.1| Hypothetical protein W02B12.10
MDWNELFGPSAEGHSPEFADIGCGYGGLVADFVQERVKALRAQNPGRYDNICCMRSNAMKNLPNFFRKSQLSKMFFLFPDPHFKKTKHKWRIISTNLLAEYAYVLMPGGRIYTITDVEELHHWMVNHLQGFPLFRRLTDKEYADDVVVPLLFESTEEGQKVTRNSGNKWAAQIEMPEQSSGADEYESLAPTYSLWVHLAAGAAAGMAEHCVMFPLDSVKTRLQSLCPCPESTCPTPIHGVASMVRREGFWRTFRGVNAVAVGSVPAHALYFTVYEKFKVLNTQQSPQPVIDKRSLLYLKGSYNGQYLHFIFLL

SEQ ID NO: 154657 - protein, 232 aa, Heterodera glycines
  misc_feature (2)..(2): Xaa can be any naturally occurring amino acid
  Coding regions on vcDNA: vcDNA=SeqID_81080; Strand=-; Position=1 -126,173-314,409-460,511-621,680-732,784-885
  Homolog annotation: Hit_ID=CAE63216.1; Match level="QueryCoverage =81%, HitCoverage=26%, E-value=9e-35, Identity=42%"; Hit description =Hypothetical protein CBG07573 [Caenorhabditis briggsae]
NXQKYNKISCYSTVGQLRDGHPQKVSIGPRCDNPFVVSHEIAHSLGFHEQSRFDRDKHSLGFHEQSRFDRDKFVQIQPKNIQLGFLNQFTRFSQSQETTFDVSYDFGSVMHYDAFVRVFPWGLSGLSSIQTVNPNYQNTIGQRFQLSFNDVKKMNLAYCHSICPFELSICPFELSCQRSGYTDPKACDRCRCPNGLAGACDRCRCPNGLAGRFCDRVEATDSLRGSASASNR

SEQ ID NO: 154658 - protein, 98 aa, Heterodera glycines
  Coding regions on vcDNA: vcDNA=SeqID_81081; Strand=-; Position=1 -161,258-393
MTNDLLTPHDLERQRSFVIGGVPESNATKPSARAQETMQWSNRFWMSWASKFPRAMYSQSGKSMSRQFGVRLQTKNERMNVRPSLSLEELSFGKACSA

SEQ ID NO: 154659 - protein, 62 aa, Heterodera glycines
  Coding regions on vcDNA: vcDNA=SeqID_81082; Strand=-; Position=1-188
MPSRNLSAKKKQQNSLVRDESTSSPSRTPKSVSKASNSNSSQQKLQKKHNSSELSTISSESV

SEQ ID NO: 154660 - protein, 518 aa, Heterodera glycines
  Coding regions on vcDNA: vcDNA=SeqID_81083; Strand=-; Position=1-1578
  Homolog annotation: Hit_ID=NP_510671.1; Match level="QueryCoverage =99%, HitCoverage=53%, E-value=1e-80, Identity=35%"; Hit description =predicted CDS, endonuclease/exonuclease/phosphatase family and RNA -directed DNA polymerase (XR69) [Caenor
SSPHPGGDQFQVCRSDITFDVSDIFEKLNRLYGKNNTAPDFINNQILKLFSSSCWPITDLSKLSFNTGKLLKIWKHSIILPVHKKENKSHVKNYRISLTFSLCKIFEKILVDRIYVFLTEKISEFQFGFVNKRSTITNLISTLEDWYDGIRDRKNIDALYLDLQKAFDKVPHNLLLYKLHRIGIRGKVLNWIKDFLTERTFQVKINEKYSKFKINSGVPQGSVLGPLLFLIYINDLPSYIPSKIGIKLFADDTKIYVNKSDTERKIMDLALINVLKWSEEWGIKFSIDKTYVLYLGTNNPKCPYKIGNFTISEAKSVRDLGVIIDNELKFTEHITYLIKYLFPYKILFKLIKSKTIRIWSLVYKTYIRSLLEYATEIWNPKSVNALNRIERCQKYFTRIALKKCNLPYISYNKRLELFKLDRLETRRKVIDLTTAFKIINCHTHYPQKLYTFSKRLRFNCIRLISKHKTNKTENSFINRTIKQWNNLDSKITASSSICSFKNKVIKWVKPLNTIKIFT

SEQ ID NO: 154661 - protein, 168 aa, Heterodera glycines
  Coding regions on vcDNA: vcDNA=SeqID_81084; Strand=+; Position=1 -229,292-474,708-802
MALFQALRPGLPPPLAVAASSDSDGEDAASERRRVVRFSGDERMQQKRRREKDGDAEGDDDEEAAEEEEEDYAPVEIPDSMLSTDTMPPPQHQPVYARAAPPVMPPPSSQMPSMGAGGVGRAPLPPGMAPPPPGYPPAAPQVKNAGFIGTRQLGPGTFGPSGFLAITF

SEQ ID NO: 154662 - protein, 213 aa, Heterodera glycines
  Coding regions on vcDNA: vcDNA=SeqID_81085; Strand=+; Position=1-642
MAKRMANFSPPNNTAPKKFLSDLDQLQIPKEIDTDNSIPDYAKLLIKQLHSLLSTASALIHCQVAAVDAVEEERRLRTVVVTNVPESKSDKAAERAREDHAIVDHMLNATDVDQAPIVFRVGKRMDGRPRPLKMEFPSKHAARHIIRMRGKVQALNGLHNVRIRESMTKEQLSERRKLIEECGKKRQADNGDWVIYANQVVLRQDIDQIRKNF

SEQ ID NO: 154663 - protein, 194 aa, Heterodera glycines
  Coding regions on vcDNA: vcDNA=SeqID_81086; Strand=-; Position=1 -102,148-243,290-358,405-545,594-697,743-812
DRRFHPAELSQLAADTLLLAASLNSPTNFSQMDECDAFFGCSQSAGKSGELSSVAHSLHSLLNDNFAKTLLIVDGVQMADSVKFFDQIKGKMCKILATSTSRTLFNGLENIQTFEVPSDNCSGEELAQMALNYGIKETFSAERINAILCETGGNFALLEKMFVMARGCPAIFDSLLAQLRHSPLSLVSCHSAYY

SEQ ID NO: 154664 - protein, 307 aa, Heterodera glycines
  Coding regions on vcDNA: vcDNA=SeqID_81087; Strand=+; Position=1 -154,852-991,1084-1502,2206-2416
MASADVSIEVAQLKNNDGGQMGTNAPAVIIKPERNGHFCRMFAPGKYTARVMRVVSSENVWWDSTEQSVHVVEKDVDGVHFVQKGFRMDIQSTHPAKMEYAPIVQHKKPSTDAVQQLKMVHLVSGLNTLFFPMPSSPTEKSAAKGKCQNHRTPPQPFKFALSSCHDFDIVVADGDGKAAENAFNDQQKDDNNSGKFTVPGTKRVELVAKATRLPIRIELDGDSTGRDELNLVDMKLTWFGPVWDEQDFELMLEKDGFEFKPYTPTADGIKIRKAGGWGEGLRLVNSKLITDNEIQFGLNFCFWVAYR

SEQ ID NO: 154665 - protein, 97 aa, Heterodera glycines
  Coding regions on vcDNA: vcDNA=SeqID_81088; Strand=-; Position=1 -121,168-475
LIIYYRHFQLNSVIVKTGNEDRRDVHFVVFPNELPAATVVSELELPANATIGGGVSSSTFRVLLKDSATGKIIQEQNVPGTVFFFTLPALLLIALCH

SEQ ID NO: 154666 - protein, 201 aa, Heterodera glycines
  Coding regions on vcDNA: vcDNA=SeqID_81089; Strand=-; Position=1 -310,740-1035
MPSFVHHHLTLLCLFLGALCAFGAVPSLCHLLGAPGGCSPIAVISAAQQPNGGGAAAQFQQPFGPAFGCPLNPLGAFGRPFPPPPPPPPPGIGGQFPSMQGQTVNLSPNFMGGGQQQQQNGGNAFGTMGGGGNCNCGTCCQQQQETNGNSNNNNFIGMPTANEFTGFNNGNNNLMNGIANGGAIDMANSGGMGVFGRRRRR

SEQ ID NO: 154667 - protein, 245 aa, Heterodera glycines
  misc_feature (9)..(9): Xaa can be any naturally occurring amino acid
  misc_feature (225)..(225): Xaa can be any naturally occurring amino acid
  misc_feature (237)..(237): Xaa can be any naturally occurring amino acid
  Coding regions on vcDNA: vcDNA=SeqID_81090; Strand=-; Position=1-740
  Homolog annotation: Hit_ID=NP_502797.1; Match level="QueryCoverage =90%, HitCoverage=62%, E-value=2e-32, Identity=36%"; Hit description =HASI (4P602) [Caenorhabditis elegans] emb|CAB16520.1| Hypothetical protein Y57G11C.19 [Caenorhabditis ele
IEKVLERLXNDPKSPAAFAGVDRLWLEAKKELGNKIRKNDVKHYLEGHRTYTLMRPRRINFPRARTTAAGFMTDCQVDLADFQTLSRHNRGNRYLMVVIDILSKRIFVTPLRTKKADDMVDGFKEVFSTMPMKPHRIFSDKGTEFRNQQLKKLFDEEEVEKYESTHSEKKAALAERAIRQIKNRVYRYFAQTKTLNWVDVIDQIVNGINKSPSRVHGMRPIDELXKFTTNMGSVWRXSAYGSFGK

SEQ ID NO: 154668 - protein, 329 aa, Heterodera glycines
  Coding regions on vcDNA: vcDNA=SeqID_81091; Strand=-; Position=1 -288,394-1095
MSINYNDKIYHGQHFAGCRDQSYDQWHYTDQREDCGARTIPFDIVGKYRECKATECETEWCISKEGVTIWCTRFKISPRFVPFDYVYELPGYTFFKTETPVYNLPPPPPPPQLKPKEKDGETEDQTTQQFFESITAAITGLDVSQKKHGEAKEFFDALSVATAGMEVDENKEKKALPQPQTNASDFFSPIAAATMGIVGDHLKPKPKPKQHQPRASDFFSPISASTMGMSDEQNKHEPNSKQPKKDSSKFASAISAATMGMSNNEQKQQIPIEKDKQQTDKEILDEFLESVSAATTCLDISHKKKPKKKGKKEAEDEEAAAIASISRKE

SEQ ID NO: 154669 - protein, 78 aa, Heterodera glycines; identical to SEQ ID NO: 144867
  Coding regions on vcDNA: vcDNA=SeqID_81092; Strand=+; Position=1 -95,462-603

SEQ ID NO: 154670 - protein, 107 aa, Heterodera glycines
  Coding regions on vcDNA: vcDNA=SeqID_81093; Strand=-; Position=1 -132,337-528
MSAIFGFIINLFCWFTCGFGILFNGILIRLIYRHTPKPMLIYSKYNFVSERGETEVIVYGLITIKGVQNRIWNLLAFVCWVFLVYVSMFGYVSQFIFRYLVIIRYIN

SEQ ID NO: 154671 - protein, 107 aa, Heterodera glycines; identical to SEQ ID NO: 154670
  Coding regions on vcDNA: vcDNA=SeqID_81094; Strand=-; Position=1 -132,333-524

SEQ ID NO: 154672 - protein, 35 aa, Heterodera glycines
  Coding regions on vcDNA: vcDNA=SeqID_81095; Strand=-; Position=1 -50,92-149
MTKTKNGRETETQNLMIDENGEDEEEEVAQQKEQI

SEQ ID NO: 154673 - protein, 669 aa, Heterodera glycines
  misc_feature (18)..(18): Xaa can be any naturally occurring amino acid
  misc_feature (375)..(375): Xaa can be any naturally occurring amino acid
  misc_feature (398)..(398): Xaa can be any naturally occurring amino acid
  Coding regions on vcDNA: vcDNA=SeqID_81096; Strand=+; Position=1 -169,276-379,471-555,628-683,736-797,847-978,1036-1164,1219-1285,1402- 1510,1789-1895,1986-2123,2184-2300,2355-2691
  Homolog annotation: Hit_ID=NP_505802.1; Match level="QueryCoverage =95%, HitCoverage=88%, E-value=4e-90, Identity=34%"; Hit description =rhodopsin-like GPCR superfamily (5L475) [Caenorhabditis elegans] emb|CAA96651.1| Hypothetical protein F53
ILSKKYFNLCRDLYALRXIPSLPPPICPLKVISHCPEGIYSEEQRAYRVYANAPISFFGILSNLFNIAIFCDCEMRQQLVNHFLLALSVSDLLLLLCNFLLLLLCNFFFLVLPVLIAEIDSFFWNNFCPFSLRYSYPLALTVQCPFSLRYSYPLALTVQTSGVYLTVLVSVHRFLGVCHPFVYLTVLVSVHRFLGVCHPFKAKRWVSRKAVEWAIVGSVLFSFSKAKRWVSRKAVEWAIVGSVLFSFSVNIPTWLELGVVPCYSTRFNRPFSQIQLAPFHDISYILIKPFSQIQLAPFHDISYILIKKCLVYTLLMFIVPFSTLITVNWKMVCALRSSTRLRTKHTLSSVCALRSSTRLRTKHTLSSSKPSRLMXTFSTLSRYSEVFKVISKINYSRXTDKQLLNCNSNSTRDRSITLMLLAIVGLFLVCNGLAFLNSIVESMSLQNTVELLRNSSEGAEEQKFVQNDAKEEMWWMELMVKWFECSVEVSNVLITLNSSTSTLVSNVLITLNSSTSTLIYLVFSSKYRMIVKSIVGLQKRDRFNRIAFTTALAARRAMELFNRIAFTTALAARRAMELSLIPEVFDVPLKEKFQNQEVENRSRQSRKRTTTLTSSGTDPRRVDSSEFKIEPARFNALAVAVQASDRGGAVQMRGRETEETKIFDFPGNV

SEQ ID NO: 154674 - protein, 104 aa, Heterodera glycines
  Coding regions on vcDNA: vcDNA=SeqID_81097; Strand=+; Position=1 -197,237-354
MMSFCSGLQLSSIGDANSANSATAVPMSAASHRRTMFKGLQKGSKELFRSQGTLNRSMTNSESNLRLMDEQEKPEKSSAEDERKKKIGETMEMAEAPRQNCYNL

SEQ ID NO: 154675 - protein, 152 aa, Heterodera glycines
  Coding regions on vcDNA: vcDNA=SeqID_81098; Strand=+; Position=1 -68,130-537
SKLKVLSSSADFSSFLFLALLFDFSFSQPTIQQKSIQELLNTPTFLPTAEKHDYFVAPFLQQQKQRWLSVRPFQEFRRSPQTADLGLLLQYLDNKRNAPSLMEDEGNGRHGISGSPLGTMRFGKRTFNSPLGTMRFGKREYNKSPLGTMRFG

SEQ ID NO: 154676 - protein, 290 aa, Heterodera glycines
  Coding regions on vcDNA: vcDNA=SeqID_81099; Strand=-; Position=1 -59,157-331,444-551,614-722,767-828,882-1041,3042-3076
  Homolog annotation: Hit_ID=CAE58778.1; Match level="QueryCoverage =100%, HitCoverage=10%, E-value=2e-89, Identity=58%"; Hit description= Hypothetical protein CBG01975 [Caenorhabditis briggsae]
QQALSCYVVSMSASTIVSKGQFGQFTSHQLFRYFADLSNPDFVTHLAMVHSRFSTNTYPSWSRAQPNRMVAHNGEINTLRGNINFMKAREGTMRSREYKEELNKLYPVVENEMTDSGCFDNVLEFLVCFDNVLEFLVRAGNRTLPEAAMTMVPEAWEKDEDMSHEKRIFYRWAAMQMEPWDGHEKRIFYRWAAMQMEPWDGPALLAFSDGRFIGAILDRNGLRPPALLAFSDGRFIGAILDRNGLRPARYCVTADEHIYLASEVGVNDLPVEGVVKRVRPRWGKSLTLLT

SEQ ID NO: 154677 - protein, 51 aa, Heterodera glycines
  Coding regions on vcDNA: vcDNA=SeqID_81100; Strand=-; Position=1-154
MDFDGGDGQRTETEEEKRKTLEAAKPRENGKGGKEKKEGKERERERRKRRE

SEQ ID NO: 154678 - protein, 96 aa, Heterodera glycines
  Coding regions on vcDNA: vcDNA=SeqID_81101; Strand=-; Position=1 -167,212-372
  Homolog annotation: Hit_ID=XP_308965.1; Match level="QueryCoverage =70%, HitCoverage=15%, E-value=5e-20, Identity=67%"; Hit description =ENSANGP00000020214 [Anopheles gambiae]
MRCFFPRVVRSVFPSPLSFVRSSLSTFYPIDDQLFGLDEEQRQLRQLVFRLAQKELAPFADEIDRQNEFTKLRDFWRLLGQQGRRGVTVPAEYGGS

SEQ ID NO: 154679 - protein, 99 aa, Heterodera glycines
  Coding regions on vcDNA: vcDNA=SeqID_81102; Strand=+; Position=1 -145,493-646
MPFLLLPLTPFELPWHYFPSGAVLAESVHALAPVPPFRASVKDGYAVIGRGRADGGHNEGASGRTGHSVRKGSTDRANRSATERGEATWRRANFCSDTA

SEQ ID NO: 154680 - protein, 469 aa, Heterodera glycines
  misc_feature (36)..(36): Xaa can be any naturally occurring amino acid
  misc_feature (171)..(171): Xaa can be any naturally occurring amino acid
  misc_feature (414)..(414): Xaa can be any naturally occurring amino acid
  Coding regions on vcDNA: vcDNA=SeqID_81103; Strand=+; Position=1 -293,338-386,434-474,575-767,817-1010,1070-1157,1244-1451,1525-1731
  Homolog annotation: Hit_ID=XP_330396.1; Match level="QueryCoverage =91%, HitCoverage=53%, E-value=2e-60, Identity=38%"; Hit description =hypothetical protein [Neurospora crassa] gb|EAA35212.1| hypothetical protein [Neurospora crassa]
PPTQKPSPPLKMPFPTQNAFPPTQNAFPSPPSDPIXIALALLGAVLAESVHALAPVPPFRASVKDGYAVIGRFSSSTIKPMSIKPMMGWEHGELNEIGTGECVRITTGAMNEIGTGECVRITTGAMVPRGADAIVQVEDTVPRGADAIVQVEDTLTVDIMKEPREGQDIRXEREGSGESKCHRERGSDVAEGQLLLGHGTVLNAAEIGAIALSGRKKVLIYERKVRVSVISTVLIYERKVRVSVISTGDELVDFYSSADARHGAVTDTNRPVLLSLLRSNGFCPVDFGIVHDNLFALIDSVRKLFALIDSVRKALTHTNILVVTGGVSMGEKDLLKEVLSDHLGLSIHFGRVFVKPGLPATFASGHLSASPSSNPPKFVFALPGNPISAFVAAHLFALPQLHELTTNKPIPITXIPQLAHPIGPLDSRPEYRRARLVRLSSADGLPFAECVGGNRSYRLASALSANILW

SEQ ID NO: 154681 - protein, 230 aa, Heterodera glycines
  Coding regions on vcDNA: vcDNA=SeqID_81104; Strand=-; Position=1 -12,376-553,609-689,766-882,1240-1426,1480-1595
  Homolog annotation: Hit_ID=S16366; Match level="QueryCoverage=100%, HitCoverage=84%, E-value=3e-82, Identity=47%"; Hit description =collagen alpha 2(IV) chain precursor - pig roundworm sp|P27393|CA24 _ASCSU Collagen alpha 2(IV) chain precurso
FPGYGEPGATGLPGVPGQDGLPGVPGESGEPGYGFPGQPGVPGEKGDAGLHGMPGLKGEKGSPGPLPLVAPPGRPGQDGLPGLPGAKGEPGNDGLSGMPGLKGQKGEHGFPGQNGLEGPPGMEGQQGFPGNPGPPGMPGSKGEAGWPGAPGLTGPKGEAGIAFNGPPGSPGFPGIKGEAGFPGTPGLPGLDGQPGQPGSPGEKGVGGLPGLPGAPGFLGVKGEPGFGGIP

SEQ ID NO: 154682 - protein, 271 aa, Heterodera glycines
  misc_feature (270)..(270): Xaa can be any naturally occurring amino acid
  Coding regions on vcDNA: vcDNA=SeqID_81105; Strand=-; Position=1 -42,98-202,271-338,398-542,1083-1215,1265-1421,1498-1528
  Homolog annotation: Hit_ID=S16366; Match level="QueryCoverage=98%, HitCoverage=84%, E-value=2e-94, Identity=44%"; Hit description =collagen alpha 2(IV) chain precursor - pig roundworm sp|P27393|CA24 _ASCSU Collagen alpha 2(IV) chain precursor
PGPGGSKGEPGPRGIPGISIPGIPGISIPGLQGRDGQPGIDGIPGRKGESGLAGLRGPPGDSLNGLPPPGDSLNGLPGPPGISGPQGPKGYDGRDGAGYDGRDGAPGLPGIPGTKGDRGGGCSICAPGAKGEKGNAGFPGFPGPQGDRGHPGMAGPAGDPGDDGLPGPIGPPGPPGAPGFDGIPGLPGTKGEPTQLVLRPGPPGYPGPKGEPTQLVLRPGPPGYPGPKGEAGFPGLPGLQGPPGKEGLPGLPGTPGQLGKHGMNGLAVSXN

SEQ ID NO: 154683 - protein, 131 aa, Heterodera glycines
  Coding regions on vcDNA: vcDNA=SeqID_81106; Strand=-; Position=1 -325,513-580
EAITVVTVSSNQALSVPKLIKLTATKTPAARKQLSMAPPLPPLAHHHHRLYSFFAFFITIISWICVFNGCECVVNGDGQYEEVEIETTFDGIDGLIDLPNLDTFNSKNGQPFDGGNELVYHDEQMELEPSF

SEQ ID NO: 154684 - protein, 254 aa, Heterodera glycines
  misc_feature (236)..(236): Xaa can be any naturally occurring amino acid
  misc_feature (243)..(243): Xaa can be any naturally occurring amino acid
  Coding regions on vcDNA: vcDNA=SeqID_81107; Strand=+; Position=1 -90,154-243,372-436,478-600,680-732,842-922,975-1012,1197-1278
  Homolog annotation: Hit_ID=CAE65650.1; Match level="QueryCoverage =92%, HitCoverage=37%, E-value=7e-39, Identity=42%"; Hit description =Hypothetical protein CBG10711 [Caenorhabditis briggsae]
NRKLNLYLFEEGHSRSKWCIFFHVTSTSFVVLSITALIFVVLSITALILASMPEFQVPDLSNQNAQGYPGTIYPTYAKATGHTISTTTVIKNNRSKIANIFWLIEVIKDGEETTVIKNNRSKIANIFWLIEVIKDGEEHRVEMVEHPVFNYVENICVIYFTLEYLLRFWVAPQKAAQFVKEFLNVIDLLAICPFVFELILIFVGIRGDNVRKVRYVGIRGDNVRKVRYSQLTALLXKALKTFXIIFLGQFAELI

SEQ ID NO: 154685 - protein, 169 aa, Heterodera glycines
  misc_feature (2)..(2): Xaa can be any naturally occurring amino acid
  Coding regions on vcDNA: vcDNA=SeqID_81108; Strand=+; Position=1 -96,156-230,333-436,627-738,850-924
  Homolog annotation: Hit_ID=NP_499978.2; Match level="QueryCoverage =94%, HitCoverage=27%, E-value=6e-54, Identity=67%"; Hit description =voltage-gated channel family member (59.4 kD) (4B505) [Caenorhabditis elegans] gb|AAK72074.2| Hypothetica
KXNNFRWAFLTVRLLRVLRVVRIAKLGRFSPGLANFALTLRKSKKQMQLANFALTLRKSKKQMQMVAIVLLTVIVFFSTLVYFLEKDEPNTTFTSIPAAFWWSVVAAAKKGLFLLIETILAGKIVGGGAITCGVLVLALPIAILVNNFMQVVRLREEKVLKQYASIATA

SEQ ID NO: 154686 - protein, 713 aa, Heterodera glycines
  Coding regions on vcDNA: vcDNA=SeqID_81109; Strand=+; Position=1 -2124,2393-2410
MAGRNQGLNVGQNQGGRPPEDGRYNLRARQNRRNWAEFEAEYDAEIDRELRILERNRSENLAEQAPNQQNSRNLRLNQNRTYVLAARPPEDGNQGREVALWNRFQFEGVQNENANLGRPVAQSSSISGNAGVQNRIVMDESPHISYEHNPRNRAGQAHEMRERQNILYEELLETLERQVLRNENEFLGGREVPVEQRNEQRNGRHVENLHWYHRAQENEHDGRHFERNNQIYKPRYEMNWRQEQYTNSEQGRNRRAYDRFQSHEENFPRPNQFERNLLMNPMVPVETNPRAMDNLAFQMYRMTLATQYASVLREIPTIEGTEGRDKIQDFFLTVETLLSDWEPDKQINVLKTRLRGKALKALNMALIKFGPVPPFNILKTEIMSTLRETDCREASAFTELTQFAKRTMNEDLMSFGEKIYRLVKCSYSGLNATQIDEIAKKFFIMNINDGELARFLECQNKPEQTFDEILMLANRIHLADPEKVKERIESRMRNEQQTRPFQSRSNWNSRTEWNPDRNRPPNTGNFWGNRRNEFRRDNQNQNWRIHQTNQFSGSNATPLNSVQPNRQTAERANPRSTNSIFLRQEEKQVKEATEVNIGRLGVSEHEKFFDSLILHTKAFPAENPAIPQISECLTLHLSVIGVTSKALTDSGAETAIVNPIFLHTLAKEKGVNLLDCGFNPNSGNSKLPFEVSSFTDTKINVIGVINVPKKKIF

SEQ ID NO: 154687 - protein, 857 aa, Heterodera glycines
  Coding regions on vcDNA: vcDNA=SeqID_81110; Strand=+; Position=1 -136,1103-1546,1975-3006,3295-4253
  Homolog annotation: Hit_ID=NP_498959.1; Match level="QueryCoverage =54%, HitCoverage=27%, E-value=8e-42, Identity=35%"; Hit description =zn-finger, CCHC type and RNA-directed DNA polymerase  and Integrase, catalytic domain containing protein
MSGEEEQLALEKLGVVESGDKENAGRTDKSDKIVVETGVVEAGEKGHILTSEGLKKDPEKFMPILDFPRPITLKELQRFLGMLNWHRKFIKDFAKIAGPLTRLMKKSEDHKKLGWNEPAENAFQTVKKLIVEDVVLKYPNFEMAEKNLDFRFHIYTDASATGLGAVHCQKDNSEKMRPICYASRRCSDAEKKYEDTKLKEKLIKSLANFMLMDGVLYRLNGKGEPEIFVPEQFRKQLFKEHHIGICASHQSGKKVYGRLKSLGFFWPNLLGDCMHWTRSCRVCAHNRIPTRNHPGLNPIVTIRPNELLCMDILKLGPTRNGNKYTLTMIDHFTRFAEAIPIPDKKAETVAQNLIEKWILKFGAPERIHTDLGTEFVNETLKEISEKMLIARSTTSGYDPACNGMCERLNRSIVEMMRKCITSPWEWDTRIGFIVFSYNITPNESTGFPPFTLFFGRTANFPTNLTVPKRPNPVYLVDHDDYLQHFRENFENILNEAKQNMVKARESQKTQFNEKSHVRLNKYALGEKVMVFFRPRAQEPTPNSAISWSTECNGEGHANCCRITLGKIFKDLPSNDPLRRLPISKLSELICLHFASDVLHGQLREWASKKDRDPTALIRFVSEPQRKIRGIEETMEKWLNNCSKAFPELKASKFKPIIFEIPPGPLEKFGTEIAKAFENIRAVKIHGLHRTIRTPHIIAGDRTAEEIGKRCEAEIILAENCIGLSDLLGKTAFGREVKEVIVCVGTSDLDIDTPLEWCEKAVKKLLTHLGQFAIKIWVVPPPFYRQKAVKHEEFLKMLVETVPKEDLCLMKGFRSIIEVTMWGNQEEKRYVDERGRLKFSGVTATLKHLKEVFGLEVP

SEQ ID NO: 154688 - protein, 216 aa, Heterodera glycines
  Coding regions on vcDNA: vcDNA=SeqID_81111; Strand=+; Position=1 -94,254-808
MQFLRQHKISPEENWKDNRNFLVSLQNGGCETLECKVSGKAERAFSAAAVNRPAKFDAIRSEMESLLDEWDCTAIQAFNELWDGPKRRPGENLEEFAERVYQLVLCAYPGLPLDLYNDYAAKHFIRALENAKVSIALEMARRPGLSYDSLVALAVRAEIAQKAANLIAEDENAHIARSFKPNKAEKTTTDWEKFYVRPTNKNVCYNCRKIGHIARN

SEQ ID NO: 154689 - protein, 75 aa, Heterodera glycines; identical to SEQ ID NO: 151730
  Coding regions on vcDNA: vcDNA=SeqID_81112; Strand=-; Position=1-372

SEQ ID NO: 154690 - protein, 82 aa, Heterodera glycines
  Coding regions on vcDNA: vcDNA=SeqID_81113; Strand=-; Position=1-248
MADVEQSYMTEADRRALERFRRAERRLFSTEIELDKVLFTFQQYDMLRRRWAMEQARQMPHGRRKRNKRRRQLWRRQRHSHQ

SEQ ID NO: 154691 - protein, 155 aa, Heterodera glycines
  Coding regions on vcDNA: vcDNA=SeqID_81114; Strand=+; Position=1 -144,1042-1112,1949-2051,2149-2240,2677-2736
CTDHFEPILARIGQLEKCRQKQNAHFDQLNTSQKDQCEKWAKMENEIATADQFSKIVEKVCDLEKEQKQRMQKAFQKEFKKMVMERIVTVQTKVEAMEKEHQQQNATSDQFSQMQNDQKILLEKISELEKEQKQRKFVQLWIRNQTTDKIGWTNL

SEQ ID NO: 154692 - protein, 22 aa, Heterodera glycines
  Coding regions on vcDNA: vcDNA=SeqID_81115; Strand=+; Position=1-70
SKPSFIQIKMCQSMLTNAKMKI

SEQ ID NO: 154693 - protein, 201 aa, Heterodera glycines
  Coding regions on vcDNA: vcDNA=SeqID_81116; Strand=+; Position=1 -270,728-1063
MDKTPKKQKTECQKGKKDNDHQRDGSEFGGAAEKHNTEENSGRTKGAEEGTKCQNSTDGKHCQAAQDPTLLRDGRTLQPPLGPNGRGQLRLISTNESDLVELLDLIMDLAGASRVLDKIEAQIAPRQSIVEKELYPNVLKLEKMERKWQMVSKTFSEEQKRHLREFGYTLMRDSQFRSLYGRTKKGETKRENLLGRKSEQI

SEQ ID NO: 154694 - protein, 214 aa, Heterodera glycines
  Coding regions on vcDNA: vcDNA=SeqID_81117; Strand=-; Position=1 -33,133-258,547-747,973-1099,1246-1403
MPLIRRKINAAMAYTMKLNESCAILGKKFDCSFAWLLERYKLSDKYAIKANNQVKFPGHPKCVFLTAASANYFPSLRMLIANIKEHFGCNQKIIAYDLGNVTKNSEWVKEILINFIFFYKDVLLEYDTVIWVDTSIFFGSDNLATILKPLQNGKIGPVQLMSRMYQYLPMAANFLPNKTYGLLGNDPQQFEAGFVILQKMEQTRQLMKWHNLNY

SEQ ID NO: 154695 - protein, 42 aa, Heterodera glycines
  Coding regions on vcDNA: vcDNA=SeqID_81118; Strand=+; Position=1 -23,177-282
MTFRVDKNPALQVLPSVGLAAHGADKYAMCGQTQTVDRYNVS

SEQ ID NO: 154696 - protein, 358 aa, Heterodera glycines
  Coding regions on vcDNA: vcDNA=SeqID_81119; Strand=-; Position=1 -17,242-337,392-673,735-1152,1220-1483
  Homolog annotation: Hit_ID=AAL78214.1; Match level="QueryCoverage =41%, HitCoverage=78%, E-value=8e-12, Identity=32%"; Hit description =putative esophageal gland cell protein Hgg-20 [Heterodera glycines]
MSSEILWRAVLLLLVDCASILWFFLDHVKKRRRPRKEIFISADCWLLVFDFLAPSQLGLGIALISRRFDLRVDEHFKTRKWKLNKQLLIHSKIVGNGTKQMQIVNSDGNPLPIPRNPLPKKVIGFTGCIQIIYIDQNVVAFLHRFRRLLGICGIYLDISTGNDRILDYFLLQIWPMFRDSMHLMLLDTITFRRFRQLAPSMLSNCLSLRYVVFNDEIVLAFPPDDSAMASDGQAVAKWLYTPLPNGVPKWLKCYVKSSVDQWSSTMEQLKKAFSNASSPVTFRIRLKSSTVIDSVVPFDRINEVTGEQLTLEQYANGFWLSRCPIEWDERNWHNVQHELLNPPNPIHFLIRDGGFDDG

SEQ ID NO: 154697 - protein, 95 aa, Heterodera glycines
  Coding regions on vcDNA: vcDNA=SeqID_81120; Strand=-; Position=1 -176,307-418
  Homolog annotation: Hit_ID=YP_111110.1; Match level="QueryCoverage =90%, HitCoverage=22%, E-value=5e-26, Identity=63%"; Hit description =putative capsule biosynthesis protein [Burkholderia pseudomallei K96243] emb|CAH38565.1| putative capsule
MAFVELGVRLFLCGDVMAGRGVDQILPHPSESHLYEGFVNDANDYVRLAERHSGPMPQKRDFDYPWGDALPILDEWKPLVRIINLETSVTTSEDK

SEQ ID NO: 154698 - protein, 41 aa, Heterodera glycines
  Coding regions on vcDNA: vcDNA=SeqID_81121; Strand=-; Position=1-123
MRMSFFKQFYETNTGLLSVRQNMNVCCPIESAFGNDNCLNQ

SEQ ID NO: 154699 - protein, 107 aa, Heterodera glycines
  Coding regions on vcDNA: vcDNA=SeqID_81122; Strand=+; Position=1 -47,207-483
  Homolog annotation: Hit_ID=EAA19671.1; Match level="QueryCoverage =62%, HitCoverage=27%, E-value=3e-11, Identity=45%"; Hit description =Ran-binding protein [Plasmodium yoelii yoelii]
MNAREIGKQQKMYKESLSKFAFEPICPIICDGTDGKEKEKKETKETEKEEKEEKREKKNEQSEEKQKNSTERQNEGQKEETDREKKAEKEKAKKGKEKKKPQRGGSN

SEQ ID NO: 154700 - protein, 67 aa, Heterodera glycines
  Coding regions on vcDNA: vcDNA=SeqID_81123; Strand=+; Position=1 -50,1059-1212
MTWPNFLLPVFLSSVLISYRKEIVQIFLLIGLGLRLRGVWVLLTQIVIPIEIWSRIINIKHRMATHT

SEQ ID NO: 154701 - protein, 1380 aa, Heterodera glycines
  Coding regions on vcDNA: vcDNA=SeqID_81124; Strand=+; Position=1-4143
  Homolog annotation: Hit_ID=NP_001004509.1; Match level="QueryCoverage= 73%, HitCoverage=66%, E-value=1e-95, Identity=27%"; Hit description =si:busm1-180o5.3 [Danio rerio] emb|CAD60788.1| novel protein similar to DNA polymerases [Danio rerio]
MESHSTKHSSNSPIDHILPKKPRQGIVQQGEGGTESSKRDAEAYVKKLYSSIEHVVKYHYAKVKSQFSIEDVPADPEGLLVGIFQYCIDNGIKDSRERGIEPTHVGCVISSSLLDGGDIPIPLRKINDNTINSILNLFLKVAQSKQQQKVTLWGEPFMVTITTVDRYGLPSKRHVKGGQRRKLATVRHQINDQCLIKISNPDDLNYCLFYALQATMVAKTRGWPRMKFHRYLNNKHGQKGQLQCDTVQLMQQIEAPMNLEGYDAETFVPRVVNHWNQAQQQHRFAVFIFGSSGQYKPLYKYIDNSYDTPLLLYYSNNHFDGVQKQGGLFGKPYCLECERPYDKASEHSKSCKARCVLCSRMGPEFPCSSTPGFYKECSGCYKRFRNNDCYHYHLHSNFCMRSKKCKNCGVIWDVLDNNKKGRKGHQCGENFCRLCNNYHNTERGCFIQPFEPKQQNVPYRIVAFDLETMQHQAMDPRQPEKKQHQPNFIAARVACPDCIDNGKRNKATAVCQICGPYRTVAFCQRRFMDTQVNKQVVTENPLKAFVDWLVFQLPKKYDTYAYSHFGGRFDMVLVFRELFRIGFNPNMLRKGNKLYEMKVHQKKNSNPNIIFRDSYNLMPCSLGELIPSYGLDVDDKPFFPHLANRPENYGREIFPTPNDYLASGMMPEKRKKFDEWYAEHRHEPFLLDEALASYCTNDVEILMAALVAFRREFFEVSRRNEGIVAKRAASDEHHNGIDVLRECMTIAGACMRHFRMNHLPSGHLAIVPERGYDNAQNQSELSRRFLHWYMEQHKVQVRMANSPGGEKRIGQYFVDGWVEAERRAIEVNGCVWHACTACYPDDEMLMPNGKTAGAVRERNVKRMEFIRNQVDKLDVYWECEIERMLAKDKQMKMRFEEYPDDGPLRIRDAFMGGRTGPLKLLHNVGADEKISYFDFTSLYPYINCTTRYPVGHPKVHVLNFEVEWRSAADNPYPLALLKVWVVPPRQIDVPVLPVKVDDRLCFPLCIACAKEYPTGGVDNDYHCQHTDQQRGWVSTCTSIELNVALDEGYRVTRVFRVLEYEQSDDKLFRPYIAEFMAQKIQASGFDSSIRGNAEKEQQFVRECAEQFDITIDPTKMAANKGKRSIAKLCLNNLWGRFSLRNYGLSQTLITDDPAVLGDFLDNRSIDVMTIDELEEEHILITYEKKKEWVTEHGCSNIVISLWTTSAARLLLLKAMQKVVRSWGCQLLYTDTDSLVLSHPLDFCPLKTGQHLGEFTDEYPDHEIREFCSGGAKQYGLVLRRKNTSSDAELEYVLKVRGMTLNYDVINNQGLRYETFKQQVMRYARTGEIEQIRIEYPNFLQPNIRSGGSVTSTQMQKCYRPYVGKGIIGNDFNVKNFGHTL

SEQ ID NO: 154702 - protein, 180 aa, Heterodera glycines
  Coding regions on vcDNA: vcDNA=SeqID_81125; Strand=+; Position=1 -375,502-669
MILWHFLIFIFFIAFEIESGIIRPNFDEIFGNEWDKNQNEGKVIRIEQNERNENLQSAAVDQIGEEMGTDPIDQMSEYSNQNVMKKSDQNTKMKPNDQQKRETIQRYEAIKEKLKQKGKLQNKDRKKKEFNERFDEFKSLYGQGKQKAFVKELGIDKKTFINWKKELLPNYHKTKRFFKK

SEQ ID NO: 154703 - protein, 53 aa, Heterodera glycines
  Coding regions on vcDNA: vcDNA=SeqID_81126; Strand=+; Position=1 -41,88-208
MRKGEAMTMSCVSGVSSPASVVTWQLNGSPTKIQPQEQKKQLQVSDIYKYLWI

SEQ ID NO: 154704 - protein, 47 aa, Heterodera glycines
  Coding regions on vcDNA: vcDNA=SeqID_81127; Strand=-; Position=1 -42,94-195
MENTWGFPNFISFAHLMDPDKGFYNKEEDKIALAIDLTVTEEKTENP

SEQ ID NO: 154705 - protein, 96 aa, Heterodera glycines
  Coding regions on vcDNA: vcDNA=SeqID_81128; Strand=+; Position=1 -37,423-676
MATVWSKFASQLTIFGTIRTQWAKCPFRGGVGAVPKQPKGIGRRPPKSINTGKDEDEAISIFWQRKRNDGSAGGRGRKRIFKRKFVEKVCLVQIML

SEQ ID NO: 154706 - protein, 773 aa, Heterodera glycines
  Coding regions on vcDNA: vcDNA=SeqID_81129; Strand=-; Position=1-2321
  Homolog annotation: Hit_ID=XP_318550.1; Match level="QueryCoverage =97%, HitCoverage=75%, E-value=1e-170, Identity=41%"; Hit description= ENSANGP00000020240 [Anopheles gambiae]
MALKSINSASLIKIKVLLNGRIVKFILDSGAEINVIDEETYRLIGQPKIWECAERGRMFDGTEKSFIGKGEGHFEFQGVKVKENFYVAEKGSMNLLSVQTMDAFGLLDGIKAKINSPINLCSAGKESRGKNAPIKSNKADGTPNKDAEKQISQLKQEYTNVFKNELGLCTKVKAHLELKPDAQPIYRKARPVPYNAKNAVDGELDRWEKMGVIGKVEHTEWAAPILVVKKADGNARLCIDYSTGLNNALKDHQHPLPLPEDIFATLNGGQYFSQIDLRDAYLQVELDEASKKLCAIATHRGNYEVKRLPFGIKTAPGIFQSIMDQMLADFDFATAYLDDIIIVSKDQKKHSEHLKKMFSRFQEWGFRVKREKCSFFQDEIKYLGQIIDKNGRRPDPSKITAINEMPEPTDVSSLRSYLGMVNHYQQFIKNMRFVRKPLDDLLKKDTEWNWSDKCKKAFDKIKEILSSKLLLTHYDPQKEIVVAADASDQGIGAVISHKFPDGTMKAIAHVSSALTPAEKNYSQIEKEALAIIFAVQKFHKMIYGRKFTLLTDHKPLLAIFGNKKGVRQCSANRLLRWSLILLAYDFNIEYVNTNDFGQADALSRLIAKGKDAEDRVIANTSVDSEVESIFIGTVEKLPIKFDDIVQSSKSDQNIKKVMKFIRNGWPQNIGNENVEIRIFHQRKEQLSITKDCLMYAERVVIPTQHRAKILQLLHKGHPGMKRMKQLAREYAYWPKMDQEIEQFVENCQPCQNEAKAPTKTNLQSWPRQMDRGR

SEQ ID NO: 154707 - protein, 134 aa, Heterodera glycines
  Coding regions on vcDNA: vcDNA=SeqID_81130; Strand=-; Position=1 -131,456-575,739-888
  Homolog annotation: Hit_ID=CAE65266.1; Match level="QueryCoverage =96%, HitCoverage=32%, E-value=7e-35, Identity=49%"; Hit description =Hypothetical protein CBG10160 [Caenorhabditis briggsae]
SVFNIVVCIVSYAIPFAGFLYWYSSVPFFLWRKKEHLMASQQSSQVTLLKVVLTVLVLALVYLVCWTPYWVGIFGRRLLNLRLSSGVITMYFVHLMPYVSCAAYPAIFTLLNRPIRSAHSHWKRSMHRRIQQSS

SEQ ID NO: 154708 - protein, 188 aa, Heterodera glycines
  Coding regions on vcDNA: vcDNA=SeqID_81131; Strand=-; Position=1 -247,312-425,548-624,726-807
  Homolog annotation: Hit_ID=CAE65266.1; Match level="QueryCoverage =93%, HitCoverage=41%, E-value=6e-49, Identity=55%"; Hit description =Hypothetical protein CBG10160 [Caenorhabditis briggsae]
SSSAGPSLSVANFTLVEMALPLRGFRQYVALTYLGCNLIGLFANSWVLFVVGPLLWLHNVRVPKSILFHILALCVSDLATMCAMVLLNLEIFCGTWRMVLLNLEIFCGTWRLGSMACTAYLLFDSMNKFSAPIIVLLISRTCYSTVCLDKRRQQSAASLKMAFLHVSVSLCLVLVLLWPLFAYSEVTT

SEQ ID NO: 154709 - protein, 97 aa, Heterodera glycines
  Coding regions on vcDNA: vcDNA=SeqID_81132; Strand=+; Position=1-292
MGRKKLTTHCGQIGHAKCQNVEKNGFWDADIVQPQEGADHEKDPRIGEQADEVAAEVSQSDVLTKAPQGKCHFDEGKIGNGKRRAGGGGVQAELHHW

SEQ ID NO: 154710 - protein, 62 aa, Heterodera glycines
  Coding regions on vcDNA: vcDNA=SeqID_81133; Strand=+; Position=1 -52,474-559,615-662
MESASVASSEVFEQNGNGSHSMFTKRCILSTSSSISYVEEMHQYENCSTIGLAIKEMPLYGR

SEQ ID NO: 154711 - protein, 54 aa, Heterodera glycines
  Coding regions on vcDNA: vcDNA=SeqID_81134; Strand=-; Position=1 -137,601-628
MPCPGVGEMVATFGCVAGQLSQQGWPTSAAAGATRIRIDKIMQKCSGLCSWFCF

SEQ ID NO: 154712 - protein, 68 aa, Heterodera glycines
  Coding regions on vcDNA: vcDNA=SeqID_81135; Strand=+; Position=1 -160,221-267
MALAKKNRVVKAAEEVDLNVSIASSFFERGFEPSRLVTSTPRPSQQREETPQEARSIEDVTEADFDSP

SEQ ID NO: 154713 - protein, 161 aa, Heterodera glycines
  Coding regions on vcDNA: vcDNA=SeqID_81136; Strand=+; Position=1 -174,220-354,433-526
  Homolog annotation: Hit_ID=AAM81354.1; Match level="QueryCoverage =100%, HitCoverage=26%, E-value=2e-39, Identity=57%"; Hit description= aldehyde dehydrogenase [Steinernema feltiae]
SSAYLINQPKYAFLAELGIQQQNDGVFDGTWNASGKEVDSLCPATNTPIAKVRFGTAEDYERVIEASRAASAIWMEMDYERVIEASRAASAIWMEMPAPTRGEIVRQIGDSLRKNIDNLGKLVSLEMGKIVSLEMGKILSEGRGEVQEFVDIADYATGLSR

SEQ ID NO: 154714 - protein, 75 aa, Heterodera glycines
  Coding regions on vcDNA: vcDNA=SeqID_81137; Strand=+; Position=1 -51,336-512
MVLRPFSSHFSFPSDQSMFFLIRATKFSIQHRNLVLLFMITMAQQQKAHFTTFMESVVLGIIYANDSVKTAETQR

SEQ ID NO: 154715 - protein, 127 aa, Heterodera glycines
  Coding regions on vcDNA: vcDNA=SeqID_81138; Strand=+; Position=1-384
MGLKSPAFQTLGFNPPTFNDIPIAGTQPTSISISETQSPAFQTLGLNPPTFNDIPISGTQSPAFQTMGLKSPAFQTLGFNPPTFNDIPIAGTQPTSISISRTQSPAFQTLGLNPPTFQSMGLNPTAF

SEQ ID NO: 154716 - protein, 165 aa, Heterodera glycines
  misc_feature (58)..(58): Xaa can be any naturally occurring amino acid
  Coding regions on vcDNA: vcDNA=SeqID_81139; Strand=-; Position=1 -152,248-393,443-949
  Homolog annotation: Hit_ID=AAT02161.1; Match level="QueryCoverage =99%, HitCoverage=77%, E-value=9e-30, Identity=42%"; Hit description =hypothetical protein L3ni22 [Dictyocaulus viviparus]
AIHCHNRPDRHFVQLPPSRLRGFTVLALTRNNIDVLPSEEVLLEKLPDLKAVDVEGNXTFDCSTLDHYRTLMVMSDCGKTPEQLEADRAKLPTDTQPNEDCDFECVANRRSRELREYVKHLWEMVKEKVGRLAKKHGLDKVVDDVGNFFNDVGERISNIKLKKKK

SEQ ID NO: 154717 - protein, 305 aa, Heterodera glycines
  Coding regions on vcDNA: vcDNA=SeqID_81140; Strand=+; Position=1 -173,281-402,452-625,712-1091
  Homolog annotation: Hit_ID=CAE69178.1; Match level="QueryCoverage =99%, HitCoverage=61%, E-value=6e-68, Identity=40%"; Hit description =Hypothetical protein CBG15211 [Caenorhabditis briggsae]
SCCGYRTHEKCIDKVRRVCPSLALARTEFSLQFDLCPEKSLLEQNYQCAECFSPIGFDDDSEKLPRICDFTGLFCCRRCHWNDEMIVPARIVKNWDFEKRAVCRATKQMLTTAMKRPLINFEKRAVCRATKQMLTTAMKRPLINFEKENPTLFKFVHKLDKIQKMRTNIMLMKCYFVYARFARKMRILQHLSRFQHFVENDTMFTMDDLLQLANGRLLADIEAIVRIFTAHITEECEICRGNAFFFSIYPFSENAAICKSCCLSVYHRSCFDRASKRCPRCLRRKARKSGMEENEGDEEEEEDGQ

SEQ ID NO: 154718 - protein, 119 aa, Heterodera glycines
  Coding regions on vcDNA: vcDNA=SeqID_81141; Strand=-; Position=1 -111,268-353,495-555,714-812
MDRRAYKRKDGLRCSSPSPASSLFSADYLEKIFDFPKVQAAAERRPTCPISRLPVLRRPQQPPLNSAEHVKPAAVNGQPPALNGIENLLQCLENVAFELTEHVCQLQLPDVPSSSSVEK

SEQ ID NO: 154719 - protein, 55 aa, Heterodera glycines
  Coding regions on vcDNA: vcDNA=SeqID_81142; Strand=-; Position=1 -87,178-258
MSKVCAREKCVGIERFLNEQTAEREQQQQIFRMDFSKCTLGSDKIKDLYSDKKIR

SEQ ID NO: 154720 - protein, 266 aa, Heterodera glycines
  Coding regions on vcDNA: vcDNA=SeqID_81143; Strand=+; Position=1 -94,143-244,336-517,574-829,1272-1374
  Homolog annotation: Hit_ID=C88482; Match level="QueryCoverage=85%, HitCoverage=31%, E-value=1e-48, Identity=48%"; Hit description =protein C05D11.7 [imported] - Caenorhabditis elegans
ARASSLQALSPNFNIIGLLRTGLEQSVPPNAHILCTGRLFISILCTGRLFISTTRARDYKNVIISEFDSREELIQAIICSCAIICSCFIPFYCGLSAPCYRGEQYIDGGFSDNQPAGQIRPGTITVSPFSGESDICPSDDDISMFGFDSMFGFDFYGTPIQFTTQNLFRMVVTLFPPSPEICSRICRQQGFEDTLRFLTKNCNIFQNVSSSNDFAKMAPCVKCLTVQSNVIPEERNCTWMNYLRRQRIFRWWYRLLIPVILPCEMV

SEQ ID NO: 154721 - protein, 67 aa, Heterodera glycines
  Coding regions on vcDNA: vcDNA=SeqID_81144; Strand=+; Position=1-204
VLLHCFFPIQMERAKRYIVDQENRTEKDARRTLLKLAEMFESPIPTTSNVARLRKQFDDDDNDADDN

SEQ ID NO: 154722 - protein, 617 aa, Heterodera glycines
  misc_feature (438)..(438): Xaa can be any naturally occurring amino acid
  misc_feature (461)..(461): Xaa can be any naturally occurring amino acid
  Coding regions on vcDNA: vcDNA=SeqID_81145; Strand=+; Position=1 -81,998-1146,1196-1391,1500-1724,1895-1952,2002-2091,2144-2333,2385 -2616,3093-3255,3429-3557,3599-3697
  Homolog annotation: Hit_ID=CAG04372.1; Match level="QueryCoverage =97%, HitCoverage=92%, E-value=1e-118, Identity=41%"; Hit description= unnamed protein product [Tetraodon nigroviridis]
DESQLKTSGRRDSRGLLIGSVHSHAPSLEGVSTEDTLQRLPKEDQAEQSPTGTLATRTPKDFFFIKVLGEGSFSTVYFAKEVTTGDEYAIKVLVYFAKEVTTGDEYAIKVLLKSEIRREAKVRYVLREKDIMAALSHPFVIRLYCTFQDNDRLYFALAYAKHGELLDWLRRLGSFDEAGTLFYASEILCALEFLHRCKVIHRDLKPENILVGADWHIMLSDFGTAKIIVKPTKRSVRSSFVGTAHYISPEVLKSEDVPEVLKSEDVGPECDYWALGAIIFQMISGQPPFRAVNEYKILKKILSLDFHFPPFRAVNEYKILKKILSLDFHFPDGFPEVARHLVSRLLVYKPSERLGSSQKGGIEALMRHSFFKDVEWSSLFTRKPPELKPYLPAFKDVEWSSLFTRKPPELKPYLPASSGEPEFYGEYSAAGLWANGLXARTERSGVIPADGPRQFGRRRLXRIQRNRIQSGSLSVAPSVEQSEQRRQNRLEKQRRENKYHRFVEDNLILKSGLIDKKKGLFARRRMFLLTEGPRLYYVDPVTMHLKGEVPFSEQMRTEAKNFRTFFVHTPKRTYYLFDPERHAKPKRTYYLFDPERHAKDWCDAIDWAREKYLRRDQ

SEQ ID NO: 154723 - protein, 17 aa, Heterodera glycines
  Coding regions on vcDNA: vcDNA=SeqID_81146; Strand=+; Position=1-57
LSGVLKVANHESDMYFD

SEQ ID NO: 154724 - protein, 218 aa, Heterodera glycines
  Coding regions on vcDNA: vcDNA=SeqID_81147; Strand=+; Position=1 -112,268-812
MLHNTLSCKAKISVDTIISIEKFLNRDITTRNSAQKKDDQRKNLNESLLYSPEDLNEYSFETEDEDEREGEGSASVELLNWVDKYEPINIVTIIQIKGNFADEFEGTNFEMVRKRWLRKSLISMSMNMDILVICTAQKFVILECSKRPTDGLNSMEMAARVEIERVDDRSFILSLAVFGVQPPQSNSSSQSLTTDWTCICIVYNHSAKYYQNVRHLLL

SEQ ID NO: 154725 - protein, 296 aa, Heterodera glycines
  Coding regions on vcDNA: vcDNA=SeqID_81148; Strand=+; Position=1 -267,536-662,1048-1218,1261-1338,1382-1628
  Homolog annotation: Hit_ID=NP_723718.1; Match level="QueryCoverage =80%, HitCoverage=18%, E-value=4e-27, Identity=33%"; Hit description =CG7061-PB, isoform B [Drosophila melanogaster] gb|AAF53157.2| CG7061- PB, isoform B [Drosophila melanogast
SPTIFPSFGFRSFTGIGTSRKDRYVKKSAADVRTNWVPIKSILRDGKRSADRTFIAPTPGWPFVAVSDNYGRIVLINTRTRRIIRIWKGYRQARCAWIETVSTSRTTPMKKALFLAIFAPKRGLLEIWSMLNGPRVLAFQVEEGSRLLSLPVVHGGILFGGSDVRETESQEAGGRAGAVFLTPDGLLYSVDVPFYLSALSTSATSIYDEHLIKDFSLEHFMIKTENADNESDVDLEKLAEFALRIKTNLARQRFLEALIVSSRGTSTKKSDAGNKKLRTLISVRSLRELVNRMVGK

SEQ ID NO: 154726 - protein, 420 aa, Heterodera glycines
  Coding regions on vcDNA: vcDNA=SeqID_81149; Strand=+; Position=1 -94,140-428,496-689,801-901,956-1206,1249-1584
CVKHLSQIQCDRTNPLLAKALSILEFVYDNSGSSAIASSLLNIAKCRLELNDFVGFFNLNLYQTFDNNAQVGTPITAKYDENNLSTKIPTNLLAKLGATLFAPFLVNSFSDFEPFLKSLTSKFRLRKDFFVTSLCAFWLYPPCNFKLDCFSAHFAEFMLGLFNLLVEDSDNSNWTTSFKETLKTIEQMVIESTNVPAALMVAVQMGDLCQKMSVTLNERKASRGSEQKTPTEDGDAFIVFDKPELELYSELCNELPSFWALLSLHLSVLHLLQWLSQQMTDESLSSQLSTSNFSVAKLLQKGVSFYREQLGLWVSNLPTFSAHGIVSLFSSNVHIEKNTDEIHFNAKTFHALRLLCKGTLPHNLRLELILCDCVWECASAWYKDESRRVTKLKVVFWRCIHCFSFRPIPSSAFYRPAPIP

SEQ ID NO: 154727 - protein, 96 aa, Heterodera glycines
  Coding regions on vcDNA: vcDNA=SeqID_81150; Strand=+; Position=1 -106,720-904
MAPQKANGTDMAKPRGYVQQQQPKQAERDEQKPSICTVMDEQLKKRYLSVKEPETPTEGQQKMVYMDLGSKSQGEIDGAFEMPPKRRKGRPPNKKA

SEQ ID NO: 154728 - protein, 29 aa, Heterodera glycines
  Coding regions on vcDNA: vcDNA=SeqID_81151; Strand=-; Position=1-87
MRKAKCETPKNANNAKGEMRKAKPRPIPA

SEQ ID NO: 154729 - protein, 24 aa, Heterodera glycines
  Coding regions on vcDNA: vcDNA=SeqID_81152; Strand=-; Position=1 -32,713-755
MTRTKYSNLTCHNLWHCFAQVDCQ

SEQ ID NO: 154730 - protein, 178 aa, Heterodera glycines
  Coding regions on vcDNA: vcDNA=SeqID_81153; Strand=-; Position=1 -115,438-548,799-877,928-961,1209-1406
  Homolog annotation: Hit_ID=NP_493464.1; Match level="QueryCoverage =99%, HitCoverage=31%, E-value=2e-49, Identity=52%"; Hit description =DNaJ domain (prokaryotic heat shock protein) (dnj-29) [Caenorhabditis elegans] emb|CAB63399.1| Hypothetic
MGRAQFEYDEVGNTFYYVIVSFFAVILFPLTHFLWPSLPKRTEVLKRGCRCEGDLVKRFRKEQIKPWEKAKCVIKGFVLLILWALFILLAYKVSQLEQTFEEYDPYKILQLDVDADVGEIKKKYRELSKQHHPDKGGDPVTFDGIVKAYKALTDEESRENWRLYGNPDGPKGDDFDVQ

SEQ ID NO: 154731 - protein, 122 aa, Heterodera glycines
  Coding regions on vcDNA: vcDNA=SeqID_81154; Strand=+; Position=1 -102,142-291,332-448
MNTIRDIKNIELVCGSRIFVVRAKIASVVSTEYNACISCRKGKCNCGMEKVKSSFLRLSLLDDTDVLGGVAFFGVKNVEKGDGMEKVKNLVGTICTLKVNVSVKEYGGKKGIYYALIDIYEI

SEQ ID NO: 154732 - protein, 38 aa, Heterodera glycines
  Coding regions on vcDNA: vcDNA=SeqID_81155; Strand=+; Position=1 -95,293-314
MALINALFKSEMANRTRRCPRLCRPRPPSPICRIASIK

SEQ ID NO: 154733 - protein, 351 aa, Heterodera glycines
  Coding regions on vcDNA: vcDNA=SeqID_81156; Strand=-; Position=1 -21,62-214,274-412,520-990,1259-1410,1468-1584
  Homolog annotation: Hit_ID=XP_392771.1; Match level="QueryCoverage =38%, HitCoverage=22%, E-value=3e-12, Identity=33%"; Hit description =similar to ENSANGP00000013336 [Apis mellifera]
ALLFELEGFAHKCLRYICQNAAKLFRSIDFLQIDQNVLCNLLESDRLLLSNEFEIWKAAIRWADKKCRQNGMKWSAENRRSVLGPALFKIRFPNIHEENFAKSVVPSGVLTMEEVIGVYQFNSHPYLCHPFRYPYGVPGLYALKFPSHGRISDWNKAKCSIKRRGTLALEIKNLSKFAQENIGSERISKTVFIKEFPWKIRAYIRTKKEAPEHSDSGESDSEDNPTEVDNWTEVDNWTEVDNWTVKYTKRLKKNAVAEGTNYEGWICQCSSTVRIVSQKSGVRDYMRGEFTEEDTFYNESNSCGYANFISFAELMDQSRGLYDKNEDKVTVAIDLTMKDEKTEENHKYPNV

SEQ ID NO: 154734 - protein, 122 aa, Heterodera glycines
  Coding regions on vcDNA: vcDNA=SeqID_81157; Strand=-; Position=1 -67,159-292,576-638,707-808
  Homolog annotation: Hit_ID=NP_496210.1; Match level="QueryCoverage =100%, HitCoverage=20%, E-value=4e-29, Identity=54%"; Hit description= TOB3 (2K539) [Caenorhabditis elegans] pir||T22612 hypothetical protein F54B3.3 - Caenorhabditis elegans
MSWIFGIKPQPSSIPAPPDDPNRNPPTPADEKQQKIGAQSAYTFDSTALERAAHAAKTLEKSTNAKQALELSRLQELTKQKEYDLQQKQLEARIAAMQSENVRVAEEERRKTLIEETKHARA

SEQ ID NO: 154735 - protein, 66 aa, Heterodera glycines
  Coding regions on vcDNA: vcDNA=SeqID_81158; Strand=-; Position=1-201
GKNLLEFNVLTKWGCTDKAPEEFQLDPEQLIINSNESKQIIRKECSYKLGKIGVLMANAAIKLPIP

SEQ ID NO: 154736 - protein, 89 aa, Heterodera glycines
  Coding regions on vcDNA: vcDNA=SeqID_81159; Strand=-; Position=1 -207,494-556
EIEFKKRQNKSFDDSAFVAEEMKKKKICAPEIECQHCGGVFGCIPDEHWWQSEGNGCCPPTQKAVCCLTKLPEAPLTISLFFILTVSVL

SEQ ID NO: 154737 - protein, 131 aa, Heterodera glycines
  Coding regions on vcDNA: vcDNA=SeqID_81160; Strand=+; Position=1 -60,1416-1488,1728-1802,2104-2291
MSEGSVPFLSRKTGFHDLATPPSEWQLQIQRRKNARTNSNANDGVPTPTVILRVDLTSQQTQERIVYDRTLITAQAYALAATNSSAVAPSAHGTSADLLAVLAPPPPPPLKAAKQEVDVLGGIRAREQNTL

SEQ ID NO: 154738 - protein, 38 aa, Heterodera glycines
  Coding regions on vcDNA: vcDNA=SeqID_81161; Strand=+; Position=1-165
SYRTTPTILNLIYSEQSYGSKSLPTTFRPTTFWGAPQF

SEQ ID NO: 154739 - protein, 17 aa, Heterodera glycines
  Coding regions on vcDNA: vcDNA=SeqID_81162; Strand=+; Position=1 -14,445-484
MTTVFQLNVFSTYCNCC

SEQ ID NO: 154740 - protein, 59 aa, Heterodera glycines
  Coding regions on vcDNA: vcDNA=SeqID_81163; Strand=+; Position=1 -49,116-177,569-637
MSDNIFAMLDDFDIENIDPTLNFSNDAWMEEVGETVTYIFFEGEVLGHMEKFNDNLNMY

SEQ ID NO: 154741 - protein, 118 aa, Heterodera glycines
  Coding regions on vcDNA: vcDNA=SeqID_81164; Strand=+; Position=1 -21,68-289,335-448
MRREESHEWLQEKVINIEKTQFEMEKQLQMLKQQQQQQQHQQQQHQPQQQQQQPQQQNAEIFEVERIVDVRKARDGKSEYKVIWTGYTESSWEPLSNLWGATEELYNLNCFIVAELLS

SEQ ID NO: 154742 - protein, 65 aa, Heterodera glycines
  Coding regions on vcDNA: vcDNA=SeqID_81165; Strand=-; Position=1 -183,623-637
MASISPNSEPLIRIRTKIENSNFSKFTFIQHNRSKSEEVHEEGYTVIWFKRFRSIIYMSIVLIIL

SEQ ID NO: 154743 - protein, 58 aa, Heterodera glycines
  Coding regions on vcDNA: vcDNA=SeqID_81166; Strand=-; Position=1 -32,404-548
MVKNDVFPCFGNSLAIPCFVLALSDDSRGFDARVSQQLPLTTGPRNCGKFDRHNAGWQ

SEQ ID NO: 154744 - protein, 37 aa, Heterodera glycines
  Coding regions on vcDNA: vcDNA=SeqID_81167; Strand=+; Position=1 -45,744-812
MSNGNDQNDQENVLQVHILTFSKKSLLERPPSDNFAL

SEQ ID NO: 154745 - protein, 26 aa, Heterodera glycines
  Coding regions on vcDNA: vcDNA=SeqID_81168; Strand=+; Position=1-78
SFKPLGFILDKFCIFCFLCIYSIINI

SEQ ID NO: 154746 - protein, 74 aa, Heterodera glycines
  Coding regions on vcDNA: vcDNA=SeqID_81169; Strand=-; Position=1-225
MPSPIAAAPIKKCSALLANSRKRHQPTKMETDRAESAENIAPIKWSDSCRSTGETSRTWRALKGKEDQRKANHC

SEQ ID NO: 154747 - protein, 79 aa, Heterodera glycines
  Coding regions on vcDNA: vcDNA=SeqID_81170; Strand=+; Position=1-239
MPFSRKYFAIASTILLELLARFPQMFFVLGIGLGWLSRLMHKCFETNNVQIGAHRSAIITQFDGLSGGHKGGRIAFCWP

SEQ ID NO: 154748 - protein, 228 aa, Heterodera glycines
  Coding regions on vcDNA: vcDNA=SeqID_81171; Strand=+; Position=1 -195,255-337,693-945,1009-1161
MAVHSYYGQLKERDLMFAILNAIKLVREGTIPPIFIEKLSAVVHDKFVAVDASLAFQQSEEWSRDGTQNTALFRGTDQHGPQQQQIPTGRKGRFPDLVRIADELDDILIDHMLCSVPRPFSPYKTSARTAPPDSVAFISGLRRSLYDPDSVKDPQTHKFNNIYVEVVLSKKLLQKKLDKFNQLREGDPVELPQNVDPLCASATFYDLNLRRLDAMEAVLLGERRVRDW

SEQ ID NO: 154749 - protein, 111 aa, Heterodera glycines
  Coding regions on vcDNA: vcDNA=SeqID_81172; Strand=+; Position=1 -61,106-176,794-994
  Homolog annotation: Hit_ID=AAB02615.1; Match level="QueryCoverage =99%, HitCoverage=11%, E-value=2e-41, Identity=68%"; Hit description =Na,K-ATPase alpha subunit
MAGFFSYFWVMADNGWMPMRLFFLRKEWDSVGVNNLEDSYGQEWTYDQRKVLEATCQTAFFIAIVVTQWADLLVVKTRRNSLVQQGMDNWPLNFALLIETAIAVFLAYTPG

SEQ ID NO: 154750 - protein, 226 aa, Heterodera glycines
  Coding regions on vcDNA: vcDNA=SeqID_81173; Strand=+; Position=1 -164,276-310,481-569,619-676,985-1098,1254-1320,1425-1520
  Homolog annotation: Hit_ID=CAE63622.1; Match level="QueryCoverage =100%, HitCoverage=35%, E-value=3e-71, Identity=60%"; Hit description= Hypothetical protein CBG08116 [Caenorhabditis briggsae]
LNASTVAMFIRGAPPEGEKGGGNDINQLNAIRDRRQLWRNARIPYALSSQYSSYSRSVIASAMQEYAKNTCIQWTPRTAVDNDYVYIVPERGCYSMVGRTGGRQILSLGNGCIQKVGRTGGRQILSLGNGCIQKGIIIHEMMHATGFFHEQSRTDRDNFITILWHNILPGMQGQFEKYSAATIQTLGSDYDFGSIMHYGPNAFTRNGLPTIPRRRATIGQRSGFSK

SEQ ID NO: 154751 - protein, 97 aa, Heterodera glycines
  Coding regions on vcDNA: vcDNA=SeqID_81174; Strand=-; Position=1-292
MKGLSVEVVSNGVLNGPQQQPLASSMASFPSLSSLHHHQFAAHQLKPSESAGTVTDFAARFIANGTTGPPLQSYLSPNTTVASGGIGKTKGLGTGGN

SEQ ID NO: 154752 - protein, 65 aa, Heterodera glycines
  Coding regions on vcDNA: vcDNA=SeqID_81175; Strand=+; Position=1 -107,664-754
MSAPLFTLFTCFLFVLCYLVPLFLVTFFYTKLLSKLFWVATAFAVYLEYAGEHNGAVPPIFVYCM

SEQ ID NO: 154753 - protein, 143 aa, Heterodera glycines
  Coding regions on vcDNA: vcDNA=SeqID_81176; Strand=+; Position=1 -255,613-789
MNVLNSLNSSTAVDLEGGGGGGSIKAAYDLTQEVLEKVSAAVVAEKEQHQQQQQQVEGVQSELNEQQQKQQQQHHQQQQHEDTSQLPNWATSSSAETEANNDHFPGDADEDEAAIVHEQTLLLHSSDSMDLLLRIDCESTTYL

SEQ ID NO: 154754 - protein, 241 aa, Heterodera glycines
  Coding regions on vcDNA: vcDNA=SeqID_81177; Strand=-; Position=1 -357,411-715,967-1030
KKTKIQSDWDVWSLKYGHFCDNISPLAVRNVDDLDNLRRLISPTILSDLDQLNSILPGDLLPDVLADNDFGGPNATSAGQTLSKWLHNPRKDGQPKSLHCLNFTTSAPTNFEWLTNFKEVFVRARTSVSYSVCLTFFVTTMPIEPFELVNEQTKEKLTLKKESDIGSSRCWLLKRCPITIVGETAETVQKQQQQQKKKDGNSANKLNNVYFHLSEGKNCIGPLSPPAEAAKEASQSSENDV

SEQ ID NO: 154755 - protein, 396 aa, Heterodera glycines
  Coding regions on vcDNA: vcDNA=SeqID_81178; Strand=+; Position=1 -1077,1473-1586
  Homolog annotation: Hit_ID=NP_702892.1; Match level="QueryCoverage =92%, HitCoverage=53%, E-value=1e-36, Identity=25%"; Hit description =Plasmodium falciparum trophozoite antigen r45-like protein [Plasmodium falciparum 3D7] emb|CAD49281.1| Pl
MEEQRSDQNSCKSAEHKSDQSKSKEQRSDQNSRKSAEHKSDQSKSKEQRSDQNSSMSAEHKSGQSKSKMEEQRSDQNSSKSAEHKSDQSKSKEQRSDQNSSMSAEHKSGQSKSKMEEQRSDQNSSKSAEHKSDQSKSKEQRSDQNSSMSAEHKSGQSKSKMEEQRSDQNSSKSAEHKSDQSKSKEQRSDQNSSMSAEHKSGQSKSKMEEQRSDQNSSKSAEHKSDQSKSKEQRSDQNSRKSAEHKSDQSKSKEQRSDQNASKSAEHKSDQSKSKMEEQRSDQNSSMSAEHRSDQSKIEEMWSDQRNNQFEDKRKDQSHEEEIYYENHDYRQSYDDEFEEEIDDYAHKSNDYNFEPFDQQKILQLYSMWMAKLALSTTNTVDKMENIHRIPCTFSGL

SEQ ID NO: 154756 - protein, 132 aa, Heterodera glycines
  Coding regions on vcDNA: vcDNA=SeqID_81179; Strand=-; Position=1 -60,108-231,274-488
  Homolog annotation: Hit_ID=NP_500039.1; Match level="QueryCoverage =75%, HitCoverage=31%, E-value=5e-15, Identity=41%"; Hit description =OSTeonectin, extracellular calcium binding protein involved in body size and growth rate control (30.2 kD
MLRFVLLFLLFVVGLALAKKADLEELESILDELDESRTAGTGAGGAEPRQERDQQQLDQLRASEPNPCDQHVCGWGKECVVDKKGRPVCECITKCPELDNDPLDQARHFWGTGRKKFYLQSLEGEKMANLCI

SEQ ID NO: 154757 - protein, 73 aa, Heterodera glycines
  Coding regions on vcDNA: vcDNA=SeqID_81180; Strand=+; Position=1 -8,915-1128
MTSRKTVRVGAVRVGAVRVGAVRVEAVRVGAVRVGAVRVEFLREFRQISNNRIENRAYIFRVLPYFFHELPVQ

SEQ ID NO: 154758 - protein, 17 aa, Heterodera glycines
  Coding regions on vcDNA: vcDNA=SeqID_81181; Strand=-; Position=1-53
GLADENFQKPHSASKKA

SEQ ID NO: 154759 - protein, 129 aa, Heterodera glycines
  Coding regions on vcDNA: vcDNA=SeqID_81182; Strand=-; Position=1 -77,232-459,520-604
MDNQSDCIAKTFKNKRTLIGSTISRSYQIHFSVPALSMQMVPFEFLNEWTKEKLTLAKANEWDIDWIMKRCKIIGEKEEKQQKDDNWDNVFIWLFGTTNSIGPLSPPPEEVEEDEAGQSITKGTSSADK

SEQ ID NO: 154760 - protein, 23 aa, Heterodera glycines
  Coding regions on vcDNA: vcDNA=SeqID_81183; Strand=-; Position=1 -3,276-344
MVSSLGLGRLNSRGHRASLEPRG

SEQ ID NO: 154761 - protein, 48 aa, Heterodera glycines
  Coding regions on vcDNA: vcDNA=SeqID_81184; Strand=-; Position=1-215
INNNYFFFSLFKFILTPAGVNVVLFFPSHWSHPLICREIIISHNTYYN

SEQ ID NO: 154762 - protein, 21 aa, Heterodera glycines
  Coding regions on vcDNA: vcDNA=SeqID_81185; Strand=-; Position=1-62
LGTHAFRRSRFGARVSALPFR

SEQ ID NO: 154763 - protein, 52 aa, Heterodera glycines
  Coding regions on vcDNA: vcDNA=SeqID_81186; Strand=+; Position=1 -79,170-249
MEDKWPQMEQMSTRSWATGHMITPKWFEGTHPVQRWLVLFNLSDCCWTPFWH

SEQ ID NO: 154764 - protein, 38 aa, Heterodera glycines; identical to SEQ ID NO: 140703
  Coding regions on vcDNA: vcDNA=SeqID_81187; Strand=+; Position=1 -59,122-179

SEQ ID NO: 154765 - protein, 136 aa, Heterodera glycines
  Coding regions on vcDNA: vcDNA=SeqID_81188; Strand=+; Position=1-411
MYANFPGTCRAASSSFSAHRLRLLLIVVIFVVLSVVADVAHAMGSMFSKNQSDVMIGRDLSDVVIGHAMWQLCMNQCGKHNANLALCEAGFGFIINRKICRCKILEEKCVPFSFGEPLPDVPVDDDDEYINCFRNS

SEQ ID NO: 154766 - protein, 244 aa, Heterodera glycines
  Coding regions on vcDNA: vcDNA=SeqID_81189; Strand=-; Position=1 -124,177-272,319-660,723-805,1713-1802
MVLTRNKTEKFKEMRSSSTEANRKRKEWRRESGRKGGSTPKTLKQTEAETTADGEGTLTQAAESGPSTSTLDLRPRSSPRPLSATPVRHHVRVRPETTDKATNMDFTTTDNATNMDLTTMDKATDVDLAYEDAATQTEQLDKQLEEQEQTISFLRLQVRNRDAMIADLRRQLEEKMAPPMETPTTSKTTPTGRPKMNVDHLQRTSRRKLADEIAARRSDQREEHDEFDQPEEETDEISLINVID

SEQ ID NO: 154767 - protein, 120 aa, Heterodera glycines
  Coding regions on vcDNA: vcDNA=SeqID_81190; Strand=+; Position=1 -302,1421-1490
  Homolog annotation: Hit_ID=CAE67323.1; Match level="QueryCoverage =96%, HitCoverage=21%, E-value=2e-28, Identity=48%"; Hit description =Hypothetical protein CBG12785 [Caenorhabditis briggsae]
MAFGGHIANIAREGIWASLTGGWYYEPANSLFCNTLHLYIWSLLFVLPILFGLSTTNSTITVAIIYLSLLGFLFVFIKMSVAFLHHIFDTVQPIKYKREREYLLRDIFMSGAEMNPSSGF

SEQ ID NO: 154768 - protein, 186 aa, Heterodera glycines
  Coding regions on vcDNA: vcDNA=SeqID_81191; Strand=+; Position=1 -207,374-546,1011-1191
MHFLILVQIFLICFTNTSLNLTLSNLFESCGKYTVDSLQMKLRYNSHNRSSPLEIWISSEDDFPGPLGMTSIGFFVDNDGVVKCAAVNFFKGYEGRRIMTKTRNVMEQIQARLPRFQRQHIIELYDTGNALRFNEEILIMELSIETFHDRLYKRIDSYKNDQEMQKYIRQLTQPIMELHQGTYYAN

SEQ ID NO: 154769 - protein, 75 aa, Heterodera glycines
  Coding regions on vcDNA: vcDNA=SeqID_81192; Strand=+; Position=1-228
MKITPSNYMYVSVNDEQILKIKNFESAKIIDSGDKNESYLFEIDAVESFTSFNSEYMGPENYAQTKEVRFHFSIS

SEQ ID NO: 154770 - protein, 145 aa, Heterodera glycines
  Coding regions on vcDNA: vcDNA=SeqID_81193; Strand=+; Position=1 -353,388-472
MFLIDQNALIKISTKFDIWSLGMIIIEIHVDQLRFAEGKNSLNEVIYFHVIRVWPGSGSCRALILPGSRSRPFFGNLDFPWTCFPGILARNRFKSNMESMSRIQVKDQGPGFSMSNSAQIEEFTFAKSVICTKDLNETQHWTPLA

SEQ ID NO: 154771 - protein, 273 aa, Heterodera glycines
  Coding regions on vcDNA: vcDNA=SeqID_81194; Strand=-; Position=1 -70,119-425,676-817,1734-2036
MTKKIVSPFNSNVEKQSGELFVFGFRFIKNRKDGSWFRCEQRNCPATAKLDDNDLMTGILGAKGHHHGCAPSRYDAETKRNQMKRLIKEEPKMKPCQIRAQIRTDIDDEVFELLGTNEALDQMANSCCQCSNRIVGGASTAHSAVRQSRGCKCSSSVVMSTTEWWLQRKPCYLRELNHHPSLSDFIAAFIKDIDKQLDIGRAERLQKSTKRRQRYIIKEQNVVRILDEADFESQEGLTNALNLIGLVMQGFVEGLHIRGNEDSEEETDDTDGN

SEQ ID NO: 154772 - protein, 156 aa, Heterodera glycines
  Coding regions on vcDNA: vcDNA=SeqID_81195; Strand=-; Position=1-471
  Homolog annotation: Hit_ID=NP_703392.1; Match level="QueryCoverage =72%, HitCoverage=33%, E-value=3e-12, Identity=36%"; Hit description =hypothetical protein [Plasmodium falciparum 3D7] emb|CAD51412.1| hypothetical protein [Plasmodium falcipa
MDTSAMQSAERIQKNERVEEKGKRCKGVERIQKNERVEEKGKRCKGVERIQKNERVEEKGKRCKGVERIQKNERVEEKGKRCKGVERIQKNERVEEKGKRCKGVERIQKNERVEEKGKRCKWPSRRGGKRNGRTDWAKENVIEKPALIGKTPNFSY

SEQ ID NO: 154773 - protein, 57 aa, Heterodera glycines
  Coding regions on vcDNA: vcDNA=SeqID_81196; Strand=-; Position=1-171
MDRIRRVASNLSLTAKGQRERRQNLALLWGRGEAKKAKNGEQKERTKEEGALSKLCK

SEQ ID NO: 154774 - protein, 192 aa, Heterodera glycines
  Coding regions on vcDNA: vcDNA=SeqID_81197; Strand=-; Position=1 -47,118-384,447-711
  Homolog annotation: Hit_ID=AAL78214.1; Match level="QueryCoverage =88%, HitCoverage=87%, E-value=7e-12, Identity=29%"; Hit description =putative esophageal gland cell protein Hgg-20 [Heterodera glycines]
MSDNPKEAEREMEKAIFISADCWLEVFDLLPIYQLGHGIALISHRFDRRVDEHFKTRKWTLDKLEIRCKIGTNEMEIINSKGKALPIPQNPLPNKVIGFRSIEIFFIDYNVLTFLHHFHRFFAVISTKWYITTENVRILEFIVLTIWPMFKHPIHEMILSPVIFRRMRQFAPSHSVQLSVPPNCLSLFRHFA

SEQ ID NO: 154775 - protein, 273 aa, Heterodera glycines
  Coding regions on vcDNA: vcDNA=SeqID_81198; Strand=+; Position=1 -92,141-561,614-873,1082-1130
MQIVNSDGNPLPIPQNPLPNKVIGFRHIQIIYIDQNVITFLRRFHRFFAFCSIYLDIRTENVRILDFVLLNVLPMLRDSIRLMLLNTIAFRRLRQLAPSLLNNCPFLRAVVFEDAIFPAFPPDDSANASDGQAVTKWLFTPRPDGVPKWLTIRSFVDSPDQWSSTMEQLKAAFSNASSPVSFCIHFLMSSPLDFIVPFDLINEVTGEKLFLLQSENDFWLIRFQIGWDERKWDNVKDKLKNRTNPIVIRIKDGGFDDGLLDDASPGPNDQQQK

SEQ ID NO: 154776 - protein, 167 aa, Heterodera glycines
  Coding regions on vcDNA: vcDNA=SeqID_81199; Strand=-; Position=1 -354,872-1021
  Homolog annotation: Hit_ID=NP_998142.1; Match level="QueryCoverage =57%, HitCoverage=23%, E-value=7e-38, Identity=76%"; Hit description =DEAD (Asp-Glu-Ala-Asp) box polypeptide 39 [Danio rerio] gb|AAH44169.1| DEAD (Asp-Glu-Ala-Asp) box polypep
MRRTANCWTCWMLWSSTRFYPVYLHILIGTNAKVVIFLRSVSRCRALNQLLIEQNFPSIAIHRAMAQEERLARYQQFKDFQKRILVATNLFGRGMDIERVNIVFNYDMPEDTDTYLHRIGFRFLILTFFCPGLKNMLGFLKVLTTNLNADLPNSVLEARGSKWMPDV

SEQ ID NO: 154777 - protein, 226 aa, Heterodera glycines
  Coding regions on vcDNA: vcDNA=SeqID_81200; Strand=-; Position=1 -115,340-468,628-831,873-991,1275-1388
  Homolog annotation: Hit_ID=CAA91120.1; Match level="QueryCoverage =83%, HitCoverage=56%, E-value=3e-66, Identity=58%"; Hit description =Hypothetical protein C26D10.2a [Caenorhabditis elegans] pir||T19484 hypothetical protein C26D10.2 - Caenor
MDEEQLLDYEEEQEETQEQQSKNDAATNGDATKKIKVKMQHECIPQAILGMDIVCQAKSGMGKTAVFVLATLQQLTPTDGTAFMPRVKVSVFFGGMPIKKDEEVLAKNTPHIVVGTPGRLLALGRTGHLKLKGVKFFVLDECDKMIGDADMRHDVQEIFKMTPQEKQVMMFSATLPRELRVVCKKFMQEKSCDCSAKWVPQMAILTQRERDGRCASQLSVGRKRIR

SEQ ID NO: 154778 - protein, 810 aa, Heterodera glycines
  Coding regions on vcDNA: vcDNA=SeqID_81201; Strand=+; Position=1-2433
  Homolog annotation: Hit_ID=NP_510849.1; Match level="QueryCoverage =91%, HitCoverage=53%, E-value=1e-170, Identity=41%"; Hit description= predicted CDS, zn-finger, CCHC type and RNA-directed DNA polymerase and Integrase, catalytic domain cont
MELDEKSKPLCTINTHCGLFQCQRLPVGVKSAPSIFQHLMDQICAGIPGVFSYLDDCLIASKTLEDHVNALHTLFQRIKDFGLRIQLEKCKFLQKELLFLGHIVSSNGIRPDPARSEAIQKMPAPHDKTTIRSFLGALNYYGRFVKPMREIRAPLDQLLRKDESWSWGDDQQSAFEQAKAIMVSELLLTHYDPTLPIVVAADASKDGIGATISHIFPDKKEKVIEHASTVLTNAQQNYSQIEKEALALVFAVQKFHRMLFGRKFTLLTDHKPLLAIFGSKKGIPIYAASRLQRWALIMANYDFEIRYINTASFGQADVLSRLIANYPRPEEDILIANICTETECYISTILQTKTEQLPVTADEIAEATPKDEILKKILAFTKSNWPKKSSDPDIAPYFPKRENILEIEDCLLFQNRVIVPQSLRNRMLKSLHMAHPGIVRMKALARQHVYWPGMDSEIERIVRQCEECQKAQKSPIKAPLAPWTPTDKVFQRVHIDFAGPCQDGHVYFILVDSFSKWPEVYQMNSMTAAATVFTLRSIIHRLGIPEEIVSDNGTQFRSSEFAALCKEFGIKHTFTPPFHPQSNGQVERFVDTFKRAMMKCKGDKNSLEKVLLSYRSTPNSAIDGYSPDQLFLGRKLRTKLALVHPKGQIDQSEKFEKGKFKQHQKDYSTKMAQQFDRNNGTKAIEFLPTDSVLLLNYRLGKSHWLQGTIVKRFNNSPTYRVHVPTLGRIVHRHANQLRRRLDFEDNSNWEPPIQEQMAIDPNQRTPPRQHAAIDQRTPPVVDQARQKAKSPIGVRRSQRVPKPVKRFTPG

SEQ ID NO: 154779 - protein, 84 aa, Heterodera glycines
  Coding regions on vcDNA: vcDNA=SeqID_81202; Strand=+; Position=1-574
PYPLCCGLGFIPTCGLALSRPPPLWLTISCILPAPSHSSPCLMSIKRSPPPPARPSAVGSARLFQSNIYPPLGASSSPRGRGGG

SEQ ID NO: 154780 - protein, 125 aa, Heterodera glycines
  Coding regions on vcDNA: vcDNA=SeqID_81203; Strand=+; Position=1 -190,434-553,993-1060
MSHPPPIDALSTSTAASSSLASTGAARLAPALFHAGSAKTNWTAMDCVWLEEVHNIQARTEDYEPFVLAPEQSRVVAELVRGCVHVRHGGQFVCAVVICSGFTASQFAQLFHRKFGRGRTCFCAQ

SEQ ID NO: 154781 - protein, 30 aa, Heterodera glycines; identical to SEQ ID NO: 136834
  Coding regions on vcDNA: vcDNA=SeqID_81204; Strand=+; Position=1-208

SEQ ID NO: 154782 - protein, 205 aa, Heterodera glycines
  Coding regions on vcDNA: vcDNA=SeqID_81205; Strand=-; Position=1 -145,216-618,689-757
  Homolog annotation: Hit_ID=CAE64964.1; Match level="QueryCoverage =87%, HitCoverage=61%, E-value=6e-60, Identity=35%"; Hit description =Hypothetical protein CBG09798 [Caenorhabditis briggsae]
MCRCRQGFLDISPNITIKPGRLCKSLENECVKGSHDCARDGGICEDTPELKRFGKGWDIFRNDEVIIEIREWLNCLTDSYTCRCAANFLDVSLDRKNRPGRNCKRLIDECASGQNDCFPGALCTDTEDSYTCACPPNHLDVSPDSAKRPGRRCLLRVNECNVQGLSDCSPNANCQDTDEVGMGATTAHARMALWTKVQTKGNGRA

SEQ ID NO: 154783 - protein, 265 aa, Heterodera glycines
  Coding regions on vcDNA: vcDNA=SeqID_81206; Strand=-; Position=1 -268,851-1306,1522-1594
  Homolog annotation: Hit_ID=NP_499254.1; Match level="QueryCoverage =99%, HitCoverage=6%, E-value=1e-57, Identity=43%"; Hit description =transmembrane cell adhesion receptor precursor; matrix receptor, muscle attachment protein, MUscle Attachm
MRLRSIVQKLTCPQPPRPPPSPGGCSVQSQIGCDRTRNEHCELVNGKPTCRCPGPFARHPQTGVCGGDLCNPELPTSCPHPELCAKTPFSNFRCVCPAQHSRDHQLGICLSSVQQRQNQQHQQQQSNFSNSSTNANFGTTFVSGGTNQKPAPQQHHVSTQSTAGGGTNNSAGNGGKFPPCAAGTVPNPRTGKCAVPGSCDPAEEQPCDVRKREKCLLHSTGQFHACQCLHGEKRHPATEICLRNECLDKRENDCDRSAKCIDTDE

SEQ ID NO: 154784 - protein, 227 aa, Heterodera glycines
  Coding regions on vcDNA: vcDNA=SeqID_81207; Strand=-; Position=1 -108,172-236,344-428,611-849,1098-1276
  Homolog annotation: Hit_ID=NP_499254.1; Match level="QueryCoverage =100%, HitCoverage=80%, E-value=2e-97, Identity=39%"; Hit description= transmembrane cell adhesion receptor precursor; matrix receptor, muscle attachment protein, MUscle Attac
AICVNVFDSFRCQCKPGYWDMSPDPETKPGRACKELININECATDSHDCSPFAECVDATDGYACVCRDGFVDSSSQYELLPGRKCSNASNECTDRSLNTCDENADCVDTPAGYSCKCIPGYVDVSSSANLPPGRVCTVVTTCPKQKTDLMFLIDGSGSIGSAVFRNEVLRFVRDFVELFDIGLENTRVGLIQYSDQIRHEFDLNQYVDKPSLLQAIAQTQYLTGLTR

SEQ ID NO: 154785 - protein, 386 aa, Heterodera glycines
  Coding regions on vcDNA: vcDNA=SeqID_81208; Strand=-; Position=1 -27,1113-1281,1492-1554,1664-1719,1785-1852,2156-2299,2629-2766,2958 -3188,3551-3794
  Homolog annotation: Hit_ID=CAE64964.1; Match level="QueryCoverage =99%, HitCoverage=79%, E-value=1e-133, Identity=34%"; Hit description= Hypothetical protein CBG09798 [Caenorhabditis briggsae]
DYGQNAPESEQCRNANCAPEAECNEGPQGPVCRCLAGFLDVSAQHGKGPGKVCRLIQNECNAGKHDCSRDANCIDTADAFTCRCKEGFRDDSPSREKPGRVCTRTEVPDSPECDVNDEVPDSPECDVNDPMSCDKGKHEACLFISGSYHCSCPMGYGRLPDGRCLAINECEDARLNECSEDAECIDQAEAYTCKCKSGFADISPQGKPGTLCRQRINECAQPQAFDVDCDANAICIDTEESFSCRCRPGFADISEQFNKLPGRRCVEAVNECLDRKLNDCSDNAQCEDSKEGYTCKCRAGFLDASENAGKYPGRVCIKSDRNLSGGSASSAFEFDDTCDPKLKACGLQCTDRMQPGTFVCACPEGQFLYTDGTCRLATACVSANAT

SEQ ID NO: 154786 - protein, 72 aa, Heterodera glycines
  Coding regions on vcDNA: vcDNA=SeqID_81209; Strand=-; Position=1 -142,686-762
MAKALAVPKTVLDMWMNKDLPSLRELVPALVQLLRDNFKHESIMCQIHYNGCIVILNKCDALLNILIASFPK

SEQ ID NO: 154787 - protein, 33 aa, Heterodera glycines
  Coding regions on vcDNA: vcDNA=SeqID_81210; Strand=-; Position=1-247
THFVFINFEKFWTFRVFLLFWTFRGLDTLWGCL

SEQ ID NO: 154788 - protein, 369 aa, Heterodera glycines
  Coding regions on vcDNA: vcDNA=SeqID_81211; Strand=-; Position=1 -132,478-617,685-770,804-861,911-1057,1190-1351,1402-1618
  Homolog annotation: Hit_ID=CAE65906.1; Match level="QueryCoverage =93%, HitCoverage=23%, E-value=5e-97, Identity=55%"; Hit description =Hypothetical protein CBG11073 [Caenorhabditis briggsae]
HASHNSLSPASSTAAMPTEAALAVNTKFTSYSPHWTPRQSQMALNTQHFQQRVINVSNAPPVALKQSESGEWEIKQGSGGLVSCVDPVMSVNPENMWLANLGMVNPENMWLANLGMNIDKFKITSTEYLEKIPAHIAAPATNTLGPAHIAAPATNTLGLPLMKQALADVLFHVIANDEQKEALADVLFHVIANDEQKEDDESAVKKQIREEMSLLGVLNNYNRGNYKLNPVIVQEQDYNVYYGGISNGLLWPALHNLPEYILPEYSDSKVLNEHWFSYVRVNYQFAIDAVRNSRPQDFFAIDAVRNSRPQDFIWIHDYHLMLTGMIMQSLERNLEIGFFLHIPFQVFGMPKIINYRSHRGEKELVTNCL

SEQ ID NO: 154789 - protein, 65 aa, Heterodera glycines
  Coding regions on vcDNA: vcDNA=SeqID_81212; Strand=-; Position=1 -186,499-510
MQSICSIFELKLTFPLSSLLWSSVELEAGRDPEGSKLHFLKISKTACQPNIFNKFITNSIRYQKC

SEQ ID NO: 154790 - protein, 128 aa, Heterodera glycines
  Coding regions on vcDNA: vcDNA=SeqID_81213; Strand=+; Position=1-387
  Homolog annotation: Hit_ID=NP_491173.1; Match level="QueryCoverage =86%, HitCoverage=11%, E-value=7e-14, Identity=36%"; Hit description =histone acetyltransferase (88.5 kD) (1E91) [Caenorhabditis elegans] gb|AAF60658.1| Hypothetical protein Y
MRVPIKVPDYYDYIPFPVDLGSIAERLKLGYYTHVTYHILNGQSKRTLRYYCAHNSYQERMFVADIRRMFDNCYKFNSPESQYYYHGYKLNELFDRLTRQHFAHCKLQAPLPAVKPEYVPNAGGGGRK

SEQ ID NO: 154791 - protein, 160 aa, Heterodera glycines
  Coding regions on vcDNA: vcDNA=SeqID_81214; Strand=-; Position=1 -223,342-469,831-960
  Homolog annotation: Hit_ID=NP_493036.1; Match level="QueryCoverage =100%, HitCoverage=50%, E-value=4e-63, Identity=66%"; Hit description= putative protein, with at least 2 transmembrane domains, of ancient origin (36.6 kD) (1M593) [Caenorhabd
QNFIRSFREHHVDPTAITRHDFVEVNGDNFMLCIPKLGHIAWQHWTSEPRELEQHLPIHWFWFLCGFYVALTNQIHKWSHTYFNLPGWVILLQQCHLILPRQHHKLHHISPHACRYCITTGWLNPALDAIGFWRKMEFLVSVITGWKPRDDDLKWATKLE

SEQ ID NO: 154792 - protein, 90 aa, Heterodera glycines
  Coding regions on vcDNA: vcDNA=SeqID_81215; Strand=-; Position=1-270
MGFFKVPEESPNGNANVCMGEAKPRWGPTHAGAKQLASMYGKGKPGMGLKLSSTQSQGNDSKKSLAFALRQPFFCRSAAPSFTTFGLSPS

SEQ ID NO: 154793 - protein, 124 aa, Heterodera glycines; identical to SEQ ID NO: 128488
  Coding regions on vcDNA: vcDNA=SeqID_81216; Strand=-; Position=1 -165,440-649

SEQ ID NO: 154794 - protein, 79 aa, Heterodera glycines; identical to SEQ ID NO: 126221
  Coding regions on vcDNA: vcDNA=SeqID_81217; Strand=+; Position=1-391

SEQ ID NO: 154795 - protein, 36 aa, Heterodera glycines
  Coding regions on vcDNA: vcDNA=SeqID_81218; Strand=-; Position=1-111
QISRADPQLSNVKDEDDQPDYDEPQNDEPENEENSF

SEQ ID NO: 154796 - protein, 278 aa, Heterodera glycines
  Coding regions on vcDNA: vcDNA=SeqID_81219; Strand=+; Position=1 -124,179-619,677-948
MAKRKIVCKLNAIKSAQKRVQNREERQEKLERARQAKSAKKTALQPNPNAETPQQDEAGPSTSAASAEEAMEPPPPTPGPVPTPEMDEEILEFDDPPPSTPATPIGDLVPFPSTPTAPMDTGETTPPPLAIDERSERIEQLEKQLKDRDDTIKFLREQVLNREALISDLRRQLDEHMVPPMAPPTTSKTPPNRGRPKKRLDELQRSARRDIVDKIVGVIDRNRSRSASRASLDRIHREIRHKFSHYTPKKGQSCRREWKRRMDFCCLPSSGRRWLTNG

SEQ ID NO: 154797 - protein, 17 aa, Heterodera glycines
  Coding regions on vcDNA: vcDNA=SeqID_81220; Strand=+; Position=1 -28,84-109
MKWVEEINNDVTEVKGI

SEQ ID NO: 154798 - protein, 51 aa, Heterodera glycines
  Coding regions on vcDNA: vcDNA=SeqID_81221; Strand=+; Position=1-157
RLIEPVKSFRMISRLFDSVNNFKNYIDSNLAQTELARRSWPVPPVAASARR

SEQ ID NO: 154799 - protein, 42 aa, Heterodera glycines
  Coding regions on vcDNA: vcDNA=SeqID_81222; Strand=-; Position=1 -88,163-203
MSVKVKEQMKVSGNKAFFVLLVQMIGVVLGVLIAAATGFFNE

SEQ ID NO: 154800 - protein, 29 aa, Heterodera glycines
  Coding regions on vcDNA: vcDNA=SeqID_81223; Strand=-; Position=1 -22,441-508
MDSDVFNYLIYKTSYRAKRDEEDNNGDGD

SEQ ID NO: 154801 - protein, 96 aa, Heterodera glycines
  Coding regions on vcDNA: vcDNA=SeqID_81224; Strand=-; Position=1 -34,191-360,688-771
APQPTTSTKTAAPEWNVAPSAAKMDDCFEDEEEKRKSSSSTTGNAVKILAIAAGAAWAFALAVWRMPEVDDENEEPEPPAQRFENVEEEKPAADEE

SEQ ID NO: 154802 - protein, 138 aa, Heterodera glycines
  Coding regions on vcDNA: vcDNA=SeqID_81225; Strand=-; Position=1 -133,799-917,1303-1464
MYEFRIVAANDEGTSVPVIVLQETTDNWVPPIPFGQYVIALTSTVLALLISALKKCLRHRFSDFMFSFALGSLSGSATFHLLPKAFSICNPNFGLSLFVIATIYVSFFSANAIKIALKMRKNDEETAGNEMDEQQEEA

SEQ ID NO: 154803 - protein, 28 aa, Heterodera glycines
  Coding regions on vcDNA: vcDNA=SeqID_81226; Strand=-; Position=1 -5,177-258
MSKIVSILFNKILSIKVVVKYANVCVYI

SEQ ID NO: 154804 - protein, 42 aa, Heterodera glycines; identical to SEQ ID NO: 154799
  Coding regions on vcDNA: vcDNA=SeqID_81227; Strand=-; Position=1 -88,163-203

SEQ ID NO: 154805 - protein, 107 aa, Heterodera glycines
  Coding regions on vcDNA: vcDNA=SeqID_81228; Strand=-; Position=1 -24,979-1093,1433-1580,1681-1717
  Homolog annotation: Hit_ID=CAE68299.1; Match level="QueryCoverage =85%, HitCoverage=63%, E-value=8e-10, Identity=41%"; Hit description =Hypothetical protein CBG13990 [Caenorhabditis briggsae]
MNRALSIKLLTIFHNVFDGFLIGSSARAPLSCLSISVALLCKRSKKLRPGKSMKMNLVLHLVSALTCAIGFSSGLLIDLLLYDTVVKYGYALGSGMFIYISAVCLFF

SEQ ID NO: 154806 - protein, 27 aa, Heterodera glycines
  Coding regions on vcDNA: vcDNA=SeqID_81229; Strand=+; Position=1-82
MAVLKFSIPVILLDEILKFVARRMEAH

SEQ ID NO: 154807 - protein, 81 aa, Heterodera glycines
  Coding regions on vcDNA: vcDNA=SeqID_81230; Strand=+; Position=1-245
MSFEYNLEMFLEKSENELSLEEHWLGMVLRNEEEINYGIIKEEENGENAQSKGKKQSTKIFYGPTDTENVLRIDFDGKIAQ

SEQ ID NO: 154808 - protein, 118 aa, Heterodera glycines
  Coding regions on vcDNA: vcDNA=SeqID_81231; Strand=-; Position=1 -120,176-412
MLLLVKTHKKIMLPKRKNLKALAEKAFSDSHFINRDNCIKCKFLFIFNYLLVLFRDWYFGKSLNLNLDFQIDLDLDFLDKKSRPGSRPISNIVVFTQRNLKGLIKITFYFIFCHKKQQ

SEQ ID NO: 154809 - protein, 49 aa, Heterodera glycines
  Coding regions on vcDNA: vcDNA=SeqID_81232; Strand=+; Position=1-149
MTPEEQQQLMGSRRPFLEPITKSTKQQNGKPRLNKADIPLNFDARQHFY

SEQ ID NO: 154810 - protein, 53 aa, Heterodera glycines
  Coding regions on vcDNA: vcDNA=SeqID_81233; Strand=+; Position=1-223
CRAMEKHKAAASMGIARESRFESKENNGTNEGMNERINFVPNCRATVLLPIIF

SEQ ID NO: 154811 - protein, 47 aa, Heterodera glycines
  Coding regions on vcDNA: vcDNA=SeqID_81234; Strand=+; Position=1-143
NVQSPVTTPSRGQQTLSLSAALVQQQQQSGTYTPNVPQGDGAATATD

SEQ ID NO: 154812 - protein, 104 aa, Heterodera glycines
  Coding regions on vcDNA: vcDNA=SeqID_81235; Strand=+; Position=1 -222,277-369
MGIVARRLLKNRAIQKQLDRRQKSRLNYVEKFKKIIFFFKDMKTLRRQQAAAGRSPIVVHSAGIGLPRTEPVHQRQEICTVPAHEVIYDVPFDGQREEEDEDSF

SEQ ID NO: 154813 - protein, 100 aa, Heterodera glycines
  Coding regions on vcDNA: vcDNA=SeqID_81236; Strand=+; Position=1 -150,203-355
MSTSESKNGKNLNSSLNINNLSPTAPDEGDCEMPDERVLHLECFESGDYDMMELYGLDRAKEMLIDLRDYAEAHGMACKHVKMLLYKLDKGLIKWKGTKP

SEQ ID NO: 154814 - protein, 241 aa, Heterodera glycines
  Coding regions on vcDNA: vcDNA=SeqID_81237; Strand=+; Position=1-726
MAINISDKKSLCNQILGQTDLTVTSSGITISGPRLSTPRFIPFDEAGRCRCCKGTESEIDTVITKEGITLWCTRIEKTQFIPFDVVYDLPGHCFFRLKNKSRVFNIPYGDIPSSDTHTTKRRTHTNDHQHELKRKAKVALDLVEAGLMADAMQDGARWKKAKTAINVLGNLLLAESLDNTSANDTPLKNDTVDIKKEEANVEEEKVQEEPKEKEENKEDLGDIDKTLDEFFNSIKASTSNM

SEQ ID NO: 154815 - protein, 529 aa, Heterodera glycines
  Coding regions on vcDNA: vcDNA=SeqID_81238; Strand=+; Position=1 -765,1272-2096
  Homolog annotation: Hit_ID=AAT47863.1; Match level="QueryCoverage =47%, HitCoverage=53%, E-value=2e-35, Identity=34%"; Hit description =HASI and integrase-like protein [Oikopleura dioica]
MDTAQQRIAIRRKLKKDEAYDDDSEHKKYRVHYPPSPPRLPLPPRAKAKIEPPPSRPTAKREPKQQKPTKFELKPSKFDSDLRPKVAPPPRPKKEPEFPLDPRPSTSRQAGHLPPPAPKIIPKPEPTKRPVPYRIPKREPKIVEQQPQPLQQPLPASAVEEEMPTVPPPRRGTKRHYPVNGENDGEVRIRKRVRQARRVRVQYSPELGPSTSAQSDEQQQQQQRELFAIPSNQLTMTQRVERLYIKCNRYADRMGALSRHNRGHRYLLVAVDVLSKRLFVVPLKNKRAEEMLEAFKQLIDQMPMVPHRIFSDKGTEFKNRLLKEFFDEQEIKKHEPVHSSVKASVAERAIRNIKQRLYRYFAEKETLNWVDAVQKIVDGINSAPSRVHGMRPNDVNFSNAQKVWKRLYGHPALQKRTPRFRNDQFVRMSREKGQFEKGYLPNYGDEILEIDEVLKAVRPIRYKLRDEHGEKFKGSFYEQELARVRKDAETSYRIEKVYRKRKLSDGSTEMLVKFIGYPNREWINESQLV

SEQ ID NO: 154816 - protein, 99 aa, Heterodera glycines
  Coding regions on vcDNA: vcDNA=SeqID_81239; Strand=-; Position=1-307
LPYNAQREIEQMDTAQQRIAIRRKLKKDEAYDDDSEHKKYRVHYPPSPPRLPLPPRAKAKIEPPPSRPTAKREPKQQKPTKFELKPSKFDSDLRPKVAP

SEQ ID NO: 154817 - protein, 134 aa, Heterodera glycines
  Coding regions on vcDNA: vcDNA=SeqID_81240; Strand=+; Position=1 -95,652-961
MNVMLKTEGYKNRENPLAASPRERAATKKQLSLAFGALATFLKCDGLNTSADSAAPLSLYYTFNRTKKNILNAAGQFKDKITKRDVTPPLKFYSDLCFALTTGFNTNIRELNNLAHLPLTSAKMAFYFEQLLDS

SEQ ID NO: 154818 - protein, 140 aa, Heterodera glycines
  Coding regions on vcDNA: vcDNA=SeqID_81241; Strand=+; Position=1 -126,193-489
MDKEFYPPLAQLVDYKLPVYGDPSKLKHIGHALASKRDGPEKQQLLFFLSVLIAVTGIDISAVMASLGDDDLNLSGGTAMDISSADITLGASNVRKKTRLDILVKQLFKTISCPWLISSWSRSRWKKSTSYSKITISLSL

SEQ ID NO: 154819 - protein, 320 aa, Heterodera glycines
  misc_feature (6)..(6): Xaa can be any naturally occurring amino acid
  misc_feature (300)..(300): Xaa can be any naturally occurring amino acid
  Coding regions on vcDNA: vcDNA=SeqID_81242; Strand=-; Position=1 -288,333-445,487-531,563-734,794-889,2367-2412
  Homolog annotation: Hit_ID=CAE63786.1; Match level="QueryCoverage =77%, HitCoverage=17%, E-value=1e-30, Identity=34%"; Hit description =Hypothetical protein CBG08327 [Caenorhabditis briggsae]
LLFNQXLFFTAAYQQHHVSFPSLLLLLLKTTFRIRREAAHCLVQIYNSLPESRLGESPPLIDYFRQNFGSKTSPDIPLPNNYAATSSNLQNNLLGQALPAAIGLIRGQDGALPAAIGLIRGQDGRECPEYVLEFIINLIRLNDNSTNRYSDDYYRGALIHALGSTNRYSDDYYRGALIHALGTKGKTLTMSERTVEQPDTKGKTLTMSERTVEQPDCLSVHARGVLREVTHALNMDTMRPSFGRIISIHCIQVLYELQKLRHLPIDTDIFWKFGLQKLRHLPIDTDIFWKFGAKAFMHRXAIIIYEDEFIEEPMSADFDL

SEQ ID NO: 154820 - protein, 382 aa, Heterodera glycines
  Coding regions on vcDNA: vcDNA=SeqID_81243; Strand=+; Position=1 -143,193-294,342-559,616-766,828-876,995-1087,1139-1209,1258 -1396,3212-3243
  Homolog annotation: Hit_ID=NP_502260.1; Match level="QueryCoverage =99%, HitCoverage=50%, E-value=5e-97, Identity=51%"; Hit description =Na/H eXchanger, sodium/proton antiporter, functions in intracellular pH regulation, found mostly in the e
MFRKFIAIGEPNLEAMDYAAGVASFLVIAVGGVLIGLLFSLITCIATKLTTRLTTRVRILAPVFVFIVPYMAYLTAELFGLSSILAIVACGISMKQYVKGIVACGISMKQYVKGNLSHDASNSVKYFVKMLAQCSETVIFMFLGLSAVSKVHLWDWAFIVATIAFCLLYRVIGVVVVVVQCIFLNRFRTKKFSFSDQFVLSYGGLRGAIAFGLVVSLEDSLPPKQMFVTTCISVIFFTFVTTCISVIFFTVFFQGITIRPLLHWLKVKKNEDKEETMFEKLCSRNCDYLMAGINCDYLMAGIEDIVGRKGPNAIRDTFERFNAKVLFERFNAKVLKPALMRGEQRKAFDASPIIRAYNKLTLLEAQRTVRGSNEFKNRHLTV

SEQ ID NO: 154821 - protein, 54 aa, Heterodera glycines
  Coding regions on vcDNA: vcDNA=SeqID_81244; Strand=-; Position=1-179
RKKCVCITCALTHSVLIGGPTERTEKKKGTADGLSPFSVSISANCDGGTFLFTK

SEQ ID NO: 154822 - protein, 29 aa, Heterodera glycines
  Coding regions on vcDNA: vcDNA=SeqID_81245; Strand=-; Position=1 -66,123-146
MAISFFEKFSMQQTLSNMKRSAKNGYLFF

SEQ ID NO: 154823 - protein, 29 aa, Heterodera glycines
  Coding regions on vcDNA: vcDNA=SeqID_81246; Strand=-; Position=1 -66,123-146
MAISFFEKFSMQQTLSNMKRSAKNGYLFF

SEQ ID NO: 154824 - protein, 29 aa, Heterodera glycines
  Coding regions on vcDNA: vcDNA=SeqID_81247; Strand=-; Position=1 -66,123-146
MAISFFEKFSMQQTLSNMKRSAKNGYLFF

SEQ ID NO: 154825 - protein, 29 aa, Heterodera glycines
  Coding regions on vcDNA: vcDNA=SeqID_81248; Strand=-; Position=1 -66,123-146
MAISFFEKFSMQQTLSNMKRSAKNGYLFF

SEQ ID NO: 154826 - protein, 255 aa, Heterodera glycines
  Coding regions on vcDNA: vcDNA=SeqID_81249; Strand=-; Position=1 -153,209-284,626-973,1018-1157,1211-1258
  Homolog annotation: Hit_ID=XP_316911.1; Match level="QueryCoverage =49%, HitCoverage=12%, E-value=1e-12, Identity=31%"; Hit description =ENSANGP00000006552 [Anopheles gambiae]
DFALRCLDYIDQNAETLFESEEFLQIDQNLLCEIFERDQLKIDDELTIWKAAIRWADEKCRQNAVECSAENRRSALVEEFRVFITVSSCVLTVEELLAVLQYHCHPNLRGAPGQYPMAFPCHGRISDQKEGTLSMEIEKLSEFVREEVNSRRLSKCIYTKGLPWKIWAQIRTKENSTEKWLGFYLFCTAPKENGDWSCKCSATFRIVSQKKGTEDFTKKFDHSFNNKSTCWGLIMITFTELMDPTKGFYDSEVDI

SEQ ID NO: 154827 - protein, 33 aa, Heterodera glycines
  Coding regions on vcDNA: vcDNA=SeqID_81250; Strand=+; Position=1 -3,394-492
MGFSGALITLCHLIRPISNLGPELEQMWIIRNF

SEQ ID NO: 154828 - protein, 107 aa, Heterodera glycines
  Coding regions on vcDNA: vcDNA=SeqID_81251; Strand=-; Position=1 -90,764-854,1086-1228
MSSKLQDRFKLMLSTGEGADVHFLVGKEKELLKAHKCVMMFASDVFGSMFRFDDKNSKTKTNKYNVSLLVKALLDFPINELPNVFLAFVEARLLNQNVQIEIYTKYF

SEQ ID NO: 154829 - protein, 24 aa, Heterodera glycines
  Coding regions on vcDNA: vcDNA=SeqID_81252; Strand=+; Position=1-74
MAKYGPKYGLKTAKSQGRHLENGP

SEQ ID NO: 154830 - protein, 56 aa, Heterodera glycines
  Coding regions on vcDNA: vcDNA=SeqID_81253; Strand=+; Position=1 -3,235-402
MITRESLRVSLPNCDLEKALEQPQQQEKQSGANIDNDNEAVQKRPQKSINHFEGID

SEQ ID NO: 154831 - protein, 90 aa, Heterodera glycines
  Coding regions on vcDNA: vcDNA=SeqID_81254; Strand=-; Position=1-273
MITSSPAASPSTAPRAAPSAAPAVSAPATAAPRAPLRGCVLDQSASAEQRNQKKQQNETRHCKIKFRKLFFDAEIHRENEQTFMVIIELN

SEQ ID NO: 154832 - protein, 39 aa, Heterodera glycines
  Coding regions on vcDNA: vcDNA=SeqID_81255; Strand=-; Position=1 -82,654-691
MWGEIFSKEIPSQCATDREFCTQSNVKGLGFVLRCQVHT

SEQ ID NO: 154833 - protein, 40 aa, Heterodera glycines
  Coding regions on vcDNA: vcDNA=SeqID_81256; Strand=+; Position=1 -69,171-224
MKVNKCELQKWNGCKKCLYMADTTVDTKWAWQSRTPWRIE

SEQ ID NO: 154834 - protein, 231 aa, Heterodera glycines
  Coding regions on vcDNA: vcDNA=SeqID_81257; Strand=-; Position=1 -130,215-347,423-510,583-927
MNRKFTQNLLVLSFALALANFFSIFGHPVEHDNEEDNEPNSQNVDKVTRNYVHKLVKDENHLSSMREFAVEWAHNNALIFRNKESPKRSDVSVFAPVSLFPSPFPRHPFEHALSIQKQLNYCNSLFQRPLQGQLIALIIFLTPRKNYILLGNVEKIWAYDGVAKRHGRNLLLKFALPPKALRPAPLALALWLGQRESPRARPEILVKINDFSKVLLSKLKGAERAVLSRWH

SEQ ID NO: 154835 - protein, 52 aa, Heterodera glycines
  Coding regions on vcDNA: vcDNA=SeqID_81258; Strand=-; Position=1 -69,290-379
MKISKKPLGIFDLLFLSTSFLRNSKTILYLRKRRPTFLMGIISSFFIKLSMG

SEQ ID NO: 154836 - protein, 30 aa, Heterodera glycines
  Coding regions on vcDNA: vcDNA=SeqID_81259; Strand=-; Position=1 -78,120-134
MANKIIFGAKLNLKSINVANLKMFIKINKS

SEQ ID NO: 154837 - protein, 133 aa, Heterodera glycines
  Coding regions on vcDNA: vcDNA=SeqID_81260; Strand=-; Position=1 -13,766-944,1016-1114,1386-1496
  Homolog annotation: Hit_ID=NP_788926.1; Match level="QueryCoverage =59%, HitCoverage=13%, E-value=3e-10, Identity=45%"; Hit description =CG6835-PD, isoform D [Drosophila melanogaster] ref|NP_788925.1| CG6835-PC, isoform C [Drosophila melanoga
MDSNTFFVGFIMIPFTIPCQMLLLVTNHFTNCTPFWGGHKGSNTKLIRSLLHGDLISPFWLGTRNIMVQPDKVSKIDTMASELGVYGVLMGNMRTGEVSHNVQQGHLLKTKLATSDEGGISAGFAVHDSPILF

SEQ ID NO: 154838 - protein, 122 aa, Heterodera glycines
  Coding regions on vcDNA: vcDNA=SeqID_81261; Strand=-; Position=1 -326,818-860
MCNFVTGERWWLSKACPCLCGNEKCKYDGDWWANLVQNGKNLARGHGKQMACKTAAPLPLQRQRHTARKSVVTLPMALSRIEVGPSLGNLPCVDMKLTGDQLAQLLKMKILGFSFALIVRLG

SEQ ID NO: 154839 - protein, 75 aa, Heterodera glycines
  Coding regions on vcDNA: vcDNA=SeqID_81262; Strand=+; Position=1 -46,211-392
MSFSFVLLIFCLFYGVGEMTDLAKEGQTPNFDFSQPQPMAQMAQIANAMAANGNGNYGMGNKFNSEGEENICKTS

SEQ ID NO: 154840 - protein, 98 aa, Heterodera glycines
  Coding regions on vcDNA: vcDNA=SeqID_81263; Strand=-; Position=1 -21,140-415
MADLANKNGQQYQLDALRKVNLARFVNHSCQPNCCAVLITTAVRIASTATAGDQYHQRGQQVPSVLIFALRRIFAGEEITVDYGNGLTLLLSGTVGAP

SEQ ID NO: 154841 - protein, 60 aa, Heterodera glycines
  Coding regions on vcDNA: vcDNA=SeqID_81264; Strand=-; Position=1 -129,282-336
EIPTTADFVVDNDLSKGKELNKLRVINTENKDKISPYKMAKMWIYHAKLFRLCVPLRDFK

SEQ ID NO: 154842 - protein, 120 aa, Heterodera glycines
  Coding regions on vcDNA: vcDNA=SeqID_81265; Strand=-; Position=1 -211,675-826
SALPPTGAASTTATVSSPIGTVIASPHHRTPLAGSENCLLIASTSLHQPSGGTPAESTTIPATAKMHRQYRNPRVRNGIPNVRQGREWDNEHQRIGCRNANIGTQSNRGRTVEHGQRSAF

SEQ ID NO: 154843 - protein, 663 aa, Heterodera glycines
  Coding regions on vcDNA: vcDNA=SeqID_81266; Strand=+; Position=1-1991
  Homolog annotation: Hit_ID=NP_704578.1; Match level="QueryCoverage =81%, HitCoverage=70%, E-value=4e-18, Identity=21%"; Hit description =hypothetical protein [Plasmodium falciparum 3D7] emb|CAD51721.1| hypothetical protein [Plasmodium falcipa
MSNLFYVLLPSDTPGYRNKPNKFRVHLPRSLTFSGQWLCGLHSIIYTNSWPAVGTTENQWVKVHFRNGKTIKIDIPTGSYQNEEELENAINDVIITGTEKSFVAARFKRQQNLAEDGVDLFFHYNPDDYWERIEEERQKYNEMMKSIEKKSSERANEMDNDRKRKIEEEEIDPLQKQSLIKRARLDALEAEARQRDEGKEEKENRTGQEFLKMYPDNYKEKLNEVRLELIRDLFKIQDHMKKYQGIADGRKIQELNKEALRMRTAMKHRRKNLNAFSKAVFNKDLQISAEEFERTNYEQNKDYVESFFDSYPTDYWEHIHKKYQGLQEDYRKIREYREQQQFTTEEQKIKSIQSEIDQLRRLIDYRRKRFAALEYEAKKRDSQQQPVALALTHGEVLKERISQVIGNRPHDDRGDDQTTKTNGQSLVSLIEQLQKERDESNAVSEKETQGDKLTVKSKSDVKGEGKTHGDVLKNKLEEIGDNEDGGDDDDDDVDTENKKTRGEILADKIRNRSENEEKTEGKIYGDVLKNKLEEIGYNDDDDDDDNNKKTRGEILADKIRNHSENEEKIEGKTHGEILKEKLYAANDDDVQLVAPKGEIFKERIESIKTTDKTENKTHGDLLQNIIASRHVERIRFKYIKERRKFSVYFNEQIIAYIELSAQL

SEQ ID NO: 154844 - protein, 39 aa, Heterodera glycines
  Coding regions on vcDNA: vcDNA=SeqID_81267; Strand=-; Position=1-120
LDILWEPKFIPTVPTIDQQHRSFSRSQHWTQDGVDQFDH

SEQ ID NO: 154845 - protein, 122 aa, Heterodera glycines
  Coding regions on vcDNA: vcDNA=SeqID_81268; Strand=-; Position=1 -50,352-397,460-732
  Homolog annotation: Hit_ID=XP_414450.1; Match level="QueryCoverage =54%, HitCoverage=21%, E-value=4e-16, Identity=52%"; Hit description =PREDICTED: similar to Sec13l1 protein [Gallus gallus]
MTHIQLEEITAQIVAFIKVIVWREVNGKWQKSYEYNQHEASINSISWAAPEYGLIFACCSTDCSISIIQFMGDVWSPVKIANAHDEVVPFNSNLAHDSEMFLGMQRGELGTRQTTAVGLGCQ

SEQ ID NO: 154846 - protein, 52 aa, Heterodera glycines; identical to SEQ ID NO: 142931
  Coding regions on vcDNA: vcDNA=SeqID_81269; Strand=+; Position=1 -69,125-214

SEQ ID NO: 154847 - protein, 52 aa, Heterodera glycines; identical to SEQ ID NO: 142931
  Coding regions on vcDNA: vcDNA=SeqID_81270; Strand=+; Position=1 -69,125-214

SEQ ID NO: 154848 - protein, 75 aa, Heterodera glycines
  Coding regions on vcDNA: vcDNA=SeqID_81271; Strand=-; Position=1 -52,212-387
MEKIPRHSSEVLSAFIKTDFTPFFDYTSDIWMDGIGSEGEEKEKEEEEGDKENAQLEIVPNWHNQSARKSEGGNI

SEQ ID NO: 154849 - protein, 177 aa, Heterodera glycines
  Coding regions on vcDNA: vcDNA=SeqID_81272; Strand=-; Position=1 -174,308-388,451-529,581-647,899-1031
  Homolog annotation: Hit_ID=NP_500016.1; Match level="QueryCoverage =46%, HitCoverage=13%, E-value=1e-16, Identity=46%"; Hit description =putative membrane protein (4B684) [Caenorhabditis elegans] gb|AAC02592.1| Hypothetical protein F58H7.1 [C
MGVFIGTIVCLLVVALVRCAVAQFPQNPVPIGTVIVAEQHFATTTQMPINPASELVDQVESIDVSSTQMIITTTRQGPPDTARVAISIVDTVTGEELPPMNLTGVLLVLTRGRYTVNWLQPNRWYGVNFRAEQQKIKTFFFLVIRAERYGEHGRSLENLVLTMRWEQHPDERQAEKI

SEQ ID NO: 154850 - protein, 102 aa, Heterodera glycines
  Coding regions on vcDNA: vcDNA=SeqID_81273; Strand=+; Position=1 -84,572-670,1211-1336
  Homolog annotation: Hit_ID=CAE68290.1; Match level="QueryCoverage =85%, HitCoverage=29%, E-value=6e-16, Identity=38%"; Hit description =Hypothetical protein CBG13975 [Caenorhabditis briggsae]
MPIAKCVNIVISDGICAVGWQDTHSFRSIGSWSYQSEYLRLVVDERDVFLGDFYDNQEWLLVSLVAVIGFHAPINATGRRESKFRLGVMTLVKLKITHEWCH

SEQ ID NO: 154851 - protein, 292 aa, Heterodera glycines
  Coding regions on vcDNA: vcDNA=SeqID_81274; Strand=+; Position=1 -42,851-968,1021-1370,1787-2155
MFIPISCDFLSRIFDLWLKKLLLTLQGRRGAEQLKKRREAQTEKARQAYLAKRTTQQPNPNAEMPQQDEPGPSTSAASVEEAMEPPPPTPAPVPTPEMYEEILEFGFSLPSTSVTPIGDLVPFSTTPTASMDTGETTSPPLAIDERSERIEQLEKQLKDRDDTIKFLREQVLVIKQKICAPLHYQKIETTAGVGFVCLDVKAALEFRLSSAKDNSISFDDELLIKLSGDHGQGFTKLTISFGQALRNNSASNDFIAAVFPAKDTRENLEQYGALLWPQIDQMNALINRPIKW

SEQ ID NO: 154852 - protein, 211 aa, Heterodera glycines
  Coding regions on vcDNA: vcDNA=SeqID_81275; Strand=-; Position=1 -155,217-394,449-631,685-804
MSISYRPLLFIAAFLFIGCHAGVEHVRLASLSCATAKDGEINGFRAVDDGLLIGSDATNATGAMILFGFQTNKKEDLSFKVFAPTSASCLSSVNNFVVSGRFCELGALETETESANCPDGGGAGSGCNSRSVTCQIKTVKEVAELPDGRVFKVNLGNLTQVTALCTKWKAYFTNVRQVMESVGGGEPCVIGDSASGFPVWLIVLIVVVVIW

SEQ ID NO: 154853 - protein, 249 aa, Heterodera glycines
  Coding regions on vcDNA: vcDNA=SeqID_81276; Strand=-; Position=1 -181,240-431,722-936,1591-1749
MRGLQLDLQTGNAVQWRDPAGGYEYANQTQLNWQPTDLKLMKQNGMPDGTLMYPTNFVLRPVGQSEFVMDLFKHIYLHKNPEIYTSTTEDTVVAPQLAAIGLAIAYNGARGNTKAQIGKVLLDEDSSEQLMHNNNRQFLQEIQLLPSNDVFKLKMESKMFLSDSFDVLDQFNTKTNTFYGNNFEKINFRQGTEAANFRFIGVPIGSDNDQLHLAIVVPNNQIDLSVVIKEFKSFKLFDLLTKSPTTEAK

SEQ ID NO: 154854 - protein, 77 aa, Heterodera glycines
  Coding regions on vcDNA: vcDNA=SeqID_81277; Strand=-; Position=1 -58,307-482
MKIGIFSVEIKEWPGDDGNDGGGIPFTFPIEFRNRLCWNLFSSQIPDVFVGITLTLSGKCVFLASIFIHIGRKGEFY

SEQ ID NO: 154855 - protein, 38 aa, Heterodera glycines
  Coding regions on vcDNA: vcDNA=SeqID_81278; Strand=+; Position=1 -35,1116-1197
MVSVLTLTQLLSYNKGIGLTENQGYQFSGFKTLIFSKN

SEQ ID NO: 154856 - protein, 70 aa, Heterodera glycines
  Coding regions on vcDNA: vcDNA=SeqID_81279; Strand=-; Position=1 -63,122-271
MRMEFVGQNKSSSATKSFFPMVPPFPLRMNRVQNSDILPQKANENFKNLHENKNDCCLFGDGTQIDDLFA

SEQ ID NO: 154857 - protein, 55 aa, Heterodera glycines
  Coding regions on vcDNA: vcDNA=SeqID_81280; Strand=+; Position=1-187
LISSQKSCQLKTAKKAELLKFFISIFFYSSKFSVIFSRLIEPVKSFRMISRLFDS

SEQ ID NO: 154858 - protein, 154 aa, Heterodera glycines
  Coding regions on vcDNA: vcDNA=SeqID_81281; Strand=-; Position=1 -110,203-344,406-509,700-806
MEIFDEFIVVDEEAIGQFSGQFTGKTSFREMIRFAELEFMRSDFHALQITDVGNASSSNPSNFEPLAQIVRWDWDTNGAQQIISTHTLNKGSEVNYNNIANDSSIVIRILKKRETKKKIQFPAPSSSLPDDDLTMKIGEKQVKHHHQTATLSIT

SEQ ID NO: 154859 - protein, 78 aa, Heterodera glycines
  Coding regions on vcDNA: vcDNA=SeqID_81282; Strand=-; Position=1 -50,95-143,193-331
YPITQPPSAANNTCLSGEIDGQHGVTIARTNRGISRRSDRRDGHGRRPSGNGFIGPAIGHSVRLVNNALMRMNTIVLH

SEQ ID NO: 154860 - protein, 44 aa, Heterodera glycines
  Coding regions on vcDNA: vcDNA=SeqID_81283; Strand=+; Position=1-320
HSLIFYNFTYSKSYYFLIVNQFDVHSDLDIFQKWLTQLQPKNKK

SEQ ID NO: 154861 - protein, 661 aa, Heterodera glycines
  Coding regions on vcDNA: vcDNA=SeqID_81284; Strand=-; Position=1 -23,72-472,517-859,905-1476,1520-1711,1901-2031,2083-2406
  Homolog annotation: Hit_ID=NP_001004509.1; Match level="QueryCoverage= 98%, HitCoverage=46%, E-value=3e-68, Identity=28%"; Hit description =si:busm1-180o5.3 [Danio rerio] emb|CAD60788.1| novel protein similar to DNA polymerases [Danio rerio]
MLDEALASYCTNDVEILMAALVAFRREFFEISRRQEYVDGIDDRENHDGIDVLRECMTIAGACMRHFRTNHLPDDHLAIVPERGYDNAQNQSLLALRFFHWYSEEYGVEVQTAHSAGGEKRIGPYSLDGWIEAEGRAIEVHGCTWHGCKKCYPIDNMLLPNGKTAGQVRERDAKRMEYIRARVNRVDVYWECKITSMLERSKAMRKSFANYVDDGPLVIRDAFTGGRTGPLKLLRKAGPGEKISYYDFTSLYPYINFTTRYPVGHPKVHVLNQQVQWTSAADNPFPLALLKVWVVPPRKIDVAVLPVKVDDRLCFPLCIACAKEYPTGGVDNDYHCQHTDQQRGWVSTCTSIELNAALDEGYRVTKVFRVLEYEQSDDKLFRPYIAEFMAQKIQASGFDSSIRGDAEKEEQFVRECAEQFGINIDPAKMVVNKGKRSLAKLCLNNLWGRFSLRNFGLCQTLITDDPVTLAEYLDNKSIEVTSIDQLDETHILITYLHKKDWVDEHACSNIDTDSLILVHPEERCPLKIGPHLGQFTDEYPDHDIVEFCSGGAKQYGLCLRRKGAGADAEKEYVLKVRGLTLNYDVINNQGMRYETFKEEVVRYATTGDYEPIIVTYPNFLRPNIREGGRVVSMPLQKCYRPYVGKGIIGSDFNVKNFGHTL

SEQ ID NO: 154862 - protein, 251 aa, Heterodera glycines
  Coding regions on vcDNA: vcDNA=SeqID_81285; Strand=+; Position=1 -144,193-306,360-516,633-772,1094-1294
  Homolog annotation: Hit_ID=CAE56905.1; Match level="QueryCoverage =98%, HitCoverage=74%, E-value=2e-74, Identity=49%"; Hit description =Hypothetical protein CBG24746 [Caenorhabditis briggsae]
MSSCRGIVMGGTKNYFDKICVPHHGLELSFVDLTRLENLENEFKPNTKMVLFETPSNPLLKIVDIEAVCRMVRARSKDCVVVVDNTFMTPYFQRPLELGADVTVQSLTKYINGHTDVLMGTVVTNKEQLDQHIYAQQIYAGAVPSAFDAFLVLRGIKTLPLRMRQHMENALAIGRWLEKDPRVEKVFLVARSLGGFESLASLPAAMSRDSVPAKVRAQTGISDNLIRLSIGCEDKADLINDLDMAMRVATE

SEQ ID NO: 154863 - protein, 85 aa, Heterodera glycines
  Coding regions on vcDNA: vcDNA=SeqID_81286; Strand=+; Position=1 -91,515-600,658-738
MPEMGVKNEFVTTSWTAGFNHKISVLKCSDGRTGPLKLFAEPKEDEKISVYDIVSLYPWVNYDTEYPIGVPKIIYPSAVQMLVNW

SEQ ID NO: 154864 - protein, 291 aa, Heterodera glycines
  Coding regions on vcDNA: vcDNA=SeqID_81287; Strand=+; Position=1 -206,265-313,427-587,688-896,977-1086,1128-1268
  Homolog annotation: Hit_ID=NP_001004509.1; Match level="QueryCoverage= 93%, HitCoverage=18%, E-value=5e-34, Identity=31%"; Hit description =si:busm1-180o5.3 [Danio rerio] emb|CAD60788.1| novel protein similar to DNA polymerases [Danio rerio]
MKLDERLLFSCCHRCASQFRTLNTRCQHVCAHSDAQRAYTGNYTHIELAMALRYGYRVDRFWRAWHYEQSDQIFKEYVRLLLKLKIEASGFPDGITTEAQRHQFIDAYATVYAVTLDVDRVHKNPGLRFIAKLMLNSLWGKFSMRNELGTNKVITRPQEFYSLVLDHKVEISAIIPLSDTAIRVMYRHKKSFVEEHSSSNIVLSLWTTSRARLKLFEYMMQVQNTDGAELLYTVSYRRRTYAFVTDTDSVIVLHKRDRVPILTGEYLGQMSEEYAGFEIQTFICGGMRYAN

SEQ ID NO: 154865 - protein, 196 aa, Heterodera glycines
  Coding regions on vcDNA: vcDNA=SeqID_81288; Strand=+; Position=1 -150,237-336,403-744
HNSVAIEKVKDQRFDALAQCHVINGTDEATKKPCGIEFRLPHGGGNCDDGFWICYQPVLQRGRTLDTSTNYKAKRTFAIDTEKDHSITKECAQRMPKDSGKSGTMLWRGIKLRTVPVPSDKNKGKHSSSSTDNDDEVTILETTFNDSLKMFVFKINSNVVATAPWRPGLANQCQIENDNFELHHFDHFLIILYSFC

SEQ ID NO: 154866 - protein, 42 aa, Heterodera glycines
  Coding regions on vcDNA: vcDNA=SeqID_81289; Strand=+; Position=1 -63,110-172
MLLFADPLVKQIDDKTFVPNEENSKFSSGIINTETDECVGEN

SEQ ID NO: 154867 - protein, 131 aa, Heterodera glycines
  Coding regions on vcDNA: vcDNA=SeqID_81290; Strand=+; Position=1-396
  Homolog annotation: Hit_ID=DAA01153.1; Match level="QueryCoverage =83%, HitCoverage=9%, E-value=1e-13, Identity=40%"; Hit description =TPA: RTl1 [Mus musculus] ref|NP_908998.1| retrotransposon-like 1 [Mus musculus]
MEPKFPFICQRPITVVEEDERAQVTDSEYEDGKGVEEEGEEEDGEEKVKEEVEEEGEEEDMDDPSGERAILRAILEKNKPKQSEEGEIVDKKEEERDETKEDKGKEREEEGEEDEEDGTSSVVTDFEFQAY

SEQ ID NO: 154868 - protein, 262 aa, Heterodera glycines
  Coding regions on vcDNA: vcDNA=SeqID_81291; Strand=+; Position=1 -284,713-1217
MCNLSTFLSIFLLPSTVYSTGDDRVFHHNRMNVVRRQLLQLPHFLNGCAVGGGGGSSGKKQKQYNQQLQQQGQNGIWDSNEVEQYRNDYQLNSIRPCYFSPVQCLLVTPGQHRAFVNHPKFNQQQKQQQQHNFEQQIKVAGEKGTAVKAIKGSSKIWHRQSPKESAKDGAQPRHEQYDAGDVQVVHQDEAVQHQQHLNHHNRRRHRLLTSGQTLCQHRHGGIGGDANANTTDGGRIKQWRRKYGERKLRRHPIFGNPFRIGL

SEQ ID NO: 154869 - protein, 25 aa, Heterodera glycines
  Coding regions on vcDNA: vcDNA=SeqID_81292; Strand=+; Position=1-77
MALNLIYLLTRSLSAPAPCMKREKD

SEQ ID NO: 154870 - protein, 269 aa, Heterodera glycines
  misc_feature (241)..(241): Xaa can be any naturally occurring amino acid
  Coding regions on vcDNA: vcDNA=SeqID_81293; Strand=-; Position=1 -166,1016-1128,1249-1344,1396-1475,1529-1639,1721-1805,3272-3393
  Homolog annotation: Hit_ID=NP_496906.2; Match level="QueryCoverage =96%, HitCoverage=41%, E-value=2e-49, Identity=41%"; Hit description =RUN domain containing protein (2O146) [Caenorhabditis elegans] emb|CAA21666.2| Hypothetical protein Y51H1
FLRRSQYFKRMAQPPTNIGTAMRLKKMRWKRDVEKKCEKRTESFLKTLSGRKSQISSELTQALCTVIEAVFIHGLRDAFFLKGSRHSNRPSPNFWPFVSKYTQRSIKTQISTLNQIHTEIGRARAWIRIVLNAWIRIVLNEYSLDHYISMFVKDTRQMKQFYAQFYADDAFLRDSECVNSLGVHLKRINGLKITAPTNSSLLNTWTPSPLSLAGLIKTAPSIGGAFKFSPSPSGHYVKKYXPIPAIQKKILIENFDFFLGSGLEIRQKR

SEQ ID NO: 154871 - protein, 279 aa, Heterodera glycines
  Coding regions on vcDNA: vcDNA=SeqID_81294; Strand=+; Position=1 -20,77-181,255-530,578-1016
  Homolog annotation: Hit_ID=AAL78214.1; Match level="QueryCoverage =52%, HitCoverage=77%, E-value=4e-11, Identity=28%"; Hit description =putative esophageal gland cell protein Hgg-20 [Heterodera glycines]
MSSKMILLIAVPMFVGGCAILLKYWDRLKKPAKPRENHKKKIFISADCWLCVFDLLPPSQLGLGIAMISHRFGIYVDEHFKTRKWALKFIQIHSKIRENGTKEMEIVKNYGKELPIPQIQLPRKVIGFECIEIFFINQNVIAFLHRFRQLFAKCPINLSIHTNNDRILDFIFHNIWPMFGKNINRLELSAATFHRLRHFVPSILNDCPSLRIVKFCDADNFFPEFPADDSAMASNGQTMAKWLFTALPDNVPKMLKCSLDKDAGNLVQKFEAFKTVLTN

SEQ ID NO: 154872 - protein, 43 aa, Heterodera glycines
  Coding regions on vcDNA: vcDNA=SeqID_81295; Strand=-; Position=1 -38,381-474
MNHMHMLFISLNGRIIDYFKFPCNRYVHSYILSTTSNMFFILL

SEQ ID NO: 154873 - protein, 120 aa, Heterodera glycines
  Coding regions on vcDNA: vcDNA=SeqID_81296; Strand=+; Position=1 -47,106-381,1276-1315
  Homolog annotation: Hit_ID=AAL78214.1; Match level="QueryCoverage =80%, HitCoverage=51%, E-value=1e-10, Identity=33%"; Hit description =putative esophageal gland cell protein Hgg-20 [Heterodera glycines]
MSDNGNEAEDEMAQAIFIAADCWLSVFDWLSPRQLGLEIALINHQFNIYVDEHFKTRRWALKSIEILRKIGENGTKEMKIVNYAGEEVPIPQKPLPKRVVGFKAISIGLIDETPDPSDLQ

SEQ ID NO: 154874 - protein, 179 aa, Heterodera glycines
  Coding regions on vcDNA: vcDNA=SeqID_81297; Strand=-; Position=1 -24,115-246,886-1017,1327-1458,1535-1654
MDAMEGDEAQQQNFSADQLDKLESGFQKSKYFSASEREILAKEIGLTETQVKAQKQKFPIEQLIKLECEFETIRYPDIFMRKEMAKETGPTEKQINIQPQIISADQLERLERRFSETRYPYPVQMGNWAKQLGLEMHQVNFWFLNRQAQHRQEEKKAKEKWLEGRRDQWKLQIPTEGTY

SEQ ID NO: 154875 - protein, 51 aa, Heterodera glycines
  Coding regions on vcDNA: vcDNA=SeqID_81298; Strand=-; Position=1 -52,464-567
MCSADPSLSLFVLGMGVGQTNTFFAEINTHSSKVPIEETQHTFCGVNNGRK

SEQ ID NO: 154876 - protein, 19 aa, Heterodera glycines
  Coding regions on vcDNA: vcDNA=SeqID_81299; Strand=-; Position=1 -10,82-131
MTTLIPCSVTRNTTMKNVM

SEQ ID NO: 154877 - protein, 49 aa, Heterodera glycines
  Coding regions on vcDNA: vcDNA=SeqID_81300; Strand=-; Position=1 -127,309-331
MFGSANLQSLAPLSSTATMANNNDDDNDGFAMAMMRRRPPFADDNLYEF

SEQ ID NO: 154878 - protein, 83 aa, Heterodera glycines
  Coding regions on vcDNA: vcDNA=SeqID_81301; Strand=+; Position=1-250
MPALCEEELYSLLMQHDKTAHQQMADDGASLPWQTHHYHHHYYSPSSLSKKAVPNFANLHFQTFLELIATLYERETDQIVRCS

SEQ ID NO: 154879 - protein, 74 aa, Heterodera glycines
  Coding regions on vcDNA: vcDNA=SeqID_81302; Strand=+; Position=1-225
MDPINNPIKSIHLAAKNDGRRADGARQPKPGDHLPNVQVDGDPVRVLHCAQLCHDVVRDQGEAVVALHAVHEEE

SEQ ID NO: 154880 - protein, 126 aa, Heterodera glycines
  Coding regions on vcDNA: vcDNA=SeqID_81303; Strand=+; Position=1 -127,623-876
MALKKWAANVRTANVRAANVRFGWGRKCPSRKCPGRKCPGRKKHISKIIRNAYLRIFQILRVLKSREIKTLTAAYKTFVRPQLEYATEVWNPNLKKDIDKIERVQKFSQEKHLENVVLCTKNMGKD

SEQ ID NO: 154881 - protein, 27 aa, Heterodera glycines
  Coding regions on vcDNA: vcDNA=SeqID_81304; Strand=-; Position=1-142
IWQHGKSYSELIAFSKSLNSFALLICT

SEQ ID NO: 154882 - protein, 393 aa, Heterodera glycines
  misc_feature (392)..(392): Xaa can be any naturally occurring amino acid
  Coding regions on vcDNA: vcDNA=SeqID_81305; Strand=-; Position=1 -1153,1326-1369
  Homolog annotation: Hit_ID=AAT73694.1; Match level="QueryCoverage =93%, HitCoverage=19%, E-value=1e-71, Identity=40%"; Hit description =putative polyprotein [Oryza sativa (japonica cultivar-group)]
KDSYPIPTWTILMYLGNKHYFTILDMPGYWQVRVKEEDIEKTAFTVPGGLYEFLVLPFGLSNAPATFQRLMNKILFEYINEFVFVYLDDILIASETFEDHMVHLRKVFGKLNENGMKVKAEKCGFALDQTPYLGHILTREGLAKDPEKYKPIKEFPMPKTIKELQRFLGMVNWHRKCIMNFAKIAAPLTKMLKKQDAIIWSDEAKKSFESLKSLIVDEVVLKYPDFNLAQNDPKFKFHIFSDASKGLGAVLCQRDQSGKMRPICYASRRCKQTESNYGPTVLECLGIKFAVQKFKHFIAWLPTIVFTDHKALPQIKSKNSVGNSKVDRWIMELGAPFQLEVIYKPGKENHVADALSRAVNSKPLNLEEKGNENCAHISALMKKSFNLNSDQXI

SEQ ID NO: 154883 - protein, 31 aa, Heterodera glycines
  Coding regions on vcDNA: vcDNA=SeqID_81306; Strand=+; Position=1-96
GTGSANWATSGVGSPNLPLINSSLDANCSSG

SEQ ID NO: 154884 - protein, 129 aa, Heterodera glycines
  Coding regions on vcDNA: vcDNA=SeqID_81307; Strand=+; Position=1-387
MCLSALFINGLKKDSIRAELIKMGVNEMKFKDAVETAVLLEQSELDAEQIGGHKKAEVAKVFAPKGGRKSSAPTQQQQMQCHRCGRNGHRNNECPNKDSKCRKCGNVGHWAVMCKTKQGSNWPRRQGKP

SEQ ID NO: 154885 - protein, 70 aa, Heterodera glycines
  Coding regions on vcDNA: vcDNA=SeqID_81308; Strand=-; Position=1-211
MGPTNESDGPKKQKKGGRRRDGMLKSTPKPKGMAAASTALRHLSPLHKVLLVVVALLQWTATGGRAVLLQ

SEQ ID NO: 154886 - protein, 124 aa, Heterodera glycines
  Coding regions on vcDNA: vcDNA=SeqID_81309; Strand=-; Position=1 -123,177-428
  Homolog annotation: Hit_ID=NP_497235.2; Match level="QueryCoverage =100%, HitCoverage=15%, E-value=4e-42, Identity=70%"; Hit description= g protein-coupled receptor kinase w02b3.2 (80.9 kD) (3B295) [Caenorhabditis elegans] gb|AAA64322.2| Temp
LLFMDQIEEVSSELQQVKGETAIVVKLKEGLKESKVILTNQDEISLKEWHTSLRTVTNQMHSFGGSMARPFQAHRVSQELLQRMGRKAIKIYGVNHDPMLQENERPGSVTRAFLNRAASVDSGI

SEQ ID NO: 154887 - protein, 302 aa, Heterodera glycines
  misc_feature (181)..(181): Xaa can be any naturally occurring amino acid
  Coding regions on vcDNA: vcDNA=SeqID_81310; Strand=-; Position=1 -54,102-173,223-328,395-537,640-867,1035-1153,1203-1278
  Homolog annotation: Hit_ID=CAE64130.1; Match level="QueryCoverage =91%, HitCoverage=27%, E-value=4e-56, Identity=44%"; Hit description =Hypothetical protein CBG08746 [Caenorhabditis briggsae]
FRFRDSVGSFNSPRYPSNYPLDAECTYHIVGPSNAYPLDAECTYHIVGPSNAQILLFFKQFALFEENSMDECNDWQFALFEENSMDECNDWLEIFDVFRENGGETLKLQAKHCWHVFPGPTVSAHGSHEMRVVFHSDNFGTANGFDARYEIRPAATKDDNRSERTADDGAFWSGQRMNEFXKNSNNLASPGFPVKYTKNLTCDLEIRVREGHQVLLKANMFNVEGQMTEEKCNCVAKVRDDSGGLFVFCCERCHFFTFYVSSSNSIRLSFLTSPEKVFLTSPEKVGHFVRPFAFSLFVLTYF

SEQ ID NO: 154888 - protein, 30 aa, Heterodera glycines
  Coding regions on vcDNA: vcDNA=SeqID_81311; Strand=+; Position=1-90
MGQRCDKCTRHQADTETEEQTEWEAKRMTN

SEQ ID NO: 154889 - protein, 127 aa, Heterodera glycines
  Coding regions on vcDNA: vcDNA=SeqID_81312; Strand=-; Position=1 -300,476-558
MPIAAFTDCDHVFDSPRSGHFSLPVFPREANADSSALFASSDDENAENDEAPNGNYERVPSSSWQPFVTATAAAEEAEEAGKRDEANGIVRYQSLPENIQCIYTFVAQPRERVKLQIEQFQLEGTTN

SEQ ID NO: 154890 - protein, 565 aa, Heterodera glycines
  misc_feature (409)..(409): Xaa can be any naturally occurring amino acid
  Coding regions on vcDNA: vcDNA=SeqID_81313; Strand=-; Position=1 -1572,2497-2604,2923-3061
  Homolog annotation: Hit_ID=NP_491240.1; Match level="QueryCoverage =90%, HitCoverage=38%, E-value=6e-77, Identity=34%"; Hit description =zn-finger, CCHC type and RNA-directed DNA polymerase  and Integrase, catalytic domain containing protein
TDKSEKVIEPPIRNDAQKNSQLKEAAAQKHRRRKTKDHKPGKKGPAAQRARREDIKYINTSSFGQADVLSRLIANYPRPEEDILIANICTETDCYINTILQTATDQLPITKAEISEWTPKDEVLRKISDHTKNGWPQKCTDPDISPYFPKRKEILEIDGVLLYGKRVIVPTQLRERIIKALHMAHPGIVRMKALARQHVYWPGLDLEIERMVRQCEDCQSAQKSPPKAPLAPWTSCSRPFQRIHIDFAGPCSDGHSYLILIDSFSKWPEVYRMDRISTPATLQVLRSIVYRLGFPEEIVSDNGTQFHAAEFKEFCSEFGIKHTFTPPYHPQSNGQAERFVDTFKRAMKKCAKDGKFWAEKMLLAYRTTPNSALNGLSPDQLFFGRRLRTQLSLVHPKDRPSQNPQITSXYARKMARQFDQHHGSKSVEFLPKDPVLLLNFNRGKRFWLNGTIIERLEKSPTYRVHVPALGRAVHRHANQLRHRYGRKGTPRTDQSSALGKLGDDEYNKYRDSISPSQPETIQLVKDSALTLANPPVATHAIHTRPQQWRDPKGKTPQQPKRANNA

SEQ ID NO: 154891 - protein, 803 aa, Heterodera glycines
  Coding regions on vcDNA: vcDNA=SeqID_81314; Strand=-; Position=1 -1407,1554-2556
  Homolog annotation: Hit_ID=XP_318187.1; Match level="QueryCoverage =88%, HitCoverage=90%, E-value=1e-125, Identity=35%"; Hit description= ENSANGP00000016242 [Anopheles gambiae]
MASSSLAHATLASSLDNRITKFQYDSECGNTFDRWFKRFGVLIEEDGKELPEQTKVRLILGKLGDDEYNKYRDSISPSQPDQVKWGESLTKLKDLFAETRSLFVRRFECFQIRQKPSQDITSLVAHINAACENADLSLKKEQLKCIILVITLRDEHHDLRQKCLKMLEEAQKNGTQVTLKQIEEELRTIQLVKDSALTLASPPVATHAIHTRPQQWRDPKGKPPQQPKRTNNAKEQPARPPNTNYGKASRGSPTHPCGSCGESDHWRTDCRFKDATCHKCQGQGHIAKACRRSSNQAKNRRERSVHTVVVKSHCMGIGTAAGRWWRLTFIINGIKILMNIDTGAQATILTLKTWKKLGSPKLDKPDIETRNCNEVPFNVEGKFVCTVCQPNQAPKKLVAYVSSEINYDLFGLPWIEALEVIPREIMHPDIHPKAQPAPAEINAMAIPQPTHKILDLESLTKALQADFSDIGAIKPIEFSHWAAPILAVMKKNGKTRVCIDFSTGLNNSLELNRHPLPRPEDIYTAISGSVYFSNLDLRDAYLQMELDEESKHLCGINTHRGLFQCQRLPFGVKSAPSIFQHLMDQIVSGIPGAFAYLDDGIIASKTLEEHVCSLYKLFKRIQEFGLKIQLEKCKFLQPELLFLGHVISAKGIRPDPGRSEVIRQMPPPHDLSTLRSFLGALNYYGRFIKSMREIREPLDQLLRKDVKWEWTDEQQTAFKKAKEIMLSDLLLTHFDPFLPIVVAADASKDGIGTTISHIFPDKSEKVIEHASCTLNDAQKNYSQIEKEALALVFAVHKFHRMLF

SEQ ID NO: 154892 - protein, 217 aa, Heterodera glycines
  Coding regions on vcDNA: vcDNA=SeqID_81315; Strand=+; Position=1-651
  Homolog annotation: Hit_ID=NP_510849.1; Match level="QueryCoverage =100%, HitCoverage=16%, E-value=2e-57, Identity=49%"; Hit description= predicted CDS, zn-finger, CCHC type and RNA-directed DNA polymerase and Integrase, catalytic domain cont
MDQIVSGIPGAFAYLDDGIIASKTLEEHVCSLYKLFKRIQEFGLKIQLEKCKFLQPELLFLGHVISAKGIRPDPGRSEVIRQMPPPHDLSTLRSFLGALNYYGRFIKSMREIREPLDQLLRKDVKWEWTDEQQTAFKKAKEIMLSDLLLTHFDPFLPIVVAADASKDGIGTTISHIFPDKSEKVIEHASCTLNDAQKNYSQIEKEALALVFAVHKFH

SEQ ID NO: 154893 - protein, 100 aa, Heterodera glycines
  Coding regions on vcDNA: vcDNA=SeqID_81316; Strand=-; Position=1 -86,519-735
MDWTIRQWHQGQSVSNGLDNPSVDIKDNPKLRTENNLRRSSKEYYDVFERFVEKGRRILLVREKEGEKRKAKGKLTQFKWTNERMNEAEELGEGLGRGDG

SEQ ID NO: 154894 - protein, 280 aa, Heterodera glycines
  Coding regions on vcDNA: vcDNA=SeqID_81317; Strand=-; Position=1 -277,321-603,648-928
MAQRVGFTQIKYTRTPAEFHQLLDDPTLDKLDFVHVSEHMDRVVVRKRPEFAKAPLTNCLPVAIYVTSYARLHLYSYMEKVIALEGAELLYCDTDSIYYVNKMGGRCVPEGEALGQMKREHVDRRIVEFVAGGPKNYGIRHTARDGTDERANLKIRSFRLSYATQQLLNFEAMKDLTLATYNIDGPIDDVIDNDDLYVYGGGGAHRCIRVTFPQIDRNVRSDVYTCEAHKDYRPFYAKGRVRPGMQTRPFGYVEDVSHPPIQPTAERRKRTLIDPDPTRP

SEQ ID NO: 154895 - protein, 67 aa, Heterodera glycines
  Coding regions on vcDNA: vcDNA=SeqID_81318; Strand=+; Position=1 -76,1266-1393
MPPLSLEDDSLATHSRLNESRISKGWSGFIHFLFFTKFENGFFYSFRSCKNDLNIAGKYLDMRTFYM

SEQ ID NO: 154896 - protein, 116 aa, Heterodera glycines
  Coding regions on vcDNA: vcDNA=SeqID_81319; Strand=+; Position=1 -280,496-566
MIKLNKAELMEVIEHCCLMDPELCCKLALTRTRMLLNVLLQVIRIESRWTSGAGFIFELLIAFTKFCEPSLNCRKRECIIALTFTNISKSLGWEGQNFFINPIEKANEDGYGETLK

SEQ ID NO: 154897 - protein, 24 aa, Heterodera glycines
  Coding regions on vcDNA: vcDNA=SeqID_81320; Strand=+; Position=1-73
MDQRNNTDAEVQKISLNIQQLSQK

SEQ ID NO: 154898 - protein, 94 aa, Heterodera glycines
  Coding regions on vcDNA: vcDNA=SeqID_81321; Strand=+; Position=1 -117,236-340,441-503
  Homolog annotation: Hit_ID=NP_492422.1; Match level="QueryCoverage =90%, HitCoverage=30%, E-value=6e-22, Identity=56%"; Hit description =syntaxin (1J578) [Caenorhabditis elegans] emb|CAB04327.1| Hypothetical protein F36F2.4 [Caenorhabditis el
MAFLKALSALEQDIGDINQIFKDLAHLVHDQGEMVDSIEANIEHASIHVQQANTSVAQAVHYQAKARQKKLMIYAFCIFVLLVLFLVLYLWLKH

SEQ ID NO: 154899 - protein, 55 aa, Heterodera glycines
  Coding regions on vcDNA: vcDNA=SeqID_81322; Strand=-; Position=1 -67,117-217
MGRGGREGGGREKEEGKERALNEEAMRSKKTEGESGGETKKGEPNENGHMENDVL

SEQ ID NO: 154900 - protein, 26 aa, Heterodera glycines
  Coding regions on vcDNA: vcDNA=SeqID_81323; Strand=+; Position=1-81
MSKCWRTFCSRWNWATPSTTIPTTTR

SEQ ID NO: 154901 - protein, 58 aa, Heterodera glycines
  Coding regions on vcDNA: vcDNA=SeqID_81324; Strand=-; Position=1-175
MLNGERDWSPLGTDRRQPVRLVHIKRPNTVTETGPMDVAQKETFWRRLSTLKGYTEVA

SEQ ID NO: 154902 - protein, 651 aa, Heterodera glycines
  misc_feature (600)..(600): Xaa can be any naturally occurring amino acid
  Coding regions on vcDNA: vcDNA=SeqID_81325; Strand=-; Position=1 -26,86-281,633-1006,3192-4414,7812-7926
  Homolog annotation: Hit_ID=AAS07042.1; Match level="QueryCoverage =99%, HitCoverage=24%, E-value=2e-91, Identity=32%"; Hit description =minus agglutinin [Chlamydomonas reinhardtii]
DRPKLSSPAPPRPPAPPPPPPPPPAPPRPPAPPPPPPPPPPPPPPPGRRPWRGPSPPPPPPPPGRRPRPPPIPPIPAPSPPGSPPPHPKRPSPPRPTPMPRAKAKIEPRPPPPPPPQRPSVKIEQKPKLELKPSTPKPDHPTPAPKSKSGPKFEQLDSRPSTSRQAGYFPPPTPKIEPKYEPQSTKRPVPYQIPKKEPKINETPPQQQPPPAAESPPRFDEEEEESQTKDTGIAPVTPKEIDDDEGLLEESPPRIEEEEAQTKDIGIAPVTPKTKSPPPAATPSPIKPSITTPSAPTTKPTTTTTTLTSQPPAKHLSPAPQPQKPLTTTSQPQKPSAVQPPKPSNPPPPKPRIATTPAPTTTTTTTTTTTPSKTQPPPPQTVAPKSTTPVPPPPKSTTPVPPPPKSATPVPQPPKTITPPITKVQSPSVKPTISAPPAQLKSSAPSPKSTDPVLQPTSLPAKSRPSAQSPPSPPSGSPPRFEEEENKAEKLTAKATTPAKPQVTSPSVKTTTITAPPAQLKSSAPPQRKPQLPTKPLAPISLSAKFPSSGSPPRYGETEHQQPSPAPIAAALAAVTRANLSCSKVSRLKFTRKYPQRSNXPSDMCPTQSQYHIIDQGHVTPFLLPGIGEAAGSVDAANNRLQSASSWSAGL

SEQ ID NO: 154903 - protein, 516 aa, Heterodera glycines
  Coding regions on vcDNA: vcDNA=SeqID_81326; Strand=-; Position=1-1550
  Homolog annotation: Hit_ID=CAA36712.1; Match level="QueryCoverage =68%, HitCoverage=90%, E-value=7e-24, Identity=29%"; Hit description =proline-rich protein [Triticum aestivum] pir||S14959 proline-rich protein - wheat
MANKFLLVPQEIYRGLTSMSDTGDINLDAVRYDLDRARAERTHPSTKNVHYNQQLRRYLKMRRELTDRPTKVELTKGISVLMRRGGEDENGEVVDAPPRPPAPPPPPPPPPPGRRPWRGPSPPPPPPPPGRRPRPPPIPPIPAPSPPGSPPPHPKRPPRPSRAAPYRRGGRLEQWQKRRYDIQRRRPVVRDLLAEAAAAPLPESDNDDDYMLESGFALPAPSQYYGDLPVLPDNADEIEEMDTAQHRIATRRKLKKDEAGENNLRHKKHRIFRPSPPRPTPMARAKAKIEPRPPPPPPPQRPSVKIEQKPKLELKPSTPKQADHPTPAPKSKSGPKFEQLDSRPSTSRQAGYFPPPTPKIEPKYEPQSTKRPVPYQIPKKEPKINETPPQQQAPPAAVVEEMPYVPPPRRGTKRRHPVNGENDEVRIRKRVRQPRRVRVQYSPEPGPSTSAQSDEQQQQQQRELFAIPSNQLTMTQRIERMYIKCNRYADRMGVRGNTINTANGKPLAHSNLRMAI

SEQ ID NO: 154904 - protein, 167 aa, Heterodera glycines
  Coding regions on vcDNA: vcDNA=SeqID_81327; Strand=-; Position=1-504
MNSAVPALQKAGVDVYAGVPSEELLKRLPKPLLLILDDLMLSIDEKYLSDLFTKKSHHHQFAVVFVTQNLFERKIKVARLSAQYLVLMRAPNSLLSIRNIGVQLFPRQLDFFLDAYRKATARPYGYLLIDMHAASDPSLRLRTNIFKDEQEGEDEGTVVFIPKNGAT

SEQ ID NO: 154905 - protein, 229 aa, Heterodera glycines
  Coding regions on vcDNA: vcDNA=SeqID_81328; Strand=-; Position=1-690
MAINISDKKALVNQILGQADITVTTSGITVSGPRLSTPRFIPFEECGRCRACKATEVEVDTMVTKEGITLWCSRISKPQFVPFDVVYDLPGHCFFRVKNKARVFNVPYGDLPSDTCITTTTTFSTQETQTDQDLKRKAKVALDLVEAGLMADAMQDGARWKKAKTAINVLGNLLLAESFDTKVTNSPVEEENVQEEPRREDEQNKEDLGDIDKTLDEFFDSIKASTANM

SEQ ID NO: 154906 - protein, 169 aa, Heterodera glycines
  Coding regions on vcDNA: vcDNA=SeqID_81329; Strand=-; Position=1 -33,176-412,549-633,856-905,1010-1114
MQMIKEEKDAWWNRFLCNSCDFGLHCYRAGNYKKPIVCVHPDISNFTDYLQRAPQTTATTTDCPQPNNEPLATVNDGVRKALNCAEVATTLSQHLIKLARFLSLRRELKRRQKEQAERREHGTETTPAAVQDAPVANTGLDHVYDTPANVPSNQNGEEEEDEWDDESEF

SEQ ID NO: 154907 - protein, 259 aa, Heterodera glycines
  Coding regions on vcDNA: vcDNA=SeqID_81330; Strand=+; Position=1 -51,391-495,539-764,806-1017,1207-1392
MGILEKGSGTDRHLLSFVNNPSFKAFLEKYCGRSIPHHETLRSNYVKNCFEGVLSKIKDDIGENGFVWCSVDETTDRNGRCMANLLIRLLNERWNAPHLISVKPLLDENGDPKVDHQTVARFVDEGLADLLSTGAKKNRLLFMVTDGAEYMKKAARNLRVFYPNMVHFTCLAHGLHRIAEEIRNQFKDVDELISSTKMVVDSFDPEEAQCIAKSQRCFSMTTVPLDIAYIAANFGSLPGAITRLEKEGLTIHECANILV

SEQ ID NO: 154908 - protein, 285 aa, Heterodera glycines
  Coding regions on vcDNA: vcDNA=SeqID_81331; Strand=+; Position=1 -82,902-941,1945-2070,2130-2249,2293-2427,2483-2608,2658-2811,2890 -2964
MGYSMVGPPFGDDDEFGPLFEMNCTGEDKTVVGTAIGGGTISVIQQQTLSSSSSAANDNKQIFIGVPTPPPVPPIPYGYGSKGISQNQTANDAPSNSKQIYLGVPTAPPVPRVPVQHDDRSKSISQQQNAAIDNEQSNGGNNKQIFIGVPTPPSVPRVPVPYGYGNKGISQNQTANDAPSNSKQIYLGVPTPPPVPRVPYSNQQRAVARGVALRPQQSVNYAPTPPPIPPIPAIPYYPYHQAKRRSISENDEPFSMSNGPQRIFPRGGNNKYVYVLHNQKDALLR

SEQ ID NO: 154909 - protein, 90 aa, Heterodera glycines
  Coding regions on vcDNA: vcDNA=SeqID_81332; Strand=+; Position=1-270
MPSSDYADNEADDRIKAPPSERFLNYSLFHNYSPYGMRSLAYDYAKYAERTKWPVKNPCGTIQFEDEPRTPRFQFWSPLTARYECSYTQN

SEQ ID NO: 154910 - protein, 280 aa, Heterodera glycines
  Coding regions on vcDNA: vcDNA=SeqID_81333; Strand=-; Position=1 -174,230-369,421-544,603-757,814-1063
  Homolog annotation: Hit_ID=CAE62876.1; Match level="QueryCoverage =95%, HitCoverage=42%, E-value=4e-64, Identity=44%"; Hit description =Hypothetical protein CBG07062 [Caenorhabditis briggsae]
NSIIRKSNGPFSLVIAPTKELASQIFALLERLSESLVFIHSLNLAQYAEANDEMLENESLDVLVSTPGRLLAAVKKVPKLLINVAHVVLDEADLLFSYGYRDEIGRLKSALPPHFQTVMTSATLNEDMTELKRTFVVGQILSLKLKESDLPGIDQLQQFQIQCLNDEERFTILLALIKLKLLVGKTVIFVSGVNRCYKLHLFFQAFKIVSCVLNAQMPANSRCRVIHEFNAGRWPYIIASECNDIFDGDNEQEQNGEQETAKNGDEAKEQQGDTTKQQKA

SEQ ID NO: 154911 - protein, 444 aa, Heterodera glycines
  Coding regions on vcDNA: vcDNA=SeqID_81334; Strand=-; Position=1 -704,792-969,1010-1246,1452-1581,1667-1752
  Homolog annotation: Hit_ID=AAO51879.1; Match level="QueryCoverage =94%, HitCoverage=97%, E-value=3e-34, Identity=34%"; Hit description =similar to F53F10.5.p [Caenorhabditis elegans] [Dictyostelium discoideum]
MTTTTATASLFGPPPMTTTTAMASLFGPPPMTTTTATASLFGPPPMTTTTITASLFGPPPMTTTTTTASLFGPPPMTTTTAMASLFGPPPMTTTTATASLFGPPPMTTTTATASLFGPPPMTTTTTTASLFGPPPMTTTTATASLFGPPPMTTTTTTASLFGPPPMTTTTATASLFGPPPMTTTTATASLFGPPPMTTTTATASLFGPPPMTTTTATASLFVAPSATTTSAPLFGLPSSTATFSAAAAPRMNFKDLQQTLLKLRVDFERQEKHFMAELDDLNAFDIVLRRAQDKVFSLGQNIDELEQERERFVCELDILSQQQTELDALITQMEKTMGLSPLDQQQLSGQPSVVIRDMANATPADLQRQNMWVRLSGDSLSGDDLKEHEHHRSMLDQIHQILRSQLDTLVWVDKQSGSLLTYVTLLAILMDRVNRATSDVLTLR

SEQ ID NO: 154912 - protein, 105 aa, Heterodera glycines
  Coding regions on vcDNA: vcDNA=SeqID_81335; Strand=+; Position=1 -132,350-484,997-1047
MQKISHFIISIILFFFVRSGLNEESYNSKTRAEPKRLGPLHFHPVFSTVIDFDSDWFRQYFLINFYMIYCIFELILINIHFANTKFIIERPFLAILIIGVPTKIC

SEQ ID NO: 154913 - protein, 112 aa, Heterodera glycines
  Coding regions on vcDNA: vcDNA=SeqID_81336; Strand=+; Position=1 -208,259-325,389-452
MADKNLSAIDGNVFFTFSMVYNFFVFSEGCLRIDTNSPNGEVSAPPLPTMMARCLPGANAEDTFVVDVENTSHSINLVNYSDTSSNETTFTCTTDRPKRKAAEKAMMLLIKP

SEQ ID NO: 154914 - protein, 51 aa, Heterodera glycines
  Coding regions on vcDNA: vcDNA=SeqID_81337; Strand=-; Position=1-154
MANKPADVDYKIVCIGDKAKMLMQRLYAKEFLFTVNDIGRSPPTFQDASIA

SEQ ID NO: 154915 - protein, 40 aa, Heterodera glycines
  Coding regions on vcDNA: vcDNA=SeqID_81338; Strand=+; Position=1-164
VCLNFNLLHRENGNLINFTFTFETFSPLFSPLFREFFAPI

SEQ ID NO: 154916 - protein, 95 aa, Heterodera glycines
  Coding regions on vcDNA: vcDNA=SeqID_81339; Strand=+; Position=1-290
  Homolog annotation: Hit_ID=NP_505492.1; Match level="QueryCoverage =42%, HitCoverage=8%, E-value=1e-12, Identity=82%"; Hit description =putative nuclear protein (55.4 kD) (5K149) [Caenorhabditis elegans] emb|CAA94805.1| Hypothetical protein Z
SEIRGKCNELNDALKQLDLTATPHKIRTTPSKRRSFIDMHGGHGKKSEFRGLEMAGNRTKNVRTRNFEASKWQGIGRKNVRIRNLRPGNGSKSEF

SEQ ID NO: 154917 - protein, 195 aa, Heterodera glycines
  Coding regions on vcDNA: vcDNA=SeqID_81340; Strand=+; Position=1-585
  Homolog annotation: Hit_ID=AAT85232.1; Match level="QueryCoverage =94%, HitCoverage=12%, E-value=5e-12, Identity=31%"; Hit description =hypothetical protein [Oryza sativa (japonica cultivar-group)]
MYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLE

SEQ ID NO: 154918 - protein, 245 aa, Heterodera glycines
  Coding regions on vcDNA: vcDNA=SeqID_81341; Strand=+; Position=1 -178,232-687,743-846
  Homolog annotation: Hit_ID=BAA95789.1; Match level="QueryCoverage =87%, HitCoverage=77%, E-value=7e-13, Identity=28%"; Hit description =KED [Nicotiana tabacum]
MELEKEREEKQWAESVKKQNEIAGPYKMIQKMHFEELKKSIGKPKKDEELQGMITTLVQDLRANKNNCRENLLSLLLIEDRNEFLKEIINETKEEIDQTELEKNLEELLNGEKKKKKSKKSKKKKIGKEKSEKSMENTKDTDREREEEKRGREQEEEKSENGKRENCDKNENKNSTKTTDGEKAKETDQTTKMAINEQMLAEELNKIGTFKKLCDELTLNELFKTFICSPSVERLLIIDQAAIIC

SEQ ID NO: 154919 - protein, 99 aa, Heterodera glycines
  Coding regions on vcDNA: vcDNA=SeqID_81342; Strand=-; Position=1 -168,251-382
MQNSDFCFCFSSLHLFALHSVSAFPKKSDCLTLFPGTTQIKSMSESKVWVPSKCDPTHPSTAQRTEFIMAFVCWSKCSSECSADGGKFRTINWPKKIFN

SEQ ID NO: 154920 - protein, 200 aa, Heterodera glycines
  Coding regions on vcDNA: vcDNA=SeqID_81343; Strand=+; Position=1 -103,199-348,392-530,571-781
  Homolog annotation: Hit_ID=XP_314273.1; Match level="QueryCoverage =80%, HitCoverage=28%, E-value=8e-17, Identity=29%"; Hit description =ENSANGP00000018635 [Anopheles gambiae]
MGALISIKIFLICLGLRRPNFYMLNFVEFESFALSYCSNLYIKNLLMEGHKTENHNENDNEEEKSAKVLKNLRLMVTTLKLWAKSNLIYSNKFGFLNGVSLTIMATKIILLYPNAPILFLLEKFYLIYAKRETKVPIKLKLVANESDKKHFDEKKIAMEEVMRIYTPSFPEQNTAKNVTHSTEKIIRKNMDEGGQLINNH

SEQ ID NO: 154921 - protein, 103 aa, Heterodera glycines
  misc_feature (12)..(12): Xaa can be any naturally occurring amino acid
  Coding regions on vcDNA: vcDNA=SeqID_81344; Strand=+; Position=1 -169,311-458
  Homolog annotation: Hit_ID=NP_510032.1; Match level="QueryCoverage =81%, HitCoverage=30%, E-value=5e-25, Identity=65%"; Hit description =reductase (29.2 kD) (XM767) [Caenorhabditis elegans] emb|CAA91943.1| Hypothetical protein M153.1 [Caenorh
NLNSKEIKTVNXLTFKGLPRELSLKLAAMSLYGAAKMFLETGEHPAVLKEAVQSPGGSTIFGIHELEKGGMRGLLINAVEAASERSRRTGEAALPPDVRNLSK

SEQ ID NO: 154922 - protein, 184 aa, Heterodera glycines
  Coding regions on vcDNA: vcDNA=SeqID_81345; Strand=+; Position=1 -147,218-422,887-1089
MLPSQCKKQSDAPRPNTSNLSSCNLQLLSDYLEWVHNIPELNMLNEDDRNFLVLCRARPSAWLLLAHHRMHNTENRPNIELDKLELLLHNEIVGPLRELEIHSVEFEILRNVCFFSTVPQLSEAGRRLVTSVQNAQLRTLSEFSLSRINLIEKANESPLLLSSVFRLNRMMNTLLTIEVKKPGI

SEQ ID NO: 154923 - protein, 328 aa, Heterodera glycines
  Coding regions on vcDNA: vcDNA=SeqID_81346; Strand=+; Position=1 -372,1112-1415,1470-1780
  Homolog annotation: Hit_ID=NP_001004509.1; Match level="QueryCoverage= 45%, HitCoverage=10%, E-value=4e-12, Identity=32%"; Hit description =si:busm1-180o5.3 [Danio rerio] emb|CAD60788.1| novel protein similar to DNA polymerases [Danio rerio]
MLKGCPKCYANDRQQKLAGGRTAEDLYERTKRRLFELQNQHGFELEVVWGCEMKQRLRADPEFRRVYNDSFVPRPLDPREDALRGGRTEPFILQYTCSPDEEIILIDIVKKKLGETKNIFSLLKKILANSLWGKLAQRVGGTEVRYTRTPAEFHALLENRNIDIIDFHHVSHHMDRVVVRKKAEFAKAPSTNCLPIAIFVTSYARLHLYDYMEQVLRLGHKLLYCDTDSIYYVTRSGRQQVPEGEALGQMKREHCSRRIYEFVSGGPKNYGFRHCDRINGEDERAELKVRSFRLSYSAQQLLNFESMKRIVLEHYNIDGQMLTHFSLT

SEQ ID NO: 154924 - protein, 209 aa, Heterodera glycines
  Coding regions on vcDNA: vcDNA=SeqID_81347; Strand=-; Position=1 -93,163-256,304-605,660-800
MDAILATDWLHNAYPEQKMTTGNEEEDKATQEGQMSWLKIIEEEEERARELQNDQMELEQVKDNIELPKHPQPQTKCSCNEKQKSVPLIDFLCKHYKCSMNELHVLLQTLSKRREISEMLRSNLHLRTNHLRPAWKNIRVHCNELTIHPAQTAYAMRGYLGITVRVYYYVKHGIKLAYPQLPCVLQFGGGDHSSLFPLECLSVVVVKEP

SEQ ID NO: 154925 - protein, 229 aa, Heterodera glycines; identical to SEQ ID NO: 154057
  Coding regions on vcDNA: vcDNA=SeqID_81348; Strand=+; Position=1-690

SEQ ID NO: 154926 - protein, 249 aa, Heterodera glycines
  Coding regions on vcDNA: vcDNA=SeqID_81349; Strand=+; Position=1-750
MRHAMRMFLVPEDVFQSVFVQPQAATAAADGADGTPIGLLRSRIQQIERSRELNEEQKAAQYHQEFKRLNKLVREQEEQPINVRLQHEKEREKNAATPPPPPPQTIDHSTPKRLEKNIVPSAFGLRRQRHHYTQKAGALSNRRPAQKQQRKAAAAAAETPNSSGNGETEKEEGDVDDGEQWDDAQSSSSTVSTGGAAPKRVLRARDGEAGKGGGGGETADRLQPKHNYQMTQKCTDHTHSKKGAQSGSQ

SEQ ID NO: 154927 - protein, 32 aa, Heterodera glycines
  Coding regions on vcDNA: vcDNA=SeqID_81350; Strand=-; Position=1 -92,653-659
MARLIAMPFKRVLVLVLLVALLGLAQDGFWRY

SEQ ID NO: 154928 - protein, 199 aa, Heterodera glycines
  Coding regions on vcDNA: vcDNA=SeqID_81351; Strand=+; Position=1 -153,603-1049
MSPRRAAASGRTSNGGGGGIVNHANAMAPAPPPPPPPPPTGWAPPRHLQEHRHADDDGKAQQQQQQRGDEDGGLVVVWPPFPATDQEDQHDIDQAADQQQQNRPPKAEAPTPKNVRRDFPEEYARQERMQAEAERQRAERNARLREKQVAHWLGEMYGLADQENGYILIDQRPIFFVDRRKRIVCLIKFKADFNCDQSQ

SEQ ID NO: 154929 - protein, 71 aa, Heterodera glycines
  Coding regions on vcDNA: vcDNA=SeqID_81352; Strand=+; Position=1-584
ALFHFWQIERRAGNKVVTLVSNLASFGIDASALDSEIRGTGTSILATAPACEGPQLLVQGNEVYSRIVLCF

SEQ ID NO: 154930 - protein, 97 aa, Heterodera glycines
  Coding regions on vcDNA: vcDNA=SeqID_81353; Strand=+; Position=1-523
FFNGRGQFRFYETNEFKIVFFCVICGADHKYDLCFSKFRTPNSNENSEFINYNEDIFLGVFEVAENGYGIRFALENTRTRTKKSIFSQQTLGCNDNS

SEQ ID NO: 154931 - protein, 174 aa, Heterodera glycines
  misc_feature (4)..(4): Xaa can be any naturally occurring amino acid
  misc_feature (17)..(17): Xaa can be any naturally occurring amino acid
  Coding regions on vcDNA: vcDNA=SeqID_81354; Strand=-; Position=1 -51,602-754,859-963,1391-1468,1517-1606
  Homolog annotation: Hit_ID=NP_500090.1; Match level="QueryCoverage =83%, HitCoverage=55%, E-value=1e-32, Identity=41%"; Hit description =lipase, class 3 family member (30.6 kD) (4C279) [Caenorhabditis elegans] gb|AAC04418.1| Hypothetical prot
QSDXRKYIYDYMDYCLXIFGHSLGGSLAALAAAWVAKSGMTTAEQIRFISFGQPRTGNLEFARHFDSLLPHKYRVVHSEDIIPRLPSKLLLNDEHSLFHHRYEVWYNNDMTTGSAYEVCESADGIQCSGTDPLGSYMAHLSYYNTDPLGSYMAHLSYYNVSLITWHRSGCASKG

SEQ ID NO: 154932 - protein, 78 aa, Heterodera glycines
  Coding regions on vcDNA: vcDNA=SeqID_81355; Strand=-; Position=1 -59,187-364
MEMRINVRSLAPKHCCQFIMTYVIVNNGEPLFPIIEWNHHAAVLANLTSTNNAQEGYHLAQDWHFRIYILLFPGQKIN

SEQ ID NO: 154933 - protein, 27 aa, Heterodera glycines
  Coding regions on vcDNA: vcDNA=SeqID_81356; Strand=-; Position=1 -49,118-152
MSVFYFILSLFYIQFFSELVLVKKTVI

SEQ ID NO: 154934 - protein, 758 aa, Heterodera glycines
  Coding regions on vcDNA: vcDNA=SeqID_81357; Strand=-; Position=1-2276
  Homolog annotation: Hit_ID=NP_498959.1; Match level="QueryCoverage =51%, HitCoverage=17%, E-value=1e-50, Identity=32%"; Hit description =zn-finger, CCHC type and RNA-directed DNA polymerase  and Integrase, catalytic domain containing protein
MKHILEFLKKKIFPDDPRQAQNLKETCHKYTLLDGLLYLCEDNGKLRLFVPSEFRENLVKQRHEGKCAGHMSAKKLFLQLAEQYFWPNMLKDCMKIHQHCRICAHTKEARANEPPLKVVRTSEPFELLCIDILDVGPSKSEFKYICVMVDHFSKYLIAEPIRNKSAEAVAKVLVEKAILIYGTPKKIHSDKGKEFVNSTIEEIVKTFGIERSLTAGYDPQANGLVERVNRIIIAMLKKSTASCWTWDERLPYIVFAYNITPSKTTKFSPFSLIFGKIARFPMDGEVPLQVNPAYTIDSDTYLQLFRENVLNMLNEARENSEEERMRSKIWYDSQPKVTANKFEAGQRVMVAFPGLNRRSRHKKLLWSHFGPYLILEINESSAFLVPIDNRNAEHIKVPIERLIRIPPGIPDISTLPKGKNPFKNALKSLIVSILSSFEVCESDGQMAHYEQLGAIANLKGGEGMIGKTEKAAQSREISFSEMEIDNEGEAEDMFGWNAKCDVGQGEHEFCAILRVAELDPALGNAELGSITVKTPLQALLAVFLLKAGTVKSMTAARSFVKSIIEGAPKEELSLFVTKKGDYVATGQCPTEEDQMKALECWFEKCSVAKHALEESGFKKIGMDEPVGLNHLADSEKKKWEEAMGETPWVLEKLRAKIIHKATKLIALPRVIIGDSTAHQLAEILDQTAVIGPKNGTLAETVRSLKPVVLSSKVKAALIIVGRDSLLGGETIEVMMEQYEMIANLCRRFQQVKFFWTCP

SEQ ID NO: 154935 - protein, 252 aa, Heterodera glycines
  Coding regions on vcDNA: vcDNA=SeqID_81358; Strand=-; Position=1 -228,263-533,898-1157
MPTVREILESLQKRVKKPRIATNEDSVLNVERTDAEQQIERNNFDVASSDDEENCEPVQFKRGETIRGALCLWYQGAFDLSKTEKISVLSLALIPPVYVWHAFSIIVNAAPLGVQGWLAYFGKTYIGTTQFEIDRGAEAFGPNADVGRFFLRRTQSTTRKCICYFHAFIKDIDKQLDIGRAERLQKSRKRPQRYIIKEQSVVRILDEADFESEEGLTNALYLIGLVMQGFVEGLHVRGNEDSKEETDDTDGN

SEQ ID NO: 154936 - protein, 294 aa, Heterodera glycines
  Coding regions on vcDNA: vcDNA=SeqID_81359; Strand=-; Position=1 -167,212-350,397-676,725-978,1309-1350
SYYLCTSFTNTTETTHCDTEIMNVTYAIIDTDRITSQIFHDVRLFCIQDEIDVGITRRLVGYCVPLQSYEKEFEASPEPTRLIIPTEAFDNQFVDTFTNHYKFKIRPMFVVPADANAFQQMFRSAPPLLCAHRILKSSTICIRTDMEPSSTRMALPSQVSKLVQDKFRLDCNPHLVPIRLSCGSECFLLLDLAEHCRDTYDAKKEPEFGHYRFRGQPIEEAKALSSHTTEEEGKLSSANFGSCSPPSNSVMECSTTTEQRPGTSEHIDNDDHCSSPPVKPLTYAQVAANRPRRK

SEQ ID NO: 154937 - protein, 43 aa, Heterodera glycines; identical to SEQ ID NO: 148805
  Coding regions on vcDNA: vcDNA=SeqID_81360; Strand=+; Position=1-130

SEQ ID NO: 154938 - protein, 52 aa, Heterodera glycines
  Coding regions on vcDNA: vcDNA=SeqID_81361; Strand=-; Position=1-156
MINTQPCFAYIDKYADTLIKSEEFLQIDQKLLCKILERDQLQIRGEISIWKA

SEQ ID NO: 154939 - protein, 114 aa, Heterodera glycines
  Coding regions on vcDNA: vcDNA=SeqID_81362; Strand=-; Position=1 -49,413-517,657-818,1077-1105
MSFSRDSTNDEFTADQGTFENVTPPSAVEELQCLRSMEMEWVQKMPSQDENVSGNVHKNEMTKSDYLAKFFKRLSSVENLADAHLSYGQGNSKNKARIFIYIFFKKPNFPFILD

SEQ ID NO: 154940 - protein, 589 aa, Heterodera glycines
  Coding regions on vcDNA: vcDNA=SeqID_81363; Strand=+; Position=1 -612,669-1827
  Homolog annotation: Hit_ID=NP_508324.1; Match level="QueryCoverage =56%, HitCoverage=13%, E-value=2e-53, Identity=37%"; Hit description =predicted CDS, peptidase family A16 and RNA-directed DNA polymerase and Integrase, catalytic domain and Z
ARHFWQFFQGKREVSPGLFVINTSFGPLINGESNIGPPNSNQKVFSMMAIHSTNLEQMPTINEVEHFFNLESLGIQDDPAQDGLSSVLTKLRHSPEILEKYDATIRDQLQQGIIEKAQRAPGQLEHFLPHHGVLTKKLRVVYDASAHTRGTPSLNSCLFRGPVLLPDLAGMLLRFRCPTFPLLADIQAAFLQISLEPEDREVTKFCRVAFGVDSSPFILAATLRHHLQHFDSPLSREISESIYVDNVLLECETVQEALEKYKFSKDILQQGCFNLREFISNSKEVMKQIPQEDQLDKPKAKVLGLFWDTEKDEIVFKFPTTDPLRPVTRRLVLSHLASLFDPLGVLGPCILPAKRLFQELWKEGHSWDDALSEEDSIRWNSIQRQWKDEEIRVPRRAMLNDTQSIELHAFVDASVHFIERLKEIRECLGCTFHFVRTGDNPADLATRGATPSELRNHHLWWKGPPWLAQASHHWPSELCFQVTESDQQPDSTENVGPSGAFLAHTHSNQPNEQVLIDPSRFSSWKRLMRTTMFVLRFLALMFKRGEETVASLAKHRKEIRQISKSGDFKAEDFALAERVLIRLDQMDDA

SEQ ID NO: 154941 - protein, 124 aa, Heterodera glycines
  Coding regions on vcDNA: vcDNA=SeqID_81364; Strand=-; Position=1 -294,453-531
  Homolog annotation: Hit_ID=NP_501697.1; Match level="QueryCoverage =99%, HitCoverage=5%, E-value=6e-18, Identity=38%"; Hit description =predicted CDS, integrase, catalytic domain containing protein family member (4K310) [Caenorhabditis elegan
PSLNSCLFRGPVLLPDLAGMLLRFRCVDSSPFILAATLRHHLQHFDSPLSREISESIYVDNVLLECETVQEALEKYKFSKDILQQGCFNLREFISNSKEVMKQIPQEDQLDKPKAKVLGLFWDT

SEQ ID NO: 154942 - protein, 144 aa, Heterodera glycines
  Coding regions on vcDNA: vcDNA=SeqID_81365; Strand=-; Position=66 -113,176-562
  Homolog annotation: Hit_ID=AAP30767.1; Match level="QueryCoverage =100%, HitCoverage=100%, E-value=3e-77, Identity=97%"; Hit description=putative gland protein G21E12 [Heterodera glycines]
MATYLFLAAAAFGAGIYCWKTYLGPMLDQPKSDDEEKPKPEGGEEATTAGEEEKKAGSKGDKHKKKDKKGEGAAAAPAADKKEEKRKDKHKSKESGKSDDSKAGKKDKHGKKDKKGKKKDTTDASTVDEALGEQSAAETSQAEQ

SEQ ID NO: 154943 - protein, 51 aa, Heterodera glycines
  Coding regions on vcDNA: vcDNA=SeqID_81366; Strand=-; Position=1-155
LQIYWLKLHMRYISKFFDSVRRFDKDGFRFAISRSTFGNWSRIFSAILCNH

SEQ ID NO: 154944 - protein, 23 aa, Heterodera glycines
  Coding regions on vcDNA: vcDNA=SeqID_81367; Strand=+; Position=1-69
MSFTQAPILWNHRQLHTETKAYM

SEQ ID NO: 154945 - protein, 401 aa, Heterodera glycines
  Coding regions on vcDNA: vcDNA=SeqID_81368; Strand=+; Position=1 -124,303-394,458-501,558-644,752-811,1016-1079,1463-1612,1964 -2187,2563-2769,2994-3144
VAFYGRDGYKYAAEKYGIEKAEPPTKNFNDMDEFDKFGFMHDMVLLLFDGCAVCNGNKVPNVTISLLQHMPPGLLVDECKEFVNRSGEALALQMEMVEKQQKSKGTFAYGVSLKERLCVEKKPGTEKAEYYMQKLKYKYRVVLEVKHTCGADGEQKTIRQLHLDFADMEDTVDLTLILSGSDSDKSGQFVNATLIPYKHEPVVPPPSPNPPIATNVDHLGANCTQIVFSELMPQFFLNVSNDAFAIACQKFAAPIYTGKNFSADDYYANTCAQVPTSLNCNNDHELIGCYKTKKVKHVVNNEIAEVCQKHLGNVGQQQAHGFRIRFCAQRNAKEQLISVESILDFSFSDKIYKREHSYSYKPGGHIAMKEKMPFFFIEFGNAKQHSMLRGTGDSSELSAEL

SEQ ID NO: 154946 - protein, 94 aa, Heterodera glycines
  Coding regions on vcDNA: vcDNA=SeqID_81369; Strand=-; Position=1-285
MAMEDKRRRKTTVGSDERIRRNVPGREAPEGTADGGAKNKCGKKDGRHTDQRNDDVSDHLGTLRQNDEGIGQRRIKKKRPEEMIKVIKPGIIVG

SEQ ID NO: 154947 - protein, 132 aa, Heterodera glycines
  Coding regions on vcDNA: vcDNA=SeqID_81370; Strand=+; Position=1 -88,131-228,595-809
ICTFSMSQLSPNHLFENLKYFETRFDGDGTFGVGLSSTPVQQNEFIGWHSGIGFDSDGDIIETSYTLGVCALRQGKNWVYAQWGGVIVYMPNGRSHWVYAQWEGVIGYMPNGRSHWVYAQWEGVIGDMPNRE

SEQ ID NO: 154948 - protein, 41 aa, Heterodera glycines
  Coding regions on vcDNA: vcDNA=SeqID_81371; Strand=+; Position=1-183
QNEEMETIYLNIGGANENVPPPKHSFIRSAHRPKLGLHALF

SEQ ID NO: 154949 - protein, 73 aa, Heterodera glycines
  Coding regions on vcDNA: vcDNA=SeqID_81372; Strand=+; Position=1 -131,838-928
MASHLSVTVLTSIIALFVLLLALHGTAPNQLKIGENGLFEEYLRWKMPKRVANYAEALPIGLLDQLNGAERLR

SEQ ID NO: 154950 - protein, 200 aa, Heterodera glycines
  Coding regions on vcDNA: vcDNA=SeqID_81373; Strand=+; Position=1 -122,677-1022,1069-1203
MMDFEDDDQSLSSKYSTKIGTSNGIRNRSFLDKSNLLSKSAFKKSSAPSLRSFSVCSSTVPSHSFGWREKREETPLKEVNQLIDQLMLYSTDEETAENELDDEAIGRQREMAIGTAAKNEGKTMLSTRAISPGRQCRHGKQQGPFASLTFNPAVRKIAAGHAFPFEGGLFGSKAVSLSRAGSSCSSLSISNNSSSPFRHL

SEQ ID NO: 154951 - protein, 148 aa, Heterodera glycines
  Coding regions on vcDNA: vcDNA=SeqID_81374; Strand=+; Position=1 -277,543-712
  Homolog annotation: Hit_ID=NP_492295.1; Match level="QueryCoverage =64%, HitCoverage=15%, E-value=1e-19, Identity=40%"; Hit description =bactericidal Permeability Increasing Protein like family member (1J22) [Caenorhabditis elegans] emb|CAB02
MGPETPKYGELMKTTCSSEEDTGLEDHGVETEDGAAAVAVRVKRQDAGDLTSLGVCLGDILPAVREQYPNQLVYVIIHTIRAPSIILSSQNGGAHVTGHADVVSMHLEDVGNQLGLPQDALDNLGTLGRDLMLKVVTFVNKSYRTFFI

SEQ ID NO: 154952 - protein, 120 aa, Heterodera glycines
  Coding regions on vcDNA: vcDNA=SeqID_81375; Strand=+; Position=1 -211,337-488
MNQQQVIKTKLNNDKLVHDGAQKKKYRDADARILRLVQRYNDINNNIVPQNDHNYANANVNPENLNNFLAVLKFFYLNLTLVQELVRKCPPYENGGTKTTLTARLACICQINVCPYFENL

SEQ ID NO: 154953 - protein, 296 aa, Heterodera glycines
  Coding regions on vcDNA: vcDNA=SeqID_81376; Strand=+; Position=1 -109,177-272,309-665,716-1041
MVSTRNKTGKFMKLSNSGTEAKRKQKEWRQEHGRRVALKQTEAETTADGEGTSTQAAESGPSTSAMDLRPHSSPRPLSATPIRRHARVRAKTTDKATNMDLTTTDNATNTDLTTADKATHMDLTTMDKATDVDLAYEDAATQTEQLDKQLKEQEQVISFLQQQVRNRDALIADLRRQLEQQAKDQPTTSTRRKKNAATLEQTSRRNLAKKIADVIDRDRSRSVSRCLLQSLHREVRHKFGHYTPMKKEQLRQQQTIHEEDGLLLLSQLGTQKAYERMKALLRLIGGKFDVFPPLKK

SEQ ID NO: 154954 - protein, 63 aa, Heterodera glycines
  Coding regions on vcDNA: vcDNA=SeqID_81377; Strand=+; Position=1 -105,412-498
MSPRDLDELEMSIDQFRTFLNDQPRMRTLLALKPKDREEQQEEIGGQKSDGESNGEEQQFDFE

SEQ ID NO: 154955 - protein, 113 aa, Heterodera glycines
  Coding regions on vcDNA: vcDNA=SeqID_81378; Strand=-; Position=1-342
MPKHWPQSKMCSVTTCCARRRPRRGRAAFGLPWVYTTRPICSDLCLALSVLISALALSVLISALALSVLISALALSVLISALVVSVLISALALSVLISALALSVLICASPYLF

SEQ ID NO: 154956 - protein, 39 aa, Heterodera glycines
  Coding regions on vcDNA: vcDNA=SeqID_81379; Strand=-; Position=1 -63,156-212
MTRTERAGLILMEKLEMLQVTNYSIRAREKPKMYSMVTD

SEQ ID NO: 154957 - protein, 138 aa, Heterodera glycines
  Coding regions on vcDNA: vcDNA=SeqID_81380; Strand=+; Position=1 -106,493-725,1284-1361
MPKCDGKQRDDNANKMGQCQCQKFDCKRRGPYNVHGRSFQTAGALGLSPSPFLHQILSRLTEMVGDVSEESQSYITDLFMCLQNLAQNITIAAHLANSPQLQSSSISTGHNRSALCIRPVLNVPFPSFAIVCRTSANK

SEQ ID NO: 154958 - protein, 150 aa, Heterodera glycines
  Coding regions on vcDNA: vcDNA=SeqID_81381; Strand=-; Position=1 -84,460-828
  Homolog annotation: Hit_ID=CAG83749.1; Match level="QueryCoverage =86%, HitCoverage=24%, E-value=1e-12, Identity=41%"; Hit description =unnamed protein product [Yarrowia lipolytica CLIB99] ref|XP _499823.1| hypothetical protein [Yarrowia lipol
MFGWIFSFFDRLQLGLKFALLSPRFNALHIFIKNVVPFLITAVPLLIIVVPLLIIVVPLLITVAPLLIIVVPLLITAVPLLITVAPLLIIVVPLLITVVPLLITVVPLLITVVPLLITVVPLLITVVPLLIIVVSLLITVVPLLITAVPL

SEQ ID NO: 154959 - protein, 82 aa, Heterodera glycines
  Coding regions on vcDNA: vcDNA=SeqID_81382; Strand=-; Position=1-249
MPDGPKRADEGAIVGFTEGKCQRQNGTTNGAKGETKGINEMGFVKAKEKWQKIKRMNEKRREFGKIKKPKRELAHVWVEVDQ

SEQ ID NO: 154960 - protein, 193 aa, Heterodera glycines
  Coding regions on vcDNA: vcDNA=SeqID_81383; Strand=-; Position=1 -135,204-352,622-781,840-977
MKSLPRPAQDEFGECSNVANSVPRHARCVSRLLRAGFDGRKIYAKAFAKSYRFDRYRMKKRAQIRESRRKTERRQKRLVWLSKKSTFGGQKVGDKSALFSAEKPKSISKIKNNSLGPPRPLGLELANAYAAHRRERRHTSIVKKNYYELHSPSQARLSPLGSVAKLMMAEVLRVKGKQRKDVKPWEIQNLKGF

SEQ ID NO: 154961 - protein, 25 aa, Heterodera glycines
  Coding regions on vcDNA: vcDNA=SeqID_81384; Strand=+; Position=1-75
TCTCGVVVKLSIFHNFSPGFNSPLG

SEQ ID NO: 154962 - protein, 78 aa, Heterodera glycines
  Coding regions on vcDNA: vcDNA=SeqID_81385; Strand=+; Position=1 -197,563-602
MPNWNNESASPLSESAADYLAILRPPPNRKCFHAFLVFTFLKKSNFVCLLSVKQIRAILMIIDILKRAFSVHIEKRNH

SEQ ID NO: 154963 - protein, 159 aa, Heterodera glycines
  Coding regions on vcDNA: vcDNA=SeqID_81386; Strand=+; Position=1 -117,159-521
MEKFRSKIESRRRERFFGADLGLAKVEQHARKSLEEQFLAFYTTVLEYLDKWFRVDRFSEKLRWVSLMSDKIPQNDALDLARQKAPDLTNNLFDDVSEANQILNSIPKDELQMLNPEQKWMKLFEADLPHLYKLVSIVLSVPVSNAFVESFFPLRLTMD

SEQ ID NO: 154964 - protein, 310 aa, Heterodera glycines
  Coding regions on vcDNA: vcDNA=SeqID_81387; Strand=-; Position=1 -382,453-882,1234-1354
MPDKTKNSIVSPNSSTESEDKFYSPENFEIDETPQKPIVANTNKKIGGQIRKNYEPQMPKAIKTNLKSEIVEENSSENEEQFYSPKFVADLKHTNKRENVHGINYLKMFNQFTSEFLEETMKNDWKQLKFSIQIADRFLVYLTEQVGEKILKRKWKILGHKNWCKPIENKQFIDFFEQKNVFNVRISNLQQKWKDIMPKINVNFFNVMILFGINLADHRLVKMGEPKNRAEKKVKKKMLKMKTMLSNAFHCFPPNELDLNDNNDVHIILQYVMSRLLFVTTKNKLSNEIVIHVFQLVERDGQLHAESNDD

SEQ ID NO: 154965 - protein, 124 aa, Heterodera glycines
  Coding regions on vcDNA: vcDNA=SeqID_81388; Strand=-; Position=1 -127,365-612
MARANFGKIRNLLEISGLLETDSEYVYLAKTLNEANLKRNFDAVSRIIGLHVGTDMLKILEKFNALPNRASISKTKFSGMFQVAYLEILKNTQDKCYQQFVEPVKGIDMSSKGLVNAINTVYFI

SEQ ID NO: 154966 - protein, 419 aa, Heterodera glycines
  Coding regions on vcDNA: vcDNA=SeqID_81389; Strand=+; Position=1 -183,417-618,661-1214,1258-1578
  Homolog annotation: Hit_ID=NP_001004509.1; Match level="QueryCoverage= 98%, HitCoverage=32%, E-value=1e-55, Identity=30%"; Hit description =si:busm1-180o5.3 [Danio rerio] emb|CAD60788.1| novel protein similar to DNA polymerases [Danio rerio]
MPEGGYERAENQSKIAVKYFEWLAQKKRVKVRHACNGGEVQFGGLKVDCVIGAEKKIIEFQECDVREELKKNKEMKKFFESVPDKGPINLRDAYAGGRTMPFCLYAKATEEVEISMFDIISLYPFVNYDTPYPVGVPKIVVSRDFNVNWTVPDDIPYDGLLKVKVVPPKNLLHPLLPVHIDEMLLFPNCWSCARRAKNEFVMTKDVKKCNHRPAQRAFLGTFTSIELRKALELGYRIVGFYRAYHFEQFDSQLFKGYVRMFLKIKVEASGWPAEVKSEDEKRAFIEMYKAKYDIGLDYDKIGFNPGLRMITKLGLNSLWGKFSMRNTLSSTEIVASMERWMELGRDNTIEFGRPVKISEEISRVVYRKKEEFIREHKVSNIVLSLWTTSAARLKLYEYMEQVYKKEGCKLLYCDTGEKE

SEQ ID NO: 154967 - protein, 114 aa, Heterodera glycines
  Coding regions on vcDNA: vcDNA=SeqID_81390; Strand=+; Position=1-345
MTREYADSEILEFVSAGPKQYALKLRRKKDGVIWHKTKIRGMTLDRRNEFKYELFKEMVLDYKEGVKKVFHYPEKIGPTNDFRVLSKDVQKEYTPVQKKGIIDHHFNVLPFGYY

SEQ ID NO: 154968 - protein, 135 aa, Heterodera glycines
  Coding regions on vcDNA: vcDNA=SeqID_81391; Strand=+; Position=1-408
MSKKNFQETSKEFRRSKNTKNYFKNSPNLEKCFEEMESHIKENKKFGIKEHVTTFYFKCPENEDPEKMFKNILKKLMGDAMIREAEPGWKIEKISVDLYCSALSDPVILPARPFQHSNPDIVFNEFITDSNHLGK

SEQ ID NO: 154969 - protein, 38 aa, Heterodera glycines
  Coding regions on vcDNA: vcDNA=SeqID_81392; Strand=+; Position=1 -51,221-286
MGTNYNNPDYSTLMGATRCGILEISPFESNGEYELKLL

SEQ ID NO: 154970 - protein, 129 aa, Heterodera glycines
  Coding regions on vcDNA: vcDNA=SeqID_81393; Strand=-; Position=1 -31,177-535
MYSHEPAGIHVVLWPLDSDKAGRSVYLGWSIFLGGHFDKRIWRGIVLAFPNADGHSRVVIAGVHHLLFFPLFLFQIHWFMALLRFAETKTNRGKILLSRGGYQGWHGIPTSEFRLPTFLGPRNSDFRNF

SEQ ID NO: 154971 - protein, 52 aa, Heterodera glycines
  Coding regions on vcDNA: vcDNA=SeqID_81394; Strand=+; Position=1 -64,120-214
MPALYVMDSILRQAKKQYKHKDVFAPRFATNLTNTIQNVLTCESADRVCSTY

SEQ ID NO: 154972 - protein, 608 aa, Heterodera glycines
  Coding regions on vcDNA: vcDNA=SeqID_81395; Strand=+; Position=1-1827
  Homolog annotation: Hit_ID=CAA82797.1; Match level="QueryCoverage =49%, HitCoverage=46%, E-value=5e-29, Identity=26%"; Hit description =gag protein [Ascaris lumbricoides]
MKIILRGNILNKKGEDPANWTTTKFRDVLNEAVRKEVQIQEVMGEYGHHYVQPKAEVVSAAHVQSPITANKRSRRPNQPSTQRHESFIASTLDESLRQQGYKKQQDMQLANSRHPQARDQAQSINRIPPYPCTFCNGNHWHDECQKVNTLNERIGIVREKKLCFKCLKANHQASNCSRPSKCYHCKRRHPTALCRDQCRSENDINMPSNSYSEKKPNDQNGRRSTAIEQQQMCNAVQSRDTRALLMTARATIFNPAQPGLSMMATVFIDPGSHRSFISSSAAKQLELTNLGTEECFLTSFGEREPKRYLSDRVAIGILCPDNDRFIFNLNALKFLLNEMPVLQLNALDHDGLQQKKLNLPNAPRQPDILLGMDVWHELKIQPIEQLPSGFTICQSKIGNIISGKGRIELSQPSNVSFVMMVTNKESTGSKPTHMQKAKQHRESKTLRRHQINKLLSSAATLRSRRKRESVPNSTTPIVIDLSSDSERNSSDVEIIQDPVAGQQISSSNKHSTAPLPKALRRPTATKQSSSIAKRPASFRKQTRKAAPSAGINRTHELSSQMKALPPTAKEKSVNQQCIMALTRSADPTTSQDDWKLAKFPKHLLDNNQ

SEQ ID NO: 154973 - protein, 206 aa, Heterodera glycines
  Coding regions on vcDNA: vcDNA=SeqID_81396; Strand=+; Position=1 -189,430-861
  Homolog annotation: Hit_ID=CAE64566.1; Match level="QueryCoverage =65%, HitCoverage=40%, E-value=1e-17, Identity=39%"; Hit description =Hypothetical protein CBG09317 [Caenorhabditis briggsae]
MLKSRSSVSIWIQNVQLAALAMPISLAMVAFQDWHKVWHNGGLNQGFDLVVWGVVATQSKTPIVVIKYADNILKTFANSFSIIVISIASIWVFASMPKPLFIVGAALIITAALIYAKFPYRAKPKADQRSNSNSATDSGSADSDSSNMSNCGTAPPTGRGGDRMPKEEDKVSRLTKLFRMGRSPTMAKLTPGQLDANGDGNGVQKF

SEQ ID NO: 154974 - protein, 93 aa, Heterodera glycines
  Coding regions on vcDNA: vcDNA=SeqID_81397; Strand=-; Position=1 -272,529-538
MPTFWSKTGNEKGINCTICMYVSLEMSVFYPIDRLIDQWQTPVDQSIISLQLLENFLYFLNRLKNREYSKKYKNLQNILLKKLIIFIYRKGIF

SEQ ID NO: 154975 - protein, 35 aa, Heterodera glycines
  Coding regions on vcDNA: vcDNA=SeqID_81398; Strand=-; Position=1 -7,228-328
MEDSKTINSRCDSTERANQWPKAADGFLRKTLIDH

SEQ ID NO: 154976 - protein, 864 aa, Heterodera glycines
  Coding regions on vcDNA: vcDNA=SeqID_81399; Strand=+; Position=1 -120,296-392,1875-4252
  Homolog annotation: Hit_ID=XP_479365.1; Match level="QueryCoverage =23%, HitCoverage=13%, E-value=1e-12, Identity=27%"; Hit description =helicase-like protein [Oryza sativa (japonica cultivar-group)] dbj|BAD32013.1| helicase-like protein [Ory
NCATMFGRFPLLTMLNSASNWHRFRPVLNIWSTNISVAKSNRSTMFDGHFPSFEHAHLDLKLALLSLRFDALMPSKQEMLKKRKKEEHLRRTEKSVSPGRSPIPNCPPKGNPNCSILDNPLSADGNGAASPRGFNTPNLSALQLSTPASSIGSKRRARPPKAGDEAITASQNNVSSVDTQFTSATQNIETPFSKKWKVDDVNRPSSAIEEIASTPIFTQRSRGGRPAKKRRGPGRSKANDSMSESSSMDQSSEATTSVALLPTVPEKINFSTVQINFATSRNFTCKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPGHWTLIVHDVQFGTHFADSLPTTYGRLDPQLTDKIKNIISDILPSAVLAGIVDVENLTVQHDGNSCGYFVCLYAESWLMNNRTFVLPDLSINYEKKRILWHINELYGSDNVPYHPREGVPTPCPIVYRHTDEAQSTSKAAELMEVDEHEDIMIIEPQTSGQAVDAILTQVQVAGENQADTLGLVSESCIPQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSTICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQTPEELRFFRMTLLNERRAPT

SEQ ID NO: 154977 - protein, 194 aa, Heterodera glycines
  Coding regions on vcDNA: vcDNA=SeqID_81400; Strand=+; Position=1 -135,212-511,560-709
MNSLKRFQLPEQGTRQQEELDSVEPKHISDVVNFNSAGVFYVLGKACPFRSKGLICRRKLSDDNMCEACGQKAIAPIHTVFVRLLLQDVEQADIAQRVTMFSSVAEEFLGMKAAELLAKEKEPESLAKHLDDLIAVKIIAKVNIKANSQTYTGFDWIVNLFKKCPGKNDSDVPKEKDDDDDDVDEIATKKTKKN

SEQ ID NO: 154978 - protein, 940 aa, Heterodera glycines
  misc_feature (117)..(117): Xaa can be any naturally occurring amino acid
  misc_feature (428)..(428): Xaa can be any naturally occurring amino acid
  misc_feature (433)..(433): Xaa can be any naturally occurring amino acid
  misc_feature (569)..(570): Xaa can be any naturally occurring amino acid
  misc_feature (619)..(619): Xaa can be any naturally occurring amino acid
  Coding regions on vcDNA: vcDNA=SeqID_81401; Strand=+; Position=1 -108,148-203,514-838,884-1007,1061-1196,1244-1744,1818-2670,2723 -2952,2999-3048,3104-3317
  Homolog annotation: Hit_ID=XP_419506.1; Match level="QueryCoverage =98%, HitCoverage=43%, E-value=9e-78, Identity=34%"; Hit description =PREDICTED: similar to FLJ00002 protein [Gallus gallus]
NLMSSGGFICFHFFSLMNCHFEDVDRVGGLMVAFHAFWSMPINFAIFWSMPINFAIALYLLNREVGMAFLAGVLVSLLLIPLNKYIASKVGQFSNKMMQMKDARVKLCTASPPPCFXFPFLNTVTELSRSMRTVKLNNWTAFFEAKIGHLRSRELANLKGMKYLDAVCVYLWASAPTVIMVLMLVTYSVVLGELLTAASAPTVIMVLMLVTYSVVLGELLTAAKVFTTLSLISILIMPLNAFPWNAFPWVLSAIINGMVSKRRFDAFFAIRCGDQRQNIVTQAEGGGERLLGLDLLGLDGNSFAWNETKSAVSNVHFNGKKVQKMIQLEFIFPVKGMLIGVIGPVGCGKTSLLMGLLGETIATEPYVRVSGVDEGFAFVGQDVWLREGTIRENVLCERPFDQKMFQLAVDSCALSFDIQVNEKPIDQXRANEXIKFLQGPGKENYRISGDGITLSGGQKLRLQKLRLALARAVYAEKRVILLDDPFAALDRTVAEFVHKNCLLKLKEAGKLIILCTHHERFLSDADLVIRLNEEGSLIRSVGGEGRDEQMTKGEGVISLMGVIGLRKPXXGVDASPADAQSADGGTLNVIGKRDEEENAAPMDATEFVGVEKQRRKRRXTNPSKLRNWLYYFEIRGFFVEEEWSFLIGVALSPSNSYCPKLWHFSGRCGQNPSLRQLRAFHWGGTECVNYSVPFRFVCQFLILHFLTLSLPLAMQMSKIGSDIWLSRWASAVSPLPNGSEFTFSESFPSLLVFLFSRSESFPSLLVFLFSRPIQKMVPLTNAQQEETNFYLFVYIGIAALNTICTLIRAFLYAFGCILAAKQMHERILHRILNATLTWWDRTPCGRVTNRATLTWWDRTPCGRVTNRLSLSTDVNRVDDALPFQLNILLASLFPLVSSLLVTVVALPLLSPFVLLLTVAYFFLQAHSKTSNHSHLCCLAI

SEQ ID NO: 154979 - protein, 107 aa, Heterodera glycines
  Coding regions on vcDNA: vcDNA=SeqID_81402; Strand=+; Position=1 -12,373-530,845-995
  Homolog annotation: Hit_ID=NP_501392.1; Match level="QueryCoverage =98%, HitCoverage=57%, E-value=4e-40, Identity=77%"; Hit description =DNA segment Chr 18 Wayne State University 98 (21.2 kD) (4J55) [Caenorhabditis elegans] gb|AAC04428.1| Hyp
MYHFGNIVGYVLAKMEEEMEDDEPHGHITSLAVKRTFRRLGLAQKLMNQTARSMVEVYNARYVSLHVRKSNRAALNLYAHTLKFDICDMEPKYYADGEDAYMMKRRL

SEQ ID NO: 154980 - protein, 41 aa, Heterodera glycines
  Coding regions on vcDNA: vcDNA=SeqID_81403; Strand=-; Position=1 -111,261-274
  Homolog annotation: Hit_ID=NP_499085.1; Match level="QueryCoverage =100%, HitCoverage=46%, E-value=1e-12, Identity=78%"; Hit description= barrier to Autointegration Factor (10.0 kD) (baf-1) [Caenorhabditis elegans] emb|CAA79543.2| Hypothetica
MSTSLKHRDFVGEPMGDKEITAVAGIGPVYGKKLEDKGFDK

SEQ ID NO: 154981 - protein, 70 aa, Heterodera glycines
  Coding regions on vcDNA: vcDNA=SeqID_81404; Strand=-; Position=1 -153,437-496
MTKQSVFNLNKNFWQNEVAKKCAAKRQEECQGDQKGDKLMCRRSSEWHGIRNNWSNCWMVFALDWNLILF

SEQ ID NO: 154982 - protein, 453 aa, Heterodera glycines
  Coding regions on vcDNA: vcDNA=SeqID_81405; Strand=+; Position=1 -110,338-446,521-612,665-723,879-936,1024-1150,1329-1407,1475 -1621,1676-1799,1944-1996,2070-2205,2534-2642
  Homolog annotation: Hit_ID=NP_497055.1; Match level="QueryCoverage =98%, HitCoverage=68%, E-value=1e-146, Identity=58%"; Hit description= glutaminase family member (2P6) [Caenorhabditis elegans]
CMGLPFQWGMAICTIDGQQFSLGDSLAPFCFQSVSKAFNYAIVASDLGDYVHSFVGHEPSGRLFNEICLDPNGKPHNPMINSGAIIVKPHNPMINSGAIIVTSLLKKGVAMADRYDFAFKEYKAFKEYKKLAGGGYIGFNNATFLSEKKTADRNYALSYYMKENKCFPPENKCFPPDCATLREELDFYFQLCSLETHCESAAVMAATMANGGVCPLTEERCIQSRPCRDVLSLMYSCGMYDYSGQFAFDVGLPAMYDYSGQFAFDVGLPAKSGVSGGMVVVVPNLMGICLFSPRLDRMGNSTRGVLFCQKLIGVLFCQKLIDTFNFHNYDSLLHADSKKIDPRRRLGNTETDLIVNLLYASKNGDLETVRRLYLQGVNLNICDYDGRTPLHLAACEGHALLLKFLLNIARVDYTIKDRWGRSALDDARTFHRTTCVALLLKTAQRRRRSYEQH

SEQ ID NO: 154983 - protein, 237 aa, Heterodera glycines
  Coding regions on vcDNA: vcDNA=SeqID_81406; Strand=-; Position=1 -48,217-444,646-855,1116-1343
MFDDLSRNIEAFEKSMVVAFDKWHSSSELAEQQVDSLRNAVAKLETCDADAVARLSASVARFETGNFAKLKESGQRIIRPLSLERKRQIEVKVAAIERELCFNKSSIQHHSKNSLQIIDKEVLGVREWIEERDEDADLIGTLLKHGEKKHIDEIDALMARSKKNQARVAEYHKNWQLFNEKVKEIAHQANDEEKGEDIVGRVGASVERLRQLEERFKKFVEELEKLRTTAANDETEQ

SEQ ID NO: 154984 - protein, 65 aa, Heterodera glycines
  Coding regions on vcDNA: vcDNA=SeqID_81407; Strand=+; Position=1 -71,426-552
MATRKRPRENVLARPNAWVPVDPYARALIGNAITNEYSIHNHLNVCPRERKKIQRKKWFHHKKAI

SEQ ID NO: 154985 - protein, 214 aa, Heterodera glycines
  Coding regions on vcDNA: vcDNA=SeqID_81408; Strand=+; Position=1 -347,398-695
  Homolog annotation: Hit_ID=XP_397365.1; Match level="QueryCoverage =86%, HitCoverage=38%, E-value=9e-20, Identity=29%"; Hit description =similar to SUMO1/sentrin specific protease 1 [Apis mellifera]
GQDERLTIDGLLCLCDGQWLNADIIDCYLDLICRCSPRAHFIPTYAILSYGRKGTVPSEWYWQLAETDTIFAPAHLYNNHWAMAILDMRERTLRLMDSMNHGYTDTEKKEFMETIMNILRDVAILQKVDIGDRSAWDVQERLSVPQQRNGTDCGIFALLFAQYSLERRQLEFGQCHIPYFRRRICHDIISVILHDQKSPVNRSDETVVQCPFAL

SEQ ID NO: 154986 - protein, 189 aa, Heterodera glycines
  Coding regions on vcDNA: vcDNA=SeqID_81409; Strand=+; Position=1 -113,623-1079
MARLSHNLSIALLQSGRTQLSKRNNNDGPSQRTIKHTKALIKEVPEAIFCRSFLLSNGSLKIASSILNAKKAVSASSDDDPSFISEFVLCGEAPRLWAKVKQLEGQKRFLEAAQLLDGVEVENLRLIHQFLANQMTDSLRLLLDQARLYRIAGNTKKALSCYQRAHTLDCTNAEGMDAFAALLGTVSES

SEQ ID NO: 154987 - protein, 29 aa, Heterodera glycines
  Coding regions on vcDNA: vcDNA=SeqID_81410; Strand=-; Position=1-93
FTVYALIIAQSLLIPQSPIIPQSTRCFEK

SEQ ID NO: 154988 - protein, 301 aa, Heterodera glycines
  Coding regions on vcDNA: vcDNA=SeqID_81411; Strand=+; Position=1 -460,510-955
MDTTTINRILAGNTKTREHYLGCFPCDKLPNIINKYPSTFVANNDPSNKEGTHWIAMFIVDDRTVYYFDSFGRKPNRCISQFLRNYEKVISNKPAIQSVFSENCGYYCIYFVHFMCSFGGRNYESNFEKMRKKLIGEDNPDLFVVNFVKKLIKNTIIASLLNCPARNLCDRLNHPDEIQKVEKYLKGKTLQTTYKNQLDEYKDFEYGGITKECARKQMAYNGFKNVTVDQHFYVRHRICLRYANNPCVIEKHKNGNERFYPLELVRVKDKNDIYLGQNFPKPIPSICNDNDFIDDQPCYHW

SEQ ID NO: 154989 - protein, 222 aa, Heterodera glycines
  Coding regions on vcDNA: vcDNA=SeqID_81412; Strand=-; Position=1 -393,443-717
ILTSSAYNLIFTPDGMTSGRFWDVFVRELWPIFSTNIRCLGFFRGDHLDNLLRQISPTILTDLNKLNSINSYDLLPAAIGDDFDVPNATISAGQALSKWLHSPRKDGQPKRLRCVDYNKQTNFDWINNFKEHFLRANAISSVNYQIHFSVHVPSMPMVPFELVNEWTKEKLTLTKANELDNIWIMKRCKIIGETAAVDWKDGNWDNNCNNVFIWLSYGIKSI

SEQ ID NO: 154990 - protein, 53 aa, Heterodera glycines
  Coding regions on vcDNA: vcDNA=SeqID_81413; Strand=+; Position=1 -114,558-605
  Homolog annotation: Hit_ID=AAK83039.1; Match level="QueryCoverage =96%, HitCoverage=30%, E-value=6e-19, Identity=88%"; Hit description =calcineurin B [Bombyx mori]
MMVGNNLKDTQLQQIVDKTILFHDKDGDGKISFEEFCDVVGNLDVHEKMVVKP

SEQ ID NO: 154991 - protein, 153 aa, Heterodera glycines
  Coding regions on vcDNA: vcDNA=SeqID_81414; Strand=+; Position=1 -115,161-366,587-727
MAKLKRNIKREAVKQRWQKQEERKAQTAKAIQARLAKKNAPQPNLDEQMSQQDEAGPSNSAASAEEAMEPPPPTPGPVPTPEMDEEILEFGFSLPSTSVTPIGDCLQEMRHCIPCGGDLSNFGKRCRTVYKCANSWSIISSRIGCWTPGDLTN

SEQ ID NO: 154992 - protein, 100 aa, Heterodera glycines
  Coding regions on vcDNA: vcDNA=SeqID_81415; Strand=+; Position=1 -79,170-238,496-650
MKKVIKKLTSMSLTDRGFMVFIFITSAIHAPGIEPGTPILVTFSQTTETGSEYQILITISTQFDPQILIGTKNRILWQWLLARIELRKIQPIIIKYIAAK

SEQ ID NO: 154993 - protein, 53 aa, Heterodera glycines
  Coding regions on vcDNA: vcDNA=SeqID_81416; Strand=+; Position=1-159
DHLCFDHSAALGEHGHRWFISVGIRFTFGALRLARVDERKKGQLPEQMFTSPR

SEQ ID NO: 154994 - protein, 126 aa, Heterodera glycines
  Coding regions on vcDNA: vcDNA=SeqID_81417; Strand=+; Position=1 -243,291-428
MCEACGQKAIAPIHTVFVRLLLQDVEQADIAQRVTMFSSVAEEFLGMKAAELLAKEKEPESLAKHLDDLIAVNLIAKVNIKANNQTYTGFDWIVNLFKKCPGNDDSDVPKEKNDVDEIATKKAKKN

SEQ ID NO: 154995 - protein, 312 aa, Heterodera glycines
  Coding regions on vcDNA: vcDNA=SeqID_81418; Strand=-; Position=1-938
  Homolog annotation: Hit_ID=XP_204841.2; Match level="QueryCoverage =93%, HitCoverage=49%, E-value=2e-50, Identity=36%"; Hit description =similar to CG33103-PA [Mus musculus]
MLDLDLDSMLDLDLDLHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGFHVGPGPGSMLDLDLDS

SEQ ID NO: 154996 - protein, 301 aa, Heterodera glycines
  Coding regions on vcDNA: vcDNA=SeqID_81419; Strand=+; Position=1 -132,184-332,390-528,581-671,720-816,873-1026,1119-1262
  Homolog annotation: Hit_ID=NP_494979.2; Match level="QueryCoverage =71%, HitCoverage=36%, E-value=3e-18, Identity=30%"; Hit description =DiSHevelled related (dsh-1) [Caenorhabditis elegans]
MEGEQLENDENVSPSRVSPTNAFGVQKSGHLLHNFAEPGPLTTKIYYYVDDQQIPFSTEIAIPPSKITLADFKKCITRRNYRYYCKVMDPALNAEVKTDIRDENAVLKPNSKNGRFELFLLSETQQTHSSASTLPIQKLQHVDAIRASLMEKRTTANNYILDGRPKFIDDSSSSPEEDSTNLRLFGESNFEGITGSIDDSDSQYTTDFTSVSQQNPHVPKRKFAMAERWCGESCDDGKHGHGQQQQSHRHRLAFHIRGHHGSINVLGNDHGEKPLPYMIYKGTFQTVTAQIALKPLLSCRA

SEQ ID NO: 154997 - protein, 83 aa, Heterodera glycines
  Coding regions on vcDNA: vcDNA=SeqID_81420; Strand=+; Position=1-253
GNNCQGRICRNPCFERQGKHLCQFGLALAVQTQIQRTIGGERWVFDVFRLMDCFSIYLIVFLGIFLFGFNHWFSLTYDKLIFC

SEQ ID NO: 154998 - protein, 154 aa, Heterodera glycines
  Coding regions on vcDNA: vcDNA=SeqID_81421; Strand=-; Position=1 -90,146-175,218-255,318-417,475-678
  Homolog annotation: Hit_ID=CAE57332.1; Match level="QueryCoverage =79%, HitCoverage=43%, E-value=1e-13, Identity=36%"; Hit description =Hypothetical protein CBG00261 [Caenorhabditis briggsae]
MCSAAQKFEQHIQYADIWYLTFQFKDSEEPVVVEITDPGTEKTGERQMAIQQKSDAIILCYSAFNPGSFLALESVTEDFQTFNGKPPATLLLCNEDQLAEEGFEDGHETDTADDGYGTNSGGGSPSDREMPPQTVPKRRSTTPTGRQHSMERIR

SEQ ID NO: 154999 - protein, 138 aa, Heterodera glycines
  Coding regions on vcDNA: vcDNA=SeqID_81422; Strand=-; Position=1 -122,172-291,356-532
  Homolog annotation: Hit_ID=E86336; Match level="QueryCoverage=93%, HitCoverage=39%, E-value=2e-23, Identity=42%"; Hit description =hypothetical protein F14O10.11 - Arabidopsis thaliana gb|AAF88160.1| Contains weak similarity to an unknown pr
KKDEKRGKEEKVKETEKPKEEKKKTKEVKEEDEKKKESKTAKKKENKGEAEERKVDEEEEEGEEDEEEEEDEEEEEGEETEIDDEEDKENIEDEAEIDEEEEEEPRKKKRRKGRRKKKVEIDNLKWKGTNGQKSTFGT

SEQ ID NO: 155000 - protein, 232 aa, Heterodera glycines
  Coding regions on vcDNA: vcDNA=SeqID_81423; Strand=-; Position=1 -126,208-383,550-635,686-996
  Homolog annotation: Hit_ID=CAE66840.1; Match level="QueryCoverage =37%, HitCoverage=13%, E-value=8e-13, Identity=42%"; Hit description =Hypothetical protein CBG12210 [Caenorhabditis briggsae]
MDGHSYSNRAEQDIILDYVKRVCTELHVKPSEIGVVTPYNYQVRRLRHKLSTEHKGVTVDTVERYQGSQRRVIIVSTVRNNEKEAIGFLMSDKVFTNSKSWMIDYCRKNGATVDMPSEAELFPSGQFQNDVLTDSDKSSSSSSSEVDEKERTDELVKKGTSSAAAAEQQNLRAKASSAEEEDEDDSSVAGETTTEDDDEEEDDEDEDDFDESSSSGDGDEFLTDTDEEEEQH

SEQ ID NO: 155001 - protein, 84 aa, Heterodera glycines
  Coding regions on vcDNA: vcDNA=SeqID_81424; Strand=-; Position=1 -83,144-315
MVDYFKKIGISSSLIERYESNPNYKDDPRIVTMLRANYRSHASIIDVPSRLFYANQMYVPEDAQPRDPLATWKALPKQVVSVLV

SEQ ID NO: 155002 - protein, 251 aa, Heterodera glycines
  Coding regions on vcDNA: vcDNA=SeqID_81425; Strand=-; Position=1 -57,406-504,578-787,853-930,981-1103,1172-1360
MGSRRTVHGGLEIIPLPRLEILEYLNQKEPPGLLAYAKKQKAYNRLLMLNDQITSEDNKTGPHTVKLCSRSRTGASVYGVQLSIDYCERNSNDIKASPVIILEPYEQQQSRQNMQYYDPYYKGRVISTDEKKQTIHFLPFFRTMPEGNYMVRFLPSQFVYNSRNHIMNELQDNQRPYRFLIFPPPVDEKLTVEQYVELRDLAISKCQFMSDRFNTEQRQAIVVSSNNNRLGYGQIVYHLVKKCLLRQLPMR

SEQ ID NO: 155003 - protein, 289 aa, Heterodera glycines
  Coding regions on vcDNA: vcDNA=SeqID_81426; Strand=+; Position=1 -102,247-303,440-554,1295-1343,1417-1602,1695-1839,1900-1966,2019-2167
  Homolog annotation: Hit_ID=CAE61708.1; Match level="QueryCoverage =66%, HitCoverage=31%, E-value=4e-28, Identity=36%"; Hit description =Hypothetical protein CBG05657 [Caenorhabditis briggsae]
MASKHQMIATPMEYMYNLDADKVLERFGKYGKYQMIVYLMAALNFFIFSYKTTDSSLSLNDSRHYVTLATDFGIGCEDKHLLEHANGAFMLESIHWLIANGKTKGVKRYISRASRVNNVTLNLHSCQSDIVAPDQTPPHPSNAPRAKRNFLDLFRMPTLLLHLSLNCYIFIVLNFVYWVLTLYSVKLHEQRMIGFFLSAVVEVPAGILAMLLLFCCGRRTVTVVALFGQTVSLGLTILVPQGSTSNLLLSLVAKVFNGVSWASEPLLLSEMAPTTVRNMVRLLLLLLLF

SEQ ID NO: 155004 - protein, 142 aa, Heterodera glycines
  Coding regions on vcDNA: vcDNA=SeqID_81427; Strand=+; Position=1-426
MQKIVVTAMSVLAILFALVAPETSGRALPQDLADFDGGPCVAFLCRTLKRWRSGGDTKKRRRKSNALVEEGSSGERTALAEEAAAEDGGDEDGAVPAAEQRQRQQTNSNNNDDNASRTGQAIVGDEAVVVDNNRTPNRKWYQ

SEQ ID NO: 155005 - protein, 374 aa, Heterodera glycines
  Coding regions on vcDNA: vcDNA=SeqID_81428; Strand=-; Position=1 -138,195-297,405-476,577-634,700-784,890-995,1070-1437,1768-1836,2332- 2350
  Homolog annotation: Hit_ID=NP_503790.1; Match level="QueryCoverage =91%, HitCoverage=52%, E-value=1e-67, Identity=43%"; Hit description =matrix metalloproteinase (62.5 kD) (5D384) [Caenorhabditis elegans] gb|AAG23982.2| Hypothetical protein C
GKLQRRGAEPEDQRKIKIKTKDVKMQIKISIFRKAIKAFQSFAHLAETGKLDIKTKKKMAQPRCETGKLDIKTKKKMAQPRCGMQDAQMIVGPGGDQKKWNKNLVTFKINNFSPQLPQSRIRDAIKRAYDTWSQVIPVRFQAQETQGQADINAQETQGQADINVQFAARSHGDPWPFDGRSGVLAHATMPTDGKLHFDDDERWALGPEDARKIAKFGYTDLFPGYTDLFPVAVHEIGHTLGLEHSKVENAIMAPFYQESVDDNGNYIPQTLKSDDIRRIQAIYGGSGGGGRTPSSAAGTSGGRRPTTTTGGGSTGSGSFGRRLGKREQFRRIRKQRQGQQLWRQCRFGTSDDDWGGLFGSGGRSRTTSNGMGGG

SEQ ID NO: 155006 - protein, 184 aa, Heterodera glycines
  Coding regions on vcDNA: vcDNA=SeqID_81429; Strand=-; Position=1 -75,437-558,937-1114,1317-1496
MAKSYRITKNGAMGRNGGEKVVNGLQQHREKKISVLHAHVDEQHNNEGNGGPTANEQNMGMVMGERAFVATPLLQQRRRMPTTPSATTSNNNNLYCSKLSAPPLAPMNNTSSPPTNDQQNGTYERQKPPTIRVQMANGANASLPGAADHSGDAKPLACRQKQSQRQNDQPNRWPSAPIAPKDEL

SEQ ID NO: 155007 - protein, 90 aa, Heterodera glycines
  Coding regions on vcDNA: vcDNA=SeqID_81430; Strand=+; Position=1-273
MNGPEEFAIVEQVDEAENGRTVDQQTMAKLRTFAKRCIFLQLDRLHLSLIMAMSARAHSAGDVVAQVKFVNALKGLTLPKYYKKIGVAFL

SEQ ID NO: 155008 - protein, 143 aa, Heterodera glycines
  Coding regions on vcDNA: vcDNA=SeqID_81431; Strand=+; Position=1 -142,334-494,552-680
VQHENLHQICDFLGYRKSPDSNVFSGFMFLVTEKLGPKTGCRKAFPFDFVPHLNLNNDSPEYMDYLESLDDCKRPMGTENRRRPIKPLILKKKSKSGQQQESQSACAAPKLLPIPKSVAESVDLREGQPVLIRRYKKERRQQN

SEQ ID NO: 155009 - protein, 74 aa, Heterodera glycines; identical to SEQ ID NO: 140367
  Coding regions on vcDNA: vcDNA=SeqID_81432; Strand=-; Position=1 -24,86-286

SEQ ID NO: 155010 - protein, 55 aa, Heterodera glycines
  Coding regions on vcDNA: vcDNA=SeqID_81433; Strand=+; Position=1 -93,144-218
MELNDSQNSNGMPREKHVDLVDFKVKEFKLETFFSMHLEVMGKYDTRAGTLRDCD

SEQ ID NO: 155011 - protein, 97 aa, Heterodera glycines
  Coding regions on vcDNA: vcDNA=SeqID_81434; Strand=-; Position=1 -164,446-574
  Homolog annotation: Hit_ID=NP_499777.1; Match level="QueryCoverage =83%, HitCoverage=50%, E-value=1e-25, Identity=71%"; Hit description =protein conserved (3O528) [Caenorhabditis elegans] emb|CAB07619.1| Hypothetical protein F45G2.10 [Caenorh
IYATKARRALAAEAATALDDGTEEPIDATEIFEHIRDINDPEHPYTLEQLNVVQEELIQVSADPTDPFVDVRFTPTIPHCSMAALIGLAIYAKLRRR

SEQ ID NO: 155012 - protein, 529 aa, Heterodera glycines
  Coding regions on vcDNA: vcDNA=SeqID_81435; Strand=+; Position=1 -124,389-766,1449-1579,1821-1965,2108-2916
  Homolog annotation: Hit_ID=NP_740921.1; Match level="QueryCoverage =100%, HitCoverage=45%, E-value=1e-78, Identity=33%"; Hit description= neuronal cadherin, embryonic epidermal enclosure and axon fasciculation factor, HaMmeRhead embryonic let
MNLESGPLRIHENGSMELIEALNFEQSAEWIQSVQIDGTHKTRLQTIRIDVLDVDEPAVFINRPRPFLAVVPPLEILPRGFQVFRLEAKDENGEGSAEKVTFRLINTERKTKSKASFDEYAKHSAPNSFTVDGLSGAIRTALTKYSPGGTYKVFVEAMDNGGAEQRVVDAIDADSGLNSALLFAVDHPQFMVNGRGELQRKPGTKPLDADQVAEDALGGTPVVQVQAIDPDRDQVNYAFVDEEGDETVVNGLFEIDPDTDDGSCCSHRRKGLAVRHTTKATVSEQTDKDRANYHNKVNTNKDDCAICVKVLVGVLDLNNNKPEFPHCADYSRMAMVEEGQYRVNASPILRVEAIDHDLGRNGHVSYSLYYARSESRKPFLIDSDSGELRPSPYFVFDREQKVVEEVTIKATDKGDRPLIGFCQFKVQVIDVNDNAPAFDKSIYETSMGRAARVGTAVLTAVAEDRDGPRNAHISYALAPDETSSAEHFEDFQSFTLPDPEIGEIMLAKKVPPENDRLLFSIIATDNGFP

SEQ ID NO: 155013 - protein, 132 aa, Heterodera glycines
  Coding regions on vcDNA: vcDNA=SeqID_81436; Strand=-; Position=1 -50,286-634
MCRLQRDFSLHRIVQDRLLNNYIGQPRPNGTWSQPTFPPEQWNVYTRTLNGEARTNNHAEAEHHRLQGAFNCRHPSIWHFIDVLRREQKGTDGKYASFVAGLEPPQKAPKYQAPEQAPLQFGAKLHSSEPEQ

SEQ ID NO: 155014 - protein, 119 aa, Heterodera glycines
  Coding regions on vcDNA: vcDNA=SeqID_81437; Strand=+; Position=1 -87,329-424,474-650
  Homolog annotation: Hit_ID=AAB35044.1; Match level="QueryCoverage =91%, HitCoverage=30%, E-value=2e-20, Identity=42%"; Hit description =filarial antigen [Brugia malayi]
MQIKIEEAEVTALKTGPKMAAKLEGQLKAAEEERKNYEKLCDLAEKLQVKIRAQKKLLDDTEEHANISLQKYRQFQISVDNAEERANTAESSLARMRSRSRLAVPSGSGPLAKSETFAL

SEQ ID NO: 155015 - protein, 19 aa, Heterodera glycines
  Coding regions on vcDNA: vcDNA=SeqID_81438; Strand=+; Position=1-57
GPGSRSRVLKSSGPGPGRA

SEQ ID NO: 155016 - protein, 91 aa, Heterodera glycines
  Coding regions on vcDNA: vcDNA=SeqID_81439; Strand=-; Position=1 -93,471-650
MGQRPNVRDAAPRGTWESIAQMLGPNDAINSRFSALSSKRCTRRENKICFTADRDVLISGVAIYGANQSGSRMITDDSTAKTNWEHKIAIK

SEQ ID NO: 155017 - protein, 189 aa, Heterodera glycines
  Coding regions on vcDNA: vcDNA=SeqID_81440; Strand=-; Position=1 -49,360-505,586-765,1549-1677,2040-2105
MDLRAAPKENGTSSNGAFFKSADDAEGISTEGNSHAEVSLTSRLNAFRLKDVGCDVAFVVGEEKEQLKAHKLVLGASSAVFFAMFYGPLGSSFVGTAIPQIAYEVPQIVHESTTTTAAGHQKAAQIDFVYSDFDVRSLSVRGQLTDDNVMNTLYAAKKYAIDALVTECCYQVIDQNTDLALDAANVADI

SEQ ID NO: 155018 - protein, 367 aa, Heterodera glycines
  misc_feature (18)..(18): Xaa can be any naturally occurring amino acid
  Coding regions on vcDNA: vcDNA=SeqID_81441; Strand=-; Position=1 -262,398-586,638-744,807-879,926-1041,1092-1235,1284-1386
  Homolog annotation: Hit_ID=NP_501066.2; Match level="QueryCoverage =98%, HitCoverage=60%, E-value=1e-105, Identity=58%"; Hit description= IMP dehydrogenase/GMP reductase and CBS domain containing protein (58.2 kD) (4H681) [Caenorhabditis eleg
SKMAFGPTISLKHFLFLXTGKLPIVNERDELTSLIARTDLKKAREFPRSSYDAKKQLMVGAAITTREKAREAVKALVKAEVDVLVIDSSNGSSKFQVDLLRWIKSEFPEWPQVIAGNVVTMRQAKLLIENGADALRVGMGSGSICITQEVCAVCAVGRAQGSAVYNVARFAKTFGVPVIADGGIRDVGYITKALAYITKALALGASTVMMGGLLAGTNEAPGEYFWAPGEYFWGPSGVRLKKYRGMGSLDAMEANECSQDRYFTCEDGNIKVAQGVTEDGNIKVAQGVTAAQRDRGSVFKFVPYILRGIQHGLQDIGVRSIAELWNGVNCGAVNGVNCGAVKLERRTHSAQLEGGVHSIHSYVSRLI

SEQ ID NO: 155019 - protein, 35 aa, Heterodera glycines
  Coding regions on vcDNA: vcDNA=SeqID_81442; Strand=+; Position=1-105
MVLLLLLVVLDGLFMLEVMLLKLLKVAIKLKLLLL

SEQ ID NO: 155020 - protein, 94 aa, Heterodera glycines
  Coding regions on vcDNA: vcDNA=SeqID_81443; Strand=-; Position=1 -160,207-329
  Homolog annotation: Hit_ID=EAL32603.1; Match level="QueryCoverage =65%, HitCoverage=11%, E-value=4e-18, Identity=70%"; Hit description =GA14756-PA [Drosophila pseudoobscura]
MDVTSNPNGSVEFEKVPKSLKKGCADTGLDFDEDGLTIHELFSQGTGLTYNDFNILPGYIDFPVSDVELGTHLTRKIRLSAPLVSSPMDTVTES

SEQ ID NO: 155021 - protein, 200 aa, Heterodera glycines
  Coding regions on vcDNA: vcDNA=SeqID_81444; Strand=-; Position=1 -51,110-661
MKTLTITVRNEKSVKDEIKYPVHIYDPKYSKSVNLWKQIRHFGWSTAIIAIEHGGQLNTCPHPLTPNNTWPFSRHQLHRSLIINFFPLSLSYFPFLLPSLSLAYSSVGQSPSHFVPQFAESFVVLCSASSPICDQSTARLPADFDGIFAPFVGASFPSARPLSRLHLLQAFGCAFPWPSMSSAKRILICVNAASARAVTS

SEQ ID NO: 155022 - protein, 20 aa, Heterodera glycines
  Coding regions on vcDNA: vcDNA=SeqID_81445; Strand=-; Position=1 -23,201-240
MHCLKRSKQISFSMGCCVIK

SEQ ID NO: 155023 - protein, 219 aa, Heterodera glycines
  Coding regions on vcDNA: vcDNA=SeqID_81446; Strand=-; Position=1 -81,286-403,522-795,1175-1361
MDKGNGGRNVCRMDWNEEWKREINEQKTFAELLKPIVTRSAQRREAAEDTVLAKRQMGFRRGPLANQGLPLPMPPSNAEVVVEPNGTTSTTTVKVAARQKAKTSSTTTAAKVVATQNAGCSSSSTAANVRQPSLSSLSAEEIARQKKGQKQIQQKTGKLSRARGCLSTKSDALELTHFHDIDSTIDSTLHAIVERPVAPFLQQRLNARPLFHQCNKKFF

SEQ ID NO: 155024 - protein, 42 aa, Heterodera glycines
  Coding regions on vcDNA: vcDNA=SeqID_81447; Strand=+; Position=1 -65,124-187
MAVNIERNLKEVQEEIVKMQNRKRRFCELLEMNEVKSAIFAL

SEQ ID NO: 155025 - protein, 37 aa, Heterodera glycines
  Coding regions on vcDNA: vcDNA=SeqID_81448; Strand=+; Position=1-113
THLRLSCYCTNNRDGAHLTLLPLVWPTSRPHQLPSHL

SEQ ID NO: 155026 - protein, 54 aa, Heterodera glycines
  Coding regions on vcDNA: vcDNA=SeqID_81449; Strand=+; Position=1 -40,472-596
MVAVKLLVWNVAKNFRQQRKMRWAGTLSMLTTNTRLNCSRNNSKNSEMRRQTGP

SEQ ID NO: 155027 - protein, 47 aa, Heterodera glycines
  Coding regions on vcDNA: vcDNA=SeqID_81450; Strand=+; Position=1 -111,276-308
MRVVINGRNEGKVENKEKGDEEKPKQSAEDGKNGFEEDIDSDADSWG

SEQ ID NO: 155028 - protein, 124 aa, Heterodera glycines
  Coding regions on vcDNA: vcDNA=SeqID_81451; Strand=-; Position=1 -152,585-807
MKEKKMGLNSNRKISLIVPVWGHLGWQKAIWAYLRPIKVPKNSETSTKVPRDNKRGKVIGNIMPRLRAFLSKLLPVFEGDQKDANVHQNAGDDDSIEQRCREDEHWGMARVFVLDPQLKKHWLT

SEQ ID NO: 155029 - protein, 111 aa, Heterodera glycines
  Coding regions on vcDNA: vcDNA=SeqID_81452; Strand=+; Position=1 -68,132-399
MANFIAIVFYVFIWVVVKWKKCNRQPIAHQCHQIKDQHQRAFVQVTGGDHFDQHRLLSDQCRRPTVRFAALALGPSQSVVCGAVLWHSVECRRCAECAGAFHLQVAKFFNF

SEQ ID NO: 155030 - protein, 163 aa, Heterodera glycines
  Coding regions on vcDNA: vcDNA=SeqID_81453; Strand=-; Position=1 -343,1015-1163
MDNLWKIFGIHLKKLPDFENSQKKLERNSLKPMHDFLEVLEKNIGKKNTEKGTQRQRILVENYAALLTDSLVEDAKLRTEFKRRARVRQRLRKMFEFAEGNLGIFEDEFWNIFNVNGREKGKRKENESAEKDGGEEAQSDGWKLIKQIGEQSGKMPKKGGGGE

SEQ ID NO: 155031 - protein, 177 aa, Heterodera glycines
  Coding regions on vcDNA: vcDNA=SeqID_81454; Strand=+; Position=1 -111,498-581,966-1304
MPQLGIKGTAGILNIFCCIYFLYSLHKLQTSRAMMKMKNHLVIVTICFAICLDFFPAFLSIGLTIFGSGLLSNVASTSTVLDSLCCAIYFSLVFVPPSWLKRGGANNANAIGGTTNIQQQRQHSQLQPQQRTNRIASTVSMMSPIIVPALNRHPPISRYSDGMVQIGTVSATVRHGT

SEQ ID NO: 155032 - protein, 67 aa, Heterodera glycines
  Coding regions on vcDNA: vcDNA=SeqID_81455; Strand=-; Position=1 -22,290-471
MATIGIGDFHPDAANVLEAAVAIVFLGSGIGLLAALMIGIAYHFQSLFFITLRGWLLKRIQFSKQQK

SEQ ID NO: 155033 - protein, 33 aa, Heterodera glycines
  Coding regions on vcDNA: vcDNA=SeqID_81456; Strand=+; Position=1-99
LFMLLTAIILAVIAVMNPSWQTVDIREFQAEHH

SEQ ID NO: 155034 - protein, 427 aa, Heterodera glycines
  Coding regions on vcDNA: vcDNA=SeqID_81457; Strand=-; Position=1 -351,687-1619
  Homolog annotation: Hit_ID=XP_308192.1; Match level="QueryCoverage =67%, HitCoverage=75%, E-value=5e-75, Identity=47%"; Hit description =ENSANGP00000021557 [Anopheles gambiae]
MELEIDLNRAFGIPAIRAVENKKELDACLAQYPEVFQDGVGRCKKMASLKFKEGCQPKRCKPRPVPFSLRNEVEKVLDQWQSEKIIEPVATSEWATPLVIVPKANGKLRLCFDCKVTVLKRLSENGLRVKREKCEFLKPEIEYLGHIVDKKGLHASPGKIETILKMPEPKNLKELQSFLGMVNYYGKFVPSLATLSEPLNELRRNDAKWTWTKSQQKAFDGIKKVLTSTEVLVHYDPQKPLFLAADASDYGVGAVIFHKDEKGKVGVIAYSSRTLNSSERNYSQIEKEARAIIFGVDKFKQYLYGRKFVLQTDHEPLKKIFGPKGELPIVAAKRLHRWSLTLMNFDFEVVYCSTKEFGNADGLSRLPCPEETTIDCVGLEVQQVQAENISCLPVTVSAIAKEVKKDEILRKVKEFIEKGWPQKSKKD

SEQ ID NO: 155035 - protein, 376 aa, Heterodera glycines
  Coding regions on vcDNA: vcDNA=SeqID_81458; Strand=+; Position=1-1128
  Homolog annotation: Hit_ID=CAA82797.1; Match level="QueryCoverage =74%, HitCoverage=42%, E-value=7e-19, Identity=26%"; Hit description =gag protein [Ascaris lumbricoides]
MSGFLRTKIAIELKALEKAKTATELYAEPDQTLTSLENAILLESAAERIKSEVEAVNAKIEQIWITASKWHDVIQKMDKDERKSEQTAYEQFQTTEKLNTKMEAANTKLTELKDLEMKVEAGAKLQRSKADRDARVEQREHAKAMAKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEYVRRLHTELSNLKRCFSVEDTKHFCMELERLARELEAAEEDIEGPPIYLMLEKKLYKPFLREILEEKAKNPDFWDTSSLRKALGSALSKELAIKEVMREYGFEGKEANPEHGFKRQLRRNRFGGSVN

SEQ ID NO: 155036 - protein, 367 aa, Heterodera glycines
  Coding regions on vcDNA: vcDNA=SeqID_81459; Strand=-; Position=1-1104
  Homolog annotation: Hit_ID=AAA93301.1; Match level="QueryCoverage =91%, HitCoverage=89%, E-value=8e-50, Identity=33%"; Hit description =HASI
MEKSIENVLERLYNDPKSPAAFAGVDRLWLEAKKELGHKVSKKDVKHYLEGHRTYTLMRPRRINFPRSRTTAAGFMTDCQVDLADFQSLSRHNSGNRYIMVVIDVLSKQIFVTPLRTKKADDMVEGFKSVFSKMPMKPHRIFLDKGTEFKNQQLKKLFDEEEVEKYESTHSEKKAALAERAIRQIKNRVYRYFAQLKTLNWVNVIDKIVSGINNSPIRVHGMRPIDVNFKNSQKVWERMFGADQHRALFGKHRKRPKFMPDQTVRMSIAKGQFEKGYIPNYGDEILEIDAVKRHTKPMRYKLRDAKGEKFKGFFYPEELTPVRKEAETAYRIERVFRKRKRADGTMEVLVKFIGYPEREWIHETQLV

SEQ ID NO: 155037 - protein, 109 aa, Heterodera glycines
  Coding regions on vcDNA: vcDNA=SeqID_81460; Strand=+; Position=1 -65,131-237,546-703
  Homolog annotation: Hit_ID=NP_509780.1; Match level="QueryCoverage =88%, HitCoverage=53%, E-value=2e-22, Identity=46%"; Hit description =lysophosphatidic acid (XL244) [Caenorhabditis elegans] emb|CAA90689.1| Hypothetical protein M79.3 [Caenor
MVLMFRRAVFQDDVTVYPVAIRQEARFGDAYWSEDNFMHYLFRVMTSWAIVYNVHYLAPQHRRPNENATEFAARVQRLIATRVGVRPIAYDGGGIWWVFVYLSDMNSHA

SEQ ID NO: 155038 - protein, 314 aa, Heterodera glycines
  Coding regions on vcDNA: vcDNA=SeqID_81461; Strand=+; Position=1 -158,410-471,524-550,615-711,804-998,1410-1535,1648-1743,1790-1906
  Homolog annotation: Hit_ID=CAE65985.1; Match level="QueryCoverage =94%, HitCoverage=40%, E-value=3e-82, Identity=55%"; Hit description =Hypothetical protein CBG11176 [Caenorhabditis briggsae]
PDFRRSKAIDRFLAKSDSAKKQRSDKAHVDSVFFRRLLRILRILIPSPFSMELLFMVAIALSLMLRTYADVWMIQTSTKIEAIQTSTKIEAAIIAIISRHKPRFWRSLTDYLLCMPLVSVINSFLKLSLCELKLRFRERLTHHFYAQYLDGFTFYKMTNLDNRIANADQLLTQDVDRFCEGIVELYSNLSKPFVDVLLYVSRIGASIGWQAPIQLFVYLLFSGTALTYLRRPIGRMTVMEQQLEGDYRFVNSRLIVNSEEIAFYQGNERERVSVLNAGNERERVSVLNAFQRMVGNLEKHLFQSLNSRFLDSFF

SEQ ID NO: 155039 - protein, 183 aa, Heterodera glycines
  misc_feature (15)..(15): Xaa can be any naturally occurring amino acid
  Coding regions on vcDNA: vcDNA=SeqID_81462; Strand=+; Position=1 -127,231-434,1180-1406
  Homolog annotation: Hit_ID=NP_495407.1; Match level="QueryCoverage =87%, HitCoverage=23%, E-value=3e-45, Identity=57%"; Hit description =ATP-binding cassette sub-family D member 3 like (75.3 kD) (2H172) [Caenorhabditis elegans] gb|AAA68339.1|
VQVEFCNCFPIKFNXCAIIHRPYFNEQNEGMMRKDKTELMQAYYAYYTTGRMMVKLADALGRLALAGREMTRLAGFTARVDQLMHVLADLEQGEECGRTIDTSNDLGTHFISRPGSGHVLVQDNLIRFQQVPLVTPNGDVLIRSLDFEVPSGTNVLVCGPNGCGKSSLFRVVRRKWNTIGGGG

SEQ ID NO: 155040 - protein, 38 aa, Heterodera glycines
  Coding regions on vcDNA: vcDNA=SeqID_81463; Strand=-; Position=1 -89,259-286
MAGAGAEGGQGAGGGRVGGGGEQQCRRGRRKNKFPVRK

SEQ ID NO: 155041 - protein, 67 aa, Heterodera glycines
  Coding regions on vcDNA: vcDNA=SeqID_81464; Strand=-; Position=1 -3,134-278,516-571
MFGAVRVHLQREPRADGQMVFEGQRIGGRSLRQQSEEASGQVLVHTDHQISKSARSRHLQGDLKKEI

SEQ ID NO: 155042 - protein, 221 aa, Heterodera glycines
  Coding regions on vcDNA: vcDNA=SeqID_81465; Strand=+; Position=1 -116,173-208,255-428,504-655,1070-1160
  Homolog annotation: Hit_ID=NP_495408.1; Match level="QueryCoverage =97%, HitCoverage=27%, E-value=7e-71, Identity=62%"; Hit description =ATP-binding cassette sub-family D member 3 like (74.9 kD) (2H174) [Caenorhabditis elegans] gb|AAA68340.1|
NFIHFFSSIFMFLLGELWPLWGGTMILPAKGKLFYVPQRPYMTIGSLRRPYMTIGSLRDQVIYPDRPADMRRRGFTDSALEADQVIYPDRPADMRRRGFTDSALEALLDQVQLRNILEREGGWEGQQDWMDVLSGGEKQRIAMARLFYHSPQFAILDECTSAVSADVEDAIYRRCHELGITLFTVSHRKSLWKHHDFSLHMDGRGHYDFKRIDHEAEQFGS

SEQ ID NO: 155043 - protein, 214 aa, Heterodera glycines
  Coding regions on vcDNA: vcDNA=SeqID_81466; Strand=-; Position=1 -186,242-313,1550-1672,1774-1912,1976-2100
  Homolog annotation: Hit_ID=CAE59540.1; Match level="QueryCoverage =59%, HitCoverage=59%, E-value=9e-42, Identity=63%"; Hit description =Hypothetical protein CBG02935 [Caenorhabditis briggsae]
MTLSFANLLITPLIHVLPNLLKANRWMFMSTSSNYKVLAACFDVALVALIIGSVKMLSDSPVIFSLYWCCVLTTGLLETLLLRSPKENCAFKSVVACALGAGIGVLFGLFTVSVDPSYAISKDPTKPLSLRETWTEMKTRVGRYSRNFASIGLLFAGTECILETTRAKSDWRNGTLSGAIVGGMLGFRAGLQPALLGAAGFAAFSTAIEFYMRR

SEQ ID NO: 155044 - protein, 76 aa, Heterodera glycines
  Coding regions on vcDNA: vcDNA=SeqID_81467; Strand=+; Position=1 -198,643-675
MTAKLEMFRQKSRTKPPKKIGRKSCEWTAPETDNPGKAIYAVTRPLLVEHKEKLTKLRDQLKAQIEANERELMEED

SEQ ID NO: 155045 - protein, 69 aa, Heterodera glycines
  Coding regions on vcDNA: vcDNA=SeqID_81468; Strand=-; Position=1-208
MTFVRHFPHFSFDLSLFSFVFRLSARSVLLRSFARGRSPIGHRSGENSHRKTDVSTSDDGPLGAQAGVR

SEQ ID NO: 155046 - protein, 110 aa, Heterodera glycines
  Coding regions on vcDNA: vcDNA=SeqID_81469; Strand=-; Position=1 -30,429-731
MLENSSAQLKESAVSFTTPTPLPMADIRLNSAAYGTFYMEQMRENGTRDEANIWPRTKNSVEQKEGSLNNGGIEWQRKIKRRKTSAVQHQVVFNIKFFFGQKAKISTKKG

SEQ ID NO: 155047 - protein, 65 aa, Heterodera glycines
  Coding regions on vcDNA: vcDNA=SeqID_81470; Strand=-; Position=1 -125,186-258
  Homolog annotation: Hit_ID=NP_494951.1; Match level="QueryCoverage =90%, HitCoverage=12%, E-value=6e-11, Identity=54%"; Hit description =GABA/Glycine Receptor subunit (ggr-3) [Caenorhabditis elegans] gb|AAA68348.1| Gaba/glycine receptor famil
MSWIPFFLDHRSLPARITLAVSSLMSITFQYGNILKSLPRVRLPKLSNSMIFWYISWAFVLIFLH

SEQ ID NO: 155048 - protein, 121 aa, Heterodera glycines
  misc_feature (16)..(16): Xaa can be any naturally occurring amino acid
  Coding regions on vcDNA: vcDNA=SeqID_81471; Strand=-; Position=1 -253,595-704
  Homolog annotation: Hit_ID=CAE64568.1; Match level="QueryCoverage =83%, HitCoverage=83%, E-value=6e-29, Identity=54%"; Hit description =Hypothetical protein CBG09319 [Caenorhabditis briggsae]
IPNYRWKKFKKIFFPXVSKALRRRSPWTDKDELLDVLYWGRQLLALCIGICWGLVPMKGAIALLLYILITSAVGHSYLTWFQEAHDEEFGGFWEIAKEGFGAAFATFMGTYVTLFCYFKIS

SEQ ID NO: 155049 - protein, 200 aa, Heterodera glycines
  misc_feature (197)..(197): Xaa can be any naturally occurring amino acid
  Coding regions on vcDNA: vcDNA=SeqID_81472; Strand=-; Position=1-605
  Homolog annotation: Hit_ID=XP_479365.1; Match level="QueryCoverage =97%, HitCoverage=13%, E-value=1e-39, Identity=43%"; Hit description =helicase-like protein [Oryza sativa (japonica cultivar-group)] dbj|BAD32013.1| helicase-like protein [Ory
NSIVDEYNENIINRLPGEYHTYLSIDESDPNSDFPISHEILNSLKCPSLPNHKIELKTNSMIMLLRNLNVREGLCNGTRMQIKEMGDHVISCVIKSGDKTGETTLIPRITLLEDKKFPFPLRRHQFPIKPAFAFTINKSQSQTFSKIGIDYTDEPFAHGQTYVAFSRCKSWKGLKIKLLDDKKKGKSKIVWQEILKXRKI

SEQ ID NO: 155050 - protein, 77 aa, Heterodera glycines
  Coding regions on vcDNA: vcDNA=SeqID_81473; Strand=+; Position=1-326
MFEYRKRTLEIIDFFVFGAVPPNRCAQIYGETESFRNSFPIACTLILRWIFAPHNCLSTPIGQLERIHFSVFGAVPA

SEQ ID NO: 155051 - protein, 210 aa, Heterodera glycines
  Coding regions on vcDNA: vcDNA=SeqID_81474; Strand=-; Position=1 -81,135-686
  Homolog annotation: Hit_ID=CAA78762.1; Match level="QueryCoverage =79%, HitCoverage=87%, E-value=4e-35, Identity=46%"; Hit description =glycine-rich_protein_(aa1-291) [Brassica napus] pir||S31415 glycine -rich protein GRP22 - rape
GTAITFFTPYNGPKARDLIKVLEEAKQNVPVELANLANNVSDNGYGDRRGRSYGRGGGGGGGYSGSSFAPTGANRSAFNSGGGGSFRGGGGSGGGSRGGYGSSNSYGGGGSGYGGGASYGGSGGGASYGGGNSYGGAGASRNTRGGGGSGGSSYGSGAGGGSNYRGGGGSGSGAGFKASGGSRGGGSGAGWAGGGGGDSNWGGSGGWSAN

SEQ ID NO: 155052 - protein, 188 aa, Heterodera glycines
  misc_feature (13)..(13): Xaa can be any naturally occurring amino acid
  misc_feature (68)..(68): Xaa can be any naturally occurring amino acid
  misc_feature (78)..(78): Xaa can be any naturally occurring amino acid
  misc_feature (98)..(98): Xaa can be any naturally occurring amino acid
  misc_feature (104)..(104): Xaa can be any naturally occurring amino acid
  misc_feature (113)..(113): Xaa can be any naturally occurring amino acid
  misc_feature (119)..(119): Xaa can be any naturally occurring amino acid
  misc_feature (126)..(126): Xaa can be any naturally occurring amino acid
  misc_feature (169)..(169): Xaa can be any naturally occurring amino acid
  misc_feature (187)..(187): Xaa can be any naturally occurring amino acid
  Coding regions on vcDNA: vcDNA=SeqID_81475; Strand=+; Position=1-565
  Homolog annotation: Hit_ID=CAD22154.1; Match level="QueryCoverage =87%, HitCoverage=53%, E-value=9e-36, Identity=49%"; Hit description =pherophorin-dz1 protein [Volvox carteri f. nagariensis]
LKQNKSIKKTTIXPPLKLLNQLALHPPLPPQFESPPPPPAQPAPEPPPRLPPLALKPAPLPEPPPPRXLLPPPAPLPXLLPPEPPPPLVLRLAPAPPXLFPPPXLAPPPLPPXLAPPPXPLPPPPXLLELPYPPLLPPPDPPPPLKLPPPPELKAERLAPVGAKLDPEXPPPPPPPRPYDRPRRSPXP

SEQ ID NO: 155053 - protein, 130 aa, Heterodera glycines
  Coding regions on vcDNA: vcDNA=SeqID_81476; Strand=+; Position=1 -115,169-446
MVRILLPNGESANVSPSESVEEAIKHCVGGDISSQNDYSLVFFGRKLNSDQRLADIPHLDGESRSVRLVCRKSPGVSIEKNLADVDKLRSQCRTLYQNLGEELQQKVGRTNNLFFLLMFNYKAGDIYGGR

SEQ ID NO: 155054 - protein, 118 aa, Heterodera glycines
  misc_feature (1)..(1): Xaa can be any naturally occurring amino acid
  Coding regions on vcDNA: vcDNA=SeqID_81477; Strand=+; Position=1 -243,336-423
  Homolog annotation: Hit_ID=NP_510484.1; Match level="QueryCoverage =93%, HitCoverage=58%, E-value=3e-33, Identity=64%"; Hit description =putative N-myristoylated protein, with a transmembrane domain, of bilaterial origin (17.6 kD) (XP588) [Ca
XLSAAGFLTIALEAPFCCAFVDFIERIAQFSESRAYWQKAALYGGMGIVPILLCAGTETILGAGMICASGVAYGFMALGKKADRTTMLGADRTTMLGGANTAGQDPAWSPQLNQPFPQ

SEQ ID NO: 155055 - protein, 116 aa, Heterodera glycines
  Coding regions on vcDNA: vcDNA=SeqID_81478; Strand=+; Position=1 -205,264-409
MPLIIYFSVVFLLLLLLFKIDTKGWSWLQYYNLLSTIPMFLPAVLNPIVPICTINYYRHVLVSDVKRFGNFLKVLFHLKIGQQNMNENEPKQQQHTSQQDAQLMCQERKISKRKIN

SEQ ID NO: 155056 - protein, 1155 aa, Heterodera glycines
  Coding regions on vcDNA: vcDNA=SeqID_81479; Strand=-; Position=1-3466
  Homolog annotation: Hit_ID=XP_479365.1; Match level="QueryCoverage =59%, HitCoverage=39%, E-value=1e-38, Identity=25%"; Hit description =helicase-like protein [Oryza sativa (japonica cultivar-group)] dbj|BAD32013.1| helicase-like protein [Ory
MTSQNSASSVGTQNTSATQNVESPPSSKKLKVEDVDRPLSAIEAIASTPVSTQKSRGGRPAKKTRGPGRGQTVGSMSEGSSIDHGSEAITNVAILPNVPEKINFSTVQINFATSRIGLYECDERRSGPRFIETCWNDLTQFLNDGFIVEYLAYLASISQRKVVVVDPMVWQMGIDRVIQYKKMTFGYDPNVTAEVILLPIHFPGHWTLIVHDVQCGTHFADSLPTPYGRLDFQVTDKIKNIISDVLPSTVLTGIVNAINLTVQHDGNSCGYFVCLYAESWLMNNRTFVLPDLSINYEKKRILWHINELYGSDNVPYHPREGVPTPCPIVYRHTDEAQSKSKTAEPMEIDEHDDITIIEPQTSGQAVNAVSTQAQVAGENQADTLGLVSDFCVVQEPIAQADDAIFVRPKTPPRRSSRIGRRQSSSISRSPSAAPRRRSSTNAVEQVTAFTQRCYLVHKGWCCAAAAAKHYPEYTDSGKLGEKKCSYCGALLFPHEDSSLCCRQGRVVLPKLNPHPKELQELIVGEKQSREGKEFIRNMSRYNNLLQFASVSAGNKPCPAGGPMAVILNGEFHRRISSMQAGTTQIPGFGQLYILDPVEAMEQRRKNPTFTGEKITNDEEFVQGHQLNDETLEILEQMIQENHPAASAYKQAREQLHELLKQQRTEELRFFRMTLLDERSAPGAMKDPKLHPHQIITPSTGEGMFAIHADPNGAPAPKGIWVENKQGQLNEIAPLSPWTDSLTYPLIKPKGDDGYKIGIPYAKPAQRKRKSDMSDDMFDNQAMSDDDICDTESIASSGSEASMQSVTSRYDKSKKFVSLRDYCKYYLAIRDENLEWQYHHILSCGGGLGQRWILDQASKIDWQIATFLRRPDMDLRISTPKNLLHYLVNQYNKQQARQNPNARQKTVDDIGSVVRLSERNVNSLQYWKKMYEDCNTIFARCHDAKKARLFITFTNNREWPEFKENIYKNGQMFTDRFDMWMRVWSSKIAVFHQELYEKSFFGTILGSGESMEFQGRGGPHAHIVAQTDLDAVPEVIQEYIWAHIPPLPCKDDDSPIAQMHREVRELMHMQLHRCSDSWCGPRDPNFGRCKKGFPAPYSKCTILHPDRPALYYRPSPTDGGAQIEVNGLIYDNSQVVPYNPYILLRYRVHHNVLFAY

SEQ ID NO: 155057 - protein, 96 aa, Heterodera glycines
  Coding regions on vcDNA: vcDNA=SeqID_81480; Strand=-; Position=1 -179,259-370
MEGCSAPKRSRQSIGIKTTPDHQNEHVHVYSKHQNRIQFSQGNFLFSSDTLLEFVDPDEISLEQYIKSDDLKRCSVPRPEGMDLWERDSECGSPKR

SEQ ID NO: 155058 - protein, 71 aa, Heterodera glycines
  Coding regions on vcDNA: vcDNA=SeqID_81481; Strand=+; Position=1 -58,256-413
MANIYDANFIHQFHNKKCARIRWWQIFAGSYWHAAFGLFIPFFRLLMVNKNSEKRAKMFNGKMEKMGDENN
